US006821724B1

(12) United States Patent
Mittman et al.

(10) Patent No.: US 6,821,724 B1
(45) Date of Patent: Nov. 23, 2004

(54) METHODS OF GENETIC ANALYSIS USING NUCLEIC ACID ARRAYS

(75) Inventors: Michael Mittman, Palo Alto, CA (US); David J. Mack, Menlo Park, CA (US); David J. Lockhart, Del Mar, CA (US)

(73) Assignee: Affymetrix, Inc., Santa Clara, CA (US)

( * ) Notice: Subject to any disclaimer, the term of this patent is extended or adjusted under 35 U.S.C. 154(b) by 0 days.

(21) Appl. No.: 09/396,196

(22) Filed: Sep. 15, 1999

Related U.S. Application Data

(60) Provisional application No. 60/100,678, filed on Sep. 17, 1998.

(51) Int. Cl.[7] .......................... C12Q 1/68; C07H 21/02; C07H 21/04; G01N 15/06; G01N 33/00
(52) U.S. Cl. ........................ 435/6; 422/68.1; 536/23.1; 536/24.3; 536/24.31
(58) Field of Search ............................ 436/6; 422/68.1; 536/23.1, 24.3, 24.31

(56) References Cited

U.S. PATENT DOCUMENTS

| | | | |
|---|---|---|---|
| 5,143,854 A | 9/1992 | Pirrung et al. | |
| 5,800,992 A | 9/1998 | Fodor et al. | |
| 5,994,075 A | 11/1999 | Goodfellow | |

OTHER PUBLICATIONS

Roberts et al. "RNA–peptide fusions for the in vitro selection of peptides and proteins," PNAS vol. 94 pp. 12297–12302, Nov. 1997.
Cho et al. Parallel analysis of genetic selections using whole genome oligonucleotide arrays PNAS vol. 95, pp. 3752–3757, Mar. 1998.
Lipschultz R.J. Letter from Lipschutz to Dr. Carrano, Aug. 22, 1994 *Link*.
AFFYMETRIC GeneChip®Assays and Controls Price List, Nov., 1997 *Link*.
AFFYMETRIC GeneChip®Arrays and Assays Product List, Jan. 1998, *Link*.
AFFYMETRIX: GeneChip®Arrays and Assays Product List, Nov. 1998 *Link*.
AFFYMETRIX: GeneChip® Arrays and Reagents, Feb. 1999, *Link*.
AFFYMETRIX: GeneChip® Price Catalog (U.S. and Canada), Jul. 1999. Link.
AFFYMETRIX: Addendum (U.S. and Canada) GeneChip®Arrays and Reagents, Aug. 1999 *Link*.
AFFYMETRIX: GenChip® Price Catalog (U.S. and Canada) Jan. 2000 *Link*.
AFFYMETRIX: Affymetrix® Price Catalog Addendum GeneChip® Arrays and Reagents (U.S. and Canada). Feb. 2000 *Link*.
AFFYMETRIX: Affymetrix® Product Catalog (Global) Aug. 2000 *Link*.
AFFYMETRIX: Affymetrix® Product Catalog (Global), Jan. 2001, *Link*.
AFFYMETRIX: Affymetrix® Product Catalog (Global), Jan. 2002, Link.
AFFYMETRIX: Affymetrix® Product Catalog (Global, Jul. 2002 Link.
AFFYMETRIX: Product Information GeneChip® HuSNP Managing Assay, 1999, Link.
AFFYMETRIX: Product Information GeneChip® GenFlex TM Tag Array, 2000, Link.
AFFYMETRIX: Product Information GeneChip® Yeast Genome S98 Array 2000 Link.
AFFYMETRIX: Product Information GeneChip® HIV PRT Assay, 1997 Link.
AFFYMETRIX: Product Information GeneChip® HIV PRT Plus, 1998. Link.
AFFYMETRIX: Product Information GeneChip® p53 Assay, 1997 Link.
AFFYMETRIX: Product Information GeneChip® p53 Probe Array and Reagents, 1998 Link.
AFFYMETRIX: Product Information GeneChip® CYP450 Assay, 1997 Link.
AFFYMETRIX: Product Information GeneChip® CYP450 Probe Array and Reagents, 1998 Link.
AFFYMETRIX: Product Information GeneChip® HU6800 Array, 1998 Link.
AFFYMETRIX: Product Information Human Genome U95 Set, 2000 Link.
AFFYMETRIX: Product Information GeneChip® Human Genome U133 Set, 2000 Link.
AFFYMETRIX: Product Information GeneChip® Human Genome Focus Array 2002 Link.
AFFYMETRIX: Product Information GeneChip® Human Cancer G110 Array, 1999 Link.
AFFYMETRIX: Product Information Rat Neurobiology U34 Array, 2000 Link.
AFFYMETRIX: Product Information GeneChip® Rat Genome U34 Array Set, 1999, Link.
AFFYMETRIX: Product Information GeneChip® Test 1, 1998 Link
AFFYMETRIX: Product Information GeneChip® Test 2 Array, 1999 Link.
AFFYMETRIX: PRoduct Information GeneChip® Test 3 Array, 2001. Link.
AFFYMETRIX: PRoduct Information GeneChip® Yeast GEnome S96 Array, 1999, Link.

(List continued on next page.)

*Primary Examiner*—John Brusca
*Assistant Examiner*—Shubo Joe Zhou
(74) *Attorney, Agent, or Firm*—Parsons Behle & Latimer

(57) ABSTRACT

The invention provides nucleic acid sequences which are complementary, in one embodiment, to a wide variety of murine genes. The invention provides the sequences in such a way as to make them available for a variety of analyses. As such, the invention related to diverse fields impacted by the nature of molecular interaction, including chemistry, biology, medicine, and medical diagnostics.

1 Claim, No Drawings

OTHER PUBLICATIONS

Affymetrix: Product Information GeneChip® Mu6500 Set, 1998. Link.
Affymetrix: Product Information GeneChip® Murine Genome U74 Set, 2001. Link.
Affymetrix: Product Information GeneChip® Murine 11K Set, 1998. Link.
Affymetrix: Product Information GeneChip® Murine 11K Set. 2001. Link.
Affymetrix: Product Information GeneChip® Murine 19K Set, 1998. Link.
Affymetrix: Product Information Arabidopsis Genome Array, 2000. Link.
Affymetrix: Product Information GeneChip® Arabidopsis ATH1 Genome Array, 2002. Link.
Affymetrix: Product Information E. coli Genome Array, 2000. Link.
Affymetrix: Product Information GeneChip® P. aeruginosa Genome Array, 2001. LinK.
Affymetrix: Product Information P. aeruginosa Genome Array, 2001. Link.
Affymetrix: Product Information Drosophia Genome Array, 2000. Link.
Affymetrix:Product Information GeneChip® B. subtilis Genome Array, 2002. Link.
Affymetrix: Product Information GeneChip® C. elegans Genome Array, 2002. Link.
Affymetrix: Product Information GeneChip® Custom Arrays, 1998. Link.
Affymetrix: Product Information GeneChip® Custom Arrays, 2002. Link.
Affymetrix: Product Information GeneChip® Ye6100 Set, 1998. Link.
Affymetrix: Product Information GeneChip® Human 35K Set, 1998. Link.
Cronin MT. et al. "Cystic fibrosis mutation detection by hybridization to light–generated DNA probe arrays", Human Mutation, 1996, 7, 3, 244–55. Link.
Hacia JG, et al. "Detection of heterozygous mutations in BRCA 1 using high density oligonucleolide arrays and two–colour fluorescene analysis", Nature Genetics, 1996, 14, 4, 441–7. Link.
Kozal MJ, et al. "Extensive polymorphisms observed in HIV–1 clade B protease gene using high–density oligonucleotide arrays", Nature Medicine, 1996, 2, 7, 753–9. Link.
Lockhart DJ, et al. "Expression monitoring by hybridization to high–density oligonucleotide arrays", Nature Biotechnology, 1996, 14, 13, 1675–80. Link.
Shoemaker DD, et al. "Quantitative phenolypic analysis of yeast deletion mutants using a highly parallel molecular bar–coding strategy", Nature Genetics, 1996, 14, 4, 450–6. Link.
Wodicka L, et al. "Genome–wide expression monitoring in Saccharomyces cerevisiae", Nature Biotechnology, 1997, 15, 13, 1359–67. Link.
DE Saizieu A, et al. "Bacterial transcript imaging by hybridization of total RNA to oligoncleotide arrays", Nature Biotechnology, 1998, 16, 1, 45–8. Link.

Fan JB. et al. "Parallel genotyping of human SNPs using generic high–density oligonucleotide tag arrays", Genome Research, 2000, 10, 6, 853–60. Link.
Harmer SL, et al. "Orchestrated transcription of key pathways in Arabidopsis by the circadian clock", Science, 2000, 290, 5499, 2110–3. Link.
Rieneck K, et al. "Massive parallel gene expression profiling of RINm5F pancreatic islet beta–cells stimulated with interleukin–1beta", Apmis, 2000, 108, 12, 855–72. Link.
Rudd KE, "New tools for an old workhorse", Nature Biotechnology, 2000, 18, 12, 1241–2. Link.
Selinger DW, et al. "RNA expression analysis using a 30 base pair resolution *Esherichia coli*genome array", Nature Biotechnology, 2000, 18, 12, 1262–8. Link.
Travers KJ, et al. "Functional and genomic analyses reveal an essential coordination between the unfolded protein response and ER–associated degradation", Cell, 2000, 101, 3, 249–58. Link.
Hakak Y, et al. "Genome–wide expression analysis reveals dysregulation of myelination–related genes in chronic schizophrenia", Proceedings of the National Academy of Sciences, USA, 2001, 98, 8, 4746–51. Link.
LU SC, et al. "Methionine adenosyltransferase 1A knockout mice are predisposed to liver injury and exhibit increased expression of genes involved in Proliferation", Proceedings of the National Academy of Sciences, USA, 2001, 98, 10, 5560–5. Link .
MacDonald TJ. et al. "Expression profiling of meculloblastoma PDGFRA and the RAS/MAPK pathway as therapeutic targets for metastatic disease", Nature Genetics, 2001, 2, 143–52. Link.
Niculescu AB. 3RD, et al. "The Human genome genetic testing and animal models", American Journal of Psychiatry, 2001, 158, 10, 1587. Link.
Stamey TA. et al. "Molecular genetic profiling of Gleason grade 4/5 prostate cancers compared to benign prostatic hyperplasia", Journal of Urology, 2001, 166, 6, 2171–7. Link.
Welsh JB. et al. "Analysis of gene expression profiles in normal and neoplastic ovarian tissue samples identifies candidate molecular markers of epithelial ovarian cancer", Proceedings of the National Academy of Sciences, USA, 2001, 96, 3, 1176–81. Link.
Chee M. et al. "Accessing genetic information with high–density DNA arrays", Science, 1996, 274, 5287, 610–4 Link.
Cho RJ. et al. "Parallel analysis of genetic selections using whole genome oligonucleotide arrays", Proceedings of the National Academy of Sciences of the United States of America, 1998, 95, 7, 3752–7. Link.
Bakay, et al. "Sources of variability and effect of experimental approach on expression profiling data interpretation", 2002, 3:4 Link.
Carmel, et al. "Gene expression profiling of acute spinal cord injury reveals spreading inflammatory signals and neuron loss", Pyhysiol Genomics 2001, 7:201–213. Link.
Affymetrix, Inc. Securities and Exchange Commission Filing S–3 filed on Oct. 17, 1997, also available at http://www.sec.gov/Archives/edgar/data/913077/0001047469–97–001100.txt. Link.

METHODS OF GENETIC ANALYSIS USING NUCLEIC ACID ARRAYS

CROSS REFERENCE TO RELATED APPLICATIONS

The present application is a non-provisional application claiming priority from Provisional U.S. Patent Application Serial No. 60/100,678 filed Sep. 17, 1998.

REFERENCE TO SEQUENCE LISTING

The sequence listing, including SEQ ID NOS: 1–127811, is contained on compact disc in two copies, labeled Copy 1 and Copy 2. The computer readable form is on a compact disc labeled CRF. The file name on each of the three compact discs is seqlist.rtf, created Jul. 12, 2002. Each file is approximately 16.3 kilobytes. The sequence listing information recorded in the computer readable form is identical to the written compact disc sequence listing. The sequence listing is hereby incorporated in this application in its entirety and is to be considered part of the disclosure of this specification.

BACKGROUND OF THE INVENTION

The present invention provides a unique pool of nucleic acid sequences useful for analyzing molecular interactions of biological interest. The invention therefore relates to diverse fields impacted by the nature of molecular interaction, including chemistry, biology, medicine, and medical diagnostics.

FIELD OF THE INVENTION

Many biological functions are carried out by regulating the expression levels of various genes, either through changes in levels of transcription (e.g. through control of initiation, provision of RNA precursors, RNA processing, etc.) of particular genes, through changes in the copy number of the genetic DNA, or through changes in protein synthesis. For example, control of the cell cycle and cell differentiation, as well as diseases, are characterized by the variations in the transcription levels of a group of genes.

Gene expression is not only responsible for physiological functions, but also associated with pathogenesis. For example, the lack of sufficient functional tumor suppressor genes and/or the over expression of oncogene/protooncogenes leads to tumorgenesis. (See. e.g., Marshall, Cell, 64: 313–326 (1991) and Weinberg, Science, 254: 1138–1146 (1991).) Thus, changes in the expression levels of particular genes (e.g. oncogenes or tumor suppressors), serve as signposts for the presence and progression of various diseases.

As a consequence, novel techniques and apparatus are needed to study gene expression in specific biological systems.

All documents, i.e., publications and patent applications, cited in this disclosure, including the foregoing, are incorporated by reference herein in their entireties for all purposes to the same extent as if each of the individual documents were specifically and individually indicated to be so incorporated by reference herein in its entirety.

SUMMARY OF THE INVENTION

The invention provides nucleic acid sequences which are complementary to particular genes and makes them available for a variety of analyses, including, for example, gene expression analysis. For example, in one embodiment the invention comprises an array comprising of any 10 or more, 100 or more, 1000, or more, 10,000 or more or 100,000 or more nucleic acid probes containing 9 or more consecutive nucleotides from the sequences listed in SEQ ID NOS: 1–127811, or the perfect match, perfect mismatch, antisense match or antisense mismatch thereof. In a further embodiment, the invention comprises the use of any of the above arrays or fragments disclosed in SEQ ID NOS: 1–127811 to: monitor gene expression levels by hybridization of the array to a DNA library; monitor gene expression levels by hybridization to an mRNA protein fusion compound; identify polymorphisms; identify biallelic markers; produce genetic maps; analyze genetic variation; comparatively analyze gene expression between different species; analyze gene knockouts; or, to hybridize tag-labeled compounds. In a further embodiment the invention comprises a method of analysis comprising of hybridizing one or more pools of nucleic acids to two or more of the fragments disclosed in TABLE 1 and detecting said hybridization. In a further embodiment the invention comprises the use of any one or more of the fragments disclosed in SEQ ID NOS: 1–127811 as a primer for PCR. In a further embodiment the invention comprises the use of any one or more of the fragments disclosed in SEQ ID NOS: 1–127811 as a ligand.

DETAILED DESCRIPTION OF THE INVENTION

1. Definitions

Massive Parallel Screening: The phrase "massively parallel screening" refers to the simultaneous screening of at least about 100, preferably about 1000, more preferably about 10,000 and more preferably about 100,000 different nucleic acid hybridizations.

Nucleic Acid: The terms "nucleic acid" or "nucleic acid molecule" refer to a deoxyribonucleotide or ribonucleotide polymer in either single-or double-stranded form, and unless otherwise limited, would encompass analogs of natural nucleotides that can function in a similar manner as naturally occurring nucleotides. Nucleic acids may be derived from a variety or sources including, but not limited to, naturally occurring nucleic acids, clones, synthesis in solution or solid phase synthesis.

Probe: As used herein a "probe" is defined as a nucleic acid capable of binding to a target nucleic acid of complementary sequence through one or more types of chemical bonds, usually through complementary base pairing, usually through hydrogen bond formation. As used herein, a probe may include natural (i.e. A, G, U, C, or T) or modified bases (7-deazaguanosine, inosine, etc.). In addition, the bases in probes may be joined by a linkage other than a phosphodiester bond, so long as it does not interfere with hybridization. Thus. probes may be peptide nucleic acids in which the constituent bases are joined by peptide bonds rather than phosphodiester linkages.

Target nucleic acid: The term "target nucleic acid" or "target sequence" refers to a nucleic acid or nucleic acid sequence which is to be analyzed. A target can be a nucleic acid to which a probe will hybridize. The probe may or may not be specifically designed to hybridize to the target. It is either the presence or absence of the target nucleic acid that is to be detected, or the amount of the target nucleic acid that is to be quantified. The term target nucleic acid may refer to the specific subsequence of a larger nucleic acid to which the probe is directed or to the overall sequence (e.g., gene or mRNA) whose expression level it is desired to detect. The difference in usage will be apparent from context.

mRNA or transcript: The term "mRNA" refers to transcripts of a gene. Transcripts are RNA including, for example, mature messenger RNA ready for translation, products of various stages of transcript processing. Transcript processing may include splicing, editing and degradation.

Subsequence: "Subsequence" refers to a sequence of nucleic acids that comprise a part of a longer sequence of nucleic acids.

Perfect match: The term "match," "perfect match," "perfect match probe" or "perfect match control" refers to a nucleic acid that has a sequence that is perfectly complementary to a particular target sequence. The nucleic acid is typically perfectly complementary to a portion (subsequence) of the target sequence. A perfect match (PM) probe can be a "test probe", a "normalization control" probe, an expression level control probe and the like. A perfect match control or perfect match is, however, distinguished from a "mismatch" or "mismatch probe." Mismatch: The term "mismatch," "mismatch control" or "mismatch probe" refers to a nucleic acid whose sequence is deliberately selected not to be perfectly complementary to a particular target sequence. As a non-limiting example, for each mismatch (MM) control in a high-density probe array there typically exists a corresponding perfect match (PM) probe that is perfectly complementary to the same particular target sequence. The mismatch may comprise one or more bases. While the mismatch(es) may be located anywhere in the mismatch probe, terminal mismatches are less desirable because a terminal mismatch is less likely to prevent hybridization of the target sequence. In a particularly preferred embodiment, the mismatch is located at or near the center of the probe such that the mismatch is most likely to destabilize the duplex with the target sequence under the test hybridization conditions. A homo-mismatch substitutes an adenine (A) for a thymine (T) and vice versa and a guanine (G) for a cytosine (C) and vice versa. For example, if the target sequence was: AGGTCCA, a probe designed with a single homo-mismatch at the central, or fourth position, would result in the following sequence TCCTGGT.

Array: An "array" is a solid support with at least a first surface having a plurality of different nucleic acid sequences attached to the first surface.

Gene Knockout: the term "gene knockout," as defined in Lodish et al. *Molecular Cell Biology 3rd Edition,* Scientific American Books pub., which is hereby incorporated in its entirety for all purposes is, is a technique for selectively inactivating a gene by replacing it with a mutant allele in an otherwise normal organism.

DNA Library—as used herein the term "genomic library" or "genomic DNA library" refers to a collection of cloned DNA molecules consisting of fragments of the entire genome (genomic library) or of DNA copies of all the mRNA produced by a cell type (cDNA library) inserted into a suitable cloning vector.

Polymorphism—"polymorphism" refers to the occurrence of two or more genetically determined alternative sequences or alleles in a population. A polymorphic marker or site is the locus at which divergence occurs. Preferred markers have at least two alleles, each occurring at a frequency of greater than 1%, and more preferably greater than 10% or 20% of the selected population. A polymorphic locus may be as small as one base pair. Polymorphic markers include restriction fragment length polymorphisms, variable number or tandem repeats (VNTR's), hypervariable regions, minisatellites, dinucleotide repeats, trinucleotide repeats, tetranucleotide repeats, simple sequence repeats, and insertion elements such as ALU. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic or biallelic polymorphism has two forms. A triallelic polymorphism has three forms.

Genetic map—a "genetic map" is a map which presents the order of specific sequences on a chromosome.

Genetic variation—"genetic variation" refers to variation in the sequence of the same region between two or more organisms.

Hybridization—the association of two complementary nucleic acid strands or their derivatives (such as PNA) to form double stranded molecules. Hybrids can contain two DNA strands, two RNA strands, or one DNA and one RNA strand.

mRNA-protein fusion—a compound whereby an mRNA is directly attached to the peptide or protein it incodes by a stable covalent linkage.

Ligand—any molecule, other than an enzyme substrate, that binds tightly and specifically to a macromolecule, for example, a protein, forming a macromolecule-ligand complex.

II. General

SEQ ID NOS: 1–127811, encompassed in Appendix I, present target sequences included in the invention. Each target sequence from columns 2, 5 and 8 corresponds to and represents at least four additional nucleic acid sequences included in the invention. As an example, if a central portion of a nucleic acid sequence listed in SEQ ID NOS: 1–127811 happened to be: 5'-agcgtgcca-3' the additional sequences included in the invention which are represented by this nucleic acid sequence would be, for example:

5'-tggcacgct-3'=(perfect) sense match
5'-tggctcgct-3'=sense mismatch
5'-agcgtgcca-3' =(perfect) antisense match
5'-agcgagcca-3' =antisense mismatch.

Accordingly, for each nucleic acid sequence listed in SEQ ID NOS: 1–127811, this disclosure includes the corresponding sense match, sense mismatch, antisense match and antisense mismatch. The position of the mismatch is not limited to near the center of the nucleic acid as in the above example, it may be located anywhere in the nucleic acid sequence and may comprise one or more bases.

Consequently, the present invention includes: a) the target sequences listed in SEQ ID NOS: 1–127811, columns 2, 5 and 8 or the sense match, sense mismatch, antisense match or antisense mismatch thereof; b) clones which comprise the target nucleic acid sequences listed in SEQ ID NOS: 1–1 27811, columns 2, 5 and 8 or the sense-match, sense mismatch, antisense match or antisense mismatch thereof; c) longer nucleotide sequences which include the nucleic acid sequences listed in SEQ ID NOS 1–127811, columns 2, 5, and 8 or the sense match, sense mismatch, antisense match or antisense mismatch thereof and d) subsequences greater than 9 nucleotides in length of the target nucleic acid sequences listed in SEQ ID NOS: 1–127811, columns 2, 5, and 8 or the sense match, sense mismatch, antisense match or antisense mismatch.

Target sequences were chosen from clusters of known murine genes available on the Unigene database as of Aug. 15, 1996. Target sequences were selected using the computer based methods described in U.S. Pat. No. 6,309,822 (issued Oct. 30, 2001), incorporated herein by reference for all purposes.

For each target sequence listed in SEQ ID NOS: 1–127811 is a corresponding Genbank database accession number. These accession numbers allow for the identification of sequences located in the Genbank sequence database through the use of computer programs such as BLAST. Access to BLAST is available to the public through the Internet at, for example, httl://www.ncbi.nim.nih.gov. One of skill in the art will be familiar with the use of the BLAST program to obtain information about particular sequences in order to, for example, determine the species from which the sequence is derived, determine the gene from which the sequence is derived, to determine other genes and species which contain similar sequences and to determine the degree of similarity between one sequence and another. All information relating to the target sequences available through the Genbank database is hereby incorporated by reference for all purposes.

The present invention provides a pool of unique nucleotide sequences complementary to murine genes and ESTs in particular embodiments which alone, or in combinations of 2 or more, 10 or more, 100 or more, 1,000 or more, 10,000 or more, or 100,000 or more, can be used for a variety of applications.

In one embodiment, the present invention provides for a pool of unique nucleotide sequences which are complementary to approximately 6500 murine genes formed into a high density array of probes suitable for array based massive parallel gene expression. Array based methods for monitoring gene expression arc disclosed and discussed in detail in U.S. Pat. No. 5,800,992 (issued Sep. 9, 1998), and U.S. Pat. No. 6,309,822 (issued Oct. 30, 2001) and PCT Application WO 92/10588 (published on Jun. 25, 1992), all of which are incorporated herein by reference for all purposes. Generally those methods of monitoring gene expression involve (1) providing a pool of target nucleic acids comprising RNA transcript(s) of one or more target gene(s), or nucleic acids derived from the RNA transcript(s); (2) hybridizing the nucleic acid sample to a high density array of probes and (3) detecting the hybridized nucleic acids and calculating a relative expression (transcription, RNA processing or degradation) level.

The development of Very Large Scale Immobilized Polymer Synthesis or VLSIPS™ technology has provided methods for making very large arrays of nucleic acid probes in very small arrays. See U.S. Pat. No. 5,143,854 and PCT patent publication Nos. WO 90/15070 and 92/10092, and Fodor et al., *Science*, 251, 767–77 (1991), each of which is incorporated herein by reference. U.S. patent application Ser. No. 08/670,118, describes methods for making arrays of nucleic acid probes that can be used to detect the presence of a nucleic acid containing a specific nucleotide sequence. Methods of forming high density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling.

In a preferred detection method, the array of immobilized nucleic acids, or probes, is contacted with a sample containing target nucleic acids, to which a flourescent label is attached. Target nucleic acids hybridize to the probes on the array and any non-hybridized nucleic acids are removed. The array containing the hybridized target nucleic acids are exposed to light which excites the flourescent label. The resulting flourescent intensity, or brightness, is detected. Relative brightness is used to determine which probe is the best candidate for the perfect match to the hybridized target nucleic acid because flourescent intensity (brightness) corresponds to binding affinity. Once the position of the perfect match probe is known, the sequence of the hybridized target nucleic is known because the sequence and position of the probe is known.

In the array of the present invention the probes are presented in pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes indicate whether a hybridization is or is not specific. For example, if the target is present, the perfect match probes should be consistently brighter than the mismatch probes because fluorescence intensity, or brightness, corresponds to binding affinity. (See, for example U.S. Pat. No. 5,324,633, which is incorporated herein for all purposes.) In addition, if all central mismatches are present, the mismatch probes can be used to detect a mutation. Finally the difference in intensity between the perfect match and the mismatch probe (I(PM)-I(MM)) provides a good measure of the concentration of the hybridized material. See pending PCT application No. 98/11223, which is incorporated herein by reference for all purposes. The probe pairs are presented in both sense and antisense orientation, thereby eliciting a total of four probes per target sequence: sense match, sense mismatch, antisense match and antisense mismatch.

In another embodiment, the current invention provides a pool of sequences which may be used as probes for their complementary genes listed in the Genbank database. Methods for making probes are well known. See for example Sambrook, Fritsche and Maniatis. "Molecular 15 Cloning A laboratory Manual" 2nd Ed. Cold Spring Harbor Press (1989) ("Maniatis et al.") which is hereby incorporated in its entirety by reference for all purposes. Maniatis et al. describes a number of uses for nucleic acid probes of defined sequence. Some of the uses described by Maniatis et al. include: to screen cDNA or genomic DNA libraries, or subclones derived from them, for additional clones containing segments of DNA that have been isolated and previously sequenced; in Southern, northern, or dot-blot hybridization to identify or detect the sequences of specific genes; in Southern, or dot-blot hybridization of genomic DNA to detect specific mutations in genes of known sequence; to detect specific mutations generated by site-directed mutagenesis of cloned genes; and to map the 5' termini of mRNA molecules by primer extensions. Maniatis et al. describes other uses for probes throughout. See also Alberts et al. *Molecular Biology of the Cell 3rd edition,* Garland Publishing Inc. (1994) p. 307 and Lodish et al. *Molecular Cell Biology, 3rd edition,* Scientific American Books (1995) p. 285–286, each of which is hereby incorporated by reference in its entirety for all purposes, for a brief discussion of the use of nucleic acid probes in in situ hybridization. Other uses for probes derived from the sequences disclosed in this invention will be readily apparent to those of skill in the art. See, for example, Lodish et al. *Molecular Cell Biology, 3rd edition,* Scientific American Books (1995) p.229–233, incorporated above, for a description of the construction of genomic libraries.

In another embodiment, the current invention may be combined with known methods to monitor expression levels of genes in a wide variety of contexts. For example, where the effects of a drug on gene expression are to be determined, the drug will be administered to an organism, a tissue sample, or a cell and the gene expression levels will be analyzed. For example, nucleic acids are isolated from the treated tissue sample, cell, or a biological sample from the organism and from an untreated organism tissue sample or cell, hybridized to a high density probe array containing probes directed to the gene of interest and the expression levels of that gene are determined. The types of drugs that may be used in these types of experiments include, but are not limited to, antibiotics, antivirals, narcotics, anti-cancer drugs, tumor suppressing drugs, and any chemical composition which may affect the expression of genes in vivo or in vitro. The current invention is particularly suited to be used in the types of analyses described by, for example, pending U.S. Pat. No. 6,309,822 and PCT Application No. 98/11223, each of which is incorporated by reference in its entirety for all purposes. As described in Wodicka et al., Nature Biotechnology 15 (1997), (hereby incorporated by reference in its entirety for all purposes), because mRNA hybridization correlates to gene expression level, hybridization patterns can be compared to determine differential gene expression. As non-limiting examples: hybridization patterns from samples treated with certain types of drugs may be compared to hybridization patterns from samples which have not been treated or which have been treated with a different drug; hybridization patterns for samples infected with a specific virus may be compared against hybridization patterns from non-infected samples; hybridization patterns for samples with cancer may be compared against hybridization patterns for samples without cancer; hybridization patterns of samples from cancerous cells which have been treated with a tumor suppressing drug may be compared against untreated cancerous cells, etc. Zhang et al., Science 276 1268–1272, (hereby incorporated by reference in its entirety for all purposes), provides an example of how gene expression data can provide a great deal of insight into cancer research. One skilled in the art will appreciate that a wide range of applications will be available using 2 or more, 10 or more, 100 or more, 1000 or more, 10,000 or more or 100,000 or more of the SEQ ID NOS: 1–127811 sequences as probes for gene expression analysis. The combination of the DNA array technology and the mouse specific probes in this disclosure is a powerful tool for studying gene expression.

In another embodiment, the invention may be used in conjunction with the techniques which link specific proteins to the mRNA which encodes the protein. (See for example Roberts and Szostak Proc. Natl. Acad. Sci. 94 12297–12302 (1997) which is incorporated herein in its entirety for all purposes.) Hybridization of these mRNA-protein fusion compounds to arrays comprised of 2 or more, 10 or more, 100 or more, 1000 or more, 10,000 or more, or 100,000 or more the sequences disclosed in the present invention provides a powerful tool for monitoring expression levels.

In one embodiment, the current invention provides a pool of unique nucleic acid sequences which can be used for parallel analysis of gene expression under selective conditions. Without wishing to be limited, genetic selection under selective conditions could include: variation in the temperature of the organism's environment; variation in pH levels in the organism's environment; variation in an organism's food (type, texture, amount etc.); variation in an organism's surroundings; etc. Arrays, such as those in the present invention, can be used to determine whether gene expression is altered when an organism is exposed to selective conditions.

Methods for using nucleic acid arrays to analyze genetic selections under selective conditions are known. (See for example, R. Cho et al., Proc. Natl. Acad. Sci. 95 3752–3757 (1998) incorporated herein in its entirety for all purposes.)

Cho et al. describes the use of a high-density array containing oligonucleotides complementary to every gene in the yeast *Saccharomyces cerevisiae* to perform two-hybrid protein-protein interaction screens for *S. cerevisiae* genes implicated in mRNA splicing and microtubule assembly. Cho et al. was able to characterize the results of a screen in a single experiment by hybridization of labeled DNA derived from positive clones. Briefly, as described by Cho et al., two proteins are expressed in yeast as fusions to either the DNA-binding domain or the activation domain of a transcription factor. Physical interaction of the two proteins reconstitutes transcriptional activity, turning on a gene essential for survival under selective conditions. In screening for novel protein-protein interactions, yeast cells arc first transformed with a plasmid encoding a specific DNA-binding fusion protein. A plasmid library of activation domain fusions derived from genomic DNA is then introduced into these cells. Transcriptional activation fusions found in cells that survive selective conditions are considered to encode peptide domains that may interact with the DNA binding domain fusion protein. Clones are then isolated from the two-hybrid screen and mixed into a single pool. Plasmid DNA is purified from the pooled clones and the gene inserts are amplified using PCR. The DNA products are then hybridized to yeast whole genome arrays for characterization. The methods employed by Cho et al. are applicable to the analysis of a range of genetic selections. High density arrays created using two or more, 10 or more, 100 or more, 1000 or more, 10,000 or more, or 100,000 or more of the sequences disclosed in the current invention can be used to analyze genetic selections in the mouse system using the methods described in Cho et al.

In another embodiment, the current invention provides a pool of unique nucleic acid sequences which can be used to identify biallelic markers, providing a novel and efficient approach to the study of genetic variation. For example, methods for using high density arrays comprised of probes which are complementary to the genomic DNA of a particular species to interrogate polymorphisms are well known. (See for example, U.S. Pat. No. 6,300,063 (issued Oct. 9, 2001) and U.S. patent application Ser. No. 08/965, 620 which are hereby incorporated herein for all purposes.) Pools of 2 or more, 10 or more, 100 or more, 1000 or more, 10,000 or more, or 100,000 or more of the sequences disclosed in this invention combined with the methods described in the above patent applications provides a tool for studying genetic variation in the mouse system.

In another embodiment of the invention, genetic variation can be used to produce genetic maps of various strains of mouse. Winzeler et al., "Direct Allelic Variation Scanning of the Yeast Genome" Science (in press) (1998), which is hereby incorporated for all purposes describe methods for conducting this type of screening with arrays containing probes complementary to the yeast genome. Briefly, genomic DNA from strains which are phenotypically different are isolated, fragmented, and labelled. Each strain is then hybridized to identical arrays comprised of the nucleic acid sequences complementary to the system being studied. Comparison of hybridization patterns between the various strains then serve as genetic markers. As described by Winzler et al, these markers can then be used for linkage analysis. High density arrays created from 2 or more, 10 or more, 100 or more, 1000 or more, 10,000 or more, or 100,000 or more of the sequences disclosed in this invention can be used to study genetic variation using the methods described by Winzler et al.

In another embodiment, the present invention may be used for cross-species comparisons. One skilled in the art will appreciate that it is often useful to determine whether a gene present in one species, for example the mouse, is present in a conserved format in another species, including, without limitation, mouse, human, chicken, zebrafish, drosophila, or yeast. See, for example, Andersson et al., Mamm Genome 7(10):717–734 (1996,) which is hereby incorporated by reference for all purposes, which describes the utility of cross-species comparisons. The use of 2 or more, 10 or more, 100 or more, 1000 or more, 10,000 or more or 100,000 or more of the sequences disclosed in this invention in an array can be used to determine whether any of the sequence from one or more of the murine genes represented by the sequences disclosed in this invention is conserved in another species by, for example, hybridizing genomic nucleic acid samples from another species to an array comprised of the sequences disclosed in this invention. Areas of hybridization will yield genomic regions where the nucleotide sequence is highly conserved between the interrogation species and the mouse.

In another embodiment, the present invention may be used to characterize the genotype of knockouts. Methods for using gene knockouts to identify a gene are well known. See for example, Lodish et al. *Molecular Cell Biology, 3rd Edition,* Scientific American Books pub pp. 292–296 and U.S. Pat. No. 5,679,523 which are hereby incorporated by reference for all purposes. By isolating genomic nucleic acid samples from knockout species with a known phenotype and hybridizing the samples to an array comprised of 2 or more, 10 or more, 100 or more, 1000 or more, 10,000 or more, or 100,000 or more of the sequences disclosed in this invention, candidates genes which contribute to the phenotype will be identified and made accessible for further characterization.

In another embodiment, the present invention may be used to identify new gene family members. Methods of screening libraries with probes are well known. (See, for example, Maniatis et al, incorporated by reference above.) Because the present invention is comprised of nucleic acid sequences from specific known genes, 2 or more, 10 or more, 100 or more, 1000 or more, 10,000 or more, or 100,000 or more of sequences disclosed in this invention may be used as probes to screen genomic libraries to look for additional family members of those genes from which the target sequences are derived.

In another embodiment, the present invention may be used to provide nucleic acid sequences to be used as tag sequences. Tag sequences are a type of genetic "bar code" which can be used to label compounds of interest. The analysis of deletion mutants using tag sequences is described in, for example, Shoemaker et al., Nature Genetics 14 450–456 (1996), which is hereby incorporated by reference in its entirety for all purposes. Shoemaker et al. describes the use of PCR to generate large numbers of deletion strains. Each deletion strain is labelled with a unique 20-base tag sequence that can be hybridized to a high-density oligonucleotide array. The tags serve as unique identifiers (molecular bar codes) that allow analysis of large numbers of deletion strains simultaneously through selective growth conditions. The use of tag sequences need not be limited to this example however. The utility of using unique known short oligonucleotide sequences capable of hybridizing to a nucleic acid array to label various compounds will be apparent to one skilled in the art. One or more, 10 or more, 100 or more, 1000 or more, 10,000 or more, or 100,000 or more of the SEQ ID NOS: 1–127811 sequences are excellent candidates to be used as tag sequences.

In another embodiment of the invention, the sequences of this invention may be used to generate primers directed to their corresponding genes as disclosed in the Genbank or any other public database. These primers may be used in such basic techniques as sequencing or PCR, see for example Maniatis et al., incorporated by reference above.

In another embodiment, the invention provides a pool of nucleic acid sequences to be used as ligands for specific genes. The sequences disclosed in this invention may be used as ligands to their corresponding genes as disclosed in the Genbank or any other public database. Compounds which specifically bind known genes are of interest for a variety of uses. One particular clinical use is to act as an antisense protein which specifically binds and disables a gene which has been, for example, linked to a disease. Methods and uses for ligands to specific genes are known. See for example. U.S. Pat. No. 5,723,594 which is hereby incorporated by reference in its entirety for all purposes.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, polymerase chain reaction (PCR) with labeled primers or labeled nucleotides will provide a labeled amplification product. In a another embodiment, transcription amplification, as described above, using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example nick translation or end-labeling (e.g. with a labeled RNA) by kinasing of the nucleic, acid and subsequent attachment (ligation) of a nucleic acid linker joining the sample nucleic acid to a label (e.g., a fluorophore).

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescenn, texas red, rhodamine, green fluorescent protein, and the like), radiolabels (e.g., $^{3}$H, $^{125}$I, $^{35}$S, $^{14}$C, or $^{32}$p), phosphorescent labels, enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of, the enzyme on the substrate, and colorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization; After hybridization, an aviden-conjugated fluorophore will bind the biotin bearing hybrid duplexes providing a label that is easily detected. For a detailed review of methods of labeling nucleic acids and detecting labeled hybridized nucleic acids see *Laboratory Techniques in Biochemistry and Molecular Biology, Vol. 24: Hybridization With Nucleic Acid Probes,* P. Tijssen, ed. Elsevier, N.Y., (1993) which is hereby incorporated by reference in its entirely for all purposes.

Fluorescent labels are preferred and easily added during an in vitro transcription reaction. In a preferred embodiment, fluorescein labeled UTP and CTP are incorporated into the RNA produced in an vitro transcription reaction as described above.

EXAMPLE

The following example serves to illustrate the type of experiment that could be conducted using the invention.

Expression Monitoring by Hybridization to High Density Oligonucleotide Arrays Arrays containing the desired number of probes can be synthesized using the method described in U.S. Pat. No. 5,143,854, incorporated by reference above. Extracted poly $(A)^+$RNA can then be coverted to cDNA using the methods described below. The cDNA is then transcribed in the presence of labeled ribonucleotide triphosphates. The label may be biotin or a dye such as fluorescein. RNA is then fragmented with heat in the presence of magnesium ions. Hybridizations are carried out in a flow cell that contains the two-dimensional DNA probe arrays. Following a brief washing step to remove unhybridized RNA, the arrays are scanned using a scanning confocal microscope.

1. A method of RNA preparation:

Labeled RNA is prepared from clones containing a T7 RNA polymerase promoter site by incorporating labeled nbonucleotides in an IVT reaction. Either biotin-labeled or fluorescein-labeled UTP and CTP (1:3 labeled to unlabeled) plus unlabeled ATP and GTP is used for the reaction with 2500 U of T7 RNA polymerase. Following the reaction unincorporated nucleotide triphosphates are removed using size-selective membrane such as Microcon-100, (Amicon, Beverly, Mass.). The total molar concentration of RNA is based on a measurement of the absorbance at 260 inn. Following quantitation of RNA amounts, RNA is fragmented randomly to an average length of approximately 50 bases by heating at 94° in 40 mM Tris-acetate pH 8.1, 100 mM potassium acetate, 30 mM magnesium acetate, for 30 to 40 min. Fragmentation reduces possible interference from RNA secondary structure, and minimizes the effects of multiple interactions with closely spaced probe molecules. For material made directly from cellular RNA, cytoplasmic RNA is extracted from cells by the method of Favaloro et al. Methods Enzymol. 65:718–749 (1980) hereby incorporated by reference for all purposes, and poly $(A)^+$ RNA is isolated with an oligo dT selection step using, for example, Poly Atract, (Promega, Madison, Wis.). RNA can be amplified using a modification of the procedure described by Eberwine et al. Proc. Natl. Acad. Sci. USA 89:3010–3014 (1992) hereby incorporated by reference for all purposes. Microgram amounts of poly $(A)^+$ RNA are converted into double stranded cDNA using a cDNA synthesis kit (kits may be obtained from Life Technologies, Gaithersburg, Md.) with an oligo dT primer incorporating a T7 RNA polymerase promoter site. After second-strand synthesis, the reaction mixture is extracted with phenol/chloroform, and the double-stranded, DNA isolated using a membrane filtration step using, for example, Microcon-100, (Amicon). Labeled cDNA can be made directly, from the cDNA pool with an IVT step as described above. The total molar concentration of labeled cRNA is determined from the absorbance at 260 nm and assuming an average RNA size of 1000 ribonucleotides. The commonly used convention is that 1 OD is equivalent to 40 ug of RNA, and that 1 ug of cellular mRNA consists of 3 pmol of RNA molecules. Cellular mRNA may also be labeled directly without any intermediate cDNA synthesis steps. In this case, Poly $(A)^+$ RNA is fragmented as described, and the 5' ends of the fragments are kinased and then incubated overnight with a biotinylated oligoribonucleotide (5'-biotin-AAAAAA-3') in the presence of T4 RNA ligase (available from Epicentre Technologies, Madison, Wis.). Alternatively, mRNA has been labeled directly by UV-induced cross-linking to a psoralen derivative linked to biotin (available from Schleicher & Schuell, Keene, N.H.).

2. Array hybridization and Scanning:

Array hybridization solutions can be made containing 0.9 M NaCl, 60 mM EDTA, and 0.005% of the product octylphenol ethylene oxide condensate sold under the trademark Triton® as described by Sigma Product number X-100, adjusted to pH 7.6 (referred to as 6×SSPE-T). In addition, the solutions should contain 0.5 mg/ml unlabeled, degraded herring sperm DNA (available from Sigma, St. Louis, Mo.). Prior to hybridization, RNA samples are heated in the hybridization solution to 99° C. for 10 min, placed on ice for 5 min, and allowed to equilibrate at room temperature before being placed in the hybridization flow cell. Following hybridization, the solutions are removed, the arrays washed with 6×SSPE-T at 22C for 7 min, and then washed with 0.5×SSPE-T at 40° C. for 15 min. When biotin labeled RNA is used the hybridized RNA should be stained with a streptavidin-phycoerythrin in 6×SSPE-T at 40° C. for 5 min. The arrays are read using a scanning confocal microscope made by Molecular Dynamics (commercially available through Affymetnx, Santa Clara, Calif.). The scanner uses an argon ion laser as the excitation source, with the emission detected by a photomultiplier tube through either a 530 nm bandpass filter (flourescein) or a 560 nm longpass filter (phycoerythrin). Nucleic acids of either sense or antisense orientations may be used in hybridization experiments. Arrays for probes with either orientation (reverse complements of each other) are made using the same set of photolithgraphic masks by reversing the order of the photochemical steps and incorporating the complementary nucleotide.

3. Quantitative analysis of hybridization patterns and intensities.

Following a quantitative scan of an array, a grid is aligned to the image using the known dimensions of the array and the corner control regions as markers. The image is then reduced to a simple text file containing position and intensity information using software developed at Affymetnx (available with the confocal scanner). This information is merged with another text file that contains information relating physical position on the array to probe sequence and the identity of the RNA (and the specific pan of the RNA) for which the oligonucleotide probe is designed. The quantitative analysis of the hybridization results involves a simple form of pattern recognition based on the assumption that, in the presence of a specific RNA, the perfect match (PM) probes will hybridize more strongly on average than their mismatch (MM) partners. The number of instances in which the PM hybridization is larger than the MM signal is computed along with the average of the logarithm of the PN1/MM ratios for each probe set. These values are used to make a decision (using a predefined decision matrix) concerning the presence or absence of an RNA. To determine the quantitative RNA abundance, the average of the difference (PM-MM) for each probe family is calculated. The advantage of the difference method is that signals from random cross-hybridization contribute equally, on average, to the PM and MM probes, while specific hybridization contributes more to the PM probes. By averaging the pairwise differences, the real signals add constructively while the contributions from cross-hybridization tend to cancel. When assessing the differences between two different RNA samples, the hybridization signals from side-by-side experiments on identically synthesized arrays are compared directly. The magnitude of the changes in the average of the difference (PM-MM) values is interpreted by comparison with the results of spiking experiments as well as the signals observed for the internal standard bacterial and phase RNAs spiked into each sample at a known amount. Data analysis programs, such as those described in U.S. patent Ser. No. 08/828,952 perform these operations automatically.

CONCLUSION

The inventions herein provide a pool of unique nucleic acid sequences which are complementary to approximately 6500 specific known murine genes. These sequences can be used for a variety of types of analyses.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

TABLE 1

| SEQ ID NO | sequence | DBAxnID | SEQ ID NO | sequence | DBAxnID | SEQ ID NO | sequence | DBAxnID |
|---|---|---|---|---|---|---|---|---|
| 1 | gacatgtcgcaagtcacagaatta | | 42605 | cagaaggagctttgcctgttctt | AA017966 | 85209 | tggctcttcagctgctaccagcag | D86948 |
| 2 | attgctgcaatgcacagaatattt | | 42606 | tggttcttcgggaacgtggcact | AA017966 | 85210 | ctgctaccagcaggcagagtcgag | D86948 |
| 3 | gttgctggatctgctgtttgaagcg | | 42607 | ttcttcctgggaacgtggcacttg | AA017966 | 85211 | gagataccaaggctaggccacata | D86948 |
| 4 | ggatctgctgtttgaagcgcagcag | | 42608 | tcttcctgggaacgtggcacttga | AA017966 | 85212 | ataccaaggctaggccacataagt | D86948 |
| 5 | ggcgcaggtgcatcgccagcatt | | 42609 | cctgggaacgtggcacttgatgaa | AA017966 | 85213 | cccaaggctaggccacataagtcac | D86948 |
| 6 | gcaggtgcatcgccagcatcgat | | 42610 | tgagcagacagcactccgcatggt | AA017966 | 85214 | cagctgacccactggaagtgccaacc | D86948 |
| 7 | gcatcgcagcatttcgatcctgt | | 42611 | agcagacagcactccgcatggttg | AA017966 | 85215 | cttggccacctgtaccaagtccag | D86948 |
| 8 | gcattgcatcctcgtcaggtcga | | 42612 | agacgcactccgcatggttggaa | AA017966 | 85216 | cctgcacgcaggccaattctat | D86948 |
| 9 | cgatctgtcaggtcaggtcagc | | 42613 | gacgcactccgcatggttggaag | AA017966 | 85217 | catgcaggccaattctatcgctgt | D86948 |
| 10 | tcgtcaggtgcaggtcagcacgtg | | 42614 | cagcactccgcatggttggaagaa | AA017966 | 85218 | ttcctatcgtgtgatgaaggt | D86948 |
| 11 | gcaggtgcacgtgctgcgtcagtt | | 42615 | actcgtgcatggttgggagaagcg | AA017966 | 85219 | ttcctgagccgcctcgtgcct | D86948 |
| 12 | cagcacgttgctgtgctgattaagacc | | 42616 | ggcactccaggagagagaggtccc | AA017966 | 85220 | gatacaggcgtgctgttctgc | D86948 |
| 13 | gctgtcgattaagaccggacgttgt | | 42617 | gcactccaggagagagaggtccca | AA017966 | 85221 | acagctgggcatgttctccagg | D86948 |
| 14 | agctgtccggaagatgcaatac | | 42618 | catcctatagagttgaataatgt | AA017966 | 85222 | tagatacaggggtcctcaacca | AA105976 |
| 15 | agattgcaaatactgcccgcaaacg | | 42619 | atctctatagagttgataatgt | AA017966 | 85223 | tgcccgatttgtgctgcatg | AA105976 |
| 16 | caaatactgcccgcaaacgtcgcgc | | 42620 | gttccttcaggttgctgtttctcctca | AA017966 | 85224 | gaccaagactgcctggcctggtcct | AA105976 |
| 17 | tgaacaggttcggagtgcgcgc | | 42621 | agttttgagctagtcagttagttg | AA017966 | 85225 | ccaagactgctggcctggttccta | AA105976 |
| 18 | gggagtcgcggcaaagcgaaagcg | | 42622 | gttagacactcctctgtctatgac | AA017966 | 85226 | gactcgtggcctggttcctcagagg | AA105976 |
| 19 | caaagcgaaagcgcaggatcgaag | | 42623 | ttagacactccttcgtctatgaca | AA017966 | 85227 | cctggcctggttcctcagaggatt | AA105976 |
| 20 | gcccgagtttacgcagggcttcctgtatg | | 42624 | tggcatcgtttgatcctctgtt | AA017966 | 85228 | cgtggcctggttcctcagaggta | AA105976 |
| 21 | gccagaggtttacgcagggcttcctgtg | | 42625 | ggcaactgttgatccctatagttc | AA017966 | 85229 | tggcctggttcctcagaggattg | AA105976 |
| 22 | gtttacgcaatatcatcaccaca | | 42626 | catcgtgttgatcctatagttcta | AA017966 | 85230 | gcctggttcctcagaggtatggc | AA105976 |
| 23 | caaatcatcaccacacgcacta | | 42627 | tttgatccctatagttctatttggg | AA017966 | 85231 | cgtggttcctcagaggtatggaa | AA105976 |
| 24 | atcaccacacgcacttatcatggaac | | 42628 | gatcctatagttctattgggtc | AA017966 | 85232 | ctgttcctcagaggtatgggtaaag | AA105976 |
| 25 | acgcactcaggaagaacgctcgat | | 42629 | atccctatagttctatttgggctcg | AA017966 | 85233 | ttcctcagaggtatttggcaaatg | AA105976 |
| 26 | atacgctgaaaaagtgcgcgatc | | 42630 | taattgtcatcagttgctccctt | AA017966 | 85234 | tctgatttgctgtcgtgccatgac | AA105976 |
| 27 | ggaaaagtgcgcgatgccggatc | | 42631 | attgctatcagtttgctcccctta | AA017966 | 85235 | ctgatgttgtgctgtcgtgccatgacct | AA105976 |
| 28 | agtcgcggatgccgggatcaaagtc | | 42632 | ttgctatcagttgctccccttac | AA017966 | 85236 | ttgttggtcgccatgacctgga | AA105976 |
| 29 | gccggatcaaagtcgtgttgctgg | | 42633 | gtcatcagttgctcccccttat | AA017966 | 85237 | gttggtcgccatgacttggaag | AA105976 |
| 30 | aagtcgtcgtggtgccatgtggg | | 42634 | tctatcagttgctcccctttacat | AA017966 | 85238 | tggtgtgccatgacttggaagggaa | AA105976 |
| 31 | aagatcgcgcggattatttgctgcaa | | 42635 | tatcagttgctcccctttacatct | AA017966 | 85239 | gtcgtgccatgacttgcaaggcc | AA105976 |
| 32 | gccggatcatttgcaactggcaa | | 42636 | atcagttgctcccctttacacatctg | AA017966 | 85240 | tttgaccaagactgctggcctggt | AA105976 |
| 33 | atttgctgcaactgcaaactgccg | | 42637 | agttgctcccctttacatctggct | AA017966 | 85241 | ttgaccaagactgcgggctggttc | AA105976 |
| 34 | cgccgaaagtgccaaatcaacat | | 42638 | agaatgagctgcagtcggggagta | AA017977 | 85242 | tggtcctcctcctggctggaag | AA105980 |
| 35 | aaggtgccaatcaacatgctggtg | | 42639 | aggctaccaggtcagcttgcaagg | X95226 | 85243 | gtcctcctcctggctggaagcat | AA105980 |
| 36 | caatcaacatgctgggtgaaggtgaa | | 42640 | ctctgtaacatggtcatccctgg | X95226 | 85244 | ctacaggccaatatcctgaatgac | AA105980 |
| 37 | tgggtgaaggtgaaagcgaagccgct | | 42641 | taacatgctcaccccgtgttcaa | X95226 | 85245 | aaggccaatatcctgaatgacagc | AA105980 |
| 38 | acgcctgcggataacgatgatg | | 42642 | caccacaggctgagcgctgt | X95226 | 85246 | aatatcctgaatgacagcgcggt | AA105980 |
| 39 | ttgcgataacgatgcatgcctgatgc | | 42643 | tgctcgttacacaggacaacga | X95226 | 85247 | tcctgaatgacagcgcggttat | AA105980 |
| 40 | acgatgatcgatgcttgatt | | 42644 | tgttacacaggacacagatac | X95226 | 85248 | ctgaatgacagcgcggttatc | AA105980 |
| 41 | ggtcgcgggatcatgatgccaacc | | 42645 | ccagcattaacttgcacacatga | X95226 | 85249 | atttaactgagatgtgttca | AA105980 |
| 42 | ggatcatgatgccaacctctacgt | | 42646 | ttaacttgcacatatgaccgtca | X95226 | 85250 | ttaactgagatgtgttca | AA105980 |
| 43 | tgcaacctctacgtgcgctttc | | 42647 | tgcacacatatgaccgcagttaca | X95226 | 85251 | gttcacagtgtcaattccgaaaag | AA105980 |
| 44 | gccctttcgccgacgcgagcag | | 42648 | catatgaccgtcagttacacgcaat | X95226 | 85252 | tcacagtgattctccgaaaaagcc | AA105980 |
| 45 | gccgacgcagatgacgatgaacgaac | | 42649 | acgtcagttgcaatatatac | X95226 | 85253 | tcacagtgtaattccgaagctcaa | AA105980 |
| 46 | cagacgaacgaacagactctag | | 42650 | accaggctagctgcaaggttgaat | X95226 | 85254 | ttcctcttggctgaagcactaa | AA105980 |
| 47 | gatgaacgaacagactccgtgatg | | 42651 | gaaagatacaatgctctcctgtgtg | X95226 | 85255 | cctcttggctgaagcactctaaga | AA105980 |
| 48 | aacagactccagggatgtgtttat | | 42652 | tgttctgacgcctgtatgcagcta | X95226 | 85256 | tggctgcgaagcatctaagatt | AA105980 |
| 49 | tcaggcgatgctgttatggcaggc | | 42653 | gacgctgtaggcgcagctagcttc | X95226 | 85257 | attaatactgagatgtgttca | AA105980 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 50 | | gtgctttatgcaggcgcaaactg | 42654 | X95226 | gcagctagcttctgttctaaattc | 85258 | AA105980 |
| 51 | | atgcaggcgcaaactgcgattct | 42655 | X95226 | taaattctgagttctcagggtgt | 85259 | AA105980 |
| 52 | | taaggtgcaaacgtctgaccacgc | 42656 | X95226 | tatcaactccatctctgtaacatg | 85260 | AA105980 |
| 53 | | caaactgtgaccacgccgaatccg | 42657 | X95226 | ctccatctctgtaacatggctcat | 85261 | AA105980 |
| 54 | | gacctgaactgcgtccgcaaactgg | 42658 | X95226 | gctcccacagttcttctggact | 85262 | AA020028 |
| 55 | | gggctaaatccgcagcaaactgccg | 42659 | AA020028 | agttctctgtactcctgtgaga | 85263 | AA106069 |
| 56 | | cgcagcaaactgccgtcggcagg | 42660 | AA020028 | agttcattggccagaatgccaacga | 85264 | AA106069 |
| 57 | | acagcaggcctgaacagccgctg | 42661 | AA020028 | ttggccagaatgccaacgattttgc | 85265 | AA106069 |
| 58 | | cgtctgaacaggcgctagatccc | 42662 | AA020028 | agaatgccaacgatttgctgaaac | 85266 | AA106069 |
| 59 | | acagggctgatgaccccggacacc | 42663 | AA020028 | atgccaaacgatttgctgaaacgg | 85267 | AA106069 |
| 60 | | atattacaacgcggcagcattatga | 42664 | AA020028 | atttgctgaaaccgcatctggat | 85268 | AA106069 |
| 61 | | cagcggcatttgatgtcggcagccgc | 42665 | AA020028 | actctcgaagttcttcctcatgtt | 85269 | AA106069 |
| 62 | | gtcgggcagccgcacactatgacccg | 42666 | AA020028 | tgttactgatctcctcctgtgaa | 85270 | AA106069 |
| 63 | | cgcacactatgagccgccagccagat | 42667 | AA020028 | tctcctcctctgtgaaatccacttt | 85271 | AA106069 |
| 64 | | aacatgcagactcacgccgcagag | 42668 | AA020028 | cctcgtgaaatccacttttcccag | 85272 | AA106069 |
| 65 | | tacaggccagagtgcgaccgcctt | 42669 | AA020028 | tgaaatccactttcccagcaaatc | 85273 | AA106069 |
| 66 | | gagtctgacgccttagctgcaatg | 42670 | AA020028 | tactcctgtgaggaggtgctgctcca | 85274 | AA106069 |
| 67 | | tactggcaagcttcacacgcgtaa | 42671 | AA020028 | ctgtgtccacacaagttaacactg | 85275 | AA106069 |
| 68 | | gggttggacctgctggatgagc | 42672 | AA020028 | tcgtcacacaagttaacactgcgt | 85276 | AA106069 |
| 69 | | tgagcgccactgcgggaaagtca | 42673 | AA020028 | ttttcaatagcctcattaatgcta | 85277 | AA106069 |
| 70 | | gccaggtgacgggctctagatctct | 42674 | AA020028 | actgcagcatgtagtgcagcttcgt | 85278 | AA106069 |
| 71 | | gccttagatctctgccgccatgc | 42675 | AA020028 | gcagttcgtccacagacgttcat | 85279 | AA106069 |
| 72 | | gccgccaatgttgttcaggccacgc | 42676 | AA020028 | tccacagttcattggccagaa | 85280 | AA106069 |
| 73 | | tgttcaggccacgccgaaggatgcc | 42677 | AA020028 | acagagcagttcattggccgaaatgc | 85281 | AA106069 |
| 74 | | agagaatgccgacgaccattact | 42678 | Z16078 | caagccagttcaggctttagggctgact | 85282 | X92523 |
| 75 | | gccgaccattatctggggag | 42679 | Z16078 | gccagttaggctgactgctggtgc | 85283 | X92523 |
| 76 | | cgttagcgactgcgactgcgatct | 42680 | Z16078 | tcctcctctagaaagtcaaagcatcc | 85284 | X92523 |
| 77 | | gacgtcgatctcatggagcaa | 42681 | Z16078 | aaagtcaaagcatccattccatgag | 85285 | X92523 |
| 78 | | gatcttgcaggagaatctgcag | 42682 | Z16078 | gtcaaagcatccatccatgagaac | 85286 | X92523 |
| 79 | | caatctccaggccaggtgcgt | 42683 | Z16078 | caagcatccatccatgagaactt | 85287 | X92523 |
| 80 | | attattccaccgcactccgtgagct | 42684 | Z16078 | aaagcatccatccatgagaacta | 85288 | X92523 |
| 81 | | taccgcgaacgtcatcaggcgtgca | 42685 | Z16078 | agcatccatccatgagaacttaaa | 85289 | X92523 |
| 82 | | ggtgacgagccgtccgcatgctaat | 42686 | Z16078 | gccatccatcatgagaacttaaaca | 85290 | X92523 |
| 83 | | cgtccgatgctaatcgcttttac | 42687 | Z16078 | atccatccatgagaacttaaacaa | 85291 | X92523 |
| 84 | | tttaccgccagatgaaatcgaacag | 42688 | Z16078 | acttaaacaattacctgcctgactg | 85292 | X92523 |
| 85 | | gatgaaatcgaacagtcgctgaacg | 42689 | Z16078 | taaacaattacctgcctgactgca | 85293 | X92523 |
| 86 | | aacagtcgctgaacagccgtgcatta | 42690 | Z16078 | ccaggttagggctgtgactgca | 85294 | X92523 |
| 87 | | acacatattcagccatcacgtg | 42691 | Z16078 | caattactgcctgactgcatttt | 85295 | X92523 |
| 88 | | ttcagccatcacgctgtggttga | 42692 | Z16078 | ggcttaggctgtgactgcaact | 85296 | X92523 |
| 89 | | atcacgctggttgatgctgcgc | 42693 | Z16078 | cttttaggctgactgcactcc | 85297 | X92523 |
| 90 | | ggtttgatgatgctgctcagtgcat | 42694 | Z16078 | taagtgacttattcctctagaa | 85298 | X92523 |
| 91 | | atgatgctcatgcgctcagtgtc | 42695 | Z16078 | aagtgactattcctctctagaaag | 85299 | X92523 |
| 92 | | ctcagtgcatgcgttccgctgaaag | 42696 | Z16078 | gtgacttatccctcctagaaagtc | 85300 | X92523 |
| 93 | | catgcgttccgcctgaaaggcatggt | 42697 | Z16078 | cttattcctctctagaaagtcaaag | 85301 | X92523 |
| 94 | | ctgaaaggcatccgtgcagctcatc | 42698 | Z16078 | attcctctctagaaagtcaaagcat | 85302 | X92523 |
| 95 | | ggcatccgtgccacgccatctctg | 42699 | Z16078 | attatcatgaaggcctgagaagtc | 85303 | X92523 |
| 96 | | tgccacgccatcttcatgaagggcg | 42700 | X04405 | agacattccgggactttggagcag | 85304 | AA106077 |
| 97 | | atctccatgaagggcgcgaccgcg | 42701 | X04405 | tgcagttgtaccttagcagaaga | 85305 | AA106077 |
| 98 | | attaacgcagttcagtcgcagcga | 42702 | X04405 | gtctcacctttgagagaacagaag | 85306 | AA106077 |
| 99 | | gttcgcagttcgtcagcgattgca | 42703 | X04405 | ccctcgcccagaggcaaagtg | 85307 | AA106077 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 100 | | agttgcagcgattgcaactggctg | 42704 | X04405 | ggcctttgctcagctgccgggtca | 85308 | AA106077 | gatgcgatcggttttccgtgaatc |
| 101 | | gggaaactgtgccagttgtgcac | 42705 | X04405 | ctctgccgggtcatgctcaggtctc | 85309 | AA106077 | atcgatcggttctccgtgaatca |
| 102 | | cgccagttgtgcactttacaagc | 42706 | X04405 | aatctcttttcactgtcacatttg | 85310 | AA106077 | gcgatcggttccgtgaatcagt |
| 103 | | cacttacaagcgcaaggcagc | 42707 | X04405 | tttccactgtcacatttgacccca | 85311 | AA106077 | tcggttttcccgtgaatcagttcgg |
| 104 | | caagccgcaaaggcagcaggctac | 42708 | X04405 | gacccaaatccaagtcactgacta | 85312 | AA106077 | ttctccgtgaatcagttcggacac |
| 105 | | gcaaaggcagcaggctaccggacgg | 42709 | X04405 | aaatcactgacagaccctgac | 85313 | AA106077 | tctccgtgaatcagttcggacacc |
| 106 | | aggttacgcaatagcacgcgctg | 42710 | X04405 | aagtcactgactgagacctgac | 85314 | AA106077 | tccgtgaatcagttgggacacccc |
| 107 | | cgcaatagcacgcggctggcttac | 42711 | X04405 | tccgggacttttgagcagatgctc | 85315 | AA106077 | gttgaactgggctcccgcgtgg |
| 108 | | ggacgcggctggcgttacagcgcaa | 42712 | X04405 | gcccctggagccttccggaatgaca | 85316 | AA106077 | acgattcgggactacaccgaggatg |
| 109 | | gcgctggcgttacagcgcaacagca | 42713 | X04405 | gagctctccggaatgacatttgccg | 85317 | AA106077 | cgattcgggactacaccgaggatga |
| 110 | | cgttacagcgcaacagcctga | 42714 | X04405 | ttccggaatgacatgccgcaagt | 85318 | AA106077 | gatcgggactacaccgaggatgaa |
| 111 | | agcgcaacagcagcctgattgga | 42715 | X04405 | aatgacattgccgcaagtacaagg | 85319 | AA106077 | ttcgggactacaccgaggatgaag |
| 112 | | cagcagccgcagtgattacgca | 42716 | X04405 | gagtaggcttccagggtgagcca | 85320 | AA106077 | tcgggactacaccgaggatgaacga |
| 113 | | ctgagctgaattacgcaacagtaa | 42717 | X04405 | ggcttccagggtgagccatgggt | 85321 | AA106077 | cgggactacaccgaggatgaacgat |
| 114 | | catcagcgcgcaagaggcagaacg | 42718 | X04405 | tgagccatgggtccccactgccag | 85322 | AA020066 | ggactcaacgagggatgaacgatct |
| 115 | | cgcaagagggcagaaccgatagaatc | 42719 | X04405 | caggcaccctgtcatgcagaacc | 85323 | AA020066 | aaccaaaaactcccaatgcagagat |
| 116 | | gggcagacgatgaatcatttggta | 42720 | X04405 | caccgtcatcgcaggcagaccactga | 85324 | AA020066 | aaatcccaatgcagatgagacgga |
| 117 | | gaccgatagaatcattggtaatggta | 42721 | X04405 | atctcaaggcacagtattacggtg | 85325 | AA020066 | tacactgaagaccaagccacctaat |
| 118 | | agaatcattggtaatgcgccgga | 42722 | X04405 | cggcacagtattacgtgcagta | 85326 | AA020066 | caagccacctcaattacaatctg |
| 119 | | ttgggtaatgagccggattacgcg | 42723 | X04405 | acgtccgtgcagtatcgtccagggtga | 85327 | AA020066 | tttcaaatgtcttttagtgcaatt |
| 120 | | atgagcgccgattaacgccgctg | 42724 | X04405 | atgctcagggtgacgtccgcctcg | 85328 | AA020066 | agctgaagacctgctcaaaatact |
| 121 | | gggtcggcgtttacggcgccgc | 42725 | X04405 | gcctcgttgctccggcttccgg | 85329 | AA020066 | agacctgctcaaaatacatctttg |
| 122 | | ctttcgaccttttcactttgcag | 42726 | X04405 | tcctgcctggacatcgcttccgcc | 85330 | AA020066 | gctcaaaatacattttggtcata |
| 123 | | tgacacttcactttgcagattgg | 42727 | X04405 | ccaccacgcttcctcagtaccgt | 85331 | AA020066 | aatacattttgtcataggttatg |
| 124 | | tttgcagattggtaacacaggaac | 42728 | X04405 | acatcgcctccagtaccgt | 85332 | X96585 | acatcttttgctcatatgttatgaaa |
| 125 | | gaaacgtcacgctgaatatatgac | 42729 | X04405 | cttcgctccagtacctgtggat | 85333 | X96585 | tgtgtacctatgctttaaataa |
| 126 | | aaacgtcacgctgaatatatgacca | 42730 | X04405 | taccgtgtggattccgcgacgact | 85334 | AA020066 | ttgtcatccatcactacatcccac |
| 127 | | cgtactgaatatatgaccaccgc | 42731 | X04405 | tcatcgcaggacccactgaggagat | 85335 | AA020066 | cccaatgcagagatgacggggc |
| 128 | | acgctgaatatatgaccaccgctcac | 42732 | X04405 | ccctgacagacccatggggaat | 85336 | AA020066 | ggcctcagctcatgtgttgtacc |
| 129 | | ctgaatatatgaccaccgctcagat | 42733 | X04405 | agtacatcatccggtgctcagcat | 85337 | AA020066 | ctctcagctcatgttgtacccg |
| 130 | | gaatatatgaccaccgctcaccga | 42734 | X04405 | tcatccggtcagacatcccaga | 85338 | AA020066 | tcagctcatgttgtacccggag |
| 131 | | cccgatgatttccgcgcgcgtgt | 42735 | X04405 | gggtcagacatcccagaatgct | 85339 | AA020066 | ggtttgtaccccgaggctgctgag |
| 132 | | catgatttccgcgcgcgctgcgga | 42736 | X04405 | cagacatcccagagatgctagtagt | 85340 | AA020066 | tgtaccccgaggctgctgaggcc |
| 133 | | gatttccgcgcgcgctgtcggagag | 42737 | X04405 | tagtagtctcactcatcatggggt | 85341 | AA020066 | ggctgctgaggcccactcttcaaa |
| 134 | | cgccgccgctgctggaagatccc | 42738 | X04405 | ggctaatctcacggcacagtatta | 85342 | AA020066 | actcttcatagtaagtacactg |
| 135 | | ccgctcgtggaagatccccggc | 42739 | AA020066 | tcatatgtctacctggtgagtaag | 85343 | AA106090 | acgaaacaacgtgtcgtgcaata |
| 136 | | ctgctgggaagatccccggctg | 42740 | AA020066 | atatgtctacctggtgagtaaggcc | 85344 | AA106090 | cgaaacaacgtgtcgtgcaataccc |
| 137 | | gctgggaagatcccccggctgca | 42741 | AA020066 | acccaaagagctcaggcaggtgtgg | 85345 | AA106090 | ctacattgaccacggggtgca |
| 138 | | gggaagatccccggctgcagaaa | 42742 | AA020066 | caaagagctcaggcagtgtgtgg | 85346 | AA106090 | tacattgaccacggggtgatgtact |
| 139 | | gatccccggctgcagaaaatc | 42743 | AA020066 | aaggtcctcaccagttgcagga | 85347 | AA106090 | cattgaccacggggtgatgtactta |
| 140 | | atccccggctgcagaaatccag | 42744 | AA020066 | ctcaccagagttgcaggaacctgc | 85348 | AA106090 | attgaccacggggtgatgtactta |
| 141 | | attgctgcattccggctgcatgc | 42745 | AA020066 | gggaaccttgcacaaccagccagc | 85349 | AA106090 | ttgaccacggggtgatgtacttag |
| 142 | | taccggtcgatcaacgagtgatga | 42746 | AA020066 | aggaacctgcacaaccagcagcatc | 85350 | AA106090 | tgaccacggggtgatgtactagt |
| 143 | | gagtgatgaggttcgcaagaacctg | 42747 | AA020066 | catccccctggctgcatcaagg | 85351 | AA106090 | acaggtgcgtgcaataccagaga |
| 144 | | gcagaacctcagggatcgcaggtcag | 42748 | AA020066 | cacccctctgatcaagtcagtatgg | 85352 | AA106090 | acgggtgcgtgcaataccagatat |
| 145 | | gacgtcagggatcggccaggggt | 42749 | AA020066 | gagcactcacaagcagtatgca | 85353 | AA106090 | gaggactcacattgaccacggggtg |
| 146 | | gccaggggttctgcataccgt | 42750 | AA020066 | cactctacaagcagtagtgggc | 85354 | AA106090 | agaatctacattgaccacggggtg |
| 147 | | gggcatgggctcaagttgaataacc | 42751 | AA020066 | taaggcacgtcacatccagaggcc | 85355 | AA106090 | attgaccacgggtgatgtacttga |
| 148 | | gaagtgtcgcgattatcttctat | 42752 | AA020066 | gccaggacctgcaaccagcgccat | 85356 | AA106090 | gaactacattgaccacgggtgat |
| 149 | | tctatatcttcagcgcgggtctg | 42753 | AA020066 | cagtcactccagaggccatage | 85357 | AA106090 | aatctacattgaccacgggtgatg |

| SEQ ID NO | sequence | DBAxnID | SEQ ID NO | sequence | DBAxnID | SEQ ID NO | sequence | DBAxnID |
|---|---|---|---|---|---|---|---|---|
| 150 | gcaacattgggccagctaaacatg | | 42754 | ctccagaggccatagcaccaggcct | AA106090 | 85358 | atctacattgaccacgggtgatgt | AA106090 |
| 151 | ccagctaaacatgcttcatcgtcgg | | 42755 | cagaggccatagcaccaggcctgag | AA106090 | 85359 | tctacatgaccacgggtgatgta | AA106090 |
| 152 | ccgggctgccaccaagtgctgctcag | | 42756 | ccatagcaccaggcctggggatcga | X64227 | 85360 | tttccttgtgtgctagcctcatg | X64227 |
| 153 | gaccaagtgacagcaatgctgtttc | | 42757 | gagtgtcaccccaaagagctccag | X64227 | 85361 | gctagcctcatgtcgttaagcgg | X64227 |
| 154 | aatgcgtttcactggttatgccgg | | 42758 | tgtgccaccccaaagagctccagga | X64227 | 85362 | ctaccgtcaatacccaagacgacgt | X64227 |
| 155 | atgccggtgaacgtgccaaacaggc | | 42759 | gtattgctgccatcacctgctgg | X64227 | 85363 | taacgacgcgcagtaatagagt | X64227 |
| 156 | acgtgcaaacaggctcctagcgttc | | 42760 | gctgccatcaccctgctgaagtgc | X64227 | 85364 | tgcaacaccaaagccaacacgaag | X64227 |
| 157 | ctctagcgttcgaacgcactgattt | | 42761 | tcagccacgtcaacgacctgtgt | X64227 | 85365 | gaagaccaaccaacaagaagctcact | X64227 |
| 158 | tcgttcactcatggtgaaaatagcat | | 42762 | acaagcacagacctgtgtggctca | X64227 | 85366 | caccaccaaagactcactgtctg | X64227 |
| 159 | atggaaaatagcgatcgctgccagg | | 42763 | tggctccttgtaccacttcagt | X64227 | 85367 | caagagctcactgtctgctggct | X64227 |
| 160 | tcaggtataagaatatctacagtac | | 42764 | ctttgtaccactttcagctggcgt | X64227 | 85368 | gctcactgtgtggtctgataca | X64227 |
| 161 | cgctgttagcaccgcaggtgaga | | 42765 | accaatttcagctggcgttaggcga | X64227 | 85369 | tgtctgtgtcatacaagagca | X64227 |
| 162 | cacccgcaggtgtagaaggcactt | | 42766 | caccaccgctgatgatctgagtaag | X64227 | 85370 | aacatgccccatctcttctctgttg | X64227 |
| 163 | tggctcgagcgatgaggattcgtc | | 42767 | gtgtctctgaccttacaaacat | X64227 | 85371 | agtctattggcgatgtgaaaaa | X64227 |
| 164 | atggattccgtcctcgtgtagct | | 42768 | ccttacaaacatgctagcgcac | X64227 | 85372 | cttcatggcgttaagcggatgatt | X64227 |
| 165 | gtctctgtgtagctgatgacgca | | 42769 | ctctgtacatgtacatgcacacac | X64227 | 85373 | tatctcaaaggccattggagcacaaa | X64227 |
| 166 | tgtagctgatgatcccgaataactac | | 42770 | tacatgcacacacagtattaa | X64227 | 85374 | agcattcaacagaggtccatgaac | X64227 |
| 167 | accagccagtcatcaactcgcgcc | | 42771 | atcaccctgctggaaatgccacatg | X64227 | 85375 | cgtggtccggtgcaacacagac | X64227 |
| 168 | ccaactcatcgatgattacggcg | | 42772 | ccacagtctgcaacaaggaaagtgg | X64227 | 85376 | caacagctactcatatcaggatgtt | X64227 |
| 169 | gattgattacggcgctcaaggatga | | 42773 | gagcacaacctgccagaagaagcca | X64227 | 85377 | atatcaggatgttcctactaccga | X64227 |
| 170 | taaggatctcggtccagagatac | | 42774 | aggagcaagctcagaactggggcatt | X64227 | 85378 | ggatgttccttactacgatcata | X64227 |
| 171 | tggtcagagatatccggtcctgtct | | 42775 | aagctcagagctggcatcttcaa | X64227 | 85379 | tccttactacgcaatacccagaa | X64227 |
| 172 | ctgtcggacacagtgccctgtgc | | 42776 | gggcattctcaagctcagagactg | X64227 | 85380 | gatcagctagaaacctgaagcgag | AA106126 |
| 173 | gtgcccgtcggagccgccgggaga | | 42777 | tctcaagtcagagactgtctgg | X64227 | 85381 | cagaaaacctgaagcgaggagaga | AA106126 |
| 174 | cagaatggcccgccgctgcagttt | | 42778 | gttgttccccaagacctagaagaa | X64227 | 85382 | gaacttcaggctgctctagaagaa | AA106126 |
| 175 | cgagttcaatacgcggatcatg | | 42779 | gagccgttgcatctggaggaaggc | X64227 | 85383 | cttcaggctgctctagaagaagc | AA106126 |
| 176 | ggagatatcgcaagctgtgtgctg | | 42780 | caggatcagtgcctttggctaccc | X64227 | 85384 | ggaaagatctgccgcatccagctgg | AA106126 |
| 177 | ctgtcattacacagatatccat | | 42781 | aggacctcatgctgccagttct | X64227 | 85385 | aagatcctcgcatccagctgagc | AA106126 |
| 178 | ccaagtaaaaatgtcatgaacta | | 42782 | aggacctcatgctgccagttct | X64227 | 85386 | atcctcgcatccagctgagctgagt | AA106126 |
| 179 | ttgtcatgaacatatcctataccct | | 42783 | ttctcccagagctgcatgagatt | X64227 | 85387 | ctgcgatccagctggcgtgaacc | AA106126 |
| 180 | tagtagaaaacagggcatggctggc | | 42784 | tctgccagagactgcatgagattgc | X64227 | 85388 | cgatccagtggagctgaaccaag | AA106126 |
| 181 | tggcagaacgaacaccacacttga | L38424 | 42785 | ccctgttcctgagacagggctcct | X80638 | 85389 | tgaaccaagctcaagtctgagatcg | AA106126 |
| 182 | tatctgatgctgtgtgagtc | L38424 | 42786 | tgccttcctgagacagggctcctc | X80638 | 85390 | aaccaagtcaagtctgagtgagaca | AA106126 |
| 183 | gtgatgctgtgtgcagatgctt | L38424 | 42787 | tgggctctagtccctctgcct | X80638 | 85391 | tcaagtgagatcgacagaagat | AA106126 |
| 184 | ttgagtcagatgctcagatgtt | L38424 | 42788 | cccatattacacaccagccactttat | X80638 | 85392 | ctagaaaccctgaagcgagagata | AA106126 |
| 185 | tgcttcatttacacagatatccat | L38424 | 42789 | catattacacaccagcacttata | X80638 | 85393 | gagattctgacctcacggaaccaga | AA106126 |
| 186 | tacacagatatccatgctgttta | L38424 | 42790 | tttggtcacaggaggggtctaggg | X80638 | 85394 | atttctgacctcacggaacagttg | AA106126 |
| 187 | gatatcatgctgtttacagaaa | L38424 | 42791 | ggatcacggccttgcttactacctga | X80638 | 85395 | tctgacctcacggaacagattgcag | AA106126 |
| 188 | aaaaatgcattagaccagaggc | L38424 | 42792 | cagtgcctttggctacctcgatgc | X80638 | 85396 | gacctcacggaacagattgcagaag | AA106126 |
| 189 | aggatgcgaggccatcatcgccgca | L38424 | 42793 | gtccattggctacctgcctcgatgctc | X80638 | 85397 | ggaaggccatccagaactggagaga | AA106126 |
| 190 | gagccatcgccgccaaatttgc | L38424 | 42794 | gccttcatgcctcggaagaataagcg | X80638 | 85398 | aaggccatcccagaacttggagaaata | AA106126 |
| 191 | tcatcgccaaatttgctctcccc | L38424 | 42795 | gtccattctgacttccccaag | X80638 | 85399 | cgcatccagaactggagaaaata | AA106126 |
| 192 | aaatttgctctcccgatactg | L38424 | 42796 | catttctgacttcccccaagctc | X80638 | 85400 | ccaaggacctggcgatccgggct | AA106126 |
| 193 | cgtcggtgatactgatgatgaa | L38424 | 42797 | cgcatccttgtaggactccagct | X80638 | 85401 | aaaggaactggcgcatccgcgggt | AA106126 |
| 194 | tgccaactatttgaggatgtgag | L38424 | 42798 | ccttgtagactccatgctgccgt | X80638 | 85402 | tatagacgcagttgaatatgaglggg | W35962 |
| 195 | gagatattgaggctttcatcatgacc | L38424 | 42799 | tatatatgaccatccatgctacgaa | X80638 | 85403 | acaatgtcgatgcattacctaccaat | W35962 |
| 196 | agcttcatcatgaccagaagctga | L38424 | 42800 | tacatgaccacgggcatgaggaag | AA020046 | 85404 | caattgtcgatgcatacctcaccaag | W35962 |
| 197 | catgaccagaagcttgacgcaccaa | L38424 | 42801 | gcacctgcctggaagaataagct | AA020046 | 85405 | attgcatgcataccatcacaaatgaa | W35962 |
| 198 | gaagttgacgaccaagctgggact | L38424 | 42802 | acctcggctggaggggtctcg | AA020046 | 85406 | ttgcgatgcatacctaccacaatgag | W35962 |
| 199 | caagctggacgaactgcgttaaacagc | L38424 | 42803 | atcaggtctaggtcatcctgagt | AA020046 | 85407 | tgccgatgcatacctaccacaatgaagg | W35962 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 200 | L38424 | agcagcaaggacatcggatgaaa | 42804 | L38424 | caggtctaggtcatcctgacgtcc | 85408 | W35962 | gatgcatactacaaatgaaggca |
| 201 | L38424 | catgtcagcgttaaactgcagtc | 42805 | L38424 | ggtctaggtcatcctgacgtccag | 85409 | W35962 | atgcatactacaaatgaaggcaa |
| 202 | L38424 | atgaagattgatcagcttgtgtag | 42806 | L38424 | tctaggtcatcctgacgtccagag | 85410 | W35962 | tgcatactacaaatgaaggcaac |
| 203 | L38424 | tgaaaatgcttgatcagccagga | 42807 | L38424 | taggtcatcctgacgtccagagtt | 85411 | W35962 | gcatactacaaatgaaggcaaca |
| 204 | L38424 | aggatatggttcaattacgactgc | 42808 | L38424 | ggtcatcctgacgtccagagttc | 85412 | W35962 | tgtttgctgtcgttagtcaaga |
| 205 | L38424 | tcaattacgactgcctatcggat | 42809 | L38424 | tcatcctgacgtccagagttcca | 85413 | W35962 | gtttgctgtcgttagtcaagac |
| 206 | L38424 | tcatgatctatacgcaaccggaacc | 42810 | L38424 | atcctgacgtccagagttccagg | 85414 | W35962 | ttgctgtcgttagtcaagacta |
| 207 | L38424 | ttcatgaggcacaggcttcaaat | 42811 | L38424 | catgacaccggccggcaatgaggtc | 85415 | W35962 | tgctgtcgttagtcaagacta t |
| 208 | L38424 | agcaacaggcactgatcgctgc | 42812 | L38424 | tgacgtccagagttccaggtcaa | 85416 | W35962 | gctgtcgttagtcaagactata |
| 209 | L38424 | tgcactgatcgctgccaatgcactc | 42813 | L38424 | tgaccacggccggcaatgaaggtct | 85417 | W35962 | caagactatagaccagttcgaatat |
| 210 | L38424 | gctgccaatgcactgatcgtca | 42814 | L38424 | tgcagaacagcgcgtccgggaga | 85418 | W35962 | actatagaccagttcgaatatgatg |
| 211 | L38424 | ccgctgcaccgcgcagccgccatgaa | 42815 | L38424 | atgtccgactggtagtcgccacgg | 85419 | U58105 | ctatagaccagttcgaatatgagg |
| 212 | L38424 | gatgtccggcattaatccatttat | 42816 | L38424 | gtagatccacaaggtccccgcacgt | 85420 | AA106116 | agcaccccggggcccccaggaaggagta |
| 213 | L38424 | cattaatcgtttatgtgatgtga | 42817 | L38424 | ggatccagctgccgctcagcctgt | 85421 | AA106116 | tagataaggccccaggcccaggaaggagta |
| 214 | L38424 | tgagtgtatccatccgtctgcc | 42818 | L38424 | ccagcagcacctctgcctgaggag | 85422 | AA106116 | tctccatccaatacaaggggccg |
| 215 | L38424 | gctccacaatatggggtactgcg | 42819 | L38424 | agcagcacctctgcctgaggag | 85423 | AA106116 | ctcatccaatacaaggggccg |
| 216 | L38424 | aaatctttgtcgcaaccactggtga | 42820 | L38424 | ggaacactgcacactgaaattgt | 85424 | AA106116 | tccatccaatacaaggggccgt |
| 217 | L38424 | gggcaactgtgatgaaggtgttttc | 42821 | L38424 | cttctagactcatcatgaggtaaaa | 85425 | AA106116 | catccaatacaaggggcccgtg |
| 218 | L38424 | atgctgacgttctgtcttggcgc | 42822 | L38424 | tgactgcgcgggctttctgttaccat | 85426 | AA106116 | atcccaatacaaggggccgttga |
| 219 | L38424 | gcttggcgccacagtgatgatg | 42823 | L38424 | cttctgtttacccatccaattcaggca | 85427 | AA106116 | tctccaatacaaggggccgcttgag |
| 220 | L38424 | cacagtgatgtgcgagatcggaa | 42824 | L38424 | ttacatccaattcaggcagaaggt | 85428 | AA106116 | ctccaatacaaggggccgcttgagt |
| 221 | L38424 | agagaagcagtgaagccgcccgc | 42825 | L38424 | tactctatatccccctcatgtta | 85429 | AA106116 | ttagccaatggccaagaaactcg |
| 222 | L38424 | gaagcagctgaagccgcccgcat | 42826 | L38424 | ccctacagttttatccattgtgac | 85430 | AA106116 | tagcccattggccaagaaactcgg |
| 223 | L38424 | gctgaagcagccggcatattaggcg | 42827 | L38424 | atgttatccattgtgaccactc | 85431 | AA106116 | tggccaagaaacctcggaagtcaag |
| 224 | L38424 | gcagcccgcatattaggggtgagcagata | 42828 | L38424 | ttgtgaccactccactgagctca | 85432 | AA106116 | gataagagccccgaataagagtacaa |
| 225 | L38424 | aagaattcagtgaagcttccagac | 42829 | L38424 | ccactgcactgactcattcaca | 85433 | AA106116 | taaagccccccagggaaggagtacaag |
| 226 | L38424 | aatgatgatcaggcaattcggtca | 42830 | L38424 | ccactgcactcattcacagaggca | 85434 | AA106116 | agtacaagatctccatcccaatac |
| 227 | L38424 | tgatcaggcaattgggcaattgc | 42831 | L38424 | attcacagaggcatgtttatacta | 85435 | AA106116 | gtacaagatctccatcccaataca |
| 228 | L38424 | atcggtcaattgctcactgtcatca | 42832 | L38424 | tcccatccaagttgtatgctattgc | 85436 | AA106116 | acaagatctccatcccaatacaag |
| 229 | L38424 | tccattgtcactgtcatcagatct | 42833 | L38424 | ttaaacagtaagcctctagactaaatc | 85437 | AA106116 | caagatctccatcccaatacaagg |
| 230 | L38424 | gtcactgtcatcagaatctgcggc | 42834 | L38424 | cagctaacagtgcctctagactaaattc | 85438 | AA106116 | agatctccatcccaatacaagggg |
| 231 | L38424 | catcagaatctgcggccaaagcg | 42835 | L38424 | attaatcttcatgtcttcatgaa | 85439 | AA106116 | atctccatcccaatacaagggc |
| 232 | L38424 | aggatcggccatccggatcacggcgca | 42837 | L38424 | cttcatgtcttgaaattcac | 85440 | U58105 | tgattcagttactgtaaagtgaa |
| 233 | L38424 | tccggatcacggcgatcaggtgtcga | 42838 | L38424 | tgctctcttttgaaatcccactaagt | 85441 | U58105 | tcatgttactgtaaagtgaaagt |
| 234 | L38424 | ggcaatgggctgcactgtgggaag | 42839 | L38424 | acacaaaggcacactgtgaagaa | 85442 | U58105 | cttatcacaatacatcgaaaact |
| 235 | L38424 | gcctccggcactgcaagtcagcaa | 42840 | L38424 | acccatggggatggggagcggaaga | 85443 | U58105 | ataccacaatacatcgaaaacttca |
| 236 | L38424 | gataaatggtttcatgccggat | 42841 | L38424 | accatggtcaaggagcggatc | 85444 | U58105 | cccaatacatcgaaactcagat |
| 237 | L38424 | ttttgttatgatatctggataca | 42842 | L38424 | gatacggtgctctctgacagtta | 85445 | U58105 | caatacatcgaaaactcagatca |
| 238 | L38424 | tgatatctggatacatagaggc | 42843 | L38424 | accggtgtctctgacacagttagag | 85446 | U58105 | aacttgcatgtgaaaaaca |
| 239 | L38424 | ctactctcgacgaatgggtatat | 42844 | L38424 | ggtgctctcgtgacagttagaaa | 85447 | U58105 | gtttaatatcctgtaaggcacgtgaa |
| 240 | L38424 | ggtatattgaaatgttgaagcgag | 42845 | L38424 | gctctcggacagttagaaaagt | 85448 | U58105 | taatatctgtaaggcacgtgaag |
| 241 | L38424 | gcagcaaaatcacaggtcatttt | 42846 | L38424 | acaactggcgtgggtttatatact | 85449 | U58105 | tatcctgtaaggcacggtgaggtac |
| 242 | X17013 | tagaaatcgggagtgggatcgctcct | 42847 | L38424 | tttataatcgcttgctcagaag | 85450 | U58105 | tatggaattctgggtttgattta |
| 243 | X17013 | aggggtgatgctctatttagcgc | 42848 | L38424 | atatactgcttgctcagaaggg | 85451 | U58105 | cctacctgtatgtgaattccat |
| 244 | X17013 | tggatgctctattagcggagaa | 42849 | L38424 | tactgcttgtcagaaggggctt | 85452 | U58105 | tttaagctgcaatttgaacact |
| 245 | X17013 | tggcacccttttaacatagat | 42850 | L38424 | tgctttgctcagaaggggctttt | 85453 | U58105 | tattgaccataactgtcaactccc |
| 246 | X17013 | cacctcttactagtatatgaatgtgc | 42851 | L38424 | tcagagccagccgctgtgagcatg | 85454 | U58105 | tgaccataactgtcaactccttt |
| 247 | X17013 | aggtgtgatgcctctatttagcgg | 42852 | L38424 | catttgcaaggagcgactcgga | 85455 | U58105 | cataaactgtcaactccctttgag |
| 248 | X17013 | tggcacccttttaacatagat | 42853 | L38424 | tgctccaaggagccgactcggagcc | 85456 | U58105 | taactgtcaactcccttttagctt |
| 249 | X17013 | gcaggttaattcgtcaggggctg |  |  |  | 85457 | U58105 | gcttcctccaagttgttattgtgt |

| SEQ ID NO | sequence | DBAxnID | SEQ ID NO | sequence | DBAxnID | SEQ ID NO | sequence | DBAxnID |
|---|---|---|---|---|---|---|---|---|
| 250 | tttattctgcaggcgtgaaagcac | X17013 | | ccacagctccgggctagaaaatg | D83144 | 85458 | aatgttgctctatacacacaataca | U58105 |
| 251 | gggctgaaagcacaggtggcatatg | X17013 | 42854 | gcggctgatccagttctggagata | D83144 | 85459 | gttgctctatacacacaatacatcg | U58105 |
| 252 | ggcatatgcgcacaaagcattcta | X17013 | 42855 | ggctgatccagttctggagataccg | D83144 | 85460 | ttccaggcactgaggaccgcagtc | AA106163 |
| 253 | atgcgagcaaagcattctcatcagt | X17013 | 42856 | tgatccagttctggagataccgtg | D83144 | 85461 | gaccgcagcccctaattcctgccag | AA106163 |
| 254 | gcaaagcattctcatcgtcgcaat | X17013 | 42857 | tccagttctggagataccggtgtc | D83144 | 85462 | agtactgtaacactagaaccatg | AA106163 |
| 255 | cattctcatcagtcgcaatgattca | X17013 | 42858 | ggagataccggtgctctggacag | D83144 | 85463 | gctaacactagaaacatggccagt | AA106163 |
| 256 | catcagtcgcaatgattcagctcgc | X17013 | 42859 | tgtccgaccacctcaagaagagcaa | D83144 | 85464 | aacactagaaacatggccagtgaa | AA106163 |
| 257 | tcgcaatgattcagctcgtgagga | X17013 | 42860 | agaacagctcagcctcagtgagat | U14135 | 85465 | actagaaaccatggccagtgaagaa | AA106163 |
| 258 | tcttagatgcgtatccggaggag | X17013 | 42861 | gatattgtcgactctcttatga | U14135 | 85466 | aaccatggccagtgaagaagaatat | AA106163 |
| 259 | atgtcgtatccgaggagagctata | X17013 | 42862 | taagacagcagcaccgagtcagca | U14135 | 85467 | agacggccacaggctatcattc | AA106163 |
| 260 | ggagagctataacggctgttgcag | X17013 | 42863 | caccgagtcagcactgttacatagca | U14135 | 85468 | cgggccacaggctatcattccac | AA106163 |
| 261 | gatgcggctlgagcaccgcatccgc | X17013 | 42864 | gtcagcagttacatacatagtac | U14135 | 85469 | cgcctgactgtgaggggctgcaag | AA106163 |
| 262 | cgctgagcaccgcatccggctgat | X17013 | 42865 | catagcatagtacctlccagttac | U14135 | 85470 | ctgcaaggctlcttcagtgatact | AA106163 |
| 263 | gcaccgcatccggctgcattggtg | X17013 | 42866 | cagttactgtcctaattgactgtg | U14135 | 85471 | gggcttcttcagtgatactgtcagc | AA106163 |
| 264 | gcatcgggctgcattgtlggtggatga | X17013 | 42867 | tagaacttagcatcagttaagttgc | U14135 | 85472 | agtcctaattcctggcagttcctg | AA106163 |
| 265 | ggataattctatgaaatcgcgctt | X17013 | 42868 | agtttgcacagcactagaacagg | U14135 | 85473 | ccctaattcctggcagttcctgaga | AA106163 |
| 266 | attctatgaaatcgcgttcttctcg | X17013 | 42869 | gtcaccaccgtgcggtgattc | U14135 | 85474 | taattcctggcagttcctgagatct | AA106163 |
| 267 | ctatgaaatcgcgttcttctgaagac | X17013 | 42870 | ccacgtgctgtgattccaactac | U14135 | 85475 | aggagcatcctacaccgatcctg | AA106166 |
| 268 | aatcgcgttcttgaagacctatgt | X17013 | 42871 | attacactacagttgacttcataag | U14135 | 85476 | cctacaccgatctlggcctgct | AA106166 |
| 269 | gtcactccatcgatgttcttctcg | X17013 | 42872 | ttcttaagttgcgccactctgtcg | U14135 | 85477 | acaccgatctlgggcctgctgcc | AA106166 |
| 270 | ttcggatcacgcgccgagtagaagc | X17013 | 42873 | agttcaccaccgtgcggtgattc | U14135 | 85478 | gatcttgcgtgattccaagg | AA106166 |
| 271 | gatcacgccgagtagaagcgcat | X17013 | 42874 | ccaccgtcgctgttgattccaactc | U14135 | 85479 | gacagttagtcaacactagaaacc | AA106166 |
| 272 | tagaagcgcatacgcatgactactat | X17013 | 42875 | tgatttcaacactctctgaagag | U14135 | 85480 | tgcgttccacgtatgcagagctcggt | AA106166 |
| 273 | agcgcatacgcatgactactaca | X17013 | 42876 | tcccagacttattgcgagaga | U14135 | 85481 | cgtgtccacgtatggagctcggag | AA106166 |
| 274 | atacgcatgactacatlaacagg | X17013 | 42877 | attgctgagagcaccgccgtgct | U14135 | 85482 | cagactcccagcagtcggaga | AA106166 |
| 275 | tcgatctcataacggacaaactga | X17013 | 42878 | gagagcaccgccgtccagtta | U14135 | 85483 | gacctccagcatcgtgggagaac | AA106166 |
| 276 | attacaatgggaacacattcagctg | X17013 | 42879 | cagtccagtttatccacaaaatg | U14135 | 85484 | cctlccagcatgtggaaggt | AA106166 |
| 277 | aatcggaacacattcagctgctggg | X17013 | 42880 | aaggcctctgtgtaatccaaggt | U14135 | 85485 | ttccagcatgtggaggaagtca | AA106166 |
| 278 | aacacattcagctgcgtgtcca | X17013 | 42881 | ctctgtgtaatccaaggcttggctg | U14135 | 85486 | agaagctgcaacgtlcatctctac | AA106166 |
| 279 | cattcagctgcgtggggtccaattgc | X17013 | 42882 | aatcggcgaaccctccgagcc | U27295 | 85487 | acgcaaagcatatctctact | AA106166 |
| 280 | agctgcgtgggtgccatat | X17013 | 42883 | acacaagcaataggaactcatctca | U27295 | 85488 | cgtcaagctcatcatctctact | AA106166 |
| 281 | tggagagtcatlcattlatccaagt | X17013 | 42884 | gactcatctcagggccctlcagc | U27295 | 85489 | aacgtcatcatctactacggcg | AA106166 |
| 282 | atlcatattcatttgtaltccaaggt | X17013 | 42885 | agggccctlcagccgaactgcatct | U27295 | 85490 | cgtcatcatctacctacgggcgag | AA106166 |
| 283 | catattcatttgatccaaggt | X17013 | 42886 | ctlcagccgaactgcatctttct | U27295 | 85491 | tcctggaccgtagcttggltctg | AA106166 |
| 284 | catltlgtatccaagglcgaatct | X17013 | 42887 | ccgaactgcatcltlcctgtatc | U27295 | 85492 | cagaaactgtgctgcgccaggccat | AA106166 |
| 285 | tttgtatccaaggtgcgaatctg | X17013 | 42888 | acatlttcattatgtlcatga | U27295 | 85493 | tgccaggccatcgtgaacgcat | AA106166 |
| 286 | tatccaaggtgcgaatctlggagg | X17013 | 42889 | catlgtlcagttaagtlgta | U27295 | 85494 | cgccaggccatcgtgaacgcatca | AA106166 |
| 287 | tatlcgtlatacggaactgaatgaa | X17013 | 42890 | gtcgtlatlgttgcttgaaccc | U27295 | 85495 | ccaggccatcgtgaacgcatcaag | AA106166 |
| 288 | aagatgatgaacggctlcatgccac | X17013 | 42891 | ttatgltcgtlatacgggaccttcat | U27295 | 85496 | gccatcgtgaacgcatcaagcccg | AA106166 |
| 289 | atgatgaacggctlcatgccactga | X17013 | 42892 | tcatltgggatgccagaccccgac | U27295 | 85497 | tcaagcccgtcgatgatgaacaa | AA106166 |
| 290 | tgaacggcttcactgaataaac | X17013 | 42893 | gacattltacatctlcagaggaaca | U27295 | 85498 | gccgctaccagacaccacgt | AA106166 |
| 291 | accgctlcatgccactgaatacgtt | X17013 | 42894 | tacatcttcagaggaacaccacgt | U27295 | 85499 | agctlaccagaccttccagcgat | AA106166 |
| 292 | tgggaccgcaggcacaactcltla | X17013 | 42895 | ttctcagaggacaccaacaagt | U27295 | 85500 | actgctccgaagccaagcaggagttggc | AA106166 |
| 293 | ggagacgcaggcacactcttatac | X17013 | 42896 | gaggacaccacgtacaagtgggact | U27295 | 85501 | gcaaggcaaggcaggcaggtga | AA106166 |
| 294 | gaacactcttlatacggttggctc | X17013 | 42897 | gattlgccacgctgctatcatg | U27295 | 85502 | gcataggacaccagcttctatgg | U76208 |
| 295 | ataagctgacacgltlcatcat | X17013 | 42898 | ccacagctgatcalgtggaaa | U27295 | 85503 | tagcggaccacagcltctatgcc | U76208 |
| 296 | agctgtacaatgttlcatcattg | X17013 | 42899 | tacaggtccaggaatcggacggaca | U27295 | 85504 | accacagttcggggtgccggagcc | U76208 |
| 297 | ctgtacaatcgttlcatccggc | X17013 | 42900 | tgglttcattlcggggatgccaga | AA020166 | 85505 | gctlcatgccgcggcccccgt | U76208 |
| 298 | tacaatcgltlcatlcattcggtg | X17013 | 42901 | tcatlcggggatgccagacccgac | AA020166 | 85506 | gctcaacgggactggggctctat | U76208 |
| 299 | aatcgtltcatlcatlcgggcgcga | X17013 | 42902 | atgcgcgtagacagaccagtgac | AA020166 | 85507 | cagtcccaaggctaacctgag | U76208 |
| | | | 42903 | tggcatagtccatagcccagtgac | AA020166 | | | |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 300 | cgttcatcattggcgtgcaatt | X17013 | 42904 | catagtccatagccagctgaccag | AA020166 | 85508 | gtaacctgagcccaaggcctcatt | U76208 |
| 301 | gacattactgtccgtgaagat | M24537 | 42905 | agtccatagcccagctgaccagtgc | AA020166 | 85509 | gcccacggcctcatgagggaatt | U76208 |
| 302 | actctgtccgtgaagatgtattgcc | M24537 | 42906 | tagccagtcgaccagtccatgag | AA020166 | 85510 | catcctactcgtcccgggagcact | U76208 |
| 303 | aagatgtatgccgtgcaatgag | M24537 | 42907 | cccagtcgaccagtccatgaggag | AA020166 | 85511 | cctatcgctcccgggagcactgt | U76208 |
| 304 | gtattgccgtgcaatgagaaaa | M24537 | 42908 | agctgaccagtgccatgagaggag | AA020166 | 85512 | acaggcccaagaggagttggcact | U76208 |
| 305 | agcagatcagtagcagatgccgtt | M24537 | 42909 | tgaccagtgccatgaggagcccaa | AA020166 | 85513 | actggtgtctcagacttctgtga | U76208 |
| 306 | cagtagcagatgccgtcaaaggt | M24537 | 42910 | tgaggccccaacagaaccaggaa | AA020166 | 85514 | tggcactcagcaaacagcgaagaag | U76208 |
| 307 | tacagagatgcgttttccattc | M24537 | 42911 | gggagcccaacagaaccaggaagat | AA020166 | 85515 | cactcagcaaaacgaagaagccg | U76208 |
| 308 | ggaggtatggtcaagtcgttatct | M24537 | 42912 | accgacgctgtggggccaggat | AA020166 | 85516 | atgacgccaaattaccaaagtcga | U76208 |
| 309 | taggtcaggtgcgttatctcagtt | M24537 | 42913 | gcccaacagaaccaggaagatcca | AA020166 | 85517 | acatctgggcactgactcagacgct | U76208 |
| 310 | gcgttatctcagtcttcaggcgg | M24537 | 42914 | cgacagcgtcaggtccaggatctg | AA020166 | 85518 | ggcacgtgactcagacgcgcgcat | U76208 |
| 311 | ctcagtctcaggcggtagctga | M24537 | 42915 | cccaagccaggtactggagtaagat | AA020166 | 85519 | tgactcagacctgcgcatagccgga | U76208 |
| 312 | tctcaggcggtagctgatctga | M24537 | 42916 | tgtttaagccccggacatccattg | AA020166 | 85520 | ctcagacgtcgcatagccgagaca | U76208 |
| 313 | ggcgtagctgattctgaagcaac | M24537 | 42917 | ttaagccccggacatccatgctg | AA020166 | 85521 | cgagcagtcagccccagaggaggaa | U34245 |
| 314 | ctgattctgaagcaaagtctttc | M24537 | 42918 | agcccggacatcatgctgagcc | AA020166 | 85522 | gatcagccagaggaagaaggtgc | U34245 |
| 315 | tctttccattcaccagaccattcg | M24537 | 42919 | cccggacatcatgctgagcctg | AA020166 | 85523 | gaaggaaccaggtggttctggagc | U34245 |
| 316 | accagaccattcgcttcaacgcag | M24537 | 42920 | acatccattgctgagcctgacta | AA020166 | 85524 | ggaaccaggtgtctggcagcacc | U34245 |
| 317 | ccattccgcttcaaggcagagcaaa | M24537 | 42921 | gaactggaagctgctgtcagaga | AA020166 | 85525 | agtgcctgcatctcccttcca | U34245 |
| 318 | cgcttcaaggcagagcaaatgac | M24537 | 42922 | ctggaagctgctgttcagaggactc | U27398 | 85526 | tgaacctgaagcactgcataccccc | U34245 |
| 319 | gcaaatgtgacactgtctatcagta | M24537 | 42923 | ctcctggccacagaaccgagaggat | U27398 | 85527 | tctgactcctttactccgagtctg | U34245 |
| 320 | cactgtctatcagtctgtggcaat | M24537 | 42924 | ctggccacagaaccgagaggatcca | U27398 | 85528 | tactccgagtctgttccacctat | U34245 |
| 321 | gaaatattaaggttcaggtcgataag | M24537 | 42925 | cctctttccgttgagaagctgtga | U27398 | 85529 | ggtttccactatctctagcacacca | U34245 |
| 322 | ttattaggtccagcagctacatt | M24537 | 42926 | aagccagtgtcctccagccagaa | U27398 | 85530 | tttccactatctctagcacacaga | U34245 |
| 323 | aggtccagcagtctacatttacat | M24537 | 42927 | ccagtctctccagccagaaagc | U27398 | 85531 | cccactccacgaaagatagcagc | U34245 |
| 324 | gctacatctacatttacatgccagtca | M24537 | 42928 | agtctgaccaaccccagcagtca | U27398 | 85532 | cactcaccgaaagagtagcagcage | U34245 |
| 325 | tacacactctacatcagtctgt | M24537 | 42929 | accagcgtgaatcccatctggg | U27398 | 85533 | caagctagcagctgtcgtcaagtgcag | U34245 |
| 326 | tcaaacgcgcgaacatgctgtgct | M24537 | 42930 | cagccagcgatccccatagccgtgc | U27398 | 85534 | gaaatcgggtgcgcgagagatt | U34245 |
| 327 | gaacatgtgctaccgcacat | M24537 | 42931 | gatcccataggtggctggtga | U27398 | 85535 | atcgggtgcagcgagagattgaa | U34245 |
| 328 | ccgcacatccggagtgtatagat | M24537 | 42932 | ccccataggtggctggtgagct | U27398 | 85536 | gaaggaagccttgactggtgctg | U34245 |
| 329 | gtgatagatgcagccgcgcaggc | M24537 | 42933 | aggactcctcatcagagaggctg | U27398 | 85537 | accgcctgagctggctggaagc | U34245 |
| 330 | gatgcagcgcgttgcaggcaagttg | M24537 | 42934 | actcctcatcagagaggctgaaa | U27398 | 85538 | ggaagccatccgcccatcgcaaa | U34245 |
| 331 | ctattaatacatgaacagccttg | M24537 | 42935 | gaaactccgctatggggccaagagc | U27398 | 85539 | cctcatctgcaaaatcccagaaga | U34245 |
| 332 | catgaacgccttgccaatcgtgg | M24537 | 42937 | ccgtatggggccaagagccaagag | U27398 | 85540 | tgtcaagaacctggagtgatacaa | AA106601 |
| 333 | gggtgaaatgacgttgccaatccac | M24537 | 42938 | cgaggcagcagtcccatgctgct | U27398 | 85541 | ctacatatctgaatgccaaactt | AA106601 |
| 334 | gacgttgccgatccaccagcactg | M24537 | 42939 | ggcagcagtccccatgctgctgga | U27398 | 85542 | ggactaccacttaggatacggcag | AA106601 |
| 335 | cactgctgtctcaccccaagag | M24537 | 42940 | cggcatctcttctgatgaaggaa | U27398 | 85543 | taccacttagggatacggacaa | AA106601 |
| 336 | ggcatctcttctgatgaaggaa | M24537 | 42941 | gcagtgtcttaaccgcagatct | U27398 | 85544 | atgatcataacatgccatgcatt | AA106601 |
| 337 | aattactacatctcacatcaacgcgat | M24537 | 42942 | ttaaccgcagaatctgctcttcta | AA161905 | 85545 | gattcataacatggccatgcattac | AA106601 |
| 338 | tccacatcacacgcagtgcgaat | M24537 | 42943 | aattgctccgttccgactgccca | AA161905 | 85546 | taacatggccatgcattacctgtt | AA106601 |
| 339 | acacgcagtgcaatgccaatgcataaa | M24537 | 42944 | gttcctgcagtgccaagatgtgaa | AA161905 | 85547 | atggccatgcattacctttcgag | AA106601 |
| 340 | attggccagtgccatcccgagc | M24537 | 42945 | agcatacactgctgctcatctactt | AA161905 | 85548 | ggccatgcattacctgttcgtgc | AA106601 |
| 341 | aagttgccgattcacccagactg | M24537 | 42946 | atacactgctgcatctactccaa | AA161905 | 85549 | atgcattacctgtttgagtcgaag | AA106601 |
| 342 | gtcagtgaccatccgagctgaata | M24537 | 42947 | cactgctgcatcacattactcacatt | AA161905 | 85550 | taccttggatacggacaa | AA106601 |
| 343 | ccatccgagctgaatacggggc | M24537 | 42948 | gcagtgcttaaccgcagatct | AA161905 | 85551 | atgatcataacatgccatgcatt | AA106601 |
| 344 | ggtgaataggtgcgccatgccac | M24537 | 42949 | ttaaccgcagaatctgctctta | AA161905 | 85552 | tacctgttttgagtcgaagatgt | AA106601 |
| 345 | tatcgggtcattgccaatgcatatag | M24537 | 42950 | aatgctccgttcctgcatgtcca | AA161905 | 85553 | tatctggaatgccaactgacaatg | AA106601 |
| 346 | gccaatgatatatgccgcttcacat | M24537 | 42951 | actgtctttataagagcagat | AA161905 | 85554 | gaatgccaaactgacaacttggg | AA106601 |
| 347 | atgccagctctacatacgaattaa | M24537 | 42952 | atgatgttcaattgcattggtg | AA161905 | 85555 | cttgacagccaactttggctgc | AA106601 |
| 348 | ctgtctccgatgaaacatatctt | M24537 | 42953 | ttccaatgatttctgtggcaataa | AA161905 | 85556 | cttgacagccaactttggctgcgt | AA106601 |
| 349 | gaattcaaaatgtgagctcaggccc | M24537 | | | | 85557 | tgacagcaacttggctgcgggtcc | AA106601 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 350 | ttaatgctatgctgccgcaggatg | M24537 | 42954 | gtcgactgtgctgatggagtaaa | AA161905 | 85558 | agcaacttggctgccggccgtca | AA106601 |
| 351 | catgtgccgcaggatgatcagtcc | M24537 | 42955 | gcgaagctgtcgctcttcagt | AA161905 | 85559 | tttggctgccggtcgctcaaagtga | AA106601 |
| 352 | ggatgatcagtccgggcgctgcat | M24537 | 42956 | tgtccgttcctcatgtacaggtccc | AA161905 | 85560 | tggctgccgccgtcaaagttaag | AA106601 |
| 353 | cgggcgcgtcatagagtgctgtct | M24537 | 42957 | ttcatgtacaggtccctccatggctg | AA161905 | 85561 | aaatggccaaggcattaaggaaatg | AA106624 |
| 354 | ctgatagggtgctgtcatttt | M24537 | 42958 | atgtacaggtccctccatggctgtga | AA161905 | 85562 | aatggccaaggcattaaggaaatgg | AA106624 |
| 355 | gtgctgtcgcattttctggagaa | M24537 | 42959 | tacaggtccctcatggctgtgaatt | AA161905 | 85563 | gctcgatttttcggcacatgctta | AA106624 |
| 356 | tgtctgcatgatttcaggagcc | M24537 | 42960 | tccctcatggctgtgaattgctccg | AA161905 | 85564 | tcgatttttcggcacatgcttat | AA106624 |
| 357 | gtatgattcaggggccatgcaggg | M24537 | 42961 | tagaattaggcctctcggagcaggg | AA161905 | 85565 | tcgatttttcggcacatgcttata | AA106624 |
| 358 | aggggccatgcaggaggcttgaagca | M24537 | 42962 | atcctaggcggttcattcctgagc | U33626 | 85566 | gattttcggcacatgcttataaa | AA106624 |
| 359 | agtgaggctctggggtgcataccag | M24537 | 42963 | gactgaactgctgttgctgtccaca | U33626 | 85567 | ttttttcggcacatgcttataaatg | AA106624 |
| 360 | cttcggggcatacactggttacc | M24537 | 42964 | tgcggccaggtgttttccagata | U33626 | 85568 | ttttcggcacatgcttataaatgc | AA106624 |
| 361 | ctgtaacagatcaaaacccgcgct | X04603 | 42965 | agcccagagtccagctttgacagc | U33626 | 85569 | ttttcggcacatgcttataaatgct | AA106624 |
| 362 | acacctctatctcaacctgcgaagc | X04603 | 42966 | tgacagctgatgacctccattc | U33626 | 85570 | ttcggcacatgcttataaatgctg | AA106624 |
| 363 | gaattgagctctcagtcaaaacgga | X04603 | 42967 | cctgatgacctccattttcatatga | U33626 | 85571 | tcggcacatgcttataaatgctga | AA106624 |
| 364 | sggatcattaaagatccggaatg | X04603 | 42968 | gacctccattcatatgaatggtg | U33626 | 85572 | tcggcacatgcttataaatgctgag | AA106624 |
| 365 | gaaggctcaatgacacgattatgtgcg | X04603 | 42969 | cacactctgactcatctcaggggt | U33626 | 85573 | aaggtctgtgccacaaaagagtg | AA106624 |
| 366 | acacgattatggtgcgctcaacacag | X04603 | 42970 | tcatcctatggtgtccaaggcac | U33626 | 85574 | aggtcgttgccacaaaaagagtgc | AA106624 |
| 367 | ggctcaacagtaaacactccgctg | X04603 | 42971 | tgttccaaggcacccaatgctccac | U33626 | 85575 | ggtcgttgccacaaaagagtgct | AA106624 |
| 368 | cacttccgctgctgccgcacatat | X04603 | 42972 | aaatcagttcttatggtggttgtg | U33626 | 85576 | gtctcgttgccacaaaagagtgctc | AA106624 |
| 369 | cggcagcatatgcagcccgtgctaa | X04603 | 42973 | ccggccatgcacattgagtatgat | U33626 | 85577 | ctcgtgccacaaaagagtgctcga | AA106624 |
| 370 | cagcccgtgcacatgaaatgcat | X04603 | 42974 | aaaggcagaactccagttgtcctgt | U33626 | 85578 | ttgccacaaagagtgctcgatttt | AA106624 |
| 371 | tgcattgtcatcatcccgaacgga | X04603 | 42975 | cagaactccagttgctctgtgaatt | U33626 | 85579 | agtgctcgattttttcggcacatgc | AA106624 |
| 372 | ggaaaactcgctcaagctgtcatgt | X04603 | 42976 | tccagttgctgtgagatggctga | U33626 | 85580 | gtgctcgatttttcggcacatgct | AA106624 |
| 373 | gtccgttccatcgtgcgagaatcac | X04603 | 42977 | tggctgacccgtgcgagcgaggattatc | U33626 | 85581 | catgatccttccagaaaaatgag | AA106624 |
| 374 | tgtgagaaatcaccgattgccctg | X04603 | 42978 | tattatctcgaccgtgcgctactgctg | U33626 | 85582 | gctcttccacgtcctcactacga | AA106625 |
| 375 | tcagtcaaacctaccgcattgaag | X04603 | 42979 | ggtccctgacccttatggccatctg | U33626 | 85583 | catgaaacctgttttgacttgtat | AA106625 |
| 376 | ctgctgcccttcgaagttgtgcgaaca | X04603 | 42980 | tgacctatggccatctcggaggtc | U33626 | 85584 | gactttgattccctgagctccctg | AA106625 |
| 377 | ctgctgccttcgaagttgtgcgaaca | X04603 | 42981 | ctgtactactgtcattggggatg | U33626 | 85585 | ttccctgacttcctgcactgaat | AA106625 |
| 378 | catgagaaacatcacgtactgga | X04603 | 42982 | ttactactgtacatggaatgatt | U33626 | 85586 | ggacttccctgactgcattgaatt | AA106625 |
| 379 | gcgcgggccaatcgtcgcgcaatgaag | X04603 | 42983 | ctatactgaatcctgcctcacaga | U33626 | 85587 | tgaagacactgcaactgctcctctac | AA106625 |
| 380 | gcaatcgtcgcgcaatgaagtgatg | X04603 | 42984 | atccttgcctcacagaaattgagtc | U33626 | 85588 | agacacgtcaacatcgtctacaat | AA106625 |
| 381 | gtaaaggcagcgcgaggaatccaaatg | X04603 | 42985 | catgccatgctaacctgtagctc | U33626 | 85589 | cagtcaacatcgtctacaatgcc | AA106625 |
| 382 | actgatgaatgaaatcctcacgcat | X04603 | 42986 | tgccatgctaacctgtaactctaa | U33626 | 85590 | aacactgctacaatgcctcagc | AA106625 |
| 383 | atcctcaegcatatcagtgatcg | X04603 | 42987 | aatctgctagctaactctatgaga | U33626 | 85591 | atctgctacaatgcctcagcagc | AA106625 |
| 384 | tatcagtctgatcgccgtagaag | X04603 | 42988 | ctgtagctctaatctatgagaaaa | U33626 | 85592 | tgctacaatgcctcagcagcctc | AA106625 |
| 385 | cagaaccaggttcgcgctctat | X04603 | 42989 | acctggtcgctgttttagcagta | U33626 | 85593 | tteacctgtctctactgcaagaatg | AA106625 |
| 386 | tgcgctctatcgcaggagtgctga | X04603 | 42990 | tggtctgtcgttttagcagtaaaa | U33626 | 85594 | caatgctccagccgcctctagtat | AA106625 |
| 387 | aaggcagcagcgtgacgtgtgt | X04603 | 42991 | atgtccgtatgtattgtaactgg | U33626 | 85595 | acctgtctactgaagagatgctg | AA106625 |
| 388 | aagatccgaacagaggcgtcgacat | X04603 | 42992 | tatgtcgggccaggccatatggtc | U33626 | 85596 | agagatgctctgaacctccaagc | AA106625 |
| 389 | gcgggctgacattcagaaatcaagc | X04603 | 42993 | ctacgtacattgggatgtattca | U33626 | 85597 | tcaactcgaagctctcggttcc | AA106625 |
| 390 | tcgaaatcaagctgtcacattgagc | X04603 | 42994 | atgagtctaccttcaccttttcgac | U33626 | 85598 | gaagctctcggttcagctccca | AA106625 |
| 391 | cctgtcacattgcgactgatgaag | X04603 | 42995 | agtctaccttcaccttctcacgt | U33626 | 85599 | cggttctagctcccattgagtatg | AA106625 |
| 392 | gacagcatcctgaatatgtaaaag | X04603 | 42996 | caccttctgcactgcatacacat | U33626 | 85600 | ttctagctcccattgagtatggt | AA106625 |
| 393 | acgaagcgacagtcgttctcgt | X04603 | 42997 | ctttccgcactgcatacacatttt | U33626 | 85601 | tagctcccattgagtatgcttta | AA106625 |
| 394 | tgcgttctctgtcctcccgg | X04603 | 42998 | ctgtcatacacattcacctttaa | U33626 | 85602 | gaacctgtccagtgcatccagaac | AA106625 |
| 395 | gctttgatttcagtcgggaatggcggt | X04603 | 42999 | tcatacacattcacctcacctttaatta | U33626 | 85603 | cctgaccagtcatccagaacaag | AA106625 |
| 396 | tcggaatgcgcgtcagcagatatt | X04603 | 43000 | cccagtccctactgaatcctg | U33626 | 85604 | ttagctgccctgcctgctttctc | AA106625 |
| 397 | cagatattgaagctgaccgctttt | X04603 | 43001 | cacaccaactgctttgagatcacgg | AA020222 | 85605 | gccttgcctgctgcttccctcatt | D10024 |
| 398 | tgaccgctttgaagctgacaaatg | X04603 | 43002 | gggagtccgtacacactctgcagc | AA020222 | 85606 | tctctcttatgccaaagaagtga | D10024 |
| 399 | cagtaaactgctgatctaccaaggcc | X04603 | 43003 | cggatcagtcagtcaaggccattgcc | AA020222 | 85607 | ctccttatgccaaagaagtgaaca | D10024 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 400 | X04603 | ctcctgtccatgtgaaggtgtgag | 43004 | AA020222 | atctcagtcaaaggcattgccacg | 85608 | D10024 | ggtcagtctgtgacatggagacact |
| 401 | X04603 | agaaggacaccgacaatgctggc | 43005 | AA020222 | tcagtcaaaggcattgccaagaca | 85609 | D10024 | gacatgagacattcctcttattgta |
| 402 | X04603 | cgcttctctgtcggcggacttgtg | 43006 | AA020222 | aaaggcattgccaagacatcacca | 85610 | D10024 | agacacttccttatgtactgtgt |
| 403 | X04603 | cggcggactgtgatcggcctgcat | 43007 | AA020222 | gccattgccacgacatcaccacag | 85611 | D10024 | cacttccttatgtactgtgtcgt |
| 404 | X04603 | cggcgcatgagggatgacgagacc | 43008 | AA020222 | acagcccaatggtggactactgga | 85612 | D10024 | ttcctttatgtactgtgtcgtgaa |
| 405 | X04603 | ccaaatgatccggccgaatgct | 43009 | AA020222 | ccaggatccacatgtcattgccc | 85613 | D10024 | ttagtactgtgtgaataaacc |
| 406 | X04603 | ccgaatgctgacatttgactagtc | 43010 | AA020222 | atccacatgtcattgcccaagcc | 85614 | D10024 | cagaacaaagcccctgacttcgt |
| 407 | X04603 | tgtcattcctttatgcaagtgctg | 43011 | AA020222 | attgtcattgcccaagcccctggct | 85615 | D10024 | tcagcacagtgactcacccagaagt |
| 408 | X04603 | tgaagtgtgacagagacgtccgaga | 43012 | AA020222 | gtcattgccaagcccctggctacg | 85616 | D10024 | gcacagtggatcacccagaagggc |
| 409 | X04603 | agacgcgagagacgtgctccgaag | 43013 | AA020222 | gccctgtacacactctggcagaca | 85617 | D10024 | tggatcacccagaagtgggctcacc |
| 410 | X04603 | gaaggagttccatatgccgatgcc | 43014 | AA020222 | caagccccctggctacgccaagtca | 85618 | D10024 | atcaccccagaagtggctctacctgt |
| 411 | X04603 | tgccgatgcgctaaaagcaagtgct | 43015 | AA020222 | ctgtacaacactggcagacacaca | 85619 | D10024 | accccagaagtgggctctactgtgcc |
| 412 | X04603 | tgctgtcagcaatatcctcatgct | 43016 | AA020222 | acactctggcagcacaacaaggagt | 85620 | D10024 | tctagagacttcgtctcctcactaa |
| 413 | X04603 | cctcatgctgcgatggccgctgtc | 43017 | AA020222 | ctctggcagcacaacaaggagtgac | 85621 | D10024 | atcttagctgccttgcctgcttgtt |
| 414 | X04603 | catgccaaggatggccgctgtc | 43018 | AA020222 | cacaacaaggagtcactcctgaatt | 85622 | J03928 | atgtccagactcagcctgtgtgat |
| 415 | X04603 | gttccatcagcgtaccggcgatg | 43019 | AA020222 | aaggagtcactcctgaatttcgtgg | 85623 | J03928 | cagactcgcctgtgtgatgcgcct |
| 416 | X04603 | gtaccgccgatgcttgtccgtag | 43020 | AA020222 | gtcaaaaacgccggatctcagtca | 85624 | J03928 | tggacgcgacacgccgcacctt |
| 417 | X04603 | agtagaggcacgtcgccgagatgaag | 43021 | AA020222 | aacgcccgatctcagtcaaggtca | 85625 | J03928 | cacgccgcacctgagcatagacaa |
| 418 | X04603 | atatggaacggctcagcgggagca | 43022 | U37351 | cctggcgtcagtggccttgtagca | 85626 | J03928 | geacttgagcatagacaaggtt |
| 419 | X04603 | cgggacaggccaacgattctcgtc | 43023 | U37351 | cgtcagtggccttgtagcatgatgt | 85627 | J03928 | ageggtttctgagcttactgtcacta |
| 420 | X04603 | gctccgctcattccctatgt | 43024 | U37351 | tcttcactccaaactgatatca | 85628 | J03928 | tctgagctcgtcactactgtc |
| 421 |  | ctttgatttacgattgccacgatgag | 43025 | U37351 | ctctaaactgatactcaattacgt | 85629 | J03928 | cttactgtcactactgttcctcgt |
| 422 |  | gattgcccacgatgagtgtaaaagaac | 43026 | U37351 | atttgcagttgcttcaacatgagaa | 85630 | J03928 | gctagccacagatcccagcaacgag |
| 423 |  | cggtgttgcatgcagacaggccggt | 43027 | U37351 | tagccccttgttctctattcagt | 85631 | J03928 | cacagatccacgaccgcgagggggaac |
| 424 |  | tacagcaaggtgccatggtgcc | 43028 | U37351 | tctcattcacgttgtaaataaaca | 85632 | J03928 | ggggtcgcctgctgctgggggt |
| 425 |  | cattgtccgattcgtcctgaa | 43029 | U37351 | ctgttagttacagtcttgtataga | 85633 | J03928 | ctttcagtcgaccccaatggctc |
| 426 |  | aagccgcgtgccgctgctgaaaacgat | 43030 | U37351 | ttttatcgcatgctgagttgc | 85634 | J03928 | cagcctgtgatcgatgcctgcggaa |
| 427 |  | gaaaacgaatttcatatgcagaagac | 43031 | U37351 | caatgcgaggcaggcccttaga | 85635 | J03928 | gtccggtcacagaactcaagaagaa |
| 428 |  | ctgatgaacagatttcacaattgt | 43032 | U37351 | tgagtgcagccccttagcacaga | 85636 | J03928 | atttgcacccagatccccgga |
| 429 |  | tactgccgtgaggctgaaacgctg | 43033 | U37351 | caggccttagtagcacactgggg | 85637 | J03928 | agcaccgcatgccccgggagagtg |
| 430 |  | tatgatgatgccgggaaatgact | 43034 | U37351 | tgtgcatctgcccggttaatggtc | 85638 | J03928 | cacactaccgcatcagcagcagcaga |
| 431 |  | gatatgtcaattcgtgtcatcg | 43035 | U37351 | aatggtccacctcaactgcagact | 85639 | J03928 | tcagcatcagatggcagactatgt |
| 432 |  | gttttcgtgaaggccaatgcgggcaca | 43036 | U37351 | caactgcagacctcaggtagtcgg | 85640 | J03928 | tcagcagactatgtcggggag |
| 433 |  | cgctaatgcggcaatgcgctttg | 43037 | U37351 | cagacctcaggtagctggatggaa | 85641 | J03928 | tggcagactatgtgctgggaggct |
| 434 |  | acacgctctacagtcgatggactt | 43038 | U37351 | acagcaaagcacacgtccccattg | 85642 | V00809 | ggtgattatgccaaagacaagt |
| 435 |  | tggactctgatattgataca | 43039 | U37351 | aagccacacgtcccattgcgtgg | 85643 | V00809 | tactgccaagacaagtccatct |
| 436 |  | tatctcaaaggcctggcaattgt | 43040 | U37351 | cccattgcgggtgtgtgctatt | 85644 | V00809 | gccaacaaccttcaaacttgcaga |
| 437 |  | ctcggcaatttgttgctggcagct | 43041 | U37351 | gctgtctcactcctaaactgt | 85645 | V00809 | aaattgttctgacatgcaggataa |
| 438 |  | gttgcctccgcagctgcctctggaggc | 43042 | AA020211 | gaaggtctatgcgctcctggaggcc | 85646 | V00809 | ttgttcgacatgcaggataatcc |
| 439 |  | cgcttactgtgaaggcaatggggcaca | 43043 | AA020211 | aaggtctatgcgctccttggaggct | 85647 | V00809 | tcgaggataatctctcttgtttacta |
| 440 |  | caatgcctcgtctcttcaaaag | 43044 | AA020211 | gctccttggaggctactgccaagc | 85648 | V00809 | aggtaatcctctcttactaata |
| 441 |  | gatttcggttcacaaaggccagac | 43045 | AA020211 | cgtcctggagcctactgccaagca | 85649 | V00809 | ataatcctcgttactaatagg |
| 442 |  | tttcacaaatggccactttgaagat | 43046 | AA020211 | tcctggaggctactgccaagcaca | 85650 | V00809 | atcctctcgttactaatatgggaa |
| 443 |  | tttacagttcgagctcaccgaaggag | 43047 | AA020211 | ccttggaggctactgccaagcacaa | 85651 | V00809 | atgctactggctccttccct |
| 444 |  | cacgaaaggagggccctatctctct | 43048 | AA020211 | ggtgaggctactgccaagcacaagtaccca | 85652 | V00809 | tctctccacaaacaggttagaaatt |
| 445 |  | aagagagcgctatctcattcagaa | 43049 | AA020211 | gaaggtcgtaagcttctgtccg | 85653 | V00809 | aatttcacgagattgccttgt |
| 446 |  | gagccgctatctcattcagaatt | 43050 | AA020211 | aaaggtctaagcttctgtcctcg | 85654 | V00809 | ctgcccaaagacaagtccatctgaagca |
| 447 |  | gcagcgttccgctttatctattac | 43051 | AA020211 | gctaagctctgtccgcctgccgg | 85655 | V00809 | cccaaagacaagtccatctgaagca |
| 448 |  | gctttaatgcgggagctgcgatt | 43052 | AA020211 | gctcaaatgcctggacatctct | 85656 | V00809 | gacaagtccatctgaagcaagaact |
| 449 |  | ttagagacgattacaaggcgaggcg | 43053 | AA020211 | gctcaaatgcctggaacatctctc | 85657 | V00809 | tccatctgaagcaagaactgactat |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 450 | | agagattacaagcggaggcgctgc | 43054 | M12481 | aggtctatgctccttggaggccta | 85658 | V00809 |
| 451 | | gattacaagcggaggcgctgccgg | 43055 | M12481 | ggtctatgcgtccttggaggcctac | 85659 | V00809 |
| 452 | | ccggcagcttgaacgactaaaga | 43056 | M12481 | gctatgcgtccttggaggcctact | 85660 | V00809 |
| 453 | | gcagctgaacgactaaagacaaa | 43057 | M12481 | tctatgcgtccttggaggcctactg | 85661 | V00809 |
| 454 | | gagctgccttgcagaaacgtcat | 43058 | M12481 | ctatgcgtccttggaggcctactgc | 85662 | AA106634 |
| 455 | | gaggcgctgcaagccgaatcggt | 43059 | M12481 | tatgcgtccttggaggcctactgca | 85663 | AA106634 |
| 456 | | ttaaagagatttgtgcctgca | 43060 | M12481 | atgcgtccttggaggcctactgcaa | 85664 | AA106634 |
| 457 | | ttttgcctgcagattgcaata | 43061 | M12481 | tgcgtccttgaggcctactgcaag | 85665 | AA106634 |
| 458 | | gcagatgcaatagactatgaaggct | 43062 | M12481 | gctggcagcctcacattgggaa | 85666 | AA106634 |
| 459 | | atagactatgaaggctgcgaaggcag | 43063 | M12481 | gcagccttcacattgggaaggaga | 85667 | AA106634 |
| 460 | | actatgaaggctgcgaaggcagagc | 43064 | M12481 | aatgcttagccaagaacaatgagat | 85668 | AA106634 |
| 461 | | ttaacattgtcaatgaacatgggg | 43065 | M12481 | tcccaggatctatcagactgaaggc | 85669 | AA106634 |
| 462 | | gcgagctgtactatgcgtgaatca | 43066 | M12481 | agtgttacaatcaacagcaactgt | 85670 | AA106634 |
| 463 | | atgagacaaactctgcgtgaaag | 43067 | M12481 | tacaatacaggcaactgagctg | 85671 | AA106634 |
| 464 | | tctcagctaaagcaatccatgctt | 43068 | M12481 | cacaggcaactggactgagcact | 85672 | AA106634 |
| 465 | | gtcactaaaggatttgcagcttgcg | 43069 | M12481 | tggtgcagccatgctttctctgc | 85673 | AA106634 |
| 466 | | ttgcactgtgcgcgaaatcaacag | 43070 | M12481 | cagccagctttctctgctagact | 85674 | AA106634 |
| 467 | | gcggggaatcacaggctgattacc | 43071 | M12481 | ccatgtatagccaactttcctcca | 85675 | AA106634 |
| 468 | | atcaatagacgatgtcacgtatt | 43072 | M12481 | aactttctccatcgtagtgtgat | 85676 | AA106634 |
| 469 | | acgatgtcagtattgccaagagct | 43073 | M12481 | cttacaatactgcaatactgaatat | 85677 | AA106634 |
| 470 | | gtattgccaagcttgaagctga | 43074 | M12481 | acacaacttgaccgtggccaacctc | 85678 | AA106634 |
| 471 | | gagcttgaagctgcagctcattcag | 43075 | M12481 | agtgaaacaacccagacattggctc | 85679 | AA106634 |
| 472 | | ctcagcttcatcagcttcacggtg | 43076 | M12481 | cagacatggctccacaagcacaga | 85680 | AA106634 |
| 473 | | ttcagcttcaggtgatgaaaaac | 43077 | M12481 | ttggttcacactcaccaaccacca | 85681 | AA106634 |
| 474 | | gatagctgctctcgcaagctg | 43078 | M12481 | tccaccaagcatccattacagata | 85682 | AA106634 |
| 475 | | agctgcagagctgctgtgaaatatgaa | 43079 | M12481 | ccacaagcacagatcccagaaaag | 85683 | AA106634 |
| 476 | | gcgcttcaccatcagataacaca | 43080 | M12481 | cttggcaccagatacatgtgact | 85684 | AA106634 |
| 477 | | atgtgacggttgtgattgatc | 43081 | M12481 | tccctagcacaaatgcttagccaa | 85685 | AA106634 |
| 478 | | ttgattcatcgtaaagggctcag | 43082 | M12481 | atctgctacgaacaatgcagat | 85686 | U31758 |
| 479 | | tgggaatgtgtcgcggaatatcagc | 43083 | M12481 | aatggcagatgcctccactggtt | 85687 | U31758 |
| 480 | | tgccgaaatcagcaggcggctat | 43084 | M12481 | ctgtttcttctcggcctgaatat | 85688 | U31758 |
| 481 | | aatgggctcagaaggactcctatgg | 43085 | M12481 | ctccggtcctggaaatatagaagg | 85689 | U31758 |
| 482 | | gaaggactcctatgtgggtgagag | 43086 | M12481 | taaatactggttcacactccacca | 85690 | U31758 |
| 483 | | tgggtgacgaaggccagaagaag | 43087 | M12481 | ctggttcacactccaccaagatc | 85691 | U31758 |
| 484 | | gagaggtacctgacctgaagtac | 43088 | M12481 | tccaccaagcatccattacagata | 85692 | U31758 |
| 485 | | agtaccccattgaacatgcatgt | 43089 | M12481 | accaagcatccattacagatagaa | 85693 | U31758 |
| 486 | | ttgaacatggcattgtaccaactg | 43090 | M12481 | aagcatccattacagatagaagag | 85694 | U31758 |
| 487 | | tgttaccatggcgacgatggag | 43091 | M12481 | tcagcccatgaaaggctggag | 85695 | U31758 |
| 488 | | ggagaagatctgcaccacacctc | 43092 | M12481 | gccatcttagaggctggacaag | 85696 | U31758 |
| 489 | | accacaccttcacatgagctgcg | 43093 | M12481 | caaggacagctcaccaaaggatgac | 85697 | U31758 |
| 490 | | cctttcacaagactcctatgg | 43094 | M12481 | agatgcctccactgagctcgcaa | 85698 | U31758 |
| 491 | | acaatgacgtcgtgtgtcc | 43095 | M12481 | tgcctccactgagcttcagcaa | 85699 | U31758 |
| 492 | | ccccttgagagcgtgtgcctga | 43096 | M12481 | tgagcttcagcaagttcagcatc | 85700 | U31758 |
| 493 | | accctggtgcgctcaccgagtgcgt | 43097 | M12481 | gctcagcaagtcatccgatcc | 85701 | U31758 |
| 494 | | tgaccagatcagttgagacctt | 43098 | M12481 | agtcatccgatcctcgggaaca | 85702 | AA106256 |
| 495 | | agatcatgtttgagacctcaacac | 43099 | M12481 | catccgatcctcgggaacatt | 85703 | AA106256 |
| 496 | | cccagccatgtagtagccatccag | 43100 | M12481 | cctgatcctcgggaacatttcg | 85704 | AA106256 |
| 497 | | gtacttagccatccaggctgtgcg | 43101 | M12481 | aggagcctgtttcttcctggtctg | 85705 | AA106256 |
| 498 | | cctaaccaggctgctgccctga | 43102 | M12481 | ctctttaagcctccagtgttagttat | 85706 | AA106256 |
| 499 | | gctgccaggctgctgatgcctgt | 43103 | M12481 | tttaagcctccagtgttagttattg | 85707 | AA106256 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 500 | gtatgcctcggtgtaccacggc | M12481 | 43104 | atctatacattcgaagctgcaa | AA020264 | 85708 | agtggctcgtcaatgccaattgc | AA106256 |
| 501 | gtcgtaccacggcgcattgatgga | M12481 | 43105 | aggcctagacttgatcagtgtcagg | AA020264 | 85709 | tccgtcaatgccaattgcatgca | AA106256 |
| 502 | tgcccactacgagggctatgtct | M12481 | 43106 | gacttgatcagtgtcaggctggttg | AA020264 | 85710 | gtcaatgccaatttgcatggcagca | AA106256 |
| 503 | cctcacgccatccgcgtctggact | M12481 | 43107 | ctgatcagtgtcaggctggttgc | AA020264 | 85711 | aatgccaatttgcatggcagcagca | AA106256 |
| 504 | ccatccggtcggactggtcgg | M12481 | 43108 | ttgatcagtcaggctggttgtca | AA020264 | 85712 | aatttgcatggcagcaaggattct | AA106256 |
| 505 | ctgacggactacctcatgaagatcc | M12481 | 43109 | gatcagtcaggctggtgtgtcaat | AA020264 | 85713 | gaaacgactgtacctgggtgtacat | AA106256 |
| 506 | actacctgaagatcctgaccga | M12481 | 43110 | atcagtcaggctggttgtcaatt | AA020264 | 85714 | tcgcagatcatcatcctgacccta | AA106256 |
| 507 | tcatgaagatcctgaccgagctgtg | M12481 | 43111 | cagtcaggctgttgtcaattt | AA020264 | 85715 | cgagatcatcatcctgacctact | AA106256 |
| 508 | tcctgacgagctggctacagtt | M12481 | 43112 | agtgcaggctggttgtcaatttg | AA020264 | 85716 | acgtccgtgactaggtctacgg | AA106256 |
| 509 | gcttcaccaccagctgagaggga | M12481 | 43113 | tgtcaggctggtgtcaatttgat | AA020264 | 85717 | cgtgactatggtctacggctagtc | AA106256 |
| 510 | gaaactgtgcgtgacatcaaagaga | M12481 | 43114 | taagcctccagtgtagtattgtg | AA020264 | 85718 | tggtctacggctagtccaaactg | AA106256 |
| 511 | agctgtcgtatgtgctctagact | M12481 | 43115 | aagcctccagttgtagtattgtgg | AA020264 | 85719 | tctacggctagtccaaacctgtag | AA106256 |
| 512 | gctatgttgcctctagact | M12481 | 43116 | gcctccagtgtagtattgtggga | AA020264 | 85720 | agtcctgcctagcctagcctaaacctg | AA106256 |
| 513 | ctctagacttcgagcaggaggagc | M12481 | 43117 | tttgtggactgcaactgacaggagcag | AA020264 | 85721 | ctgcctgctagcctaaacctggca | AA106256 |
| 514 | caggatgcccactgccgcatcct | M12481 | 43118 | aaggcatactacatccattcgagaag | AA020264 | 85722 | tgcagtccccgtggaggagacagt | AA106256 |
| 515 | agaagagctatgaggctgcctgacgg | M12481 | 43119 | agcatatcatacattcggagaagt | AA020264 | 85723 | cagtcccgtggaggaacgttg | AA106256 |
| 516 | atgagctgcctgacgcccaagtcat | M12481 | 43120 | catatctatacattcggagagtcg | AA020264 | 85724 | aaggagctgcgtctgactctg | AA106256 |
| 517 | tgcctgacgcccaagtcatcactat | M12481 | 43121 | atatctatacattcggagaagtcgc | AA020264 | 85725 | gagctgctggctgctgactctgcc | AA106256 |
| 518 | gccaagtcatcactattggcaacga | M12481 | 43122 | cagatctccagttgagacttcatt | AA020264 | 85726 | ctggctgtcgactctgccctctagc | AA106256 |
| 519 | atcactattggcaacgagcggttcc | M12481 | 43123 | agacttcattccttgtccagtgga | AA020264 | 85727 | ctgctgacctgtcgggctccctcagaag | AA106256 |
| 520 | ggcaacgagcggttccgatgccctg | M12481 | 43124 | ggttccaaaatgcgcagcaaggat | AA020264 | 85728 | tgccctaagcggcctccaagtcagag | AA106256 |
| 521 | ttccatgccctgagctctttc | M12481 | 43125 | tccaaaatgcgcgagcaaagatgaa | AA020264 | 85729 | ctctagagggcctccaagaggcca | AA106256 |
| 522 | tgcctgaggctctttcagcct | M12481 | 43126 | cctcaaccagatctctgaaata | AA020264 | 85730 | ccacactgttcacaagccagtg | AA106256 |
| 523 | aactacattccaattcatcatgaag | M12481 | 43127 | accagatctctgaaatagtggaga | AA020264 | 85731 | tcacaagccagtgctcgtaggagt | AA106256 |
| 524 | ttccatcatgaagttggacttgac | M12481 | 43128 | gttgctctcctccagttgtgac | AA020264 | 85732 | acaagccagtcgtctgtagggttgg | AA106256 |
| 525 | tgaatccgtaaagaccctatgc | M12481 | 43129 | tctccagtttatagtacagaga | AA020264 | 85733 | aagccagtgctctgtagagggtggg | AA106256 |
| 526 | gacctatgccaacagtgttgt | M12481 | 43130 | aatgttacagtctctccctgtatct | AA020264 | 85734 | gtcctcgtgagagacagttgag | AA106256 |
| 527 | cacagtgtcgtggtaccaac | M12481 | 43131 | gtctcctcgtatctaatctagat | AA020264 | 85735 | aatgagctgtatttccagtgtgc | AA106256 |
| 528 | accatgtaccagccagtgctgca | M12481 | 43132 | ctctcgtatctaatctagattt | AA020264 | 85736 | tattcccagtgtcacagtggtt | AA106256 |
| 529 | aggcattgtgacaggatgcagaag | M12481 | 43133 | agattttgcattcttttctgaaat | AA020264 | 85737 | ccagttgcacgtgtcgtgggaggc | AA106256 |
| 530 | aagagattactgctctgcctccta | M12481 | 43134 | cattctgtccagtggatcaccc | AA020264 | 85738 | tgcacagtgctgtggagctgcatg | AA106256 |
| 531 | acgtcctgcctctagcaccatga | M12481 | 43135 | ctgtccagtggatcaccaaggcc | AA020264 | 85739 | cacagtcgtggaggctgatgg | AA106256 |
| 532 | tcctagcaccatgaagatcaagatc | M12481 | 43136 | tggatcaccaaggatcacagaaag | AA020264 | 85740 | ctgaatgccccgcgtgaagagact | AA106256 |
| 533 | gatcaagatcatgctcctctgg | M12481 | 43137 | cagcctcgaaaacacgtcttgaa | AA020264 | 85741 | tgaggcgtgtggcgcttgaact | AA106256 |
| 534 | tgctcctctgagcgcaagtactct | M12481 | 43138 | tcaccgaaccaggtcgaagtatt | AA020264 | 85742 | agcaaaaatgatccactgatgcca | AA106256 |
| 535 | cctgagcgcaagtactctgtgtga | M12481 | 43139 | gagtgaactgctacccgcaattga | AA020264 | 85743 | atggatccactgatgccaagtatc | AA106256 |
| 536 | gtactctgtgtgaggaccctcc | M12481 | 43140 | gctacccgcattgacatcagaga | AA020264 | 85744 | ttcttcactgtgctgctctcaca | U43076 |
| 537 | gtggatgcgtgggcctctggcc | M12481 | 43141 | acctgcatgacatcacagagga | AA020264 | 85745 | agcgctcatggaagactctgctctg | U43076 |
| 538 | ggctcatctggcctcactgcca | M12481 | 43142 | ctgactccaaaatcacacgctgc | AA020278 | 85746 | catgagactctgctctgggtta | U43076 |
| 539 | cttccagatgtggatacacaag | M12481 | 43143 | cacagcctgccacagcagattgt | AA020278 | 85747 | agatgccagttgccagggtcaccg | U43076 |
| 540 | tcctagcaacggcaggatacgatg | M12481 | 43144 | agtcctgcctgttgtgaat | AA020278 | 85748 | ggatacaaatgtcccatctaggca | U43076 |
| 541 | catctgcacgcagtgcttctag | M12481 | 43145 | cctcgcctgtggttctgaatcg | AA020278 | 85749 | aatgtcccatctaggcaaggtc | U43076 |
| 542 | cgcaagtgcttctaggggactctt | M12481 | 43146 | gcctgtgttcgtgaatctgact | AA020278 | 85750 | tgtctatggtattgtcactgt | U43076 |
| 543 | ggcgactgctacggcacgttt | M12481 | 43147 | cttgtttgctgaatctgacttg | AA020278 | 85751 | cctgaactggcaacactggccaat | U43076 |
| 544 | tgccgtatggaggcgctcaccc | M32599 | 43148 | tctgaatctgactttgctccggta | AA020278 | 85752 | gtcaataacaagtctcaatataacg | U43076 |
| 545 | tggctcaccagctgccattgcag | M32599 | 43149 | gaatctgactttgcttccggtacaa | AA020278 | 85753 | gtcaataacagtctcaggtctg | U43076 |
| 546 | ccatttgcagttgcaagtgggat | M32599 | 43150 | tctgactttgcttccggtacaaca | AA020278 | 85754 | cccactgcaagtatcaacag | U43076 |
| 547 | ccttcattgacctcaactacagt | M32599 | 43151 | gcttccgtacaaacaggccacctg | AA020278 | 85755 | aagtatcacatgcagcgttgcacg | U43076 |
| 548 | tgacctcaactacatggtcaacagt | M32599 | 43152 | tccggtacaaacaggccacctggag | AA020278 | 85756 | caggttgcatcgatctggctct | U43076 |
| 549 | actactaacatggttccagta | M32599 | 43153 | ggtacaacaggccacctgagact | AA020278 | 85757 | tgcagacttcggctctggggtcc | U43076 |

| SEQ ID NO | sequence | DBAxnID | SEQ ID NO | sequence | DBAxnID | SEQ ID NO | sequence | DBAxnID |
|---|---|---|---|---|---|---|---|---|
| 550 | ctacatgttccagtatgactccact | M32599 | 43154 | agcctgccacgcagcagattgctaaa | AA020278 | 85758 | tgggtcccaactccaagtctggtg | U43076 |
| 551 | tccagtatgactccactcacggcaa | M32599 | 43155 | ctgccacgcagcagattgctaaaag | AA020278 | 85759 | gtcagtgcgtgaccctctccggaa | U43076 |
| 552 | ctccactcacggcaaattcaacggc | M32599 | 43156 | gtccactcatgccctgtacccagg | AA020278 | 85760 | aacttagccaccatgccctagctc | U43076 |
| 553 | tcactcacggcaaattcaacggcagtc | M32599 | 43157 | atgccctgtacccaggcccctagcag | AA020278 | 85761 | cccaactcttcactgtgctgctc | U43076 |
| 554 | caacggcacagtcaaggccgagaat | M32599 | 43158 | ggtcagaggcctgagtccgcctg | AA020278 | 85762 | actgtctcatcaaggaaaaattgt | U43076 |
| 555 | tgggaagctgtcatcaacgggaag | M32599 | 43159 | cagagcctgagtccgcctgcctgtg | AA020278 | 85763 | catcagtttattctccgacacaa | U56650 |
| 556 | gctgtcatcaacgggaagccatc | M32599 | 43160 | agcctgagtccgcctgtggttct | AA020278 | 85764 | agagtcatggtccgttatgttc | U56650 |
| 557 | agccatcaacatcttccaggagccg | M32599 | 43161 | ctgagtccgcctgttggtctg | AA020278 | 85765 | tatgttccaaaccattaaggtcat | U56650 |
| 558 | ccatcaacatcttccaggagccgc | M32599 | 43162 | caggtcaccctagaatcagatctgctc | AA020278 | 85766 | tctgattccaattcaacaggtct | U56650 |
| 559 | gcgagaccccataacatcaaatgg | M32599 | 43163 | ggtcaccctagaatcagatctgct | AA020278 | 85767 | ttcacattatctttacagttga | U56650 |
| 560 | ctagtatgtgtggagtctactg | M32599 | 43164 | ctgctactttgatggccatgacgg | AA020278 | 85768 | actacaattaccalagtgagagacc | U56650 |
| 561 | tgtcgtggatcactggtgtctc | M32599 | 43165 | ctacttgatggccatgacgggct | AA020278 | 85769 | agagacatactatcttttggata | U56650 |
| 562 | agtctactggtctcttcaccacat | M32599 | 43166 | atggccatgacggggctgagcctgcc | AA020278 | 85770 | ttctccaatgtaatagaaatgaa | U56650 |
| 563 | gggggtagcaaggtgtcatc | M32599 | 43167 | gccatgacggggctgagcgctgcctg | AA020278 | 85771 | catgttacttacctaggaatgctc | U56650 |
| 564 | agccaaacgggtcatcatctccgcc | M32599 | 43168 | atgacggggctgagcgcctgtga | AA020278 | 85772 | acagtgccagattccatgcgcaaa | U56650 |
| 565 | ggtgtgaaccacgagaaaatatgaca | M32599 | 43169 | aggatcatcggctctggtgaagg | AA020278 | 85773 | gactgccaattccctgccagattc | U56650 |
| 566 | tatgcaacaatcaacagattgtca | M32599 | 43170 | atcatccgcctctggtgaggaa | AA020278 | 85774 | atttccgacaatccaacaggtct | U56650 |
| 567 | ctcactcaagattgtcagcaatga | M32599 | 43171 | atccgcctctggtgaaggagaagg | AA020278 | 85775 | gacacaatttcaacaggtctgggcaa | U56650 |
| 568 | aagatgtcagcaatgcatcctga | M32599 | 43172 | gtctgacaaggcctcggaccag | AA020278 | 85776 | atgtttcagtgagctggtacctcc | U56650 |
| 569 | ccctgccaaggtcatccatgaca | M32599 | 43173 | gacaaggcctcggaccagaattga | AA020278 | 85777 | aatctttaactgccatatgagta | U56650 |
| 570 | catccatgacacattggcattgg | M32599 | 43174 | cctagaatcagatcgtcctcccagc | AA020278 | 85778 | ctttgccaattgcgaccatccaa | U56650 |
| 571 | caacttgcattgggaaggcctc | M32599 | 43175 | gctcccagcatctctgttcctg | AA020278 | 85779 | gcaatttgaccccatccaaaatctg | U56650 |
| 572 | gaagggctcagccactgccatg | M32599 | 43176 | ccccagcatctctgttcctggtg | AA020278 | 85780 | tcgaccatccaaaatctgctacca | U56650 |
| 573 | catgaccacagtccatgccatcat | M32599 | 43177 | cagatctcgtttcctggagt | AA020278 | 85781 | ggtcacactgtgccggaatgtg | U56651 |
| 574 | atcacgccacagtccatgccatcatgg | M32599 | 43178 | catctctgtttcctggagtgat | AA020278 | 85782 | gaatgtgtcacctgctgctctg | U56651 |
| 575 | gactgggatgcccctctcaggtgg | M32599 | 43179 | ctgttcctggtgagtgattcctgc | AA020278 | 85783 | ataactccactgctcaaggggattgt | U56651 |
| 576 | ggcccctctcgaaggtgtgcgctg | M32599 | 43180 | tgatctctgctactttggatgccca | AA020278 | 85784 | tgtccggctctctcaagcctt | U56651 |
| 577 | ccgtggggctgccagaacatcatc | M32599 | 43181 | ttcctgctactttggatgcccatga | AA020278 | 85785 | gctctaagccctcaaggtgatctg | U56651 |
| 578 | gccagaacatcatcctcccgcatcca | M32599 | 43182 | gtaatcaaatcgcctcctccact | AA020278 | 85786 | tatgcctgcactaactatcacag | U56651 |
| 579 | tgcatccactgggtctgcaagct | M32599 | 43183 | tcaaaatcctctccactctg | AA020278 | 85787 | ctgactacaactatcaactgacaac | U56651 |
| 580 | ggcaaggtcatccagagcctgaacg | M32599 | 43184 | cccactggggaacgatcatcaat | AA020278 | 85788 | atcacagtgacaaccttactttcc | U56651 |
| 581 | cccagagcctgaacggaagctcact | M32599 | 43185 | ggatcatcaatgcctcttccaga | AA020278 | 85789 | ctgagactgaagccttgcggagttaa | U56651 |
| 582 | gaacggaagcctcactgccatggcc | M32599 | 43186 | catcaatgcctcttttccagagga | AA020278 | 85790 | ggtcacactgttgccctgaatgtg | U56651 |
| 583 | tggcatggcctccctgtctctacc | M32599 | 43187 | tcaatgcctcttttccagagggga | AA020278 | 85791 | gaatgtgtcacctgctgcttg | U56651 |
| 584 | tctgacgctgccgccgtgagaaactt | M32599 | 43188 | aggtaaacttcccgtcgattcatgcg | AA020278 | 85792 | gtctacctgctgctctgttgact | U56651 |
| 585 | gagaaacttcccgtcgattcatgacga | M32599 | 43189 | gtaaacttcccgtcgattcatgcgaa | AA020278 | 85793 | tggttgcacacactgctaggaaaac | U56651 |
| 586 | ggcaatctgagggccccagcagggc | M32599 | 43190 | aaactcccgtcgattcatgcgaact | AA020278 | 85794 | atttggcaacaaccgcgattga | U56651 |
| 587 | ggcccctgaagggcatctgggcc | M32599 | 43191 | ggatctcaggaactcgatggggct | AA020278 | 85795 | aagatcaagtcctccaactgg | U56651 |
| 588 | cactgaagggctctctgggctacac | M32599 | 43192 | tcagtgaactgtcattccg | AA020278 | 85796 | cctctaactgtcgcattgagtatga | U56651 |
| 589 | tggctacacgtgaggaccaggtgt | M32599 | 43193 | atgcgaactggtctcattcgcc | AA020278 | 85797 | tgtcgcattgagtatgagaaggt | U56651 |
| 590 | actggggaccaggtgtctctctg | M32599 | 43194 | aaatctgctccctccactccgag | AA020278 | 85798 | ttgacaaggccaacaagaacaacact | U56651 |
| 591 | ccaggtgtctctgtgctacctcac | M32599 | 43195 | atctgctccctccactctgagttg | AA020278 | 85799 | aggcaccaaggaacaacactctgcaa | U56651 |
| 592 | ttgctccttgggactcaacgaa | M32599 | 43196 | ccacttcctgagttgggtcaagaaac | AA020278 | 85800 | ccaagaacacactctcaactacga | U56651 |
| 593 | tgcgactcaaacgcaactcccat | M32599 | 43197 | gaaacactttccaagttcagttatt | AA020278 | 85801 | cctgtatccaggagagaccaaag | U56651 |
| 594 | cggagctccggaactttcaatgac | M32599 | 43198 | tataattgccacagaagtaaaatc | AA020278 | 85802 | agtcctttcaacttgttattcgg | U56651 |
| 595 | gcattgctccaatggtgt | M32599 | 43199 | taattgccacagaagtataaattc | AA020278 | 85803 | tgggtggtgctggaaagac | U76546 |
| 596 | caatgacaacttgtcaagcttcatt | M32599 | 43200 | taatttgccacagaagtaaaattcc | AA020278 | 85804 | tggactctgtgaltgtgagagat | U76546 |
| 597 | caacttgtcaagctcattcctg | M32599 | 43201 | attccagaactgcatcaaccaac | AA020278 | 85805 | atcaggaagtccctgctctatagt | U76546 |
| 598 | actgactcattcctgatgaccaatg | M32599 | 43202 | caccatccagtcagtcagtaagtcactgt | U50406 | 85806 | gagtcctgtggctacttatagtgctaa | U76546 |
| 599 | tgacaatgaatacggcacagcaac | M32599 | 43203 | ctcagttaaagtccgacagtcatt | U50406 | 85807 | actgcctgtctctctcagattga | U76546 |

| SEQ ID NO | sequence | DBAxnID | SEQ ID NO | sequence | DBAxnID | SEQ ID NO | sequence | DBAxnID |
|---|---|---|---|---|---|---|---|---|
| 600 | atacggctacagcaacaggggtg | M32599 | 43204 | agaagtgcctggcctactacatat | U50406 | 85808 | ctctcagagattgagaagtgtt | U76546 |
| 601 | ggtggacctcatggctacatggcc | M32599 | 43205 | gctggcctacctacatagtggc | U50406 | 85809 | aactggctcatcgactcctggca | U76546 |
| 602 | acctcatggcctacaggcctccaa | M32599 | 43206 | ctgaaatccagcacttgagagtg | U50406 | 85810 | tgagctcatcgactcctggcatct | U76546 |
| 603 | acccaccccagcagcaactgagc | M32599 | 43207 | tcctagcactgagagttgagaact | U50406 | 85811 | catcgactcctggcatcgcagcc | U76546 |
| 604 | cccagcaaggacactgagcaagag | M32599 | 43208 | tgcacttacagcagcctgagtac | U50406 | 85812 | tgcagccacctgcaatcatagg | U76546 |
| 605 | ggacactgagccaagagaggccctat | M32599 | 43209 | cagcctgagctacaaatgagatgtt | U50406 | 85813 | ccacctgcaatcatcaggagagtgg | U76546 |
| 606 | tccctcacaattccatccagacc | M32599 | 43210 | ttcccaaaacacacaaaagcaag | U50406 | 85814 | acaggctgcagttcaacgaattgt | U76546 |
| 607 | tcaaccagtcagcattcctcac | X57349 | 43211 | aagcaagtgccttaccgaggata | U50406 | 85815 | gcaattccaaaacagtcacttttca | U76546 |
| 608 | tttagctgtcggcaagtagalg | X57349 | 43212 | gtgcttacctggtcaagtaaatgt | U50406 | 85816 | ccaaaacagtcacttctacttctg | U76546 |
| 609 | agataacgtcatgtgagatgaaa | X57349 | 43213 | ttacagccctgggtgctagttgta | U50406 | 85817 | cagtcacttcacttcttgggatgt | U76546 |
| 610 | aatggaagactgcttgcagtca | X57349 | 43214 | taagtcacttggttcctacagtt | U50406 | 85818 | ctttcacttcgggatgtaggtgg | U76546 |
| 611 | actctgcttgcagaccatcagtg | X57349 | 43215 | ttgccttacagttggccaagaggac | U50406 | 85819 | ttcacttctgggattgtaggtggtca | U76546 |
| 612 | tctcttgattcatgagtgg | X57349 | 43216 | agagggacatctgttcacatcctg | U50406 | 85820 | ggaagtcataccaccgatgcaacaga | U76546 |
| 613 | ttcatggtgctacctgggctatt | X57349 | 43217 | atccttggaggccatcagacagcag | U50406 | 85821 | catacaccgatgcacagatggtat | U18372 |
| 614 | tggtacctgggctatgttaagcgt | X57349 | 43218 | caagacccctggaggactgtggt | U50406 | 85822 | ttacccctgggcatccctcattctac | U18372 |
| 615 | aaacagagatgttctacatcatc | X57349 | 43219 | ggtagcacctgctccatgggt | U50406 | 85823 | tcctcattctactcaggcggtccg | U18372 |
| 616 | cctacatcatccgctatatggg | X57349 | 43220 | acctgcctccatggtggtctgtaa | U50406 | 85824 | gcgctgcactccagaaggtggct | U18372 |
| 617 | atctcgtctatattgggcagacctc | X57349 | 43221 | cctccatgggtctgtaagaagtg | U50406 | 85825 | agagcctccagaaggtggctgcacaa | U18372 |
| 618 | agacctcaaaacactgttcagag | X57349 | 43222 | tcctctttggtctcagaacaggcct | AA020296 | 85826 | tgcacaacaatatcatctccatagt | U18372 |
| 619 | gaagttgaactcatagagttgct | X57349 | 43223 | ttggtctcgaacaggcctagagggc | AA020296 | 85827 | acaatatcatctccatagtgggaat | U18372 |
| 620 | catagagtttgtgacaccatcag | X57349 | 43224 | gtggcattgtgtgcccctttcctg | AA020296 | 85828 | tcatctccatagtgggaatcgtct | U18372 |
| 621 | tgacaccatcaagcagctgagcag | X57349 | 43225 | gctatttgtgccccttcctggg | AA020296 | 85829 | agtcggtcatgacgctcaat | U18372 |
| 622 | aagcagctgagccagaataacataca | X57349 | 43226 | tgccccttcctgcgctgatgatg | AA020296 | 85830 | gcttcatgacgctcaatatcct | U18372 |
| 623 | gaataacataactcctgtgaggt | X57349 | 43227 | ccctttctgcgctgatgggga | AA020296 | 85831 | tgacgctcaatattccgtgtag | U18372 |
| 624 | acactcctgtgaggctgatctca | X57349 | 43228 | gggacaggactgctctgatgctggga | AA020296 | 85832 | gaaatcgtcatacgtctatgacgg | U18372 |
| 625 | atgattaaatctcagcaaagtcg | X57349 | 43229 | accaggactgctctgatgggagcag | AA020296 | 85833 | tggatcacgtctatgacgctgag | U18372 |
| 626 | tcagcaaagtctgcgagatgaaca | X57349 | 43230 | actgctctgatcggcagtcgagga | AA020296 | 85834 | agagctaccgcacgaatccgatga | U18372 |
| 627 | gcagcatttgcaaaacatggtgac | X57349 | 43231 | gcagcattgtcaaaacatggtgac | AA020296 | 85835 | acccagcagaatccgatgatgacagc | U18372 |
| 628 | catgctcatctagagaactgtgat | X57349 | 43232 | agtcagttcagaatggcaagtg | AA020296 | 85836 | cacagtccaagtcgcacgatgtga | U18372 |
| 629 | ggtgatccatacacaccctggttc | X57349 | 43233 | catggtccaagatggcagtccag | AA020296 | 85837 | actgaacaaggcccagatgctgaa | U18372 |
| 630 | ttcctctttcatcatactagtgt | X57349 | 43234 | gggtccaagctctccggtctagagc | AA020296 | 85838 | acaaggccagatgcggaacgcgaa | U18372 |
| 631 | ctcatatcagttccgcccatcca | X57349 | 43235 | aagtccggctcagtgactc | AA020296 | 85839 | acaactccaccgtctttgataagct | U18372 |
| 632 | gttccgccatctcagtcatcagg | X57349 | 43236 | gctctagagctgactcctgccccga | AA020296 | 85840 | atgactccaccgtctttgataagct | U18372 |
| 633 | tctcagctcatcaggttgcctaata | X57349 | 43237 | ctagagtcgactctgcccgacaga | AA020296 | 85841 | tatgtgactccctgcaaagccca | U18372 |
| 634 | cctaatatacctgcaaacaatct | X57349 | 43238 | cagcacctccagtgtcttaccag | AA020296 | 85842 | gacaaggctagccgatgcgaga | AA106291 |
| 635 | ctgtcaaacaatctcaagagctgc | X57349 | 43239 | acaccttccagtgtcttaccag | AA020296 | 85843 | aggatgctagccgatgcgagagcc | AA106291 |
| 636 | aagagctgtcgaaaaagctatttt | X57349 | 43240 | agtgcttaccagtggctattgt | AA020296 | 85844 | tgccttgtgcacagatgtcga | AA106291 |
| 637 | ctgtcctagagaaaacatggctgt | X57349 | 43241 | gtcttaccagtggctattgtgt | AA020296 | 85845 | tcgttgaccacgatgtgaccaat | AA106291 |
| 638 | catagatttcatgtaagctgaa | X57349 | 43242 | gtatttcttgccacaccacccg | AA020296 | 85846 | acacgatgtgaccaagtcagca | AA106291 |
| 639 | gtaagctgaactttcacagaatca | X57349 | 43243 | tttcctaaacatagagaagtccac | AA020296 | 85847 | tgtgaccaagtccagcaataagt | AA106291 |
| 640 | tatgttgtagtaggcccagagag | X57349 | 43244 | ttacaaactgcttgcgtccagccgg | U05252 | 85848 | ctgaccaagtcagcaataagttgc | AA106291 |
| 641 | ggaggccagagagacgcttggtg | X57349 | 43245 | ttgtgtcaagggctgcaccaggt | U05252 | 85849 | accaagtcagcaataagttgcagg | AA106291 |
| 642 | gtgttgcgggaagtcagtgtggg | X57349 | 43246 | gctgcaccaggtgttaccctgt | U05252 | 85850 | ttgcaggtcccaagtcacacgagg | AA106291 |
| 643 | gaaactgcccaagtattccagat | X57349 | 43247 | gcaaccaggtgttgtacctgcag | U05252 | 85851 | caggtcccaagtcacacgaggact | AA106291 |
| 644 | agtattccagatgattcaaaa | X57349 | 43248 | tgttacccagtggctatgtgt | U05252 | 85852 | taaaggttaccaccgaggctgg | AA106291 |
| 645 | cagaagtataatctttgcaaga | X57349 | 43249 | accctggtccacacacacacggg | U05252 | 85853 | cttaccaccgaggctggagaact | AA106291 |
| 646 | ctttgccagtgactgccaggcgac | X57349 | 43250 | accgttcagcagatgatcacagtaaa | U05252 | 85854 | atgctagccgatgcggagcgga | AA106291 |
| 647 | ctgaggcggactttggagctgttgg | X57349 | 43251 | attattctggagctcaaaatagca | U05252 | 85855 | cagctcaaatgcaaaccaaaagcc | AA106291 |
| 648 | ttcatcttgcatttaaagttc | X57349 | 43252 | atttaaacttctgtgttattga | U05252 | 85856 | caaaccaaagccaggtgagcaggc | AA106291 |
| 649 | tcgaaagttcctcagtcaaccaa | X57349 | 43253 | ataacttctgtgtttatgattgc | U05252 | 85857 | ctctgaatcgctctggcattat | AA106291 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 650 | X57349 | aatggtcgtacagcagcggaagtg | 43254 | U05252 | atgagaagtcacccttgtgttcact | 85858 | AA106291 |
| 651 | X57349 | ggaagtggctgctcagctcattatt | 43255 | U05252 | ccacctgttcgttcactcagacaaac | 85859 | AA106291 |
| 652 | X57349 | tcagctcattattaaactttaccccat | 43256 | U05252 | tgtgttcactcagacaaacctttcat | 85860 | AA106291 |
| 653 | X57349 | tgaattgaacctgactactgagagatg | 43257 | U05252 | cactcagacaaacctttcattgttta | 85861 | AA106291 |
| 654 | X57349 | taacagaaactactgtcatttatg | 43258 | U05252 | tcagacaaacctttcattgttattg | 85862 | AA106291 |
| 655 | X57349 | gaaccagttcaaaaacagatatcagg | 43259 | U05252 | aatcttggaaactgcacaaacag | 85863 | D88577 |
| 656 | X57349 | tatgggtctaagttctacagtggctg | 43260 | U05252 | agcgccagcactcaaggttttact | 85864 | D88577 |
| 657 | X57349 | tctacagtgcgtgtattccgctcgt | 43261 | U05252 | agcccagcactcaaggttttactgg | 85865 | D88577 |
| 658 | X57349 | gtattccgctcgggagactactc | 43262 | U05252 | tggccagcagcaacagcagcactg | 85866 | D88577 |
| 659 | X57349 | tgctactctagataacaactgat | 43263 | U05252 | gcagcaaccagcagcactgagagca | 85867 | D88577 |
| 660 | X57349 | tgatttcataatgctgagaaaaca | 43264 | U05252 | gcctgctacgggaaggatggagact | 85868 | D88577 |
| 661 | X57349 | aggggatgtcacttcctgctcgccc | 43265 | U46854 | tttgtcctcacagcatgcacaatg | 85869 | D88577 |
| 662 | X57349 | cttcctgcctatgtatctca | 43266 | U46854 | gtctttgacagcatcagccacctca | 85870 | D88577 |
| 663 | X57349 | ctatgtatctccaagagagtctct | 43267 | U46854 | gacagcatcagccacctcatcaatt | 85871 | D88577 |
| 664 | X57349 | agagtctctttccgacatatctc | 43268 | U46854 | cacctcatcaattacacctcgaga | 85872 | D88577 |
| 665 | X57349 | ctgggctctggatctcacactctc | 43269 | U46854 | atcaattacacctcgagagcagcc | 85873 | D88577 |
| 666 | X57349 | tctccagcttagtgggagaactg | 43270 | U46854 | ctcgagagcagctgccactgtct | 85874 | D88577 |
| 667 | X57349 | tactggactattcaggagtcgca | 43271 | U46854 | atgtctctgcggagtgagttt | 85875 | D88577 |
| 668 | X57349 | gggagtcgcaaatgccctctggt | 43272 | U46854 | tgtctccagcaaccagtgagagga | 85876 | D88577 |
| 669 | X57349 | cctctcggtgacatttggaatatt | 43273 | U46854 | cttatgccaggtcaggaagactggc | 85877 | D88577 |
| 670 | L09192 | ctagttggctgactgaacaagatg | 43274 | U46854 | accagcagcactgagagcgccac | 85878 | D88577 |
| 671 | L09192 | gaggctccgagttgtcgcgatcc | 43275 | U46854 | actgtcgtgagcatcacattaaag | 85879 | D88577 |
| 672 | L09192 | agagtgagattgccatccgagtgt | 43276 | U46854 | agcactgagacgcccacggaaagg | 85880 | AA106010 |
| 673 | L09192 | catccgagtgtttcgctgcgtgca | 43277 | U46854 | ctggcccagttgagcaaagccg | 85881 | AA106010 |
| 674 | L09192 | gtgacagagctgggtatccgcaca | 43278 | U46854 | aaagccgctgtgtctggagtgatca | 85882 | AA106010 |
| 675 | L09192 | ccgcacagtcgcaggcgctactcggaa | 43279 | U46854 | tgcatccgccgtcacaccccagag | 85883 | AA106010 |
| 676 | L09192 | gctgtctactcggagcaggacacag | 43280 | U46854 | gatgccaggatgctggaggagctta | 85884 | AA106010 |
| 677 | L09192 | gagcaggacacagcgcgatgcaca | 43281 | U46854 | aacgctgagccctggtaccaaggag | 85885 | AA106010 |
| 678 | L09192 | gaggcagagatgacacagcgagaaagc | 43282 | U46854 | gagccctgccaaggagagaatga | 85886 | AA106010 |
| 679 | L09192 | ctgatgaagcctacctatggccg | 43283 | U46854 | tattctgcccaaggtcaacac | 85887 | AA106010 |
| 680 | L09192 | tattggccgtggccctgcaactgtg | 43284 | U46854 | tgtgcccaaggtcaacaccacatgc | 85888 | AA106010 |
| 681 | L09192 | gcacctgcaggcctactgcaca | 43285 | U46854 | cctacgagtcagagcagtgggtgt | 85889 | AA106010 |
| 682 | L09192 | atcccacatatcaagctggtgca | 43286 | U46854 | gtacagcgcaagctcaagctgtagta | 85890 | AA106010 |
| 683 | L09192 | ggtgtatccgctatggggttcctc | 43287 | U46854 | ggcactcaagctgtatgtagaaaca | 85891 | AA106010 |
| 684 | L09192 | ctctcgagagcgagcagactttgccc | 43288 | U46854 | agctctggtgtgtcagcagaagcac | 85892 | AA106010 |
| 685 | L09192 | ccgggccattgccatcgctgcggc | 43289 | U46854 | agaatgctagtcatttgtgtctaca | 85893 | AA106010 |
| 686 | L09192 | tcagctcccgccatcggccagga | 43290 | U46854 | atgctagtcatttgtctacaga | 85894 | AA106010 |
| 687 | L09192 | acgagcgcatgatggtctccaacaa | 43291 | U46854 | gctcatttgtgtctacagattg | 85895 | AA106010 |
| 688 | L09192 | gcttccctatatctttcaaggccgc | 43292 | U46854 | agtactcagagtactgccctacac | 85896 | AA106010 |
| 689 | L09192 | tgcgggtctgtcagctatgagga | 43293 | U46854 | ccagtagctcctactacagggct | 85897 | AA106010 |
| 690 | L09192 | gaatagctagaggggttgaagag | 43294 | U46854 | gactcctacatcgggctctcag | 85898 | AA106010 |
| 691 | L09192 | ccgcatcaatggctgccattcag | 43295 | U46854 | ccaagtcaacaactgccagtc | 85899 | AA106010 |
| 692 | L09192 | gccatcagtgtcgggtcacccacg | 43296 | U46854 | acacacatgcaacacatgcccggtcag | 85900 | AA106010 |
| 693 | L09192 | ccgcctgacaacgcctctgcatc | 43297 | U46854 | cacatgcccagtcctgggtcagtcc | 85901 | AA106010 |
| 694 | L09192 | gcctctgcatttccaggcgctgtc | 43298 | U46854 | ggtgttatcaaccggaaagcctct | 85902 | AA106010 |
| 695 | L09192 | ctctctgctcaaggtcattgca | 43299 | U46854 | atccaccgggaagctcttccactt | 85903 | AA106010 |
| 696 | L09192 | caaggtcattgcacacgcaaagat | 43300 | U46854 | ttcacctggggtacgaggggagag | 85904 | AA106010 |
| 697 | L09192 | ccaccaagatgagcagagcctggc | 43301 | U52433 | tccactcagcctacgagtcagagac | 85905 | U62297 |
| 698 | L09192 | atccctctcgagaagttctca | 43302 | U52433 | actgcctacagtcgtcagagacgt | 85906 | U62297 |
| 699 | L09192 | tctcaacaacagcgttcctgca | 43303 | X92591 | ggcttcaaacatccgttcgcatag | 85907 | U62297 |

| SEQ ID NO | DBAxnID | sequence | SEQ ID NO | DBAxnID | sequence | SEQ ID NO | DBAxnID |
|---|---|---|---|---|---|---|---|
| 700 | L09192 | ttcctgcaggcagcagtggacaccc | 43304 | L09192 | ttcaaacatccgttcgccatagaa | 85908 | X92591 | agatcacagacagaggtccagca | U62297 |
| 701 | L09192 | gacaccagtcatcgagatgagaacc | 43305 | L09192 | gtgccagtcaaggctcgtgccact | 85909 | X92591 | agcagctgtaccagatccagcaagt | U62297 |
| 702 | L09192 | atgagaacctgcgtgttccagct | 43306 | L09192 | aaggtctgtgccactcggcaaacc | 85910 | X92591 | tgtaccagatccagcaagtccacat | U62297 |
| 703 | L09192 | gttccagtccgcctgcacagaac | 43307 | L09192 | gctcgtgccactcggcaaaccaga | 85911 | X92591 | agatccgcaagtccaccatgcctgc | U62297 |
| 704 | L09192 | cctcggcagtcagtgggatcaggc | 43308 | L09192 | ctgtgccactcggcaaaccagagc | 85912 | X92591 | agcaagtccaccatgcctgcaggca | U62297 |
| 705 | L09192 | aatcctgtccaatgtgagcccagt | 43309 | L09192 | cactcggcaaaccagagctgccag | 85913 | X92591 | tcaccatgcctgcaggccaagacct | U62297 |
| 706 | L09192 | tgagcccagtcctgtggatcctgc | 43310 | L09192 | tcggcaaaccagagctgccagtcg | 85914 | X92591 | ttcagtcagccaatcagccctga | U62297 |
| 707 | L09192 | cctgtgttcctggtgtgccatag | 43311 | L09192 | agcctgccagtctaccggtgccca | 85915 | X92591 | cagccaatcagccctctgatgggca | U62297 |
| 708 | L09192 | gctggttcagggactccttctg | 43312 | L09192 | ctgccagtctaccggtcccatca | 85916 | X92591 | agcctggacagatcatttgcacaca | U62297 |
| 709 | L09192 | tcctctcgggagaaggccagagg | 43313 | L09192 | gggagctccctacactcgtgttgg | 85917 | X92591 | gacagatcattgcgcagtgcaata | U62297 |
| 710 | L09192 | tcccgagctgtgggaatcaccag | 43314 | L09192 | cactcggtgtggcattctagg | 85918 | X92591 | agctgccccagtcgcaata | U62297 |
| 711 | L09192 | aatcaccagggtctgctgtgatgg | 43315 | L09192 | ccgttcgccatagagaacatatcg | 85919 | X92591 | atgctgcccaatctgcaatatctcg | U62297 |
| 712 | L09192 | aaatactcacgtgatactacatg | 43316 | L09192 | gactacaaggggtcgtgcaggtg | 85920 | X92591 | cccagtccaatatacgattagc | U62297 |
| 713 | L09192 | tggagtactacatggggcctgtga | 43317 | L09192 | ttgccttggggtcggtcatgcacc | 85921 | X92591 | gatttagccaagtctgatcagggcac | U62297 |
| 714 | L09192 | tagctgaagaactgcgcgagctgg | 43318 | L09192 | cctttgcgtgggtcatgcaacac | 85922 | X92591 | ttgtcaaggacagatccagacact | U62297 |
| 715 | L09192 | gaactcacactcgtgcattaagga | 43319 | L09192 | gtcatgccaactgggctaccccg | 85923 | X92591 | ttgctaccaatgccaacagatcac | U62297 |
| 716 | L09192 | cattaaggacatggcggcctgctg | 43320 | L09192 | ccggcccgcaaatgctgccaatgtgtg | 85924 | X92591 | cactgcagccaccgaggctgtgg | AA106036 |
| 717 | L09192 | cctgtcgaagctgccgcctgcacc | 43321 | L09192 | ctcagcaatgtgtgcggtcgtgt | 85925 | X92591 | ctgctgcatcgggacacaggttc | AA106036 |
| 718 | L09192 | actgcactaccatccatgataca | 43322 | L09192 | ggctccgtggcctcatgttggcg | 85926 | X92591 | ttcccgtactgtaagtgcgtgcta | AA106036 |
| 719 | L09192 | tgtgggcagcatggcctgcctgcca | 43323 | L09192 | cagactgcccgcagcttctact | 85927 | X92591 | cccagtacgtaaggtcgtcatg | AA106036 |
| 720 | L09192 | gggctgatgttgggacgtggcagt | 43324 | L09192 | gactgagcccgcagcttctactta | 85928 | X92591 | tgtaagtgcgtgtatgcaggagag | AA106036 |
| 721 | L09192 | gactccatgtctggatgaccctac | 43325 | L09192 | gtcaggcccaaacagtgtccccag | 85929 | X92591 | taagtgcgtgtatgcaggagagcc | AA106036 |
| 722 | L09192 | gatgacctccacgccaagcatgggg | 43326 | L09192 | acaccaacaagttgagtgggatct | 85930 | X92591 | agtgcgtgtatgcaggagagagcga | AA106036 |
| 723 | L09192 | gtgtttgactacatgagtactggg | 43327 | L09192 | atagaatgtgggccctcgagcag | 85931 | X92591 | tgctatgcaggagagccgaggccca | AA106036 |
| 724 | L09192 | gaactccacgcttcagattgca | 43328 | L09192 | agagatgtggccctcagagcag | 85932 | X92591 | gagagcgagccaccctattcat | AA106036 |
| 725 | L09192 | gccttcgattgcaggctaccatg | 43329 | L09192 | ccctcagagcagaggtaggcatt | 85933 | X92591 | gagccgaggccacctattctct | AA106036 |
| 726 | L09192 | gcacgttaccatgaagtctggcaa | 43330 | L09192 | taggcattctgcattctgcagaga | 85934 | X92591 | agatggctgcgatgctggagacaa | AA106036 |
| 727 | L09192 | ggcgaactccgacgtgatgag | 43331 | L09192 | cattctgcagatgcacagatgcc | 85935 | X92591 | atggctgcgatgctggagacaact | AA106036 |
| 728 | L09192 | ggccagtccaactgcactcc | 43332 | L09192 | gcacagtgccagagagacaggatg | 85936 | X92591 | gctcatccggacacaggtccact | AA106036 |
| 729 | L09192 | caggccatagcatggccgttggt | 43333 | L09192 | agagcccagagagcagagccatgcttg | 85937 | X92591 | tggcatccggacacaggttccact | AA106036 |
| 730 | L09192 | gagggcaagaaggcctagtggagg | 43334 | L09192 | atgcccagagagcagcatgctgtg | 85938 | X92591 | ccggaacaggttccactcaactg | AA106036 |
| 731 | L09192 | aggtgacacacctccagattgt | 43335 | L09192 | ctgagcccagagagcttctactaa | 85939 | X92591 | gacacaggttccactcaactgaaga | AA106036 |
| 732 | L09192 | cagttcattaggtgcagaatggttga | 43336 | L09192 | ccagactttctacttactgccta | 85940 | X92591 | caggttccactcaactgaagacaaa | AA106036 |
| 733 | L09192 | ttcgatccattcggttaaagacac | 43337 | L09192 | agcagcttctacttacttaccta | 85941 | X92591 | atcaaggccgtggtcattgacctgg | AA106036 |
| 734 | L09192 | aagaaaccccaggccatgaagaagat | 43338 | L09192 | cagcttctacttacttacctaggt | 85942 | X92591 | gtcattgacctgggttccagctact | AA106036 |
| 735 | L09192 | gatgcactccatcccaaggctttg | 43339 | L09192 | tctacttacctactcaggtgcttg | 85943 | X92591 | tggttccagttactgaagtgcgt | AA106036 |
| 736 | L09192 | ggtcatagacactcaaggtggcagca | 43340 | L09192 | ctactaggtgcttggaggatgaac | 85944 | AA020304 | tgttcagcaaggtgcttctgcag | U66201 |
| 737 | L09192 | gccagccctgtgttggagagggc | 43341 | L09192 | acctaggtgcttgaggatgaactc | 85945 | AA020304 | tctgatccgcaagaggccagt | U66201 |
| 738 | L09192 | gtgctcagccgccatgaagatgaga | 43342 | L09192 | tctggtcaggtccaaacagtgtcc | 85946 | AA020304 | aaggctatctcactcgctccagat | U66201 |
| 739 | L09192 | aggtgactgggtgactcgcccatg | 43343 | L09192 | aaccattgactgggtagctttga | 85947 | AA020304 | atgtgatctatctccaaccctga | U66201 |
| 740 | L09192 | gacttcgccatgggaggccactatc | 43344 | L09192 | tgactgggtagcttttcagatc | 85948 | AA020325 | tctattcctcaacctgatccgca | U66201 |
| 741 | L09192 | catgttaccaaggacatgactctg | 43345 | L09192 | ctccaaggtggctgctttacctga | 85949 | AA020325 | cctcaacctgtatcgccagcagga | U66201 |
| 742 | L09192 | tgactctggaaggcgacgacctcat | 43346 | L09192 | caggttgcgtgctttacttact | 85950 | AA020325 | aatcaggccgtgcatggttctagg | U66201 |
| 743 | L09192 | aggcgacgacctcatcctagagatt | 43347 | L09192 | gttggctgcctgagaatcca | 85951 | AA020325 | gccgtgcatggttctcaggactcaa | U66201 |
| 744 | L09192 | ccaggtcagccactccataggagta | 43348 | L09192 | tgctttactgagaatccaccacagt | 85952 | AA020325 | ttgtaccaaactcattgaagtgtg | U66201 |
| 745 | L09192 | cttaggctcctgcctcaggagtga | 43349 | L09192 | ttactgagaatccaccagtctac | 85953 | AA020325 | acagaaccatcactaccagaaat | U66201 |
| 746 | L09192 | tccatggagacagcacactggc | 43350 | L09192 | acctgagaatccaccagtatgac | 85954 | AA020325 | aaccatcactacacgaaatttgaga | U66201 |
| 747 | L09192 | acacactacccatgcctgggccc | 43351 | L09192 | gaatccaccagctatgactggct | 85955 | AA020325 | catcactacgaaatttgagaaaa | U66201 |
| 748 | L09192 | tgccatccctcagtctatttgtc | 43352 | L09192 | tccaccagtatcgactgggttac | 85956 | AA020325 | gggaccgaaccccagtcgaaagg | U66201 |
| 749 | L09192 | tagttgctcacatattcatctctg | 43353 | L09192 | ttactcaaggccatgtggggcatag | 85957 | AA020325 | cagaacccccagtcgaaggattgt | U66201 |

| SEQ ID NO | sequence | DBAxnID | SEQ ID NO | sequence | DBAxnID | SEQ ID NO | sequence | DBAxnID |
|---|---|---|---|---|---|---|---|---|
| 750 | cacatattcatctctctgccaaataa | L09192 | 43354 | ggttccgtgcgcaggagatataat | AA020325 | 85958 | ggttattcagcgcagcaggataatt | U66201 |
| 751 | catctctgccaaataaggcctgc | L09192 | 43355 | tgcagagatcataccccagaaccaa | AA020325 | 85959 | gatattctcagatgcatccaga | U66201 |
| 752 | ttgccaaataaggcctgctcctcg | L09192 | 43356 | agggatcataccccagaaccaaaag | AA020325 | 85960 | tcctgcagatgcatccagatggtac | U66201 |
| 753 | tcacaggtcctcggaaattgctca | L09192 | 43357 | ccagaaccaaaaggccattgctagt | AA020325 | 85961 | acagcgactaccacccttccaatct | U66201 |
| 754 | agtagcatagctgtctccaaagt | X00686 | 43358 | ccaaaaggccattgctagttccctg | AA020325 | 85962 | tggccatccaagggttaaagccag | U66201 |
| 755 | atgctgtctcaaagattaagccat | X00686 | 43359 | ggccattgctagttccctgaaatcc | AA020325 | 85963 | gccttatgtggccatgaatggaga | U66201 |
| 756 | aagccatgcatgctaagtacgcac | X00686 | 43360 | tgcagttccctgaaatcctgaat | AA020325 | 85964 | ctatcttgatctacgtagccttct | U66201 |
| 757 | tgcatgctaagtacgcacggccgg | X00686 | 43361 | tagttcccgaaatcctggaatgag | AA020325 | 85965 | tgatctacgtagccttcttgagat | U11853 |
| 758 | aggaaactgcgaatggtcattaa | X00686 | 43362 | cctcacctccaggttggtcgtta | AA020325 | 85966 | tgaacaggacgtctcgaggct | U11853 |
| 759 | cgaatggtcattaaatcagttatg | X00686 | 43363 | tccaaatttacctgccaactgcaa | AA020325 | 85967 | gctctgagtgctgctatttctcacc | U11853 |
| 760 | ttatggtcctttggctgctgctc | X00686 | 43364 | gtgcgtcaccctggaatggggaag | AA020325 | 85968 | cactccatgaaactcagtcgcacc | U11853 |
| 761 | ggataactgtggtaatctagagct | X00686 | 43365 | gggagacccaactgccagatgta | AA020326 | 85969 | atgaaaactcagctgcaccaatgc | U11853 |
| 762 | tctagagctaatcatgccgacgag | X00686 | 43366 | gagacccaactgccagatgatt | AA020326 | 85970 | actcagtcgcaccaatgctggggt | U11853 |
| 763 | atacatgccgacgggcgctgacccc | X00686 | 43367 | agacccaactgccagatgtatttt | AA020326 | 85971 | ctgcacccaatgctgggggttgacca | U11853 |
| 764 | gcatttatcagatcaaaaccaacc | X00686 | 43368 | ataatgttctgcacgtgaaatatt | AA020326 | 85972 | ttgaccagatgccaatggcttta | U11853 |
| 765 | gcttggggactctagataacctgg | X00686 | 43369 | taatgttctgcacgtgaaatgtt | AA020326 | 85973 | accagatcgccaatggctttaagt | U11853 |
| 766 | tagatactctgggcgtcgatcgcacg | X00686 | 43370 | atttatactctagacatgcacatt | AA020326 | 85974 | agatcgccaatggctttaagtgtt | U11853 |
| 767 | ctatcaacttctgatgtagtcgcc | X00686 | 43371 | tttatactctagaacatgcacatt | AA020326 | 85975 | tgccaatggctttaagtgttga | U11853 |
| 768 | gtagtcgcctgctacaggtga | X00686 | 43372 | ttatactctagaacatgcacatta | AA020326 | 85976 | ccattgctgtggctgctgtgtaa | U11853 |
| 769 | tgcctaccatgggtgaccacgggga | X00686 | 43373 | atactctagaacatgcacatttata | AA020326 | 85977 | cctcaacttctgggtcggaagct | U11853 |
| 770 | cggctaccacatccaaggaaggcag | X00686 | 43374 | tactctagaacatgcacatttatat | AA020326 | 85978 | ctgcagcctactaggagccacgt | U11853 |
| 771 | acatccaaggaaggcagcagcaggcg | X00686 | 43375 | tggtctaccctggaatgggaaga | AA020326 | 85979 | cctacgttttatcactctcgctgc | U11853 |
| 772 | aagcagcaggcgcgcaaatacc | X00686 | 43376 | tctacccctggaatgggaagaggat | AA020326 | 85980 | tcatctctcgctcctcctcatct | U11853 |
| 773 | taacaataacggactctttgaggc | X00686 | 43377 | aagggatccctgggtctccagaga | AA020326 | 85981 | tcatctttctcctaatctctcacctt | U11853 |
| 774 | aggatccatgggggcaggctctgg | X00686 | 43378 | aggatccctgggtctccagatca | AA020326 | 85982 | ccctgcaacgctgagccgggag | U11853 |
| 775 | gctcgtagttggatcctgggggcg | X00686 | 43379 | tgggtctccagagatcagggagagc | AA020326 | 85983 | acctcatccagggatgaaccaggactg | U11853 |
| 776 | gccccctgatgcttagctgagt | X00686 | 43380 | gggtctccagagatcaggggaggagacc | AA020326 | 85984 | aactcttggctccaagaagaggcg | U11853 |
| 777 | gatgcttctgagtgtccgg | X00686 | 43381 | gtctccagagatcagggggagaccc | AA020326 | 85985 | ggagccagagcctcagcttaaggg | U66202 |
| 778 | ttagagttcaaggcaggccccgag | X00686 | 43382 | tctccagagatcagggggagacccca | AA020326 | 85986 | cggaacatttcacactgggtgcaa | U66202 |
| 779 | aggtgtcaaagcaggcccgacgcgc | X00686 | 43383 | agatgcctcgacagatcttct | AA020326 | 85987 | atttcacacctgcatgcaaatcaa | U66202 |
| 780 | caagcaggccgagccgcctggat | X00686 | 43384 | atgtcctcgacagatcttcgt | X92592 | 85988 | acgtgacatactcaatgatctacgtca | U66202 |
| 781 | ccgagccgcctggatacgcagcta | X00686 | 43385 | cctctgcacagattcgatcatggc | X92592 | 85989 | catactactcatcaatgatctca | U66202 |
| 782 | cgcctggatacgcagctaggaata | X00686 | 43386 | tctgcacagattgcatggatt | X92592 | 85990 | accgtcagcagcatccgccgcgagg | U66202 |
| 783 | tggatacgcagctaggaataatg | X00686 | 43387 | cacagaattcgcatgcatttaaa | X92592 | 85991 | ctgcagcacattctgccaacc | U66202 |
| 784 | cggaactgaggccatgattaagag | X00686 | 43388 | attgatgtcctgtctcagcatgc | X92592 | 85992 | ccaaaccactgaaagtggccatgta | U66202 |
| 785 | gggccattgctattcgccgctagag | X00686 | 43389 | tgatgtcctgtctcagcatgcc | X92592 | 85993 | agccatctcgcacgatctcacgga | U66202 |
| 786 | tcgtatgtcgcgcctagaggtgaa | X00686 | 43390 | gtctcagcatgcccatttaagac | X92592 | 85994 | agcgaaggtctcgtcggtgtactgaa | U66202 |
| 787 | attgcccgctagaaggtgaaattct | X00686 | 43391 | tctcagcatgcccatttaagacag | X92592 | 85995 | gcaaatcagcatgtcgcacacgaatc | U66202 |
| 788 | gggcaagacggacagagcgcctgaaagc | X00686 | 43392 | tcagcatgcccatttaagacacagaa | X92592 | 85996 | cagagcctcagtcttaaggctaagt | U66202 |
| 789 | agcattgccaagaatgtttcatt | X00686 | 43393 | agcatgcccatttaagacacagaagtt | X92592 | 85997 | catggccacacgaatcaacgtag | U66202 |
| 790 | cgcctgataccgcgtagttc | X00686 | 43394 | catgcccatttaagacagaagttt | X92592 | 85998 | ttaccaaactatacgcgcaagg | U66202 |
| 791 | tcgtagtccgaccataaacgatgc | X00686 | 43395 | cctcgacgatctttcgttaaa | X92592 | 85999 | actgcaactgcagcaatggaac | U66202 |
| 792 | gaccataaacgatgccgactgggga | X00686 | 43396 | tggtatgtcctttagcattcag | X92592 | 86000 | acagcactacactgtttaacct | U66202 |
| 793 | acgatgccgactgggcgatgcggggcgg | X00686 | 43397 | gtatgtcctttagcattcagt | X92592 | 86001 | ttaacctcatccctgtgggtctcg | U66202 |
| 794 | cgatgcgcggttatccatga | X00686 | 43398 | tctttttagcattctaggtaattga | X92592 | 86002 | tcatcccgggtctccgggtgt | U66202 |
| 795 | tgacgaaggcaccacccaggggtg | X00686 | 43399 | acaccaatagttgtccattgtg | X92592 | 86003 | gagttcaaaccaagctgtattggc | U66202 |
| 796 | acagattgtatgctcttctcgatt | X00686 | 43400 | cccaatagttctcattgtgact | X92592 | 86004 | acacctggaacatttcacacctga | U66202 |
| 797 | ggtggttggtgcatggcccgttcttag | X00686 | 43401 | tcttcctctgcacagaattcgca | X92592 | 86005 | ggatactcagctacctcccagcagc | AA106224 |
| 798 | tcatggccgtccttttagttggtgga | X00686 | 43402 | ttccttctgcacagattcgcatg | X92592 | 86006 | cagccccacagtactcaccatcaga | AA106224 |
| 799 | tggttgagcgattgtctggttaat | X00686 | 43403 | ctgtctttgcccgcccactgtgt | U46155 | 86007 | ctgcaggactgcgcgcactcgc | AA106224 |

| SEQ ID NO | sequence | DBAxnID | SEQ ID NO | sequence | DBAxnID | SEQ ID NO | sequence | DBAxnID |
|---|---|---|---|---|---|---|---|---|
| 800 | taacgaacgagagctctggcatgcta | X00686 | 43404 | tctttgcccgtccactgtgtcca | U46155 | 86008 | aatgtactgtacaaccacatcttca | AA106224 |
| 801 | gagactgtgcagctaactagtta | X00686 | 43405 | gcagctctgtgccagctacgcca | U46155 | 86009 | ctgtacaaccacatcttcacaatgt | AA106224 |
| 802 | tagaggacaagtgagggccgttcagcca | X00686 | 43406 | ccatcaccactgtgacggcttctgc | U46155 | 86010 | tacaaccacatcttcacaatgtcca | AA106224 |
| 803 | agtggcgttcagccaccgagattg | X00686 | 43407 | ctgtgacggcttctgctctgctgc | U46155 | 86011 | atcttcacaatgtccagtccagta | AA106224 |
| 804 | gttcagccaccgagattgtgcaat | X00686 | 43408 | cttcggtgactgtgtcgtgatcc | U46155 | 86012 | acaaagtccagtagccgagtccacc | AA106224 |
| 805 | ttgagcaataacaggtctgtgatgc | X00686 | 43409 | cctgtccaggtatgagagctaccc | U46155 | 86013 | agtagccagtccaccagtgtcac | AA106224 |
| 806 | taacaggtctgtgatgccctagat | X00686 | 43410 | gctatgagagctaccctgagactga | U46155 | 86014 | agccagtccaccagtgtcacagc | AA106224 |
| 807 | gtgatgccctagatgtcggggct | X00686 | 43411 | atgcagctaccctgagactgatca | U46155 | 86015 | agccagtccaccagtgtcacaga | AA106224 |
| 808 | ccctagatgtcggggctgcacgc | X00686 | 43412 | ctgatcacgggtgtattgaggatcc | U46155 | 86016 | gtcccagttgcacagatttgggg | AA106224 |
| 809 | gctgcacgcgcgctacactgactgg | X00686 | 43413 | tattttgaggatcctcatgtgccttt | U46155 | 86017 | cagtactccatcagacgacatccggt | AA106224 |
| 810 | cgggctcactgacgtgcctcagcgt | X00686 | 43414 | ttgaggatcctcatgtgcctttca | U46155 | 86018 | aagtgctagaacagttgtgtgttgtgg | AA106224 |
| 811 | actggctcagcgtgcctggggcaacc | X00686 | 43415 | ccadgtggtcatccgactccag | U46155 | 86019 | tcacatgacacatggttactgag | AA106224 |
| 812 | agcgtgtgcctaccctgcgcggca | X00686 | 43416 | tggccatccggactccagaactca | U46155 | 86020 | cagacacatcggactgagctgtgc | AA106224 |
| 813 | ccagtaagttgcgagtcataagctg | X00686 | 43417 | aaggccagcagcctcgaaggatcc | | 86021 | acacatcggactgagctgctgg | AA106224 |
| 814 | agtgcggtcataagcttgcgttga | X00686 | 43418 | cctacagacccgcgagagacgcttt | | 86022 | catcggtactgagctgctggagt | AA106224 |
| 815 | gcttcgtttgattaagtccctgccc | X00686 | 43419 | tttctactgaagggcattctggcc | | 86023 | gctgctgagtcgtcaagtgcac | AA106224 |
| 816 | tcgaactgactactctagagaagt | X00686 | 43420 | ctagaaatagggacgctcaggccc | | 86024 | tctgtagctcactgttgctatgc | AA106224 |
| 817 | gcgggagatggctctcgcccgtaag | | 43421 | gcaatagggaccgctcaggggcccg | | 86025 | ctcatgctgcaggactggctggc | AA106224 |
| 818 | gtgagatggctcgcccggtaagagc | | 43422 | ccgccatgggcagctcgtgtgccag | | 86026 | gactagcactgttgctagactgg | AA106783 |
| 819 | agatggctcgcccggtaagagcac | | 43423 | cttcacctggactgacagcaaaccc | | 86027 | tagcactgtttgctagacctggcat | AA106783 |
| 820 | cgggtaagagcacaaccaccatg | | 43424 | gactgacagcaaaccaaggcctgc | | 86028 | caccagttgcattgctcactggtac | AA106783 |
| 821 | tcaaaccccagcaaccacatgtagc | | 43425 | cagttctgccattccagctgtggg | | 86029 | cagtggcacgtcactgcttctg | AA106783 |
| 822 | ccagcaaccacatgtagcttcaac | | 43426 | tttctgccattccagctgcggggac | | 86030 | cactgttcactgcttctggggcagc | AA106783 |
| 823 | gcaaccacatggtagcttcaacaac | | 43427 | ctgccattccagctgtgtgggcacgtc | | 86031 | tgttcactgcttctcgggacagctc | AA106783 |
| 824 | accacatggtagcttcaacaacat | | 43428 | ccattccagctgtgggcacgtcag | | 86032 | tcactgcttctgggcagctctat | AA106783 |
| 825 | catggtagcttcaacaacactctcg | | 43429 | ctgtgggcacgtcaggcgaaggcaag | | 86033 | cttctgggcagcctcatcgttg | AA106783 |
| 826 | tggtagcttcaacaacactctcgta | | 43430 | caagccaggtcacctacgaccac | | 86034 | tctgggcagccctactcgctggg1g | AA106783 |
| 827 | tagcttcaacaacatctcgtaaca | | 43431 | cagtcacctgactgacacaaaccc | | 86035 | ctagacctgccattgctcctgtggggc | AA106783 |
| 828 | aaaatcgatgccctggtctgagt | | 43432 | gactgacagcaaaccacaggcctgc | | 86036 | ctatcgctgggcggttagtac | AA106783 |
| 829 | aatcgatgccctggtctgagtgt | | 43433 | gtcacctgaccacctgag | | 86037 | tcgctggggcctggtagtacag | AA106783 |
| 830 | ctgatgccctggtctgagtgtctg | | 43434 | cacctgaccacagctgctgagctgga | | 86038 | tgtttctagacctggcatttgctc | AA106783 |
| 831 | gatgcccctggtctgagtgtctgaa | | 43435 | ccagctgagctggaaggaaaatc | | 86039 | gtacagctacagttcatcaacctt | AA106783 |
| 832 | tgcccctggtctgagtgtctgaaga | | 43436 | tgcagcaaaccccaaggcctcgtc | | 86040 | ctagacctgcgattgctccggtaca | AA106783 |
| 833 | cctggtctgagtgtctgaagacag | | 43437 | caaaccaaggcctgctcaagatt | | 86041 | ctggcatttgctcggtacataaggt | AA106783 |
| 834 | ggagtgtcgaagagactagacagtg | | 43438 | acccaaggcctgctcaagattgacttgac | | 86042 | gcatttgctcggtacataaaggttca | AA106783 |
| 835 | ggtctgaagacagctacagtgct | | 43439 | ggcctgctcaagattgacttgaga | | 86043 | ttgctcggtacataaggttcaaag | AA106783 |
| 836 | gaagacagctacagtgtctaaataa | | 43440 | taaggtcggcgtctgatgtc | | 86044 | tatctgacgtgtccctgatcaat | AA106783 |
| 837 | gacagctacagtgtctaaataaata | | 43441 | cagaggcccagttctgccattcc | | 86045 | ctgtacgtgtccctgatcaatta | AA106783 |
| 838 | ttgggatttagctcagtggtagag | | 43442 | caggcccagtttctgccattccagct | | 86046 | gaaccaccagtggcactgtcactgc | AA106783 |
| 839 | tggggatttagctcagtggtagagc | | 43443 | gcccagttctgccattccagctgt | | 86047 | agtcacttgcccagaaacagtcct | AA106783 |
| 840 | gggattttagctcagtggtagagc | | 43444 | tcacttgcactgtctcgggtttca | | 86048 | gccccaagcctagcaagctcaaagg | U66203 |
| 841 | ttagctcagtggtagagcg | | 43445 | ttcgctctcatgtccagactgagc | | 86049 | ccatgaaccgtgaggggctatttgta | U66203 |
| 842 | gatttagctcagtggtagagcgt | | 43446 | tcggctcatgtccagactgagca | | 86050 | tattgtacagctgccacatttcac | U66203 |
| 843 | attttagctcagtggtagagcgctt | | 43447 | caaactgatgacaacagccatgtact | | 86051 | attactatgtcctgatcgctctgc | U66203 |
| 844 | ttagctcagtggtagagcggtttg | | 43448 | actgatgacaacagccatgtactact | | 86052 | ctgtaacgtggtccctgatcaat | U66203 |
| 845 | tagctcagtggtagagcggtgcct | | 43449 | cagccatgtactactgccagagc | | 86053 | atgtcctgatcgctctcga | U66203 |
| 846 | gctcagtggtagagcggtgcctag | | 43450 | gccatgtactactgccagagcgg | | 86054 | tgtatgcctctgctctcctacgca | U66203 |
| 847 | ctcagtggtagagcggtgcctagc | | 43451 | gattagactactgggccaggcgac | | 86055 | ctctcaccgcgctgtcttctgg | U66203 |
| 848 | tcagtggtagagcggtgcctagca | | 43452 | actctcacagtcctccagagtcg | | 86056 | ccaaggcagctgccacttgtgcc | U66203 |
| 849 | agtgggtagagcggctgcctagcaag | | 43453 | tctcacagtctccagtctgcg | | 86057 | cccacttgcccaagtcctcgga | U66203 |

| SEQ ID NO | DBAxnID | sequence | SEQ ID NO | sequence | DBAxnID | SEQ ID NO | sequence | DBAxnID |
|---|---|---|---|---|---|---|---|---|
| 850 | | gtggtagagcgctgcctagcaagc | 43454 | ctcacagtcctccagagtcgcga | X94418 | 86058 | ccatgtaccgggagcctctctcca | U66203 |
| 851 | | ggtagagcgctgcctagcaagcgc | 43455 | acttgcactgctctgggtttcat | X94418 | 86059 | cagagcctcagctcaaggcatcgt | U66203 |
| 852 | | cgcttgcctagcaagcgcaaggccc | 43456 | ttgcactgctctgggtttcatta | X94418 | 86060 | gcatcgtcaccaaactgttctgcg | U66203 |
| 853 | | gcttgcctagcaagcgcaaggccct | 43457 | gcactgctctgggtttcattaac | X94418 | 86061 | acctcaggcgaatccgatgggag | U66203 |
| 854 | | ttgcctagcaagcgcaaggccctgg | 43458 | tgctctgggtttcattaaccagc | X94418 | 86062 | aggcgaatccgatgggatatccca | U66203 |
| 855 | | tgcctagcaagcgcaaggccctggg | 43459 | gtaatagggctgtggaagcacaa | X94418 | 86063 | atccgatgggagtatccagggcac | U66203 |
| 856 | | ctagcaagcgcaaggccctgggttc | 43460 | tataattcggctctcatgtccagac | X94418 | 86064 | aggcaccccagggaccacagctc | U66203 |
| 857 | | tagcaagcgcaaggccctgggttcg | 43461 | ataattcggctctcatgtccagac | X94418 | 86065 | gactccgtgtggtcaccatccagag | U66203 |
| 858 | | gccctgggtcgctcagtctg | 43462 | attcggctctcatgtccagact | X94418 | 86066 | acatgccgtgaaccgtgaggggct | U66203 |
| 859 | | tgggagatgctcagtgggtaaga | 43463 | attcgaattcacaatgcagagctgc | X94418 | 86067 | acttgcagatgcacccgatggage | U66203 |
| 860 | | gagatggctcagtgggtaagagcac | 43464 | gaatcacacatgcagagctgcagcg | AA020368 | 86068 | agatgcacccgatggagctctcga | U66204 |
| 861 | | cagtgggtaagagcaccgactgct | 43465 | ctgcaaccttactaacagaggaatg | AA020368 | 86069 | atgtaatctactcatccatgctgta | U66204 |
| 862 | | tggggtaagagcaccgactgctctt | 43466 | atgtgaaaatgctccatctgct | AA020368 | 86070 | tctactcatcatgctgtacagga | U66204 |
| 863 | | cgactgctctccgaagtcagag | 43467 | gtgaaaatgctccatcctgtctcc | AA020368 | 86071 | cagcagctcattttctacccaagcc | U66204 |
| 864 | | ctgctctccgaagtccagagtc | 43468 | gctctccatctgctccaggctta | AA020368 | 86072 | ctcatttctacccaagccattgga | U66204 |
| 865 | | ggtccagagtccaacctcccagcaac | 43469 | tctcccatctgctccaggcttaga | AA020368 | 86073 | ttctaccaaggccattgaagttgc | U66204 |
| 866 | | tccagagttcaaatcccagcaacca | 43470 | ccatctgctccaggcttagatta | AA020368 | 86074 | aagttgcatgtaccgagaaccatc | U66204 |
| 867 | | cagagttcaaatcccagcaaccaca | 43471 | atctgctccaggcttagattatg | AA020368 | 86075 | ccatgtaccgagaaccatcctgca | U66204 |
| 868 | | agttcaaatcccagcaaccacatgg | 43472 | ctgctccaggcttagattatatgggg | AA020368 | 86076 | accgaaccatcctgcatgatgt | U66204 |
| 869 | | tcaaatcccagcaaccacatggg | 43473 | gctccaggcttagattatatggggga | AA020368 | 86077 | aaccatcctgcatgttggtga | U66204 |
| 870 | | aaatcccagcaaccacatggggct | 43474 | attgccttagggttagacagactga | AA020368 | 86078 | gcaaaccagtcaacaagtcaagac | U66204 |
| 871 | | cagcaaccacatggtggctcacaac | 43475 | attcacaatgcagagctgcagctt | AA020368 | 86079 | acccgatggagctctcgatggaac | U66204 |
| 872 | | gcaaccacatggtggctcacaacca | 43476 | tcacaatgcagagctgcagcgttat | AA020368 | 86080 | atgacagcaccaattccacactgt | U66204 |
| 873 | | acaccacatggtggctcacaaccatc | 43477 | acaatgcagagctgcagcgttat | AA020368 | 86081 | gccaattccacactgttcaacct | U66204 |
| 874 | | ctctcggtgtctgaagacagcgc | 43478 | tgcagagctgcagcgttatatctg | AA020368 | 86082 | tcaacctcatcccagtgggactgcg | U66204 |
| 875 | | ctctcggtgtctgaagacagcgca | 43479 | gctgcagcgttatatctggcaacc | AA020368 | 86083 | tcatcccagtgggactgcgcgtgt | U66204 |
| 876 | | gtgtctgaagacagctacagtgt | 43480 | cagcgttatatctggcaacctac | AA020368 | 86084 | cagtggagctgcgtgttgccat | U66204 |
| 877 | | tgtctgaagacagctacagtgtact | 43481 | gccgttatatctggcaacctacta | AA020368 | 86085 | ggttgtgccatccagggatggaa | U66204 |
| 878 | | acagctacagtgtactacatata | 43482 | tatatctgcaacctactaagg | AA020368 | 86086 | tgccatccagggatggaagagacagg | U66204 |
| 879 | | agctacagtgtactacatatata | 43483 | agcaaaactacgcacatagtcgagg | X79082 | 86087 | agagctgacttctccacctccg | U66204 |
| 880 | K02785 | catctccatatatctcatttaacc | 43484 | acgacatagtcgaggatgcactt | X79082 | 86088 | cacctcctgaccatcacaagcatatg | AA106190 |
| 881 | K02785 | tctccatatatctatttaaccgc | 43485 | agcgaagctctccagcttggctaa | X79082 | 86089 | agagaagctcactcacaaggaagtg | AA106190 |
| 882 | K02785 | ttaagctatcccggtttcagtggcca | 43486 | gctctccagcttggctaaccat | X79082 | 86090 | gaagctcacaaggaagtggat | AA106190 |
| 883 | K02785 | gctatcccgttcagtggccaaag | 43487 | cagcttggctaaccatccgagc | X79082 | 86091 | gctcactcacaggaagtggatgat | AA106190 |
| 884 | K02785 | tatcccgttcagtggccaaaagtg | 43488 | cttggctaaccaatccgagcaca | X79082 | 86092 | tgatcttttcaaggaagcaggcatt | AA106190 |
| 885 | K02785 | ccgttcagtggccaaaagtgtgca | 43489 | aaccaatccgagcacacaagaggt | X79082 | 86093 | tgaaccaacgcaagtagaaatat | AA106190 |
| 886 | K02785 | ttcctaggccgatctaccgggatg | 43490 | caatccgagcacacaagagttca | X79082 | 86094 | atatgacagttatccagaggatcc | AA106190 |
| 887 | K02785 | tcctaggccgatctaccgggatgt | 43491 | tccgagcacatcaagagttgtgacag | X79082 | 86095 | tgacagttatccagaggatcacc | AA106190 |
| 888 | K02785 | tagccgatctaccgggatggtgt | 43492 | atcaagagctcagtctgtgacag | X79082 | 86096 | cacgttatccagaggatccatt | AA106190 |
| 889 | K02785 | cgccatctaccgggatggtgtga | 43493 | aagaggctcagtctgtgacagtaa | X79082 | 86097 | gaggatcaccattcctgtgcga | AA106190 |
| 890 | K02785 | cgatctaccggggatgtgagat | 43494 | tatcttctgttgatgcagtcgc | X79082 | 86098 | cttccgaccatcatgtatgcaa | AA106190 |
| 891 | K02785 | gatctaccggggatgtgagatg | 43495 | gatcctgcttgcttcatggcttt | X79082 | 86099 | caccattcctgtgcgagactactaa | AA106190 |
| 892 | K02785 | catatatctattaaccgctg | 43496 | ggacttgtcctcaggcttggt | X79082 | 86100 | cctgaccatcatgcatatgcaaatc | AA106190 |
| 893 | K02785 | atctaccggggatgggtgagagc | 43497 | tgtcctcaggcttggtatctg | X79082 | 86101 | gaccatcatgcatatgcaaatcaag | AA106190 |
| 894 | K02785 | taacgcttgatccctttcatg | 43498 | tttcatattgttgctgcaggtagt | X79082 | 86102 | gaaagaaatcctggccatgctg | AA106190 |
| 895 | K02785 | tttatccattctatcctaag | 43499 | atgtttcgattggcaggtaagt | X79082 | 86103 | tctggccatgctgatggcagacaag | AA106190 |
| 896 | K02785 | ttatccattctatcctaagagg | 43500 | agtaacatactaactttcaatga | X79082 | 86104 | agttacatcatgcgctgagctg | AA106190 |
| 897 | K02785 | ttccatttctatcctaagagag | 43501 | gctcgtctgaagatcgtgtgaaa | X79082 | 86105 | agttacatcatgcgctgagctg | AA106190 |
| 898 | K02785 | catttctatcctaagagagagaga | 43502 | tcgctcgaagatgctgtggaaagca | X79082 | 86106 | ttacatcatgcgctgggctggg | AA106190 |
| 899 | K02785 | ttttctatcctaagaggaagact | 43503 | tgggtaaagccctgaacctgccctg | AA020403 | 86107 | catgctcgagctcgagctgagctcgaaa | AA106190 |

| SEQ ID NO | DBAxnID | sequence | SEQ ID NO | DBAxnID | sequence | SEQ ID NO | DBAxnID |
| --- | --- | --- | --- | --- | --- | --- | --- |
| 900 | K02785 | gaagagactatctctgaagaggaa | 43504 | L36135 | ttctttcccgctttggcatcgctg | 86108 | U66887 |
| 901 | L36135 | tctcagtgctcagactgacccttc | 43505 | L36135 | aggctccatggagcaccgaagcagt | 86109 | U66887 |
| 902 | L36135 | caccaccacatttaaacagctgcta | 43506 | L36135 | ggctccaaggagcaccgaagcagtg | 86110 | U66887 |
| 903 | L36135 | gggacacagcagctcattatccagagg | 43507 | L36135 | ctccatgagcaccgaagcagtt | 86111 | U66887 |
| 904 | L36135 | aagctgactcaactcactcctagc | 43508 | L36135 | tccatggagcaccgaagcagtgt | 86112 | U66887 |
| 905 | L36135 | gtattactccaatagtcacacagg | 43509 | L36135 | catggagcaccgaagcagtgttac | 86113 | U66887 |
| 906 | L36135 | actccaatagtcacacggagagt | 43510 | L36135 | tgttactgcgtcctgcagataa | 86114 | U66887 |
| 907 | L36135 | tttcctagtcagcactacggtgtgaa | 43511 | L36135 | gttactgcgtcgctgcagataag | 86115 | U66887 |
| 908 | L36135 | aactcacactggcttccttaatgc | 43512 | L36135 | tactgcgtcgctgcagataagaaa | 86116 | U66887 |
| 909 | L36135 | cactggcttccttaatgctctcca | 43513 | L36135 | ctgcgtcgcctgcagataagaaacg | 86117 | U66887 |
| 910 | L36135 | gcttcctaatgctctccaagcaga | 43514 | L36135 | tgcgctgcctgcagataagaaacga | 86118 | U66887 |
| 911 | L36135 | ctctccaagcagacaataagcttc | 43515 | L36135 | tttcccgcttggcatcgtcgtga | 86119 | U66887 |
| 912 | L36135 | aagctctaagatgcgatcaatta | 43516 | L36135 | ccgctttggcatgctgtgacgaa | 86120 | U66887 |
| 913 | L36135 | cacatttaaacagctgctaacaaaa | 43517 | L36135 | cgcttggcatgctgtgacgaaag | 86121 | U66887 |
| 914 | L36135 | taagatcgcatctaattatctcca | 43518 | L36135 | ctgtgacgaaagccctaggctcca | 86122 | U66887 |
| 915 | L36135 | taaacagctgctaacaaaccagct | 43519 | L36135 | acgaaagccttaggctcctaggag | 86123 | U66887 |
| 916 | L36135 | accagcttttctgacagcaacaa | 43520 | L36135 | cgaaagccctaggctcatggagc | 86124 | U66887 |
| 917 | L36135 | tttctgacagcaacagctag | 43521 | L36135 | aaagccctaggctccatgagcac | 86125 | U66887 |
| 918 | L36135 | gtgacagcaacagctagctaatc | 43522 | L36135 | ttaggctccatggagcaccgaagca | 86126 | U66887 |
| 919 | L36135 | agctagctaatctccagtctaga | 43523 | L36135 | agtatgcgagcccgagtgttcaa | 86127 | U66887 |
| 920 | L36135 | gctaatctccagtctagaagaaaa | 43524 | L36135 | gtgaagactcacgctttgtt | 86128 | AA106192 |
| 921 | L36135 | tcatttaccgaactcattaggaagtgg | 43525 | Y08640 | tgtctacgttaagagccctatgg | 86129 | AA106192 |
| 922 | L36135 | tgatctactggccatcatcaagtt | 43526 | Y08640 | aagcaaatataccagacattgcgg | 86130 | AA106192 |
| 923 | M12836 | ccatcatcaagttcttctgcttag | 43527 | Y08640 | tataccagacattgtgcgactcca | 86131 | AA106192 |
| 924 | M12836 | attctagaccatgcgaccatttttc | 43528 | Y08640 | cagacattgcgaccatttcc | 86132 | AA106192 |
| 925 | M12836 | atagcctacagctttaccatgg | 43529 | Y08640 | ctccattatacaaggaattgttcac | 86133 | AA106192 |
| 926 | M12836 | tacagctttaccatggccctgt | 43530 | Y08640 | tgttcacttcagtgagccagc | 86134 | AA106192 |
| 927 | M12836 | ccctgtgtctgtgaaccagctaa | 43531 | Y08640 | aatttgagccagccatgcaaatcga | 86135 | AA106192 |
| 928 | M12836 | ttgctcttgaaccagctaacccat | 43532 | Y08640 | agcagccatgcaaatcgatgggta | 86136 | AA106192 |
| 929 | M12836 | ttgaaccagctaacccatgaagac | 43533 | Y08640 | aaatgcgcgccgagcactctag | 86137 | AA106192 |
| 930 | M12836 | ctctagaacaactcgaagagcttct | 43534 | Y08640 | ctctagaacatctgagtacaaca | 86138 | AA106192 |
| 931 | M12836 | acaactggaaggcctcttactg | 43535 | Y08640 | tgtgttctatgcacctgaccgaaga | 86139 | AA106192 |
| 932 | M12836 | gcctgtatttcacatattgacaa | 43536 | Y08640 | ctatgcacctgaccgaagaggaacga | 86140 | AA106192 |
| 933 | M12836 | tatttcacatattgacaatatt | 43537 | Y08640 | tattttccattgcattcgattctgac | 86141 | AA106192 |
| 934 | M12836 | tcagcttctctgttctgaagaac | 43538 | Y08640 | ctgcattgcttactgatgtcagcgga | 86142 | AA106192 |
| 935 | M12836 | catctgtcgtggcaatgagaagaa | 43539 | Y08640 | cacgggatccgtcgtcgttctcagga | 86143 | AA106192 |
| 936 | M12836 | ttcatctcactgccataaaggtgc | 43540 | Y08640 | acatggcccttcagagttcctaca | 86144 | AA106192 |
| 937 | M12836 | ctctgtggcttcactctataa | 43541 | Y08640 | atggaattcaaccaagctaatatg | 86145 | AA106192 |
| 938 | M12836 | ttcactctataaagtccctcactc | 43542 | Y08640 | ttctaaccaagtcaatatgcaaggt | 86146 | AA106192 |
| 939 | M12836 | ctcactcatgttgcataaacatttt | 43543 | U16175 | cctgaccatgggcatggcgcgcgacatc | 86147 | AA106192 |
| 940 | M12836 | aaactgaactcactccttcctgat | 43544 | U16175 | ggtcctcctcggatgcgccgtcc | 86148 | AA106192 |
| 941 | M12836 | tcctgattccatccactccgat | 43545 | U16175 | caagtctgccatcagtttgtt | 86149 | AA106192 |
| 942 | M12836 | atagctcgaccattcgttctct | 43546 | U16175 | ccatacctgccaggcgtcttcc | 86150 | AA106192 |
| 943 | M12836 | ctcagaccattgtactccttac | 43547 | U16175 | tctgcttcctctggatgctccta | 86151 | AA106192 |
| 944 | M26053 | ctctgtggcttcacaatcct | 43548 | U16175 | tctgccttcatctctgtta | 86152 | U75506 |
| 945 | M26053 | tacttctgcacaatcctcgcac | 43549 | U16175 | tggatgcttcatctctgtta | 86153 | U75506 |
| 946 | M26053 | ccacttccgctccaaggtcagtc | 43550 | U16175 | attctctgtttactcgttggccta | 86154 | U75506 |
| 947 | M26053 | gcagttcatggggcttcagaggag | 43551 | U16175 | tgtgttacctgttggccttaggcggc | 86155 | U75506 |
| 948 | M26053 | agaggctcacccaaacctgtcaca | 43552 | U16175 | tggtcaggccgcaggtcatcatg | 86156 | U75506 |
| 949 | M26053 | tgtcacacagaacatgtgcgcag | 43553 | U16175 | aggccaggccgaggtcatcatgtctctg | 86157 | U75506 |

| SEQ ID NO | sequence | DBAxnID | SEQ ID NO | sequence | DBAxnID | SEQ ID NO | sequence | DBAxnID |
|---|---|---|---|---|---|---|---|---|
| 950 | acagaacatcagtgcagaggctgg | M26053 | 43554 | caggtcatcatgtctgtcgaccag | U16175 | 86158 | actggacatctgcgttcagcttg | U75506 |
| 951 | catcagtgcagaggcctgggccga | M26053 | 43555 | cttcctgatgccgtcctccgt | U16175 | 86159 | catctcgttcagcttgagtgta | U75506 |
| 952 | ataagcatcagtgctgtgccaagaa | M26053 | 43556 | cttccgtgggctgctgagtgccc | U16175 | 86160 | tgcgttcagcttgagtgatctgaa | U75506 |
| 953 | atcagtcgtcgtccaatgaaaaatg | M26053 | 43557 | tgttcagcgtcagaggccgcc | U16175 | 86161 | atgaaggcagcctgtcgagaag | U75506 |
| 954 | ggtcctgtttgagccatcaaa | M26053 | 43558 | cgtggtgaccaagcctgaggaaa | U16175 | 86162 | aggaactgcctgcaaagccctg | U75506 |
| 955 | gtgcttgccaggggcttcctcct | M26053 | 43559 | gggcttgccaaactgactgagcc | U16175 | 86163 | gccaaagccctgatgaggtgaaga | U75506 |
| 956 | ccacagtggggtcagcacgacct | M26053 | 43560 | tgccaactggactgagccgtcag | U16175 | 86164 | ttcccagaagacatggagaacgaca | U75506 |
| 957 | cagcagggaccctcaggcctacag | M26053 | 43561 | actggactgagccgttcagcgcc | U16175 | 86165 | aacgacaaggccatgctgataatga | U75506 |
| 958 | caattataagtactgcctgagcagc | M26053 | 43562 | gacctgagtctgctcccaagtct | U16175 | 86166 | cacgcaccatcttgctccgtgatg | U75506 |
| 959 | tagctactgctgagcgccgcgc | M26053 | 43563 | gctatctcccagctgggacttcctg | U16175 | 86167 | ccatcttgtccgtgatgtctcc | U75506 |
| 960 | ctgcctgagccagccgctgagggc | M26053 | 43564 | gtttctgctcccaggtcaactg | U16175 | 86168 | ttgctccgtgatgtcttccacacga | U75506 |
| 961 | ccgctgagggtctctgctcc | M26053 | 43565 | tagcttcatgacctcttccaaa | U16175 | 86169 | atcttattcactaaaagtctcatc | U75506 |
| 962 | ttctctggaacaacaacatgaag | M26053 | 43566 | catgacctcttccaaatgggc | U16175 | 86170 | tctattcactaaaagtctcatca | AA106406 |
| 963 | ggctgcagtccacccaagcccaaga | M26417 | 43567 | ctccaaatagggcctctgccagcta | U03715 | 86171 | aacttattcaccatatagtgct | AA106406 |
| 964 | agatatcctgatggatacaaggcc | M26417 | 43568 | agaggccatgcagaactttgacaca | U03715 | 86172 | acttattcaccatatagtgcta | AA106406 |
| 965 | caaggcctccagacaggccaagag | M26417 | 43569 | gaacttgacacaggcagggagca | U03715 | 86173 | cttattcaccatatagtgctaa | AA106406 |
| 966 | ggcctccagaccaagccaaggtctg | M26417 | 43570 | atcagtcagcaccagggctctgg | U03715 | 86174 | ttattcaccatatagtgctaat | AA106406 |
| 967 | ctccagaccaagccaagagaactc | M26417 | 43571 | tcagcacccagggtctggctggga | U03715 | 86175 | tattatcaccatatagtgctaatc | AA106406 |
| 968 | ccaagaaacttctccccatttg | M26417 | 43572 | ataccatctgtatagtccatt | U03715 | 86176 | attatcaccatatagtgctaatcc | AA106406 |
| 969 | ctccccattctgagttggctacc | M26417 | 43573 | catttaacacagacttcctgccctt | U03715 | 86177 | ttatcaccatatagtgctaatcca | AA106406 |
| 970 | tcagcaagtgtacttctgtgcc | M26417 | 43574 | cccactgaactggccagtcgtgt | U03715 | 86178 | tatcaccatatagtgctaatccac | AA106406 |
| 971 | gacatcagtgtacttctgtgccgc | M26417 | 43575 | tggctccagggtcaactgcaacc | U03715 | 86179 | atcaccatatagtgctaatccaca | AA106406 |
| 972 | atcagtgtacttctgtgccagcgt | M26417 | 43576 | agatgtcccgagacaccagcctgg | U03715 | 86180 | tcaccatatagtgctaatccacac | AA106406 |
| 973 | gtacttctgtgccagcggtaatcg | M26417 | 43577 | agcctggccgcagaaggcgtatgg | U03715 | 86181 | ctattcactaaaagtctcatcac | AA106406 |
| 974 | tcagctaataaccacaacatg | M26417 | 43578 | tactgagccagtcgcaggcctcc | U03715 | 86182 | caccatatagtgctaatccacacc | AA106406 |
| 975 | gactaataaccacaacatgtac | M26417 | 43579 | tcggagctccacaacagtactacac | U03715 | 86183 | ttatttcactaaaagtctcatca | AA106406 |
| 976 | taataaccacaacaacatgtactgg | M26417 | 43580 | ctgcaacacagctactacgtcctg | U03715 | 86184 | tatttcactaaaagtctcatcaca | AA106406 |
| 977 | ctccattctgagttggctacgg | M26417 | 43581 | caacactacatcgtctgtgcatt | U03715 | 86185 | gcacctccaccaaatcattaccac | AA106406 |
| 978 | caacagtggtatctgccaggac | M26417 | 43582 | ctacatctcctgcattgagaat | U03715 | 86186 | gttaaacttattatcaccccatatg | AA106406 |
| 979 | gctgatcattcatatggtgct | M26417 | 43583 | tgactcctgcatatctgccaaga | U03715 | 86187 | ttaaacttattatcaccccatatgc | AA106406 |
| 980 | gatccattattcatatggtgctggc | M26417 | 43584 | tatctgccaagacatcgtgacat | U03715 | 86188 | taaacttattatcaccccatatgtg | AA106406 |
| 981 | ccattattcatatggtgctggcagc | M26417 | 43585 | gtacgtgaacacgcagtggcttt | U03715 | 86189 | aaacttattatcaccccatatgtgc | AA106406 |
| 982 | ccgtctgtgactccaggaaatagc | M26417 | 43586 | tgaacacgcagtggcttttaaccctt | U51805 | 86190 | accgtgctcgtctgctttaga | U75530 |
| 983 | tcttcctgcagggccagccaaagt | M26417 | 43587 | tggcttaacctggctgctcgg | U51805 | 86191 | ggctctgtcgttttagagcagaa | U75530 |
| 984 | tctcatcaagtatgcctccagtcc | M26417 | 43588 | taaccttggctgtcggaactca | U51805 | 86192 | gacagtgtatctcccaggtctct | U75530 |
| 985 | caagtatgctccagtccatctct | M35667 | 43589 | accataagccaggagtgactgact | U51805 | 86193 | accggccatttccacactcgtgat | U75530 |
| 986 | gtagctccagtccatctctgggg | M35667 | 43590 | ttaaaccctaagtgactgaat | U51805 | 86194 | ccatttccacactgcatcagaag | U75530 |
| 987 | tgctcccagtcatctctgggat | M35667 | 43591 | tgccacatgaaaacccatctgggg | U51805 | 86195 | tccacatctgcatcaagaagatgc | U75530 |
| 988 | gacagattcactcagtatcaac | M35667 | 43592 | aaaccatctgggcatcacacagaaa | U51805 | 86196 | cctccatgctagtatctgataata | U75530 |
| 989 | agattcactcagtatcaacagt | M35667 | 43593 | gcatcacacagcaaagcaagacagaact | U51805 | 86197 | gataatatcagtctctcctatcag | U75530 |
| 990 | tttccatcagtatcaacagtg | M35667 | 43594 | cagaactgtcaccagacagagaa | U51805 | 86198 | atcactcctatcagaggagacett | U75530 |
| 991 | aatgtattctgcaacagtaac | M35667 | 43595 | acatcgtgacattggcttgcgaga | U51805 | 86199 | ctctccatcagaggagacactt | U75530 |
| 992 | gtattctgtcaacagagtaacagc | M35667 | 43596 | tgtacattggctgcgacgtaga | U51805 | 86200 | atgactacagaccctattttagata | U75530 |
| 993 | gagtaacgtgcagcctacacgttc | M35667 | 43597 | aaggacctctcagctacctgctggg | U51805 | 86201 | catctccagtattggaagttat | U75530 |
| 994 | ttctcaggcctcagcagcccaaagtatt | M35667 | 43598 | ggccgatccacctgagcttgtgt | U51805 | 86202 | agtgccaacacctgccgcacct | U75530 |
| 995 | tatttgcaacacactggtat | M35667 | 43599 | tgagcttgatgtgacggccagt | U51805 | 86203 | aacacctgccgcaccggtgag | U75530 |
| 996 | tggcaacaactacactggtatcaca | M35667 | 43600 | ttgatgtcgacggctgaccaagc | U51805 | 86204 | tggtagtccagcctgctccagg | U75530 |
| 997 | caacaacctacactggtatcacaa | M35667 | 43601 | acaagacagggtctctttcagact | U51805 | 86205 | ctagcggctgctgagaataca | U75530 |
| 998 | acatgagtctccaaggcttcatc | M35667 | 43602 | caggctccttcagacctagtat | U51805 | 86206 | aatacatcaggggcctgaagaag | U75530 |
| 999 | tgagtctccaaggctctcatcaag | M35667 | 43603 | atagccagctccaaaagtctcc | AA020447 | 86207 | gttgggtccgcaggttactata | U75530 |

TABLE 1-continued

| SEQ ID NO | DBAxnID | sequence | SEQ ID NO | sequence | DBAxnID | SEQ ID NO | sequence | DBAxnID |
|---|---|---|---|---|---|---|---|---|
| 1000 | M35667 | aaggtctcatcaagtatgcttcc | 43604 | agccagtctcaaagagtctccaa | AA020447 | 86208 | tgtcctgcaggttactatacctga | U75530 |
| 1001 | M35667 | gctctcatcaagtatgcctccag | 43605 | gccagtaccaacatgtgaagaaga | AA020447 | 86209 | ctttgatctgtcttgctggct | U75530 |
| 1002 | M60429 | agcacttccgctcagtcagtgaac | 43606 | accaaatacctgtaatcctagact | AA020447 | 86210 | tgtctgtatgtgtctgagaagg | D21099 |
| 1003 | M60429 | ttccgctcagtcagtgaacttcca | 43607 | ggattgcctgcactcagagattcaa | AA020447 | 86211 | gaaactatctagtccagttcta | D21099 |
| 1004 | M60429 | actacaagaacactcagcccatcat | 43608 | attgcctcactcaggagttcaga | AA020447 | 86212 | gaactcaattctagcactacatgt | D21099 |
| 1005 | M60429 | cagatggctcttacttcgtctacag | 43609 | tgcctgcactcaggagttcaagacc | AA020447 | 86213 | tgctcacggccactgctcgtaacac | D21099 |
| 1006 | M60429 | tctacagcaagtccaatgtgcagaa | 43610 | agtcaagaccagctgggcaacatg | AA020447 | 86214 | cggccactgctcgtaacaccccagc | D21099 |
| 1007 | M60429 | gaaatactttcacctgctcgtgtt | 43611 | ttcaagaccagctgggcaacatggt | AA020447 | 86215 | ttcgagcctcgcaggcactaggca | D21099 |
| 1008 | M60429 | ctttcacctgctcgtgtaacatga | 43612 | caagaccagctgggcaacatggtga | AA020447 | 86216 | ccctgcaggcactaggcatggatg | D21099 |
| 1009 | M60429 | ctgtgtacatgagggcctgcacaa | 43613 | agaccagctgggcaacatggtgaaa | AA020447 | 86217 | tatgcaggcaaaacaccatgcact | D21099 |
| 1010 | M60429 | cccactcctgtaaatgatcta | 43614 | accagctgggcaacatggtgaaac | AA020447 | 86218 | ggcaaaacaccatgcactgacttt | D21099 |
| 1011 | M60429 | gatctcaagtgtctggagccctct | 43615 | ccagctccaaagagtcccaata | AA020447 | 86219 | acaccactgacttttaagaa | D21099 |
| 1012 | M60429 | agtgtcctgagccctcggtcct | 43616 | agtctccaaaagagtctccaatag | AA020447 | 86220 | ctagtctgatctttcaattgtc | D21099 |
| 1013 | M60429 | tggctctacagactctgacaccta | 43617 | ctctcaaaagagtctccaataggaa | AA020447 | 86221 | atagctagtctgtctttaattcag | D21099 |
| 1014 | M60429 | cttcccatgtcaacaggactggc | 43618 | ctcaaaagagtctccaataggaaag | AA020447 | 86222 | agctccagttcagggatctgatc | D21099 |
| 1015 | M60429 | aaggccacaggaccagacgcgaa | 43619 | aatctgtatctagccagtaccaaca | AA020447 | 86223 | tctgatctcttctgacctctaca | D21099 |
| 1016 | M60429 | ggccacaggaccagacgaaggtcc | 43620 | tctgtatctagccagtaccaaca | AA020447 | 86224 | tctgatccacggcaaaattagg | D21099 |
| 1017 | M60429 | gaccgaaggtccacaggtgtacac | 43621 | tagccagtaccaacatgtgaaga | AA020447 | 86225 | gcaccctgggtgcacatatagc | D21099 |
| 1018 | M60429 | tgataacagacttccctgaaga | 43622 | tagccagtaccaacatgtgaagaaa | AA020447 | 86226 | tatatgcacgcaaacaatgaagt | D21099 |
| 1019 | M60429 | cagactctcctgaagacattac | 43623 | tcgaagccatgttctcttgggct | AA020447 | 86227 | cacgccaaacaacatgaagttacaaa | D21099 |
| 1020 | M60429 | tcttcccagaacattactgtgga | 43624 | gaagccatgttctcttgggctg | AA020447 | 86228 | gctctccaggaactagaactca | D21099 |
| 1021 | M60429 | acattactgtggagtgggcagtggaa | 43625 | ctccagcgagtgttcaccactgt | AA020447 | 86229 | aacctagaactcaattctagcacta | D21099 |
| 1022 | M60429 | taccgccatccgatggtctctttt | 43626 | cgagtggttcaccacctgttgctc | AA030302 | 86230 | ttactgttggtgatccggttcgcca | AA106486 |
| 1023 | M60429 | ccatccgatgtctctttcacct | 43627 | agtcggttcaccacctgtctcct | AA030302 | 86231 | tgtttggtcacctgtcgccagcc | AA106486 |
| 1024 | M60429 | gtctttgctccgctcctccagc | 43628 | tggttcaccacctgtctccttct | AA030302 | 86232 | gctcaaagtatctgcagtctgcta | AA106486 |
| 1025 | M60429 | cctcatagaggcccctgaagatgaga | 43629 | acaccgccacagggcctggtcagccag | AA030302 | 86233 | caacgtatctgcagtctcgctacta | AA106486 |
| 1026 | M96430 | gatgaacttaccctatgaaacat | 43630 | cagccgccacagggcctggtcagccag | AA030302 | 86234 | cgtatccgagtctgcactacag | AA106486 |
| 1027 | M96430 | tcctcccagtacacatcctaggc | 43631 | caggtgccagccagcatgggc | AA030302 | 86235 | atctgcagtctgcgctactacagag | AA106486 |
| 1028 | M96430 | gcttacctgccgatcctaccgcct | 43632 | gtggccagccagactatgggct | AA030302 | 86236 | ctcgcagtctacagagtgcagagat | AA106486 |
| 1029 | M96430 | tgtacaccgagaacatgaacttct | 43633 | gccagactatggtgctgccgcca | AA030302 | 86237 | gctactacagagtgcagagattat | AA106486 |
| 1030 | M96430 | gacatgaactctgttctttcac | 43634 | cagactatggtgctgccgccacg | AA030302 | 86238 | tgggtgtccgtttgtgaagccat | AA106486 |
| 1031 | M96430 | ctcctccaatcaaatttacatcct | 43635 | acacactccagtgtgtggacaggc | AA030302 | 86239 | ccatagacatgggtcactgggatg | AA106486 |
| 1032 | M96430 | aaatttacatcctccctgctcagct | 43636 | acactccagtgtgtggacaggcca | AA030302 | 86240 | tagacatggtcactgggatgcgt | AA106486 |
| 1033 | M96430 | tcctgctcagtccaataaatgg | 43637 | acagggccagcaccacctgggcct | AA030302 | 86241 | acatgggtcactgggatgcgtgt | AA106486 |
| 1034 | M96430 | gcctctcgacgttacctgcgga | 43638 | cccagtcgatgcctccagcgagt | AA030302 | 86242 | ttggtgatccggttgccagccgta | AA106486 |
| 1035 | M96430 | gcttacctgccgaactactacggcct | 43639 | gctcagtcctccagcgagtggtt | AA030302 | 86243 | gccagcgtacagggttaagtgat | AA106486 |
| 1036 | M96430 | ccagcctgcacctttaccatgct | 43640 | gatggcctccagcgagtggttcacc | AA030302 | 86244 | tagaactggatgggccagcatgt | AA106486 |
| 1037 | M96430 | tgtacactgcagagaactgcttacacaa | 43641 | tgccctccagcgagtggttcacc | AA030302 | 86245 | actgatcggccactcatgtatc | AA106486 |
| 1038 | M96430 | ctttaccattgctacacaaca | 43642 | gcctccagcgagtggttcaccact | AA030302 | 86246 | gtggaggccagtcatgtatcaaa | AA106486 |
| 1039 | M96430 | cattgctacacaacacagaggcac | 43643 | cttttgacaatgtcttcaatatgat | AA030302 | 86247 | agacgtgtccagtagtatcga | AA106486 |
| 1040 | M96430 | acacatgaggccaccgcacaagctg | 43644 | caatgtccttcaatatgatggttt | AA020468 | 86248 | agctgtgtcaacgatcgagtctg | AA106486 |
| 1041 | M96430 | ccgcacaacgtgtcttttgctcgg | 43645 | tcccagtgaagtttacactgccacat | AA020468 | 86249 | tgtgctcacgtactgcagtctcg | AA106486 |
| 1042 | M96430 | acacagctgtctctgctagagtt | 43646 | ttcacatgcactacatcaatagtca | AA020468 | 86250 | tgaagcagtccagacttagcctg | AA106486 |
| 1043 | D00659 | ctggtctcctgtcagtctcacag | 43647 | tgcacatcatcataagctcactgat | AA020468 | 86251 | cagtccagccactagcctggttgc | AA106486 |
| 1044 | D00659 | tgtgccaataatgcaagtctg | 43648 | tcatcataagtcactgctcatcctg | AA020468 | 86252 | tagaacaacgcagcagtctgcta | D88769 |
| 1045 | D00659 | gtactgtcagtgcagaatacata | 43649 | taagtcacctgccatcctggacagaa | AA020468 | 86253 | agcagcctgctaaccactgcagtg | D88769 |
| 1046 | D00659 | tctttcaccttaaaccagttgct | 43650 | acttgcatcctggacagaagcccca | AA020468 | 86254 | ctcgtaaccagtgtgactggc | D88769 |
| 1047 | D00659 | agttgcttacggtggatccacatgt | 43651 | tcctttgacacagaagccccaagtgg | AA020468 | 86255 | gtgtgtaggcctcactgactgc | D88769 |
| 1048 | D00659 | tggcccacatgtaaattgttggg | 43652 | ctcactgaactttggaacagacttca | AA020468 | 86256 | tgcctactgcattcaacggcc | D88769 |
| 1049 | D00659 | cgttttacttccaattgctcct | 43653 | tggaacagactcactgccagcact | AA020468 | 86257 | tggcactctagctaacggcccaaagg | D88769 |

| SEQ ID NO | sequence | DBAxnID | SEQ ID NO | sequence | DBAxnID | SEQ ID NO | sequence | DBAxnID |
|---|---|---|---|---|---|---|---|---|
| 1050 | ttactctcaatttgtgctcccagga | D00659 | 43654 | agactcactgccagcaactcaggt | AA020468 | 86258 | gaataccagtgtcacttcttatgtc | D88769 |
| 1051 | tcaattgtgctcccaggagtgtag | D00659 | 43655 | aggttccagtaggtctccagcatca | AA020468 | 86259 | caggtgcacttctatgtctggct | D88769 |
| 1052 | tgtgctcccaggagtgtagttagac | D00659 | 43656 | tggtgccaccttcctgagatgagg | AA020468 | 86260 | cactctttatgtcttggctacagta | D88769 |
| 1053 | agctaggagactctatgtgtgtag | D00659 | 43657 | cagtagtgtccagcatccacactt | AA020468 | 86261 | ttatgtcttggctacagtactggaa | D88769 |
| 1054 | tcctgctagagttctacagctgtg | D00659 | 43658 | gtctgagtcacacatctttgtaga | AA020468 | 86262 | ttcagacggtcaagcaagtgcaaag | D88769 |
| 1055 | tagagttctacagctgtgtcagca | D00659 | 43659 | agcatcacactttgtagagactct | AA020468 | 86263 | cctaataaacttcacttcagctcac | D88769 |
| 1056 | gctgtgtcagcacatccagaaatgac | D00659 | 43660 | ttgtagagactctgggaaggat | AA020468 | 86264 | attaccattctactccacgacat | D88769 |
| 1057 | acatcaagatgactctggcagaagt | D00659 | 43661 | agactctcgggaaggatccacga | AA020468 | 86265 | tactccacgaattgcatcgcagga | D88769 |
| 1058 | aaatgactctggcagaagtaacttaa | D00659 | 43662 | gaaggatccaagcaacttccactct | AA020468 | 86266 | acgacattgcatcgcaggaagatat | D88769 |
| 1059 | gtcaaactccagcatggggccagg | D00659 | 43663 | cactcttcccagtgaagttcacat | AA020468 | 86267 | ttcctgggcaaatgcaagtctggtg | D88769 |
| 1060 | atcccagcatggggccaggcataa | D00659 | 43664 | ggtatcatcacttcctgcgtgta | AA020468 | 86268 | tgcaagtctgggcatccacacgta | D88769 |
| 1061 | agggcgccccaaagcatgtgcca | D00659 | 43665 | atcacttttcctgcgggtgactctc | AA020468 | 86269 | tcctgggcatccacagtacggcac | D88769 |
| 1062 | aacacaagtctcacctcaaggacca | D00659 | 43666 | agcaattcctgcctttgtatttcagg | AA020468 | 86270 | aaccgtagcaaaccgtcagcatgc | D88769 |
| 1063 | agtcacctcaaggaccacgagag | L15325 | 43667 | gatacattatacggccatgtccc | AA020468 | 86271 | tgtccgtccacactgtcctgaaac | AA107038 |
| 1064 | acaccttgaccgtcttgtggcaat | L15325 | 43668 | ttttcctaaacactttaagatcatata | U49185 | 86272 | ccgctccacactgtctgaaactga | AA107038 |
| 1065 | tttacagctgtgtctggcggaac | L15325 | 43669 | cactgagccttccaattgtatcaga | U49185 | 86273 | aatcaggtgagcacaccgtgagag | AA107038 |
| 1066 | gcgttgtgctggaccttacagagta | L15325 | 43670 | tagaccttccattgtatcagagta | U49185 | 86274 | atcgggtgagcacaccgtgagagg | AA107038 |
| 1067 | cagtggcactccggttaggtgatt | L15325 | 43671 | accttccattgtatcagagtatcc | U49185 | 86275 | cggtgagcacaccgtgagaggtc | AA107038 |
| 1068 | gcactccggttaggtgattctcaa | L15325 | 43672 | agtatcaattacatttacaattat | U49185 | 86276 | ggtgagcacacacgtgagaggtca | AA107038 |
| 1069 | tctcaaattcaggcagtag | L15325 | 43673 | atccaattcattacaattagtac | U49185 | 86277 | gtagcacaccgtgagaggtcag | AA107038 |
| 1070 | attctcaaggacagttagttccta | L15325 | 43674 | tatttcaggaagtcaagttt | U49185 | 86278 | gagcacaccgtgagaggtcagag | AA107038 |
| 1071 | gtctagtattcatattcccatgaag | L15325 | 43675 | tattaaacctgatgttctcttcta | U49185 | 86279 | agcacaccgtgagaggtcagagg | AA107038 |
| 1072 | tattcatattcccatgaagctccca | L15325 | 43676 | tttcctgcggtgactctccaaact | U49185 | 86280 | gcacacactgagaggtcagaggc | AA107038 |
| 1073 | ttaatttgaaatctccttgtctgg | L15325 | 43677 | cctgcggtgacttctccaaactgaa | U49185 | 86281 | acacgtgagaggtcagaggctg | AA107038 |
| 1074 | acctccaaggacacagacagagaaga | L15325 | 43678 | gtgacttccaaactgaaactgcat | U49185 | 86282 | cacacgtgagaggtcagaggcgt | AA107038 |
| 1075 | ccaaggccttcgccaaaggcctcaga | L15325 | 43679 | actctccaaactgaaactgctag | U49185 | 86283 | cgctccacactgctcgaactgaa | AA107038 |
| 1076 | cctcagacctgaaggacgcatgagaa | L15325 | 43680 | ccaaactgaaactgctaaggcagtt | U49185 | 86284 | gctccacactgcctgaaactgaca | AA107038 |
| 1077 | acaatatgcacagtgaggaggaaaca | L15325 | 43681 | aactctaaggcagtttggctaag | U49185 | 86285 | actgctgaaactgacacctggg | AA107038 |
| 1078 | tggccgctgagcctgagcgcagt | L15325 | 43682 | aatgacagcattcctgcctttgat | U49185 | 86286 | ctgtcctgaaactgacaactgggc | AA107038 |
| 1079 | caattgcctgagctagaggtgatg | L15325 | 43683 | gacgcattcctgccttgtattc | U49185 | 86287 | tcctgaaactgacacctgggcata | AA107038 |
| 1080 | gattgcaaccttgtagtcagtgaa | L15325 | 43684 | ccgccatgaacatcttccggctgac | U49185 | 86288 | cctgaaactgacacctgggcata | AA107038 |
| 1081 | cagtgaaccttgtagtcagtgaa | L15325 | 43685 | tgaacatcttccggtgactgggga | U49185 | 86289 | agtccatttactgaatgtagaatc | AA107038 |
| 1082 | taaccaacaagtaggactcagc | L15325 | 43686 | agagtcagctctgtcgtctgcactggt | U49185 | 86290 | gtccatttactgaagtagaatcg | AA107038 |
| 1083 | acaccaagtatgactcagctgc | M21117 | 43687 | agctcctgtcgactgcttcac | AA028877 | 86291 | cacgaggctgtcgtagagctg | AA107038 |
| 1084 | aaccattccatgcatgtgatagta | M21117 | 43688 | acactctccggctgactggggacct | AA028877 | 86292 | agatgcttgacgtggcaagttc | Z75287 |
| 1085 | gacagagcaaacaaggccaaggctc | M21117 | 43689 | tctgtctcgcactggtcttcacgactg | AA028877 | 86293 | tcagctctacatacagatcatgag | Z75287 |
| 1086 | ctcatccgactgtttgtaggtc | M21117 | 43690 | cactgggtcttcacgactgctacct | AA028877 | 86294 | agaggcccccagatgatgatgagca | Z75287 |
| 1087 | ccttcatcagggtccttcatgta | M21117 | 43691 | tggtcttcacgactgctacctggac | AA028877 | 86295 | aatgtttgcaagtgctggagaca | Z75287 |
| 1088 | gtccttcatgtattgcaatgca | M21117 | 43692 | tcttcacgactgctacctggacct | AA028877 | 86296 | gtgctgcgagagctttgacgatctg | Z75287 |
| 1089 | atatgaaagcatcctcagctgtg | M21117 | 43693 | tcacttcctttattccatacaa | AA028877 | 86297 | ggagacctttgaagtctgtggagca | Z75287 |
| 1090 | aagcatcctttcagctgtgcgct | M21117 | 43694 | tcatttcctatatcaaacagtctat | AA028877 | 86298 | aataccagctagcatagagttatactg | Z75287 |
| 1091 | agctgtgctcaggcatgtatgaa | M21117 | 43695 | tttccttatacaacagtcatgaa | AA028877 | 86299 | tatactgccttgtcttcaagactc | Z75287 |
| 1092 | ttctttcatgtcttcagcaa | M21117 | 43696 | acactctccggctgactggggacct | AA028877 | 86300 | gccttgtcttcaagactcattgag | Z75287 |
| 1093 | tttgctttcagcaagacatcattca | M21117 | 43697 | cctttatacaacgctcatgaagct | AA028877 | 86301 | tcttcaagactcattgaagaaagc | Z75287 |
| 1094 | agatgaactcagcagctgcagacca | M21117 | 43698 | tcttcaggtctgactggggaccgtc | AA028877 | 86302 | ctgcttccaaaagcctttctgatgt | Z75287 |
| 1095 | actcagactcagcagcagtcctc | M21117 | 43699 | cggccagtcatcctactgctgaa | AA028877 | 86303 | tgaggcccagcatagtcaacatc | Z75287 |
| 1096 | cagaccagtcctctcaggcagcaga | M21117 | 43700 | ccatgtcatcctactgctgaagt | AA028877 | 86304 | ccagcatagtctaacatcacgct | Z75287 |
| 1097 | agtcctctaggcaggagagacaccac | M21117 | 43701 | tcatctactgctgaagatctgaa | AA028877 | 86305 | tatgtctaacatcagcgctatgtt | Z75287 |
| 1098 | aggcagacaccacatacaaccagca | M21117 | 43702 | tcctactgctgaagatctggggaa | AA028877 | 86306 | taacatcacgctagttgccacc | Z75287 |
| 1099 | catacaaccagcagcactagtccag | M21117 | 43703 | gctcctgctgaagatctctgggaa | AA028877 | 86307 | cagcgctatgtttgccactgcgaac | Z75287 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1100 | atgaaagctgccatctagcctgag | M21117 | 43704 | gtgctgggatctgtgggaagagtca | AA028877 | 86308 | tatgttgccacctgcaactcagaa | Z75287 |
| 1101 | agctcaaccatgctagtaaggcaa | M21117 | 43705 | cgtacatagctcctatatggagc | U48797 | 86309 | tgccacctgcaactcagaaaatcca | Z75287 |
| 1102 | ctcagagtgctgatacagtgactt | W44034 | 43706 | tagtcctattggagcaagta | U48797 | 86310 | gaaatttcagctctacatcagatc | Z75287 |
| 1103 | taaccgctgtactctctcagcgat | W44034 | 43707 | ctctgtgccagctgagatcctat | U48797 | 86311 | gagatgaattcgccaagccgtgctt | AA107061 |
| 1104 | tcagtacttaacctgagacctccga | W44034 | 43708 | gtccagctgagatcctattgttc | U48797 | 86312 | agatgattcgccaggcgtcttc | AA107061 |
| 1105 | ctgagacctccgaaaaccaggatct | W44034 | 43709 | tgttcctctgaatgtccacgaa | U48797 | 86313 | ctagacatcagtggtgaatgtt | AA107061 |
| 1106 | ttagctatgcttacacaacaact | W44034 | 43710 | cctcttgaatgtccacgaaccactg | U48797 | 86314 | acatgggctcagcaagcaaaggcgtg | AA107061 |
| 1107 | atgctacactacaacactcgttac | W44034 | 43711 | accactgaatagcatcagaaccctt | U48797 | 86315 | catgggctcagcaagcaaaggcgtgg | AA107061 |
| 1108 | acacactgttacagctgttcttga | W44034 | 43712 | gtaatagcatcagaaccttaaatga | U48797 | 86316 | tggctcagcaaaggcgtggagt | AA107061 |
| 1109 | cagctgtctgaccgctgaatca | W44034 | 43713 | taactgcactcttgatattcaaat | U48797 | 86317 | tggagttctagcgtctcaagtaccc | AA107061 |
| 1110 | ttcctgacgctgaatcagtatga | W44034 | 43714 | tgtgaaaaacactccactactgtag | U48797 | 86318 | ggagttctagcgtctcaagtaccct | AA107061 |
| 1111 | agatcatcaatgttaagctgtcctt | W44034 | 43715 | atgtgaccaacttcaactacaacag | U48797 | 86319 | gagttctagcgtcaagtaccta | AA107061 |
| 1112 | ttaagctgtcctttgtatggctgat | W44034 | 43716 | ccaacttcaactacaacagtgtgt | U48797 | 86320 | tgtaggccgcactagacatcagtgg | AA107061 |
| 1113 | tgtccttgtatggctgattataca | W44034 | 43717 | gagttaaaaactccaacatgaatgg | U48797 | 86321 | gtaggccgcactagacatcagtggt | AA107061 |
| 1114 | tctgtacttctcagcgatctataa | W44034 | 43718 | gatggttcacatgtgctggagga | U48797 | 86322 | taggccgcactagacatcagtggtg | AA107061 |
| 1115 | cttcttcagcgatctataacattca | W44034 | 43719 | tctacatgttgctggaggactttta | U48797 | 86323 | aggccgcactagacatcagtgt | AA107061 |
| 1116 | acatcaatctcaagaaatgtttat | W44034 | 43720 | tcacacctgccaatgatcctcagt | U48797 | 86324 | ggccgcactagacatcagtggtgtg | AA107061 |
| 1117 | taacagacatcaaagcctttggtac | W44034 | 43721 | tttttgcctggaggaactgtctaga | U48797 | 86325 | gccgcactagacatcagtggtgtga | AA107061 |
| 1118 | acatcaaagcctttgtacagataa | W44034 | 43722 | attaaccacctcatttctaagctgc | U48797 | 86326 | ccgcactagacatcagtggtgtgaa | AA107061 |
| 1119 | atctgccattactcacatcgtac | W44034 | 43723 | cacctcatttctaagctgccaaaca | U48797 | 86327 | cgcactagacatcagtggtgtgaat | AA107061 |
| 1120 | ccattactcacatcagtacttaccc | W44034 | 43724 | atttctaagctgccaaacagtctt | U48797 | 86328 | gttacctcgaagctcccaagagc | AA107061 |
| 1121 | ctcacatcagtacttaccctgagac | W44034 | 43725 | tacaaagcctcttgtcatcaaaagc | U48797 | 86329 | tctgaagctcccaagaggcctggc | U40375 |
| 1122 | tcggatccatgccaggagatcagga | AA108947 | 43726 | aaagcctctcttgtcatcaaaagccgt | AA116706 | 86330 | tgagacaggccatcagaggcatgc | U40375 |
| 1123 | gatccatgccaggagatcaggagtg | AA108947 | 43727 | tgcatgctgacgcgacatgttggt | AA116706 | 86331 | ggcatgcagtcaattgctatgtc | U40375 |
| 1124 | atccatggccaggatgaccaccacag | AA108947 | 43728 | atgcatgcacgcgacatgttggtga | AA116706 | 86332 | cagctcaagttctatgtccccagc | U40375 |
| 1125 | atgaccaccagtgctgtataacg | AA108947 | 43729 | ctgacgcgacattgtgtcaggaa | AA116706 | 86333 | caccgatgctattattcagttgg | U40375 |
| 1126 | cccacagtgctgtagtacagg | AA108947 | 43730 | ggaatccagttcctggaatagcgca | AA116706 | 86334 | aagtagctcgatcctgatggcaag | U40375 |
| 1127 | gagatcctggcctcctcgtacccctg | AA108947 | 43731 | atccagttcctggaatagcgcaatt | AA116706 | 86335 | ctctgatccgatggcaagacctg | U40375 |
| 1128 | tctcgtaccctgaggagtccgtc | AA108947 | 43732 | ttcctgaatagccgcaattgaagt | AA116706 | 86336 | tcctgaagcaaggccttggctgc | U40375 |
| 1129 | cgtcgaatcaaccagaacatacccagc | AA108947 | 43733 | taacttggcttcctgagagactg | AA116706 | 86337 | tggcaagacctggcgtcaaagaa | U40375 |
| 1130 | cgaatcaaccagacataccagcagc | AA108947 | 43734 | ctttggcttcctgagagactgcag | AA116706 | 86338 | gaccttggctgtcaaagcaggactg | U40375 |
| 1131 | atcaacaccagacataccagcaat | AA108947 | 43735 | tggcttcctgagagactgcagttagg | AA116706 | 86339 | tctgccgtcattgaataaacag | U40375 |
| 1132 | aaccagacataccagcagcagcaatg | AA108947 | 43736 | cttcctgagagactgcagttatgg | AA116706 | 86340 | gctcccaagaggcctggccaccttat | U40375 |
| 1133 | cagacataccagcagcaatatggaa | AA108947 | 43737 | gcctcttgtcatcaaaaagccgtgac | AA116706 | 86341 | aagaggcctggccacttatggcctc | U40375 |
| 1134 | ccatgccaggagatgcagcaggatgct | AA108947 | 43738 | tcaattgagacttccactagcgta | AA116706 | 86342 | cttgtagctggtgtgcaccgagca | U40375 |
| 1135 | atcaggagtgcctacacagagcacca | AA108947 | 43739 | tctgtcatcaaaaagccgtgaccac | AA116706 | 86343 | ccgagagtagctgttccactcctcgg | U40375 |
| 1136 | gcctacaagaggccaccattggcagg | AA108947 | 43740 | tgtcatcaaaagccgtgaccactt | AA116706 | 86344 | agcagctgttccactccggctgt | U40375 |
| 1137 | tacaagaggcaccattggcaggggacc | AA108947 | 43741 | catcaaaagccgtgaccacttga | AA116706 | 86345 | actccgggctgtgtaaccactcg | U40375 |
| 1138 | agcaccattggcagggaccgattg | AA108947 | 43742 | ccgtgaccacttgaatgaaccag | AA116706 | 86346 | ggcttgctaaccaccctcttctg | U40375 |
| 1139 | accattgcagggaccgattgagg | AA108947 | 43743 | ccagttcattgcatgctgacgcgac | AA116706 | 86347 | tgctaaccactgtttcggggccag | U40375 |
| 1140 | agcagcaacttgagcaggtgacc | AA108947 | 43744 | gtcatgctgacgtgacgacatt | AA116706 | 86348 | gccgcgatcttgctgtca | U40375 |
| 1141 | gtgatctggggtgaatgacaccca | AA108947 | 43745 | cattgcatgctgacgcgacattgt | AA116706 | 86349 | gcccgtctgtaccctacctgg | U40375 |
| 1142 | agtggctttctatgtcagaag | AA124192 | 43746 | gagcccactgataagcatgacgtgcc | U52842 | 86350 | tcatgctttcatgaccattggcct | U40375 |
| 1143 | ctctatgtccagaagccatattg | AA124192 | 43747 | aagcatgacgccgagtctaccc | U52842 | 86351 | ttctatgaccattggccgtggt | U40375 |
| 1144 | tgacaatgcctgtcgaagctgcag | AA124192 | 43748 | tgggccatctaaaagtcggagcctgc | U52842 | 86352 | gaccatgggcgtcgtggtcacct | U40375 |
| 1145 | ctcgagctgcagtgccctcctcta | AA124192 | 43749 | atcaaatgcggagccgccattca | U52842 | 86353 | tctacctgcttagccgccaggaagc | D21207 |
| 1146 | gctgcagctgcgcctcaatgctgt | AA124192 | 43750 | atgcggagcctgccattcagagaaa | U52842 | 86354 | agtcctgcagacacagttataacc | D21207 |
| 1147 | gcagctgctgcccctaatgctcac | AA124192 | 43751 | tagaactactaggaacacaaaagtct | U52842 | 86355 | acacagttataacctgcctttctga | D21207 |
| 1148 | gctgcctcaatgctgtcacagt | AA124192 | 43752 | gaacaaagctctaactgtgtgcag | U52842 | 86356 | ttataacctgccttctgcactctc | D21207 |
| 1149 | gctctaatgctcacgtaagata | AA124192 | 43753 | taacgtgtgcagtcttaagcag | U52842 | 86357 | ttctgcactgctccaggcatgccct | D21207 |

| SEQ ID NO | sequence | DBAxnID | SEQ ID NO | sequence | DBAxnID | SEQ ID NO | sequence | DBAxnID |
|---|---|---|---|---|---|---|---|---|
| 1150 | tctaatgctcaacgtaagataac | AA124192 | 43754 | tgtcagcttcttaagcgaatgag | U52842 | 86358 | ccaggcatgccttaagcgatggtg | D21207 |
| 1151 | attcttatgtctatgccattcac | AA124192 | 43755 | ccatctccagctcagtgtcactc | U52842 | 86359 | gtaccggatctcgaatcgctggat | D21207 |
| 1152 | tcttattgctatgccattcacag | AA124192 | 43756 | tccagctcagtggtcactcctccag | U52842 | 86360 | taccttacctggcctggctggctt | D21207 |
| 1153 | tatgctcatgccattcacagatc | AA124192 | 43757 | acatgtcaagaatcaccagacattaa | U52842 | 86361 | tacctgccctggctgccttttgcca | D21207 |
| 1154 | tatgttccagaagccatattgatt | AA124192 | 43758 | acctctctcattctcggcgctgtc | U52842 | 86362 | ctggctttgtccacgtcgctcaact | D21207 |
| 1155 | tatgccattcacagatctgctgtg | AA124192 | 43759 | tgtcactgccctgctgccagagacc | U52842 | 86363 | accgtgctcaactactatgtatggc | D21207 |
| 1156 | tgtcgagggcctttgttttat | AA124192 | 43760 | tgccctgctgccagacctgggc | U52842 | 86364 | ctcaactactatgtatgcgtgata | D21207 |
| 1157 | tgcctgcccaagtcgtcagaca | AA124192 | 43761 | gctgccagagacctgggccagcg | U52842 | 86365 | tgaaggcaccccagccatcaggaatg | D21207 |
| 1158 | gccagtggcctgtcagacagtaggc | AA124192 | 43762 | tgatacagtgcaggaggaccgaagagc | U52842 | 86366 | gccagcaccatggggcagccatcgccat | D21207 |
| 1159 | cagtcgaagtccaccctgacaat | AA124192 | 43763 | acagcagtcgaacagcagaagcag | U52842 | 86367 | caccatgggggcagccatcatgct | D21207 |
| 1160 | tctgaagtccacactgacaatgc | AA124192 | 43764 | accactccaggtctcaacacaagag | U52842 | 86368 | tgtaacattatgcaacctggaagcc | D21207 |
| 1161 | gaagtccacacctgacaatgctgtgc | AA124192 | 43765 | ccaggtctcaacacaagagaagaac | U52842 | 86369 | atttatgcaacctggaagccttaaga | D84655 |
| 1162 | acctgactgtgtcgaagctg | AA124192 | 43766 | aaagttgcaacttcagtctcccat | U52842 | 86370 | gagcaactcttactgttaacaat | D84655 |
| 1163 | tggaaacgcacaaaacccagaagag | W44037 | 43767 | cctccattcactctacagacagag | L36829 | 86371 | cctacagtccccgtatctcaaa | D84655 |
| 1164 | cacaaaaaccaagaagactacgcaggg | W44037 | 43768 | tttctgacataaactcatgactaat | L36829 | 86372 | tgtccccgtatctcaaacgtca | D84655 |
| 1165 | gggccagtgccacacatctggagga | W44037 | 43769 | acataaactcatgactaatctttgt | L36829 | 86373 | ctgtatcttcaaaacgtcaactttt | D84655 |
| 1166 | gccagtgccacacatctggaggat | W44037 | 43770 | taaaactcatgactaatcttttgtca | L36829 | 86374 | tctgttcaggtaccccttccac | D84655 |
| 1167 | ccagtgccacacatctggaggatga | W44037 | 43771 | actcatgactaatctttgtcaatc | L36829 | 86375 | tgtcaggtaccctcactgtgct | D84655 |
| 1168 | cagtgccacacatctggaggatga | W44037 | 43772 | gactaatctttgtcaatcatgaac | L36829 | 86376 | cctccatgtcctccatggggctat | D84655 |
| 1169 | gtgccacacatctggaggatgaga | W44037 | 43773 | taatcttttgtcaatcgaactttt | L36829 | 86377 | ccagactagcgtcgtgcagtcaa | D84655 |
| 1170 | ccacacatctggagatgaggaagg | W44037 | 43774 | gtcccagccattttgtatatgttg | L36829 | 86378 | catgaaaatcaccactgccgattat | D84655 |
| 1171 | cacacatctggaggatggccaaa | W44037 | 43775 | atatctatacatcacaaagttata | L36829 | 86379 | aatcaccactgccgtcgtgtgcc | D84655 |
| 1172 | aagtgtcaggcactgatggccaaa | W44037 | 43776 | tttacgtctgggggcagtttctgt | L36829 | 86380 | actagtgccgtgaagtctctacc | D84655 |
| 1173 | gtgtcaggcactgatgcccaaagg | W44037 | 43777 | ttcatttaagtctttgcaatggat | L36829 | 86381 | tgaagtctaccgcttgacatg | D84655 |
| 1174 | tgtcctcctagacagcagcgcgtc | W44037 | 43778 | tcactccatagacacagcagccgctc | L36829 | 86382 | ctctcccgtttgactatggtgc | D84655 |
| 1175 | aagagtacgcaggcaggcccagctg | W44037 | 43779 | ccctacacagagcgggtccccagg | L36829 | 86383 | cagccacgaagtactgatgtcgggg | D84655 |
| 1176 | caggcactgatgccaaatgggata | W44037 | 43780 | gtcgcccacagcagccattgtac | L36829 | 86384 | gcgtcatgactgctgtcaaaaa | D84655 |
| 1177 | ttctggcggtcaagcaggattccat | W44037 | 43781 | aggcagcccatgtacacttcagcg | X96793 | 86385 | tgagtgctcggtcaccaccacctgg | X98014 |
| 1178 | cgtcaagtcaggatccattctgta | W44037 | 43782 | cagccattgtacacttcacgtga | X96793 | 86386 | tcacacaactggctgagctcacaag | X98014 |
| 1179 | tggtcaggtcatctctatga | W44037 | 43783 | ggacttgaccgatacaagtctgag | X96793 | 86387 | gcatatccaagtgctgagggtcaggagct | X98014 |
| 1180 | cagtgcatcttaaagatga | W44037 | 43784 | atacaagtgggtggtgtctc | X96793 | 86388 | cccaagatgcagggtgggaggagagc | X98014 |
| 1181 | caggcccccaagactgctgagggcat | W44037 | 43785 | aggctgcatagcagccaactaaggt | X96793 | 86389 | tgagagcatgccccattaaacgc | X98014 |
| 1182 | agtccaatctggaaacatgcaaa | M77167 | 43786 | tgtcttcgtgtacagctcagggaa | X96793 | 86390 | ctcttgacacacagcaacagcctggttg | X98014 |
| 1183 | aggcccaagactgctgagggcatt | M77167 | 43787 | cagagggccctggctctccagggaac | X96793 | 86391 | ccatctcagaaatctcacgactcagag | X98014 |
| 1184 | gccaagactgctgaagggcattgct | M77167 | 43788 | ccctgctctccagggaactggga | X96793 | 86392 | agaatctacgactcagagaccac | X98014 |
| 1185 | ctgctgagggcattgtgagtggct | M77167 | 43789 | gcagtagcccaggaactttgaccga | X96793 | 86393 | tgagtgctcgtcaccaccactgg | X98014 |
| 1186 | ttctggcgttcaagcaggattccat | M77167 | 43790 | gccggtggactgaccgataacaag | X96793 | 86394 | tcacacaactggctgagctcacaaa | X98014 |
| 1187 | cgtcaagtcaggatccattcgta | M77167 | 43791 | ggacttgaccgatacaagtctgag | X96793 | 86395 | gcatatcccaagtgctgagcctcaggagt | X98014 |
| 1188 | tggtcatcttaaagagatga | M77167 | 43792 | atacaagtgggtggtgttctc | X96793 | 86396 | cccaaagtccaggagtcgagagc | X98014 |
| 1189 | cagtgcatcttaaagatgcaaa | M77167 | 43793 | tgtcttcgtgtacagctcaggaa | X96793 | 86397 | tgagagcatgcccctaaaaacgc | X98014 |
| 1190 | taaatgacatttcagactttgag | M77167 | 43794 | ccgactccgaggcccctgctgcc | X96793 | 86398 | ctcttgacacacagcctggttg | X98014 |
| 1191 | acatttcagactttgagatgaa | M77167 | 43795 | ttgcagcccacgcggttgtctgcc | X96793 | 86399 | gacaacagcctggttcagccgcattta | X98014 |
| 1192 | acttgtatcatttcacctcg | M77167 | 43796 | ceggactaactgcccaagccagattc | X96793 | 86400 | gcctcagttcagcctgcattta | X98014 |
| 1193 | tatctatttcacctgatctca | M77167 | 43797 | taactgccaacagccagattcctga | X96793 | 86401 | gggagatctcacctcctcgcatg | X98014 |
| 1194 | ttaaatcacaatttgtcatagt | M77167 | 43798 | ccaagccagattcctgaataaag | X96793 | 86402 | tcgttgcacacaggcacgacctcaat | X98014 |
| 1195 | ttgatcaaaggcacaaaacatga | M77167 | 43799 | ctctccaggaactggaaagagaga | X96793 | 86403 | accaggtccatgggtgtctga | X98014 |
| 1196 | agcaggatcaatctgtaaaataac | M77167 | 43800 | ggctagaccctgatcctaatccca | X96793 | 86404 | ttccttgacctgccatattggctg | X98014 |
| 1197 | attccattcgtaaatacctgtaat | M77167 | 43801 | gacccgtctactgtatcctggaa | X96793 | 86405 | gacctttgccattatggctgtca | X98014 |
| 1198 | tgtagtctgctcatccatca | M77167 | 43802 | gtctactgtatcctggaatggac | X96793 | 86406 | agcaatatgggctgtcactcct | X98014 |
| 1199 | ctgtctgatctccactacattat | M77167 | 43803 | atctggctctgagaatgcagcagga | X96793 | 86407 | aaactcagccatgaagaccaccacta | X98014 |

| SEQ ID NO | sequence | DBAxnID | SEQ ID NO | sequence | DBAxnID | SEQ ID NO | sequence | DBAxnID |
|---|---|---|---|---|---|---|---|---|
| 1200 | tgcatccatactacattatgctat | M77167 | 43804 | tttatgttcaccctttgcaaagt | X96793 | 86408 | tctctaatctactcctccaacaat | AA106532 |
| 1201 | catactacattatgctatggtctc | M77167 | 43805 | tctctgaacaacagcagatgcc | X96793 | 86409 | taatctctactcctccaacaatgaag | AA106532 |
| 1202 | acattatgctatggtctcagtgtc | M77167 | 43806 | cgtcgctgaccatcgcgatggtt | AA023081 | 86410 | tgaactgcctatcggaacatagcat | AA106532 |
| 1203 | ttgctatggtctcagtgtcatctct | M77167 | 43807 | cccggctgccagcaggttcatctg | AA023081 | 86411 | aactgcctatcggaacatagcatga | AA106532 |
| 1204 | ttgctgtctatggtttagcctgta | M16449 | 43808 | cagtgcctgtacaacaaagcctg | AA023081 | 86412 | gcctatcggaacatagcatgaccat | AA106532 |
| 1205 | gctgctatggtttagcctgtaggt | M16449 | 43809 | gccagttacaacaaagcctggaagc | AA023081 | 86413 | atagcatgaccatagcgcgaggacg | AA106532 |
| 1206 | gcgttttcgacttggaagaacat | M16449 | 43810 | gttacaacaaagcctggaagctaga | AA023081 | 86414 | agcatgaccatagcgcgaggacgcg | AA106532 |
| 1207 | ttttctgacttggaagaacattct | M16449 | 43811 | tacaacaaagcctggaagctagacg | AA023081 | 86415 | catcgaccgaaagcctcttagaat | AA106532 |
| 1208 | acatctctgtagttctaagtgt | M16449 | 43812 | caacaaagcctggaagctagacgttagacg | AA023081 | 86416 | acagtacacgcgcctcaggaaca | AA106532 |
| 1209 | tacagagccgaactgcctcgtggt | M16449 | 43813 | gaagctagacgccgcacctatgcaaa | AA023081 | 86417 | agtacacgcgcctcaggaaacagg | AA106532 |
| 1210 | actgcctcggtcctgggcttca | M16449 | 43814 | ctagacgcgcacctatgcaaacaca | AA023081 | 86418 | aggcgccacttaacaacaacgtgacga | AA106532 |
| 1211 | gcctctgtcctgggctttcagg | M16449 | 43815 | agacgcgcacctatgcaaacacaca | AA023081 | 86419 | tgtaatagactacatcacagcctt | AA106532 |
| 1212 | tcgtggtcccggtgcttcagggag | M16449 | 43816 | acgcgcacctatgcaaacacacagg | AA023081 | 86420 | atctctactctccaacaatgaaggc | AA106532 |
| 1213 | cagcgttctgcctgagagcat | M16449 | 43817 | gcgcacctatgcaaacacacacggg | AA023081 | 86421 | ctactctccaacaatgaaggcgcag | AA106532 |
| 1214 | ccagttcgcctgagagcattg | M16449 | 43818 | cggtcgccagcaggttcatctgt | AA023081 | 86422 | actctccaacaatgaaggcgcagag | AA106532 |
| 1215 | gttctgcctgagagcattgcaa | M16449 | 43819 | gctgccccagcaggttcatctgctcc | AA023081 | 86423 | gagaccaaatgcgcaactactacga | AA106532 |
| 1216 | atggtttgactgtaggtcatgct | M16449 | 43820 | cccagcaggttcatctgctcc | AA023081 | 86424 | gaccaaatgcgcaactactacgaga | AA106532 |
| 1217 | ttgcaagaagctggcctgaattc | M16449 | 43821 | cagcaggttcatcgtctcctttccc | AA023081 | 86425 | aaatgcgcaactactacgacggt | AA106532 |
| 1218 | ttagcctagtcatgctgctagc | M16449 | 43822 | aggttcatctgtctctttccgact | AA023081 | 86426 | atgcgcaactactacgacggtga | AA106532 |
| 1219 | tagctagtgtcaggggcaatgag | M16449 | 43823 | ctttcccgactgcagcgccagttac | AA023081 | 86427 | gcaactactacgagacgggaactg | AA106532 |
| 1220 | ctatgcactagtatccagactttt | M16449 | 43824 | cccgactgcagcgccagttacaaca | AA023081 | 86428 | cctgcgagttcagctgtctac | AA106532 |
| 1221 | tgcactagtattccagactttta | M16449 | 43825 | tgcagcgccagttacaacaaagcct | AA023081 | 86429 | cagctgctcatcgaatgcatgggg | AA106532 |
| 1222 | ttttgagttcagctgaatgtcat | M16449 | 43826 | ttcatagcagcagttaagtgacgga | X70296 | 86430 | aaagcctgctgccactttacaagga | AA106532 |
| 1223 | gttcagctgaattgcatcccgttt | M16449 | 43827 | tggalgcctgggatgctgctgtgaa | X70296 | 86431 | tcttttgactgctttgaatgt | X80502 |
| 1224 | cagcctgaattgcatcccgttggg | M13990 | 43828 | gctgctgcaagttcatcttgttca | X70296 | 86432 | gcactgctttgaatgcttccact | X80502 |
| 1225 | aattgcagaaacactctgaaagac | M13990 | 43829 | tgtcaagttcagcatcttgttcattc | X70296 | 86433 | attgaagccgtgtgaattagactg | X80502 |
| 1226 | attctgcagaaacactctgaaagacc | M13990 | 43830 | caagttcagcatcttgttcattc | X70296 | 86434 | ataataaaccgactccccatgtgaat | X80502 |
| 1227 | ctgaaagaccaccatcaggttag | M13990 | 43831 | gttcagcatcttgttcattccg | X70296 | 86435 | aaccgactccccatgtgaatggggaa | X80502 |
| 1228 | tgaaagaccaccatcaggtttagc | M13990 | 43832 | atcctgtgtatatgtgcattcta | X70296 | 86436 | cctctcacttgtatatgtcctca | X80502 |
| 1229 | gaaagaccaccatcaggttttagca | M13990 | 43833 | ctagcaaaagccgtagcctcttcgt | X70296 | 86437 | gatataagtcctcaaccaggagagc | X80502 |
| 1230 | aagaccaccatcaggttttagcaag | M13990 | 43834 | gcaaaagccgtagcctcttcgtgtg | X70296 | 86438 | gtcctcaaccaggagagctctgc | X80502 |
| 1231 | agaccaccatcaggttagcaagc | M13990 | 43835 | aaagccgtagcctcttcgtgtgtg | X70296 | 86439 | cttagccaagggatcagaatctt | X80502 |
| 1232 | gaccaccatcaggttttagcaagct | M13990 | 43836 | gtagcctctcgtgtgtttctg | X70296 | 86440 | actcgtcacactgctaaggaac | X80502 |
| 1233 | acccaccatcaggtttagcaagcta | M13990 | 43837 | tatactgatgtgtcactaaaata | X70296 | 86441 | tggcctaagaactccaaatggaaa | X80502 |
| 1234 | cccaccatcaggttttagcaagctag | M13990 | 43838 | atgagcaggccggttcacgatgtc | X70296 | 86442 | aatagtctccagaacgaacaacccata | X80502 |
| 1235 | tttgcagaaacactctgaaagactg | M13990 | 43839 | ccggttcacgatgtctagaagatt | X70296 | 86443 | atccagaacgaaccatagacaat | X80502 |
| 1236 | gaaaacactctgaaagaccaccatc | M13990 | 43840 | gttcacgatgtctagaagatttct | X70296 | 86444 | aagaaccatagacaacatcggaa | X80502 |
| 1237 | aacactctgaaagaccaccacate | M13990 | 43841 | ttcttaactactgatcagttatc | X70296 | 86445 | accataacaactggcaaagcct | X80502 |
| 1238 | acactctgaaagaccaccatcagg | M13990 | 43842 | ctactgatcatatctaggttaac | AA020620 | 86446 | agacaatctggcaaaagcctgtctgc | X80502 |
| 1239 | cactctgaaagaccaccatcaggt | AA016708 | 43843 | tctcgagtattgctgtcgtcaag | AA020620 | 86447 | tctggccaagctgtctgccactta | X80502 |
| 1240 | actctgaaagaccaccatcaggtt | AA016708 | 43844 | gtatttgctgctgtcagtcagc | AA020620 | 86448 | cctcctgtcttcacgaactagt | X80502 |
| 1241 | ctctgaaagaccaccatcaggttt | AA016708 | 43845 | ttgtgctgctcaagttcagcatc | AA020620 | 86449 | ttctcagtcttcacgaactcagtca | X80502 |
| 1242 | tctgaaagaccaccatcaggttta | AA016708 | 43846 | tgatcaaggccatctcatctccaa | AA020620 | 86450 | aggccctgcagagaccacactctgcatga | X83562 |
| 1243 | gtgttcgatccagccgagcagtaca | AA016708 | 43847 | tcaaggccatctcatctccatcaacaa | AA020620 | 86451 | tcagaggacacactctgccatgaa | X83562 |
| 1244 | ttcgatccagccgagcgagcagaca | AA016708 | 43848 | aacgcaacaaatcatcaacatcaggga | AA020620 | 86452 | gcacttaccatactgccttgat | X83562 |
| 1245 | accacgagagcagagacaacctga | AA016708 | 43849 | cgcaacgcaaatcatcacagggagaa | AA020620 | 86453 | ctttgatataagctccttgtgcact | X83562 |
| 1246 | gacagagacaactgactcgcggtt | AA016708 | 43850 | aacagcaaatcatcagggagactttt | AA020620 | 86454 | ctccttgtcacttgctctgctct | X83562 |
| 1247 | ctgactcgcagttttcgactag | AA016708 | 43851 | atttggttctaagccgcatgagaa | AA020620 | 86455 | tgtatcatctgatccatcacag | X83562 |
| 1248 | actgcagtttcagatctaggt | AA016708 | 43852 | tggtgctcaagcgcgatgatgagaactg | AA020620 | 86456 | gtatcatcacagcattaggcgttgg | X83562 |
| 1249 | aaatgcttaacgaccttcagacag | AA016708 | 43853 | gaggcttgaacaacagctcattta | AA020620 | 86457 | atcaagcattaggcgttggtggcata | X83562 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1250 | aacgacctcagagagcaagaactcc | AA016708 | 43854 | gctctgacaacagctcatttacag | AA020620 | 86458 | gcattaggcgtggtcatagacac | X83562 |
| 1251 | gcagaagaacctcgctcaaaatc | AA016708 | 43855 | acaagctcatttacagacattagc | AA020620 | 86459 | gtgcatagcaacaacagttgctca | X83562 |
| 1252 | gaagaactccgctcaaaattcacag | AA016708 | 43856 | agctcatttacagacattagcaaac | AA020620 | 86460 | gctcttcacgaactcagctaagatc | X83562 |
| 1253 | ctcctgctcaaaattcacgaggtgt | AA016708 | 43857 | tcatttcagacattatgcaacact | AA020620 | 86461 | ctcagctaagatctcctgaccaca | X83562 |
| 1254 | ctcctgctcaaaattcacgaggt | AA016708 | 43858 | tcctcatcttcaacaaccacggaa | AA020620 | 86462 | atcagtccccttcatagctgcact | X83562 |
| 1255 | gatccagcgcagtcagtacaagtgg | AA016708 | 43859 | tcttcaacaaccacggaagccgcg | AA020620 | 86463 | catagcctgcactggccaatccaga | X83562 |
| 1256 | gtgtcgaactcaagcaccaagatg | AA016708 | 43860 | ggctccaagttctaccagccta | AA020620 | 86464 | ctgcactggccaatccaagaagt | X83562 |
| 1257 | ggagttgccctcatcttcaatcacg | AA016708 | 43861 | tctccaagttctaccagccctag | AA020620 | 86465 | tgtgccttgccttgcagttcgca | X83562 |
| 1258 | gtgccctcatcttcaatcacgaga | AA016708 | 43862 | ccaagtctaccagcctatagta | AA020620 | 86466 | cttgcagtttgccttgcagttcgca | X83562 |
| 1259 | gccctcatcttcaatcacgagaggt | AA016708 | 43863 | agtctaccagcctatagtgaaga | AA020620 | 86467 | gttcgcatcttcggatcattcttg | X83562 |
| 1260 | atctcaatcacgagaggtcttt | AA016708 | 43864 | accagcctatagtgaagacacga | AA020620 | 86468 | tccggatccatggactatatctgcaga | AA116773 |
| 1261 | ttcaatcagagagggtctttttggc | AA016708 | 43865 | aagacacgcaacagcaaatcatcag | AA020620 | 86469 | ccatggactatctgcagagtttcc | AA116773 |
| 1262 | cggggaccaaagcagcagaagagacaca | AA016708 | 43866 | tatactaccacaaaccacgtacaca | AA020620 | 86470 | tgccctgcaaggaggaggagacatag | AA116773 |
| 1263 | ggcaccaaagcagcagaagacaacc | AA016708 | 43867 | gtacaacactagttcaaatgctctc | L41495 | 86471 | cccctgcaaggaggaggagacatag | AA116773 |
| 1264 | ctgtcgcctagcaccatggaagc | AA068780 | 43868 | ttacccaagtgctctattccgggt | L41495 | 86472 | aagccacctggcctatcggccatgt | AA116773 |
| 1265 | ttgtcgcctagcaccatggaagcc | AA068780 | 43869 | aagtgctctattccggtgagaaga | L41495 | 86473 | gcccatcggcctatcggcatgttc | AA116773 |
| 1266 | tagcaccatggaagccacgcaa | AA068780 | 43870 | tcttatccggtgagaagaccta | L41495 | 86474 | ccatcggcctatcggcatgttc | AA116773 |
| 1267 | agcaccatggaagccacgcaagcaag | AA068780 | 43871 | gagaagaacctcactccatgatt | L41495 | 86475 | atctggctatcggcatgtctctg | AA116773 |
| 1268 | gaaccatggaagccacgcaagcaagt | AA068780 | 43872 | aacctcactccatgattggggaag | L41495 | 86476 | catgttctcggatatgtggacaat | AA116773 |
| 1269 | caagctgccacactggtatgttg | AA068780 | 43873 | actccatgattggggaaggaatgg | L41495 | 86477 | tgtctctggatatgtggacaatcc | AA116773 |
| 1270 | gccaactcggtatgttggagatc | AA068780 | 43874 | gcgatcaccgacaccacagagac | L41495 | 86478 | atgtggacaatccaagaagacacaa | AA116773 |
| 1271 | ccaactcggtatgttggagatcc | AA068780 | 43875 | accggacaccacagagactaggat | L41495 | 86479 | atattcgaggagactttggcttat | AA116773 |
| 1272 | caactcggtatgttggagatcca | AA068780 | 43876 | ctcctgagccagaattgtccagtgg | L41495 | 86480 | atggactactcgagagtctccag | AA116773 |
| 1273 | actcggtatgttggagatccaa | AA068780 | 43877 | agccagaattgccagtggttgaaa | L41495 | 86481 | ttatctgcagagtttccaggacaat | AA116773 |
| 1274 | tgtgcggtagcaccatggaagcca | AA068780 | 43878 | ttcaaatgctccattgggtagaga | L41495 | 86482 | atctcagagtttccaggacaatga | AA116773 |
| 1275 | gtcggcctagcaccatggaagccac | AA068780 | 43879 | tgtctcacttgggcaaggggtct | L41495 | 86483 | tcaaaccaggctaccctgggacagc | AA116773 |
| 1276 | tcgccttagcaccatggaagccacc | AA068780 | 43880 | tccggatctcatctgtgctg | L41495 | 86484 | ctgggaacagcccttgctcactatg | AA116773 |
| 1277 | gccttagcaccatggaagccacca | AA068780 | 43881 | catctgtgctgcctgctgcctt | L41495 | 86485 | acagccttgctcactatgtac | AA116773 |
| 1278 | gccttagcaccatggaagccaccaa | AA068780 | 43882 | gttgctgccgcctgccttagccc | L41495 | 86486 | agccttgctcactatgtacag | AA116773 |
| 1279 | ccttagcaccatggaagccaccaag | AA068780 | 43883 | gctgcctgccttagcccagactg | L41495 | 86487 | tttgctcactatgatacaggtca | AA116773 |
| 1280 | cttagcaccatggaagccaccaagc | AA068780 | 43884 | ctgccttagccagactggtgatt | L41495 | 86488 | gcgctgccgaattctcacctgca | AA116773 |
| 1281 | ttagcaccatggaagccaccaagca | AA068780 | 43885 | ctacgttaccaagtgctctatt | L41495 | 86489 | ccgaattctcacctgcaagatat | X99946 |
| 1282 | tatacgcctggggtaatgagaggtg | X03919 | 43886 | aagacctactttcaccagctactg | AA020650 | 86490 | aacgttgccctcagctaccatg | X99946 |
| 1283 | acgtcctggggtaatgagaggtggct | X03919 | 43887 | acctactctaccagctgtgatg | AA020650 | 86491 | accattggccctcatgataaatg | X99946 |
| 1284 | tcctacacggcctatacttagt | X03919 | 43888 | gtcctctactactcagccaccaaga | AA020650 | 86492 | gtgccctcatgcataaatgaagtcc | X99946 |
| 1285 | tacacggcctatactttagtatg | X03919 | 43889 | ctctactactcagccaccaagaacg | AA020650 | 86493 | atctctacacactaagccgaaaaca | X99946 |
| 1286 | acggcctatactttagtatagacg | X03919 | 43890 | tactactcagccaccaagaacgga | AA020650 | 86494 | cttaatttgagccctggctgtttga | X99946 |
| 1287 | atactttagtatagcctgtatacat | X03919 | 43891 | tactagccaccaagaacggca | AA020650 | 86495 | ttgagctggctgtttgaaaattg | X99946 |
| 1288 | tatttgtcatgttttgtgcataga | X03919 | 43892 | gccaccaagaacggcatcctgtacc | AA020650 | 86496 | tcaccgcaaaacaatctaagtcat | X99946 |
| 1289 | atatttagtctgcacctagagca | X03919 | 43893 | accaagaacggcatcctgtaccgag | AA020650 | 86497 | aatctaaagtcatctcacaggccaac | X99946 |
| 1290 | aggtctgcacctagagca ttga | X03919 | 43894 | aaggcatcctgtaccgagttggtg | AA020650 | 86498 | tgtttgtgccaacttccaa | X99946 |
| 1291 | gctgcacctagagcactttgaaat | X03919 | 43895 | atcctgtaccgagttgtagtgtg | AA020650 | 86499 | ttgctgccaactccaataaat | X99946 |
| 1292 | agcactttgaaatacctccattga | X03919 | 43896 | ctgtaccgagttgtgatggtg | AA020650 | 86500 | ttcttcacctgcaagatatcttca | X99946 |
| 1293 | actttgaaatacctccatgttgag | X03919 | 43897 | taccgagttgtgatggtgtacc | AA020650 | 86501 | ccaaacttccaataaatttcgttg | X99946 |
| 1294 | ggctctgcggccgattagactg | X03919 | 43898 | tatgatcaagaatacgcgagatttcg | AA020650 | 86502 | acctgcaagatatttccggagga | X99946 |
| 1295 | tcttgcggccgattagactagaa | X03919 | 43899 | caagattcgcagattgcagttccc | AA020650 | 86503 | acagatcgcagtacgatgatga | X99946 |
| 1296 | tcacacctagaagtactgtaagaatac | X03919 | 43900 | aagttcaaatctcgtgtgagctgt | AA020650 | 86504 | tcagaatcgcatgatggagcac | X99946 |
| 1297 | agaatacctcaatgtttgaggggga | X03919 | 43901 | aaatttctgtgtgaggctgccgc | AA020650 | 86505 | aggacactgccaagctgatgtac | X99946 |
| 1298 | atacctcaatgtttgaggggcatgt | X03919 | 43902 | ttcgtgggagctgtgccgctctgg | AA020650 | 86506 | ctgccaagctggatgtactgaaga | X99946 |
| 1299 | tcgttagctactactaattcct | X03919 | 43903 | gccctgtctgctggatgaggcaaa | AA020650 | 86507 | atcagaaccacaagctgaccaaga | X99946 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1300 | tactctactaattctacacggcct | X03919 | 43904 | cccaggtcctggagcagtcgagg | AA020650 | 86508 | tgaaccaactgattaagcaggcag | X99946 |
| 1301 | tctactaattctacacggcctgta | X03919 | 43905 | agggtctggagcagtcgaggacc | AA020650 | 86509 | tcctgtccagcaattgtcgagct | U76832 |
| 1302 | tgtgagaactgggccgatccatg | W44201 | 43906 | atgaccacctgggtcagtcgaagc | U33535 | 86510 | aattgtcgagtcatcaacaagtg | U76832 |
| 1303 | aactgcgccggatccatgtaactg | W44201 | 43907 | ccgcagtcacggactggatcatt | U33535 | 86511 | agaacatccgagctcggccgacta | U76832 |
| 1304 | tgcaggcagctccatcgctcagct | W44201 | 43908 | aactaacacaggaatgtgtgttcag | U33535 | 86512 | tcctgagctcggccgactacggga | U76832 |
| 1305 | agctcaccaaagcagtagccgc | W44201 | 43909 | cttccaacctctataaacatgtgga | U33535 | 86513 | agacagtcaagatagcctagagaa | U76832 |
| 1306 | ccaaagcagtagccgcaccactgct | W44201 | 43910 | aacatgtggacaccggaaggagata | U33535 | 86514 | aagtcatgatgccatctgtctc | U76832 |
| 1307 | cactgctcactcgcatagcatgg | W44201 | 43911 | ctagacagtggacctgacaaagt | U33535 | 86515 | tgattgccatctggtctctgtcac | U76832 |
| 1308 | tgctcactctcgcatagcatggct | W44201 | 43912 | cagtggacctgacaaagtgacaag | U33535 | 86516 | gtgtctgctcactgtctccatct | U76832 |
| 1309 | tcactctcgcatagcatggctgtg | W44201 | 43913 | atatttcaagccaagctgacaaag | U33535 | 86517 | ctgttctcatcttggctgtcatcat | U76832 |
| 1310 | tggatactttccaaattgtcat | W44201 | 43914 | gacagtgtcttcactgagcccta | U33535 | 86518 | tcatcttgctgtcatcattggcat | U76832 |
| 1311 | atactttctccaaattgtcatcta | W44201 | 43915 | gtcttcactgagcccttaaaacat | U33535 | 86519 | tggctgtcatcattggcatcatccat | U76832 |
| 1312 | ctttctccaaattgtcatctacct | W44201 | 43916 | taaccactataaatgtttcatgc | U33535 | 86520 | tcatcattggcatcaccataaacgt | U76832 |
| 1313 | tcttccaaattgtcatctacctgg | W44201 | 43917 | ccactataaatgtttcatgcggtg | U33535 | 86521 | tcgagtcatcaacaagtgcaactc | U76832 |
| 1314 | tggcgccgatccatgtaactgttc | W44201 | 43918 | tagagatcttcccaacgtactat | U33535 | 86522 | tggcatcaccaaccgttggataa | U76832 |
| 1315 | tccaaattgtcatctacctggtga | W44201 | 43919 | ggaaagaccacagccgcgttcggcat | U33535 | 86523 | tcatcaacaagtgcaactcaactg ca | U76832 |
| 1316 | cgccggatccatgtaactgttccag | W44201 | 43920 | acagcctcggcatctcggaatt | U33535 | 86524 | caatgcgcgaatacggaagaga | U76832 |
| 1317 | atccatgtaactgttccagcagag | W44201 | 43921 | gcctggtcagcaattcgcgggtgga | U33535 | 86525 | tcctgaaggacacgcaggtgactcg | U76832 |
| 1318 | catgtaactgttccagcagaggctg | W44201 | 43922 | ttcggtgtggacagtggactcta | U33535 | 86526 | tctctgcgcgcacagtagatcca | U76832 |
| 1319 | gttccagagggtgggccaaga | W44201 | 43923 | acagtggactctactcggcatgaa | U33535 | 86527 | gcagtatccgagagctccatgatgat | U76832 |
| 1320 | ccccagagggctgagtgcctg | W44201 | 43924 | gactctactccggcatgaacgagaa | U33535 | 86528 | tccgagtccatgagatcttac | U76832 |
| 1321 | acgacggactctgagtggcctgtgc | W44201 | 43925 | tctacctccggcatgaacgagaaggg | U33535 | 86529 | tgatcaaccgcatcgaagaaagaacat | U76832 |
| 1322 | acgaactcgagtggcctgcatc | W44201 | 43926 | ctcctgggagcttattggagcgg | U53584 | 86530 | tttgtaccccagatgctgcaag | U31966 |
| 1323 | aacgcaatgctgagggttaaagg | W44201 | 43927 | gttcctaaactctaaggcttcagtg | U53584 | 86531 | agatgctgcaagagtggctctcct | U31966 |
| 1324 | atgctaggctgttaaaggggttaag | M12289 | 43928 | ctgctgtatgtggatgcagtg | U53584 | 86532 | ggtgcagtcgtccagaatctt | U31966 |
| 1325 | ccaaatcgcgcagtaaacaca | M12289 | 43929 | tgctgatgcagtgcctagaagggg | U53584 | 86533 | cctgtccagaatcctgccaggaaa | U31966 |
| 1326 | gagtaacacatcgcagagaag | M12289 | 43930 | tttgacaacctgttcaaggtgat | U53584 | 86534 | gtccagaatccttgccaggaaactc | U31966 |
| 1327 | gtaacacatcgcagagaggaag | M12289 | 43931 | ccaactcctggaacagtgtgctt | U53584 | 86535 | cagaatcctgccaggaaactcaat | U31966 |
| 1328 | acacatcgcagaggaggaagct | M12289 | 43932 | tcctgaacagtgtgctttccgt | U53584 | 86536 | aatcctgccagaaactcaatgcag | U31966 |
| 1329 | acatctgcagaggaggaaggct | M12289 | 43933 | tctgctgccaggtgtgacttaga | U53584 | 86537 | cctgccaggaaactcaatgacag | U31966 |
| 1330 | gctgccaagggggctgaaggaagca | M12289 | 43934 | acttagaactccgtcctgagtagat | U53584 | 86538 | ggccctttgcctcagatgcagag | U31966 |
| 1331 | ggtcgtctgggggtcactgcctc | M12289 | 43935 | ccggagcatcacagctacaagg | U53584 | 86539 | cctttgcctcagatgcagaggg | U31966 |
| 1332 | tcgctgctgggtcactgcctc | M12289 | 43936 | cagtacgacggcctgaaggcacag | U53584 | 86540 | tttgcctccagatgcagaggggcct | U31966 |
| 1333 | tcactgcctctcgtgttactt | M12289 | 43937 | cagacggctgggggctgggacacgtccgta | U53584 | 86541 | agactgctgaaggccaaggaaagc | U31966 |
| 1334 | ttttctctactgctgactaataa | M12289 | 43938 | cagccattttctgtagcaggacct | U53584 | 86542 | caaggagctgctcctctaataaaa | U31966 |
| 1335 | agaatgctccggtcgcaggacct | M12289 | 43939 | tcctctaacggaaggcacaattca | U53584 | 86543 | tctaataaaaccccaaggcagagtg | U31966 |
| 1336 | aatgtgctccggtcgcaggacctgg | M12289 | 43940 | caattcagtcgttcagaaccagga | U53584 | 86544 | gaatgtccagcatggaggtctc | U31966 |
| 1337 | gaggaacaatcagccaaccctgg | M12289 | 43941 | ttcagaacaaccagaccaacctag | U53584 | 86545 | tgtgccagcatgtggagtcagg | U31966 |
| 1338 | gaggttcaccacaaatcagccag | M12289 | 43942 | acaccaacatcagtcgcaggctgt | U53584 | 86546 | gtccagcatggtgagtcagggcc | U31966 |
| 1339 | ggttcaccacaaatcagccgcagg | M12289 | 43943 | acatcagtcaggctgtgtgacaag | U53584 | 86547 | aaactcaggctggagtcgcagag | U31966 |
| 1340 | ttcaccacaaatcagccagagta | M12289 | 43944 | gatccaagctagccattctccttc | U53584 | 86548 | tgaagagggaccacacagaggagtg | U31966 |
| 1341 | cacaccaaaatcagccgcagtaa | M12289 | 43945 | acattaactcaggcattctttctc | U53584 | 86549 | cgagcacacagaggaggagtg | U31966 |
| 1342 | caccaaaatcagccagagtaaca | M12289 | 43946 | ctgctgttctctgtctgt | U53584 | 86550 | tccattgagatgccagctggcct | AA107731 |
| 1343 | agatgccaaggcatacgtgagc | W44217 | 43947 | cctcagccgccacagttaatgcgac | L01991 | 86551 | atgccagctgctcgatcagcct | AA107731 |
| 1344 | attggccaaggcatacgtgagtt | W44217 | 43948 | tcagccgccacagttaatgcgaccac | L01991 | 86552 | atttccaaagtcgacgggtcct | AA107731 |
| 1345 | tctgacatccctagtcaata | W44217 | 43949 | tgttgctccatcaaagaagaccta | L01991 | 86553 | tccaagtcgcgggtcctat | AA107731 |
| 1346 | tgacatccctagtcagtcaatag | W44217 | 43950 | aggtcaaggccaccacagatggagg | L01991 | 86554 | tccttatccgaacgagagtga | AA107731 |
| 1347 | atccctagtcagtcaatagga | W44217 | 43951 | atgccaccagtgagcagtcag | L01991 | 86555 | tccccgaacgagagtgacctct | AA107731 |
| 1348 | atccctagtcagtcaataggaact | W44217 | 43952 | gatccacgcagccatttctaacatca | L01991 | 86556 | accttcaagcattggggctgagt | AA107731 |
| 1349 | tatgctgtgaactttctttagcagg | W44217 | 43953 | tttctaacatccccctttgtcagg | L01991 | 86557 | ttctaagcattgggcgtgagtcaa | AA107731 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1350 | cttgtgaacttctcttagcaggcag | W44217 | 43954 | acccttgtcaggttatatgtcgt | L01991 | 86558 | taagcattcgggctgagttcaagaa | AA107731 |
| 1351 | aactctttagcaggcgagtgaactc | W44217 | 43955 | tcctactgttctttattgtaaatgc | L01991 | 86559 | agctcctccatctcttcttcagga | AA107731 |
| 1352 | cttcttagcaggcgaggagaatct | W44217 | 43956 | ttattgtaaatgcttgtgggtgata | L01991 | 86560 | tctattctcttcaggatgtagt | AA107731 |
| 1353 | tcttagcaggcgaggagaactga | W44217 | 43957 | atgcttgtgtagaaggctttt | L01991 | 86561 | attctctctcaggatgtacg | AA107731 |
| 1354 | tcctgcgtgcatagtgcatatgcc | W44217 | 43958 | ctcccagtcagccaccaggaaatgt | L01991 | 86562 | ctctgatcacgcctagctcatgtt | AA107731 |
| 1355 | tgccaaggccatactgactgagcttgc | W44217 | 43959 | ccagtcagccaccaggaaatgtgt | L01991 | 86563 | tgatcagcctagctccatgttgag | AA107731 |
| 1356 | atacgtgagcttgcacagagct | W44217 | 43960 | atgctacagcactaaagtgctact | L01991 | 86564 | gaaacacgcgctgactgtgctaa | AA107731 |
| 1357 | tgagcttgcacgcagcctgacca | W44217 | 43961 | atgtcacgtgtgaacacaataa | L01991 | 86565 | acacagcgctgactgttgctaacca | AA107731 |
| 1358 | agctgcacacgagcctgacatc | W44217 | 43962 | aaactcagtcgactgtgtcgcc | L01991 | 86566 | tgtactttgctaacaactccacca | AA107731 |
| 1359 | cacacgagcctgacatccctagt | W44217 | 43963 | ctcagctgaactgttgctgcctat | L01991 | 86567 | aaactgagcctaatttccaagtgct | AA107731 |
| 1360 | cacgagcctgacatccctagtca | W44217 | 43964 | cagctgaactgttgctgcctatcaa | L01991 | 86568 | ctgagctaatttccaagtgctgac | AA107731 |
| 1361 | cgagcctgacatccctagtcaag | W44217 | 43965 | aactgttgctgcctatcaaagaaga | L01991 | 86569 | ctaattccaagtgtcgacgcgggt | AA107731 |
| 1362 | agcctctgacatccctagtcaagtc | W44217 | 43966 | tcccggctccaaagtgagagtc | U53591 | 86570 | catcccagatcagccattacttt | AA107731 |
| 1363 | atgcaccttgtttgccaagaagc | M91602 | 43967 | cctggctccaaagtgagagctcaa | U53591 | 86571 | cagatcagccattacttgctac | U36788 |
| 1364 | ccttgttcccaagaagcgaatag | M91602 | 43968 | tcctattgccacctgccgtgctaa | U53591 | 86572 | atgaatgccttttgaccgccatga | U36788 |
| 1365 | gaccagatgtttgcagccttccc | M91602 | 43969 | aatcttttccgtataaggtat | U53591 | 86573 | ttgaccggcagactggatcatcaa | U36788 |
| 1366 | cctgcaattccgcaattctgatt | M91602 | 43970 | ttccttcagttcatagggttatagtg | U53591 | 86574 | actgaatcaataacgttgtgggcac | U36788 |
| 1367 | gacgttaccgcaatctgattata | M91602 | 43971 | ggtagtaatctctcatttccag | U53591 | 86575 | tcatcaatctgtggcacagagt | U36788 |
| 1368 | ttggtccacatcattacccacgag | M91602 | 43972 | tagtaatctctcatttatccagca | U53591 | 86576 | accagttcactatctgatgtgcg | U36788 |
| 1369 | gtcacatcattacccagagaag | M91602 | 43973 | atctctctattatccagcactca | U53591 | 86577 | tcactatctggatgtgctcgc | U36788 |
| 1370 | aaggactgaggcctgaaccacagcc | M91602 | 43974 | ctctccatattatcccagcactcaa | U53591 | 86578 | tcctggatgtgcgctgcctga | U36788 |
| 1371 | gccctgaaccacacgcctcagtgc | M91602 | 43975 | ctctattatccccagcactcaaaaa | U53591 | 86579 | atcatttctcgcatatgggacag | U36788 |
| 1372 | ctgaaccacagcctcagttgacca | M91602 | 43976 | gtccagactggctcggaatatgag | U53591 | 86580 | tctctgcagtaggacagaatgaa | U36788 |
| 1373 | tctcatccaggctgtgcgcaaa | M91602 | 43977 | atatgcagcagacaacatgatatact | U53591 | 86581 | ctttggtggggctggactgcgtaact | U36788 |
| 1374 | ccatccaggctgtgcgcaaataa | M91602 | 43978 | atgcagcaagcttgcattgtacag | U53591 | 86582 | ttactttgctacctcaagagaga | U36788 |
| 1375 | atcccaaggcattcaagctgttg | M91602 | 43979 | ttcaagcttgatgttacagtacag | U53591 | 86583 | tgctacctcaagaaggagggctcatc | U36788 |
| 1376 | ctcaaagcattcaaggtgttgatc | M91602 | 43980 | tgttaatgttgcccaccttggg | U53591 | 86584 | caattccaagagctgactctgagaa | U36788 |
| 1377 | aaggctgactatgtcgggggatgc | M91602 | 43981 | tgtgtgccaccttggaagaag | U53591 | 86585 | gggaaggccttcatcttcatgagtg | U36788 |
| 1378 | gcfgactatgtcgggggatgctga | M91602 | 43982 | aatgccaatcctaagccctattgc | U53591 | 86586 | ccctcatgctcatgagtgcctg | U36788 |
| 1379 | gagatgtgaccacaagcagagaa | M91602 | 43983 | tgccaattcctaagcctcattgca | U53591 | 86587 | atgctcatgagtgcctggcc | U36788 |
| 1380 | ctgaccacaagcagagaggtct | M91602 | 43984 | taagtccatcgcaccctgcgcgtg | U53591 | 86588 | atgaggtcctgtggccatcgt | U36788 |
| 1381 | accacaagcagagaggttctccca | M91602 | 43985 | agtccatgccacctgcgccgtgct | U53591 | 86589 | atccaccagagcaagaatcgttc | U36788 |
| 1382 | atcgaccgagatgtcgagccttc | M91602 | 43986 | acagacgccaatcatacgactacagtt | AA020692 | 86590 | cgagagccaacatcgactgcggtgaa | U77083 |
| 1383 | ccccatttcgatgatgtcgatat | M91602 | 43987 | gcaccacacgactacgcttcatctg | AA020692 | 86591 | ccaacatgactgggtgaaggagaa | U77083 |
| 1384 | ctatttcgatgatgtcgatat | M63903 | 43988 | atcgagtcgagccaccaaacaagaa | AA020692 | 86592 | caggagctcagacaccagcatccta | U77083 |
| 1385 | tttccatctcgttgcggcatt | M63903 | 43989 | gtcgagccaacaacagcaacaatt | AA020692 | 86593 | caccagcatcctactctcaaggatg | U77083 |
| 1386 | tcctactctgttgccggcatgct | M63903 | 43990 | ccaaccaacaagaacaattcatcaa | AA020692 | 86594 | tccagctcggagccagcctagct | U77083 |
| 1387 | gttgccgcatttgtgatttctag | M63903 | 43991 | acaatttcatcaaatcagactcttt | AA020692 | 86595 | agccagctccttcctaactgtcag | U77083 |
| 1388 | tatactttgtagtctcagtcgggt | M63903 | 43992 | tcatcaaatactcagactcttcaaat | AA020692 | 86596 | cctagctcctaactgtcaggctgac | U77083 |
| 1389 | actttgtagtctcagtcggttga | M63903 | 43993 | atatcagacttcttcaaatcagaat | AA020692 | 86597 | tcctaactgctaggctgacggacac | U77083 |
| 1390 | tagtctcagtcggtgattcat | M63903 | 43994 | ttcaaatcagaatcttccaacactt | AA020692 | 86598 | ctcagggaagccccagctctgaagct | U77083 |
| 1391 | gtgttgattccatcatggaaata | M63903 | 43995 | tcctccaacatttcggacgggct | AA020692 | 86599 | agagctcccgaatgcttactat | U77083 |
| 1392 | tatgttgtacatactgccaagaat | M63903 | 43996 | aacaatttctgaggggttcatag | AA020692 | 86600 | tccctgaatgctttactatccctg | U77083 |
| 1393 | catactgccaagaatgtcctgca | M63903 | 43997 | ttctggacgggcttcatagtagacc | AA020692 | 86601 | attccagaaccaaagaaatcaacaagg | U77083 |
| 1394 | acgtcccaagaatgtcctgcaagt | M63903 | 43998 | tacgtcacgtcctttgcaagt | AA020692 | 86602 | tattcaaggttcacagaacag | U77083 |
| 1395 | aatagagccaactatttgtatgta | M63903 | 43999 | tgcaatgctgaattcagagtcta | AA020692 | 86603 | gcagttagttcctgttcgagaac | U77083 |
| 1396 | tgcttctttccctctggaa | M63903 | 44000 | acagttcatctgggttttgcccac | AA020692 | 86604 | agtcctggttcctgagaaccactg | U77083 |
| 1397 | cctcctgtcctggaactgtcgcca | M63903 | 44001 | tcatctgggttatgccaacggatg | AA020692 | 86605 | tgagaaccactgtcccagtatgac | U77083 |
| 1398 | gaactgtcgcaccgtgatcca | M63903 | 44002 | atgcaacggatggttcctgccat | AA020692 | 86606 | ccactgtcccagtatgaccctct | U77083 |
| 1399 | gtcgcaccgtgatccagtcctg | M63903 | 44003 | ggttcctgcagtgaagaactct | AA020692 | 86607 | gtatgaccacccttactactctcagc | U77083 |

| SEQ ID NO | sequence | DBAxnID | SEQ ID NO | sequence | DBAxnID | SEQ ID NO | sequence | DBAxnID |
|---|---|---|---|---|---|---|---|---|
| 1400 | gtgtgatccgtctcctgctctggct | M63903 | 44004 | ttgaagaactcttaaccagttgct | AA020692 | 86608 | ttactatctcagcagcctgctgcagg | U77083 |
| 1401 | cagatccagtgaagggttctgt | M63903 | 44005 | aactcttaaccagttgctgaatct | AA020692 | 86609 | tctcagcagcctgcagggtctct | U77083 |
| 1402 | aagggtttctgtcttgatgcttca | M63903 | 44006 | ttaaccagttgctgaatcttgaa | AA020692 | 86610 | ttttctctcatccaatcctgaaag | AA107785 |
| 1403 | aactcagatggcgtctaagatcat | W44163 | 44007 | aacacactgcgaactctgaggtttg | U41636 | 86611 | tctcatccaatcctgaaagcat | AA107785 |
| 1404 | ggcgctcaagatcatccgcgggtg | W44163 | 44008 | acacactgcgaactctgaggttg | U41636 | 86612 | ttagtgctcgagctagatccgccag | AA107785 |
| 1405 | aggacatcctcaacaatctgaatga | W44163 | 44009 | atgtagttcaccctgtagagata | U41636 | 86613 | tttcccggcatccaaaatcatggc | AA107785 |
| 1406 | catcctcaacaatctgaatgatgcc | W44163 | 44010 | tgtagttcaccctgtagagatagt | U41636 | 86614 | cggaccatccaaaatcatggctcctag | AA107785 |
| 1407 | tcctcaacatctgaatgatgccat | W44163 | 44011 | gtagttcaccctgtagagatagatg | U41636 | 86615 | catccaaaatcatggctctagtt | AA107785 |
| 1408 | atgatcagctgctagctgctgtag | W44163 | 44012 | atagatgtcttatctagtgt | U41636 | 86616 | ccaaaatcatggctctagtttcag | AA107785 |
| 1409 | gagtcagctgctagctgctgtagag | W44163 | 44013 | agatgtcttattctagtgtgtga | U41636 | 86617 | aaatcatggctctagtttcagaag | AA107785 |
| 1410 | gtcagctgctagagctgctgtagagct | W44163 | 44014 | gatgctcatttagtgtgtgat | U41636 | 86618 | tcatggctcctagttcagagatc | AA107785 |
| 1411 | ctagctgctgtagagctgctgacc | W44163 | 44015 | tgctctatcttagtgtgtgatca | U41636 | 86619 | tggctcctagttcagagatctgc | AA107785 |
| 1412 | agctgctgtagagctgctgaccgt | W44163 | 44016 | gctcttatcttagtgtgtgatcaa | U41636 | 86620 | agtgatgagcgctgcctggccctg | AA107785 |
| 1413 | tgtagagctgctgacgtggggaac | W44163 | 44017 | tctattctttagtgtgtgatcaaca | U41636 | 86621 | tgcctggccctggttcctgagtt | AA107785 |
| 1414 | taagalcatccgcggggtcgacga | W44163 | 44018 | gtgatcaacagtcttcggtcaaat | AA020700 | 86622 | tcatctccaatcctgaaagcatg | AA107785 |
| 1415 | aagatcatccgcggggtcgacgag | W44163 | 44019 | cactgaactcttgaggtttggagt | AA020700 | 86623 | tctccaatcctgaaagcatgtgcc | AA107785 |
| 1416 | atcatccgcggggtcgacgagagc | W44163 | 44020 | ggagtttcgctcaggcaaacaagt | AA020700 | 86624 | ccaatcctgaaagcatgtgccctg | AA107785 |
| 1417 | agctgcgtcggacgagctg | W44163 | 44021 | gagtttcgctcaggcaaacaagtt | AA020700 | 86625 | atcctgaaagcatgtgccctgagtt | AA107785 |
| 1418 | agctgcgagctaggccgagaatcca | W44163 | 44022 | gtttcgctcaggcaaacaagtgc | AA020700 | 86626 | ctgaaagcatgtgccctgagggc | AA107785 |
| 1419 | gagaatccactaatgtcaggacat | W44163 | 44023 | ttcgctcaggcaaacaagttgctt | AA020700 | 86627 | aaagcatgtgccctgaggggcata | AA107785 |
| 1420 | gaatccactaatgtcaggaccatcc | W44163 | 44024 | tcgctcaggcaaacaagttgctt | AA020700 | 86628 | tgtgccccgaggggcataaaccg | AA107785 |
| 1421 | atcactaatgtcaggaccatcc | W44163 | 44025 | tctaacctaccagaaatgtg | AA020700 | 86629 | tggttatgtctgagctagatcggc | AA107785 |
| 1422 | gtgcaggacatcctcaacaactgc | W44163 | 44026 | aaatgtagttcaccctgtagaga | AA020700 | 86630 | gtcactgtggctggttcctagttg | U30838 |
| 1423 | ttaaatgtacatctccaactgtc | W44163 | 44027 | atctgcctgcctgcacggactatg | AA020700 | 86631 | tggttatcagtgctgcgtgggcg | U30838 |
| 1424 | tttttcatgcgtcacacgaag | M84918 | 44028 | tgcctgcctgcacggactatgt | AA020700 | 86632 | ctaatgctcacgtatgtcagtta | U30838 |
| 1425 | agctgatcctgagtgcggcagggc | M84918 | 44029 | ttccggaccattccaggaggaagag | AA020700 | 86633 | atggctcacgtatgtcagttacag | U30838 |
| 1426 | tgatcctgagtgcggcaggc-gctct | M84918 | 44030 | gaagtcatcatccgtgaacaacaaag | AA020700 | 86634 | acagattgccagctcagggtctaat | U30838 |
| 1427 | ttcctttcctcatagcagggtg | M84918 | 44031 | gtcatcatccgtgaacaacaaagt | AA020700 | 86635 | gattgccagctcagggtctaatctt | U30838 |
| 1428 | ttgttgtcacttctcgagcct | M84918 | 44032 | atcatcctgaacaacaaagagtgtg | AA020700 | 86636 | tgccagctcagggtctaatcttct | U30838 |
| 1429 | acagttgcggaaggccactcaggc | M84918 | 44033 | atcctgaacaacaaagagtgtgaca | AA020700 | 86637 | gtctaatcttctggtctaatactt | U30838 |
| 1430 | ggaaggccactcaggtcaggtgta | M84918 | 44034 | tgtgacaattctaccacaacttcaca | AA020700 | 86638 | caaatcctgtgtcctagcataa | U30838 |
| 1431 | ttatctccaggcatgctgtagt | M84918 | 44035 | gacacattctaccacaacttccaca | AA020700 | 86639 | cctgtgtccctagcataatccag | U30838 |
| 1432 | tctcccaggcatgctgtgtgtgca | M84918 | 44036 | gaggacaccaccagggagaagtct | AA020700 | 86640 | cctagcataatccacgaggtcttg | U30838 |
| 1433 | cccaggcatgctgtagtgcaaca | M84918 | 44037 | gacaccaccagggagaagttctgct | AA020700 | 86641 | atccacgaggtcttgagattacaa | U30838 |
| 1434 | atttcctcaagctggcgagtcaggtg | M84918 | 44038 | ttctgctatagagtcaactcgtaact | AA020700 | 86642 | ttatcagtgctgccgtgctgggcc | U30838 |
| 1435 | tttcatgcggctcacagcgaaggcc | M84918 | 44039 | tgaaggaccattccgcgtcactg | AA020700 | 86643 | gttaaatgctaccaccatgat | U30838 |
| 1436 | gctcacggaaggccactgcact | M84918 | 44040 | aaggaccatccccgtcgactgta | AA020700 | 86644 | aaatgctaccaccatgatgaa | U30838 |
| 1437 | cacaggaaggccactgcactcg | M84918 | 44041 | catccccgtcgactgctgtg | AA020700 | 86645 | tgtgctaccaccatgtgaaaa | U30838 |
| 1438 | gaaggccactgcactctgcgca | M84918 | 44042 | ggacttccaaggctgacgaccgcat | AA020700 | 86646 | ttatgaaaacgtgccatgtgtgc | U30838 |
| 1439 | acctcactggccagctgatcct | M84918 | 44043 | atgtgcctcagttcggaccattc | AA020700 | 86647 | tattcaccatcattgaataactt | U30838 |
| 1440 | tcactgggcagctgatcctga | M84918 | 44044 | tggctcagtcggaccaattcag | AA020700 | 86648 | gtaacccaaacatgacaaattat | U30838 |
| 1441 | ctggccagctgatcctgagtg | M84918 | 44045 | cctcagtccggaccattcaggaga | AA020700 | 86649 | accccaacatgacaaatatgat | U30838 |
| 1442 | cagagctgatccgtgagtcgcagg | M84918 | 44046 | cagttccggaccattccaagaagg | AA020700 | 86650 | cccaagccacagcagtgtacaaggt | U30838 |
| 1443 | gtttgcaacagcgacaattga | D14552 | 44047 | gctaacccagtcctgccaacagga | D63644 | 86651 | tctcgagttcgccgtcgttgg | M33934 |
| 1444 | aattgacatccaaacaaaggaat | D14552 | 44048 | cccagtctgccaacagggactcag | D63644 | 86652 | gagttccggagcagtgcaggacaa | M33934 |
| 1445 | tctgcaggttaccatggccgc | D14552 | 44049 | gaggacttgcgacctgcat | D63644 | 86653 | tcgttcctacctgattgctggcat | M33934 |
| 1446 | gggacgttaccatggccgctgatgt | D14552 | 44050 | ggcatgctccccatttctgagt | D63644 | 86654 | tgattgctggcatccagcatttcctg | M33934 |
| 1447 | ctgatgctcctaaagcatccagcg | D14552 | 44051 | ccatttctgagttctagtcaggcaa | D63644 | 86655 | ctggcatccagcattcctgcaaga | M33934 |
| 1448 | aagccatccagtgcgataatgcccca | D14552 | 44052 | ggcttactgcccagcgctatta | D63644 | 86656 | tccagcattcgtcagacattgg | M33934 |
| 1449 | tgaccagcagggtgaaactctcgga | D14552 | 44053 | tactgccagacgtcattatcagc | D63644 | 86657 | attccgtcagacgtcattgccaa | M33934 |

| SEQ ID NO | sequence | DBAxnID | SEQ ID NO | sequence | DBAxnID | SEQ ID NO | sequence | DBAxnID |
|---|---|---|---|---|---|---|---|---|
| 1450 | tcatcagcaggctgaggatgacaa | D14552 | 44054 | ccagaagcctattatcatgccataga | D63644 | 86658 | agagttaaccaagctcaggcat | M33934 |
| 1451 | atgacaacggtaccagcagagacat | D14552 | 44055 | gctattatcatgccatagatgccca | D63644 | 86659 | taaccaagtcagccatgacgta | M33934 |
| 1452 | tctttgggtcaccctcaggacata | D14552 | 44056 | tggacatgcatcacctggctcaa | D63644 | 86660 | acagcctccattgtacgagaacg | M33934 |
| 1453 | accgcctatagatcgagtccatcgc | D14552 | 44057 | tggcactccatggctctaaccaca | D63644 | 86661 | aacagatccagtatatgccttgaat | M33934 |
| 1454 | ttagatctgagtccatcgcctccat | D14552 | 44058 | taaatccattgaataatcatt | D63644 | 86662 | gctttggtccgtcgtatgctga | M33934 |
| 1455 | acatcccaacacaaaggaatgaatcc | D14552 | 44059 | aacaggactccaggtttgctgaga | D63644 | 86663 | gtgttcgttattgctgatgagg | M33934 |
| 1456 | ttctgtcttcgggtgtgacaatc | D14552 | 44060 | tcccaggtcagccagcagcatcacg | D63644 | 86664 | atattgccaaagcttggctcttgg | M33934 |
| 1457 | tagatcatatcacagagagagagaac | D14552 | 44061 | tcgcaacagccgcctggccagactg | D63644 | 86665 | ctcttggggcttccacgtcatgat | M33934 |
| 1458 | aggagacctgcaggccaagaagaacaa | D14552 | 44062 | cagcagcctggccagacgaagtt | D63644 | 86666 | gggcttccacagtcatgatgggctc | M33934 |
| 1459 | ccctgcaggccaagaacaagggcgt | D14552 | 44063 | ttccaggacatgctaccatgccgg | D63644 | 86667 | tggacaaacatctcagcagccagaa | M33934 |
| 1460 | aggaacagctgccgagtcgtgta | D14552 | 44064 | gacatgctaccccatgccgggcgacc | D63644 | 86668 | aacatcagcagcagcagaaccgata | M33934 |
| 1461 | gccatatttaatgctcgcggggacgt | D14552 | 44065 | ccgagcaggggactggcaactata | D63644 | 86669 | gccagaaccgatactacagtgaagc | M33934 |
| 1462 | ttatgtctgcgggagacgttaccat | D14552 | 44066 | actggcaactataacatcgaggact | D63644 | 86670 | ctgacgttgcagccctgctcgatg | U30840 |
| 1463 | gaacaagccaatgctcatctcacca | M74753 | 44067 | atgggaacatcgctccatacacct | D63644 | 86671 | tgtcagccctgctcgatgccagaa | U30840 |
| 1464 | caagccaatgctcatctcaccaagt | M74753 | 44068 | gctccatacaccttcaggtggtag | D63644 | 86672 | agcccctgtagatgccaggctac | U30840 |
| 1465 | agccgatgtgtgggtccatgaaaacg | M74753 | 44069 | gatgtcaccaaaatgctgtgttag | D63644 | 86673 | atctgatccagtcccagatgaaa | U30840 |
| 1466 | tgagcaagaccctcctggtcaggc | M74753 | 44070 | gaagccaagctctagcacactatata | D63644 | 86674 | atccagtcccagatgaaagttgga | U30840 |
| 1467 | agacctcctggtcagggcagagaga | M74753 | 44071 | tggatccgagtcgtaccaagctt | D63644 | 86675 | attgtgactccgacctgcgaacc | U30840 |
| 1468 | cctcctgtcagggcagaagatat | M74753 | 44072 | cgagtctggtaccaagcttgatgca | D63644 | 86676 | acttcccgcatcgaaccctgtg | U30840 |
| 1469 | ttcgtggctctgacaattctactt | M74753 | 44073 | cggtaccaagcttgatgcatagctt | D63644 | 86677 | ccgcatcgaaccctggtgtcaga | U30840 |
| 1470 | gctcgtgcaattctactaattc | M74753 | 44074 | ttcatagtgtcacctaaaatagct | D63644 | 86678 | gtccagatcctatctggaaac | U30840 |
| 1471 | ccagtatcactttccacatgcaa | M74753 | 44075 | ataggtggtaatcatcaggtcata | D63644 | 86679 | atccatctgtcgaagcatgtac | U30840 |
| 1472 | cgtatcactttccacacatgcaataa | M74753 | 44076 | attgttatccgctccacatccaca | D63644 | 86680 | ccacctggtgaaaggagatgttt | U30840 |
| 1473 | ttcactttccacacatgcaataaagt | M74753 | 44077 | tcacaattccacacaacatagagc | D63644 | 86681 | ttagactgatcctcacacctgtc | U30840 |
| 1474 | aatgctcactccaagttgcct | M74753 | 44078 | aagcctcagctaatgaatgagagc | D63644 | 86682 | gccctgctgatgccaagaacgttca | U30840 |
| 1475 | aatgctcatctcaccaagttcagga | M74753 | 44079 | tacacctgcaggtgtagcatg | D63644 | 86683 | ggtggccacagttggccctggccagga | U30840 |
| 1476 | gctcatctcaccaagttcaggaaag | M74753 | 44080 | tggaccaaacagccagagctacct | D63644 | 86684 | cacagttggccctggccagactgaat | U30840 |
| 1477 | cctctgcacgttctcaggacactg | M74753 | 44081 | caaacgccagactaccttatccc | D63644 | 86685 | tgccaggtacctcagaatt | U30840 |
| 1478 | aagcccagcatgctgagctagaagag | M74753 | 44082 | tccctgcacgttactgcggggactg | D63644 | 86686 | atagctacctcagaatttagcta | U30840 |
| 1479 | atcgcaagaatcgcaagctcaataaac | M74753 | 44083 | gacatgtacctgggggactggtcagt | D63644 | 86687 | ttagactccaggtacagcagaaccc | U30840 |
| 1480 | gcaaagaccccgtgactcacctca | M74753 | 44084 | tcccctcttcagatcaaattat | D63644 | 86688 | ccattcagagggtacagcagaaacc | U30840 |
| 1481 | acctcacctctagcccggatggtg | M74753 | 44085 | tctctcagatcaaattcattcaagg | D63644 | 86689 | gaacaggaaaccccattccagaa | U30840 |
| 1482 | acctcagccgaatgctggttggtccatg | AA166601 | 44086 | ttaaaagatgtcaccacaaatgctg | D44443 | 86690 | gaattatgaaccaccaacaaccagge | AA107752 |
| 1483 | attaaacagagcgcatcatcgctg | AA166601 | 44087 | agaattccattacgacataatctg | D44443 | 86691 | ttatgaaccaacaaccagccat | AA107752 |
| 1484 | ttaaacagagcgcatcatcgctgag | AA166601 | 44088 | ccatacgacataatctcatgaa | D44443 | 86692 | aatcctgggcctgtggaaactac | AA107752 |
| 1485 | attcatactgacagttcagttagt | AA166601 | 44089 | ataacaactgatcaggatagtagta | D44443 | 86693 | atcctgggctgctgaaactcact | AA107752 |
| 1486 | tcatcactgacagttcagttgtc | AA166601 | 44090 | acactgacgatgatgatgtagtgatag | D44443 | 86694 | tgctgaaactcactgaagattg | AA107752 |
| 1487 | atcactgacagttcagttagtt | AA166601 | 44091 | gtagtgatagcccaccagtagccttaa | D44443 | 86695 | gaaactcactgaagattcgaactt | AA107752 |
| 1488 | atatgaccaacagatagaagattct | AA166601 | 44092 | atagcccaccagcagtagccttaacaa | D44443 | 86696 | gatcgaacttttctagtggccgcg | AA107752 |
| 1489 | atgaccaacagatagaagattccta | AA166601 | 44093 | gcctttaacacagctctcagacca | D44443 | 86697 | tcgaactttcttagtggccgagcga | AA107752 |
| 1490 | attcctacagagagcaagctcggtt | AA166601 | 44094 | acacagtctctcagacagatttt | D44443 | 86698 | gaactttctgagactgctgatatt | AA107752 |
| 1491 | tagattgcaacagtcatgctgga | AA166601 | 44095 | acagtctctcagacagagttttgc | D44443 | 86699 | ctgagcgattgacactgctgatatt | AA107752 |
| 1492 | gattgccaacagtcatgctggga | AA166601 | 44096 | acgtctctcagacagagtttggc | D44443 | 86700 | gcgattgacactgctgatattaca | AA107752 |
| 1493 | ttgccaacagtcatgctggaagatc | AA166601 | 44097 | gtctctcagacagagtttggcatc | D44443 | 86701 | caagccccattcaggtgattattctg | AA107752 |
| 1494 | tgccaacagttgcatgctggagatct | AA166601 | 44098 | tctcagacagagtttgcatcgt | D44443 | 86702 | tatgaaccaacaaccaggccatt | AA107752 |
| 1495 | acagagttgcatcgctggaagtaca | AA166601 | 44099 | tacgacataatcgtcattgaacaa | D44443 | 86703 | atgaaccaacaaccaggccatg | AA107752 |
| 1496 | gccaacagttgcatgctggagatcct | AA166601 | 44100 | tgcatagttatccagctttggtacc | D44443 | 86704 | tgaaccaacaaccaggccatga | AA107752 |
| 1497 | agagcgcatcatcgctgtgtacaag | AA166601 | 44101 | ttaaagtgcctcgatcaaggatacag | D44443 | 86705 | cacaacaaccaggccattgaaaat | AA107752 |
| 1498 | agcgcatcatcgctgtgtacaagt | AA166601 | 44102 | aagtgcctcgatcaaggatgaccc | D44443 | 86706 | ccaacaaccaggccattgaaatg | AA107752 |
| 1499 | cgcatcatcgctgtagtacaagctag | AA166601 | 44103 | gggcaatagacaccaatccgaagga | D44443 | 86707 | agttgagcaggaatcctggggctgct | AA107752 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1500 | gtacaagctagtagtcctggtgt | AA166601 | 44104 | caatagacccaatccgaaggaaga | AA020683 | 86708 | gaagcgaatccggggcgctgaa | AA107752 |
| 1501 | acaagctagtagtcctggtggtiga | AA166601 | 44105 | acaccaatccgaaggaagaatgcgct | AA020683 | 86709 | aagcgaatccggggcgctgtgaaa | AA107752 |
| 1502 | aagctagtagtcctggtgtgata | AA166601 | 44106 | atgcgctgctactgccaaagaa | AA020683 | 86710 | aacttcaatgcaggaggccacaag | U30839 |
| 1503 | gaattcatcactgacagttcagtta | AA166601 | 44107 | cgctgcgtgctactgccaaagaa | AA020683 | 86711 | tagagatcactgtccctgcgaaat | U30839 |
| 1504 | aatggtactctcaagtcatcacaa | W46084 | 44108 | atacaatgattttcacgtgttgt | AA020683 | 86712 | tgtcctcagccaacaacgtagtgtc | U30839 |
| 1505 | actctcaagtcatcacaaagtccga | W46084 | 44109 | tggtaatctcctctagtttgct | D78644 | 86713 | tcagcaacaacgtagtgtcatgtta | U30839 |
| 1506 | ttctttgacgctgagatcaagaagc | W46084 | 44110 | tagacatttctattgcttctaaata | D78644 | 86714 | cccgtcgtacaccgtgcctgca | U30839 |
| 1507 | gaactgctactccccatattagt | W46084 | 44111 | tcttcctatgctacagtta | D78644 | 86715 | tcctgcatgtccagtccactttc | U30839 |
| 1508 | ctgctactccccatattagtgtc | W46084 | 44112 | ttccctatgctacagttaatc | D78644 | 86716 | atgtccagtccagtccactttccatgg | U30839 |
| 1509 | ctactcccccatattagtgtctca | W46084 | 44113 | gttaatctattgccatcctga | D78644 | 86717 | cagtccactttccatggcctttg | U30839 |
| 1510 | ctcccatattagtgtcaggctgc | W46084 | 44114 | aatcttattgccatcctgaacca | D78644 | 86718 | tgtgccacattcagttgatatcagct | U30839 |
| 1511 | cccatatttagtgtcaggctgc | W46084 | 44115 | cttattgccatcctgaaccaca | D78644 | 86719 | gttatatcagctctgctactgaa | U30839 |
| 1512 | catatttagtgtcaggctgcgt | W46084 | 44116 | attgccatcctgaaccacaaatg | D78644 | 86720 | tcagtctgcctagtgaaggct | U30839 |
| 1513 | atttagtgtcaggctgcgtttaga | W46084 | 44117 | tgccatcctgaaccacaaatgtgt | D78644 | 86721 | tctgtctagtgagctgtttgtt | U30839 |
| 1514 | taggtctcaggctgcgttagaga | W46084 | 44118 | catccctgaacacaaatgtgtatt | D78644 | 86722 | atcactgcctgaaatgaagag | U30839 |
| 1515 | tgtctcaggctgcgttagagaaaga | W46084 | 44119 | ccctgaaccacaaatgtgtatttag | D78644 | 86723 | cttcccacacgtgaagtctagagatt | U30839 |
| 1516 | ctcaagtcatcacaaagtccgagta | W46084 | 44120 | tatatctcctaggtttgctga | D78644 | 86724 | tacagatcatccaatggagatgct | U30839 |
| 1517 | aagtcatcacaaagtccgagtatga | W46084 | 44121 | caltcttttctaaagaccgctgct | D78644 | 86725 | aattgtcatgtttgccacattc | U30839 |
| 1518 | tcacaaagtccgagtatgatgaat | W46084 | 44122 | tcttttctaaagaccgctgtctgc | D78644 | 86726 | catgttttgccacattcagtga | U30839 |
| 1519 | ctgcgtcgtactcactgggagt | W46084 | 44123 | ttttctaaagaccgctgtctgtcgtg | D78644 | 86727 | tgtgccacattcagttgatgtctg | U30839 |
| 1520 | cgtactctcatcgtgggagtccatta | W46084 | 44124 | aagaccgctgcttgctataagctac | D78644 | 86728 | acatttcagttgatgtctgcagagt | U30839 |
| 1521 | tccattaaaggactctttgacgctg | W46084 | 44125 | acgcgtctcttgctatagctactaa | D78644 | 86729 | taaatatgtcctcagcaacaacgt | U30839 |
| 1522 | attaaggactctttgacgctgaga | W46084 | 44126 | ctataagctctaacgcggcattgg | D78644 | 86730 | gtagctttccaaccagcctgagg | U30839 |
| 1523 | aaggactctttgacgctgagatca | W46084 | 44127 | gttaacaacctgtgggcctgtga | D78644 | 86731 | ttctcaaccagcctgagggntct | U30839 |
| 1524 | cctaagtccacatctgctcaggc | W46084 | 44128 | acgaattccaggtgcctgagcag | AA020714 | 86732 | atccagttgccgaaggaaccgagc | U52461 |
| 1525 | ttcgtcctggcgaattcctg | L00923 | 44129 | gaattccaggtgcctgagcagt | AA020714 | 86733 | gaccagcagccgtggaagctgccca | U52461 |
| 1526 | gaccctgatgtgcaacagtgtatcc | L00923 | 44130 | agatccaagatcggcagcgtgta | AA020714 | 86734 | atgttctactcttcctcagcagct | U52461 |
| 1527 | gcacagtgatcacaccccaggtcat | L00923 | 44131 | atcaccccagaagatcggcagtcag | AA020714 | 86735 | tactcttcctcagctagcag | U52461 |
| 1528 | ttagctttgaaactgcatgaaag | L00923 | 44132 | caccccagaagatcgggcgtgcacg | AA020714 | 86736 | gttctcccaaggacagacataagccacg | U52461 |
| 1529 | agccgttcagactgggagatctctct | L00923 | 44133 | agatcgcgtgcacgttccagca | AA020714 | 86737 | gacataagcacgctctcgagct | U52461 |
| 1530 | cgttcagactgggagatctctct | L00923 | 44134 | gcgtcacgcgttcagcagcgtct | AA020714 | 86738 | tggctccaccaactgcagaagcaga | U52461 |
| 1531 | tggcagatctcttgatgtgca | L00923 | 44135 | acgcgtccagcagcgtctggct | AA020714 | 86739 | caccaactgcagaagcagatgacg | U52461 |
| 1532 | cagatcttcttgatgtgcaata | L00923 | 44136 | tcgttcagcagcgtctggctgtgt | AA020714 | 86740 | catttcatatggcgtgaaggctg | U52461 |
| 1533 | atcttcttgatgtgcaataaaa | L00923 | 44137 | aaatgcgacgaacctgaacatcc | AA020714 | 86741 | gcaacactgccaattaaagttcag | U52461 |
| 1534 | acatccaagatcgttcagaagtt | L00923 | 44138 | atgcgacgaacctgaacatctg | AA020714 | 86742 | aaccagcgagggagtctccatca | U52461 |
| 1535 | tgttctctattggaggataaatgt | L00923 | 44139 | caggtgccgagcagctccagt | AA020714 | 86743 | gagtctccatcaacgtcattgctg | U52461 |
| 1536 | cattaaacatacatcattatgttca | L00923 | 44140 | gcggaacctgaactgaacaactggt | AA020714 | 86744 | cccaaatcaaatagcccatcataa | U52461 |
| 1537 | ttaaacatacatcattatgttca | L00923 | 44141 | acgcatttcataactgacct | AA020714 | 86745 | tcaaataagccatcataagcctga | U52461 |
| 1538 | aacatacacatttatggttcagat | W46087 | 44142 | cgcggtcagctccatgcggtca | AA020714 | 86746 | aagccatataagcctgacatttct | U52461 |
| 1539 | tattgttcagatcgtttcacct | W46087 | 44143 | tgagcagtccatgtggtgtcaga | AA020714 | 86747 | agcctgacattctctgatgcc | U52461 |
| 1540 | gtcactgaacagggctgtagaatg | L00923 | 44144 | agcagtccatgtggtgtcaga | AA020714 | 86748 | acatttctcggatgccaccatt | U52461 |
| 1541 | aatgtttctccgttcccagagaa | L00923 | 44145 | catgtcggttcagatgaagagc | AA020714 | 86749 | gatgccaccattgtacactgcca | U52461 |
| 1542 | gcttgttccgttccagaagca | L00923 | 44146 | agggccagattccaccccgaagatcgg | AA020714 | 86750 | tgtcctacatcttctacaacggga | AA107742 |
| 1543 | agatggacctgatgtgcacagt | L00923 | 44147 | gcgcagatcacccagaagatcgcg | AA020714 | 86751 | gtcctacatcttttacaactggccaag | AA107742 |
| 1544 | ctgtagactctcagtccagcca | W46087 | 44148 | caggatcacccagaagatcggcgg | AA020714 | 86752 | aacgcagtcgaacactcggccaac | AA107742 |
| 1545 | actgcttccgtttccagaagacat | W46087 | 44149 | acgcattttccataactgacct | U58471 | 86753 | acgcagtggaacactggccaac | AA107742 |
| 1546 | cctacagctactctcttgcctc | W46087 | 44150 | cgcggtgttccagctcccgagc | U58471 | 86754 | caggtggaacactggccaacgtg | AA107742 |
| 1547 | tacagctactctctttgcctccaa | W46087 | 44151 | ctccctctccgtggagagcatct | U58471 | 86755 | aggcgaacactcggccaacgtag | AA107742 |
| 1548 | agctactcttttgcctccagaa | W46087 | 44152 | caagactcctccacattccaa | U58471 | 86756 | gtgcgaacactggccaacgtgaga | AA107742 |
| 1549 | ttcctttgcctccagaagtca | W46087 | 44153 | acctccaacgccagagagttgg | U58471 | 86757 | gcgaacactggccaacgtgagag | AA107742 |

TABLE 1-continued

| SEQ ID NO | sequence | DBAxnID | SEQ ID NO | sequence | DBAxnID |
|---|---|---|---|---|---|
| 1550 | tctttgcctccaagaaagtccagtc | W46087 | 44154 | cctccaacaggccagagagttggt | U58471 | 86758 | cgaacactcggccaacgtgagaagt | AA107742 |
| 1551 | ttgcctccaagaaagtccagtcga | W46087 | 44155 | tccaacaggccagagagttggtaa | U58471 | 86759 | gaacactcggccaacgtgagaagtc | AA107742 |
| 1552 | aagtccagtcggatggccagatgt | W46087 | 44156 | ccaacaggccagagagttggtaag | U58471 | 86760 | cactcggccaacgtgagaagtccac | AA107742 |
| 1553 | ctcatgaagctgcagcatgcatcac | W46087 | 44157 | ggtgctgactctcgggatagtgct | U58471 | 86761 | actcggccaacgtgagaagtccaca | AA107742 |
| 1554 | cagccctccgggctgagccatggaagc | W46087 | 44158 | gtgctgagtctcgggatagtgtctc | U58471 | 86762 | catctcttacaacgggaagacccag | AA107742 |
| 1555 | ccctccgggctgagccatggaagctct | W46087 | 44159 | caaacaacagacacagagcttcca | U58471 | 86763 | ggagtcatgtctcacgaatcgg | AA107742 |
| 1556 | gtccttcagcagccaagacatgaa | W46087 | 44160 | agttgtatctcttcctccgaag | U58471 | 86764 | gagcatgtctcaggaatcggt | AA107742 |
| 1557 | ctttcagccagacagtgaagta | W46087 | 44161 | agctctccagagccgggcgtgtct | U58471 | 86765 | tgcctgctcgagaacgcagtgcg | AA107742 |
| 1558 | ttagaaccgagccatctctgtaa | W46087 | 44162 | gagagccaagccaattgtaactag | U58471 | 86766 | ccctgctcgagaacgcagtgcgaa | AA107742 |
| 1559 | gaaccgagccatctctgctaaagg | W46087 | 44163 | gctctccagacgcggcgtgtctctt | U58471 | 86767 | ctgtctcgagaacgcagtgcgaaca | AA107742 |
| 1560 | gagccatctctgctaaaggcatgac | W46087 | 44164 | tctccagagcgggcgtgctcctac | U58471 | 86768 | tgtctcgagaacgcagtgcgaacac | AA107742 |
| 1561 | ccatctctgctaaaggcatgacctt | W46087 | 44165 | ctccagagcggcgtgctcttctacc | U58471 | 86769 | tctcgagaacgcagtgcgaacactc | AA107742 |
| 1562 | gcatgacctagtgaccccctaca | W46087 | 44166 | cagagcggcgtgctcttaccgt | U58471 | 86770 | agccggaacacggtgagatgtacga | AA107388 |
| 1563 | tgaccccctacgactcttcctt | W46087 | 44167 | gcttgcctcgggactcgcctct | U58471 | 86771 | acaatatctgaacagcctctca | AA107388 |
| 1564 | tgatatcaccacatgtgacatgc | W46087 | 44168 | ttgcctctgggactgcctctct | U58471 | 86772 | gcaaggtcacctcctggaaggcctcc | AA107388 |
| 1565 | atatcaccacatgttggacatgca | W46087 | 44169 | tgcctctgggactgcgcttctctc | U58471 | 86773 | ccaagaggctggtgtccaaggatga | AA107388 |
| 1566 | gagcactcctactggacatgcaa | W46087 | 44170 | aaatcagctccatacaacgctccg | U58471 | 86774 | actttgtgagtgttggttgtctgc | AA107388 |
| 1567 | gcactctactggagatccaatcga | W46087 | 44171 | ctgcgacagtccgtcactagga | AA021664 | 86775 | tgttggtgtcctgctgtcatggga | AA107388 |
| 1568 | actcctactggagatccaatcgaa | W46087 | 44172 | tccaagatcaacgcgagcaagaatc | AA021664 | 86776 | ttggttgtcctgctgtcatgggacc | AA107388 |
| 1569 | tcctactggagatccaatcgagatg | W46087 | 44173 | ccaagatcaacgcgagcaagaatca | AA021664 | 86777 | ttgtcctgctgtcatgggaccttgg | AA107388 |
| 1570 | ctactgggagatccaatcgagatgag | W46087 | 44174 | acagagtactgtctcgattggg | AA021664 | 86778 | cctgctcatggggactcttgggaa | AA107388 |
| 1571 | cgaacaagaaccagaccaaaagtt | W46087 | 44175 | cagagtactgtctcgattggga | AA021664 | 86779 | tgctgtcatggggacctttgggaaga | AA107388 |
| 1572 | caaagatacagcagccctaagata | W46087 | 44176 | gagtactgtctcgatttgggag | AA021664 | 86780 | ctgtcatggggacctttgggaagaag | AA107388 |
| 1573 | tatcagccctaagatacagagaa | W46087 | 44177 | tgtctcgatttgggaagttgaga | AA021664 | 86781 | ttgactttggaccttgtatgagt | AA107388 |
| 1574 | tcagcagccctaagatacagagaat | W46087 | 44178 | ttaaacaagatccagtcactgagg | AA021664 | 86782 | tattctgaacaagcctcccagttg | AA107388 |
| 1575 | agcagccctaagatacagagaagtt | W46087 | 44179 | acagatccagtcactggagatcaa | AA021664 | 86783 | gacttttgacctgtgattgagttc | AA107388 |
| 1576 | atcaccacacagttgacatgcaaga | W46087 | 44180 | cagatccagtcactggagatccaag | AA021664 | 86784 | ttctgaacaagcctctccagttgaa | AA107388 |
| 1577 | caccacatgttggacatgcaagaca | W46087 | 44181 | gatccagtcactggagatccaagag | AA021664 | 86785 | ctgaacaagcctctccagttgaaac | AA107388 |
| 1578 | agcacatgcaatcagtcatccaa | W46087 | 44182 | ccgacagtccgtcactgtgggaa | AA021664 | 86786 | gaacaagcctccagttgaaacca | AA107388 |
| 1579 | acagatccaatcaagtcatcaaag | W46087 | 44183 | atccagtcactggagatccaagaggg | AA021664 | 86787 | gcctcccagttgaaaccaatatt | AA107388 |
| 1580 | agactccaatcaagtcatcaaaacg | W46087 | 44184 | gacagctccgtcactatggaagata | AA021664 | 86788 | atattacaaactcgggcaaggcacct | AA107388 |
| 1581 | actcaatcaagtcatcaaaagcg'tg | W46087 | 44185 | acagctccgtcactatggaggat | AA021664 | 86789 | tacaaactcgggcaaggcacctcctg | AA107388 |
| 1582 | aagatagaagcactcctactggagat | W46087 | 44186 | agctccgtcactatgaggatga | AA021664 | 86790 | aactcgggcaaggcacctcctggaag | AA107388 |
| 1583 | gatagaagcactcctactggagatcc | W46087 | 44187 | gctccgtcactatgaggatgaa | AA021664 | 86791 | gtaccaggcattctgacaggatgc | AA107388 |
| 1584 | agatgtacctcagaaaccagaggt | W46087 | 44188 | aatttcagagggatccaagatcaa | AA021664 | 86792 | accaggcattctgacaggatgcag | AA107807 |
| 1585 | tgaaagcacaactcagtgactgac | W46087 | 44189 | ggatccaagatcaacgcgagcaaga | AA021664 | 86793 | ggcttaatgtccaactttcagcag | AA107807 |
| 1586 | tgagtatctatcctacgctcctga | W46093 | 44190 | gatccaagatcaacgcgagcaagaa | AA021664 | 86794 | aatcaggggcctgcattgtccaacc | AA107807 |
| 1587 | gtatctatcctacgctcctgaga | W46093 | 44191 | ctacgacctcctgggctccactat | S70056 | 86795 | ctgcattgccaacgaaatgcttc | AA107807 |
| 1588 | ccttacgctcctgagatcctctac | W46093 | 44192 | agctccgtgctactcttaggga | S70056 | 86796 | attgtccaacgaaatgcttcctga | AA107807 |
| 1589 | tacgctcctgagatcctctacgat | W46093 | 44193 | agaatactgcatgccgtcaccagc | S70056 | 86797 | tgccaacgaaatgcttcctgaag | AA107807 |
| 1590 | gctctcgagatttcctccacgatcag | W46093 | 44194 | gcctatctgggctgggtctc | S70056 | 86798 | tccaacgaaatgcttcctgaagga | AA107807 |
| 1591 | gagatcctcctacgatcagaagtat | W46093 | 44195 | tcctgctgtggcttccatgtatg | S70056 | 86799 | atgcttccgaaggacctaacaat | AA107807 |
| 1592 | attcctctacgatcagaagtactgac | W46093 | 44196 | ggtcacccatcaaatgcttcatggt | S70056 | 86800 | gcttcctgaaggacctaacaagtgc | AA107807 |
| 1593 | ctcctacgatcagaagtactccatgtg | W46093 | 44197 | ccatcaaatgcttcatggtccactac | S70056 | 86801 | aaggacctaacaagtgccagaaat | AA107807 |
| 1594 | gtcactgccttctgttttgggtg | W46093 | 44198 | aatgcttcatggtcactatgtttg | S70056 | 86802 | ggacctaacaagtgccagaagttg | AA107807 |
| 1595 | gcctctgttttggagttgccagt | W46093 | 44199 | tgttaagacctgctgcttggttt | S70056 | 86803 | ccagccatctgacaggatgcagaa | AA107807 |
| 1596 | cacaacttcagtgactgacttacta | W46093 | 44200 | gaccctgctgctttgtcatag | S70056 | 86804 | gcatttctgacaggatgcagaggag | AA107807 |
| 1597 | ttcagtgactgacttactaaactac | W46093 | 44201 | ttcatagtatctttaacctgagtaa | S70056 | 86805 | aggagatcacagcctagccacctagc | AA107807 |
| 1598 | tgacttactaaactacttttctg | W46093 | 44202 | gtatcttaacctgagtaaatctg | S70056 | 86806 | gagatcacagcctagccactgcac | AA107807 |
| 1599 | tgacttactaaactacttttctggct | W46093 | 44203 | gcctgctacttcttaggagtcacc | S70056 | 86807 | gatcacagcctagccactagcacga | AA107807 |

| SEQ ID NO | sequence | DBAxnID | SEQ ID NO | sequence | DBAxnID | SEQ ID NO | sequence | DBAxnID |
|---|---|---|---|---|---|---|---|---|
| 1600 | ctttctggctccagaggtcttact | W46093 | 44204 | cctcagccatggctgtcttgggcc | S70056 | 86808 | tcacagctagactcagcaagatg | AA107807 |
| 1601 | ggctccagaggttcttactgggag | W46093 | 44205 | ccatgctgtcttggccctgaaga | S70056 | 86809 | gtgggtccaatctgggcttaatgtc | AA107807 |
| 1602 | gaaccaatactactgtgaagctgt | W46093 | 44206 | actaatgtcatctcagtctgtaagc | S70056 | 86810 | gtccaatctgggcttaatgtccaac | AA107807 |
| 1603 | gcaaatcacgcagagagcctgagtat | W46093 | 44207 | tcagtctgtaagccctgtaagtc | S70056 | 86811 | tggagctactgcctgccccagga | |
| 1604 | ttcccaaagttggaagccaagtcat | M33212 | 44208 | cctctgaaagcttcggcaaaatg | S70056 | 86812 | tggcacccaagaaggccaagaag | |
| 1605 | aattgttccggatgactgaccagg | M33212 | 44209 | ctccagtcagcttcctaacattt | S70056 | 86813 | atcttcggacacttgcagccat | |
| 1606 | atctctggcagtggaagactctc | M33212 | 44210 | gtcagcttcctaacattttgaga | S70056 | 86814 | ccatggccgtcaatgtgaagaa | |
| 1607 | ctgtctcattctgtaatagtaa | M33212 | 44211 | aagcccacatttgaggtggctcat | AA021692 | 86815 | tgggccgtcaatgtgaagaatga | |
| 1608 | gtctcattctgtaatagtaata | M33212 | 44212 | aagcccacatttgaggtggctcatc | AA021692 | 86816 | atgaggaactgacgctatgatgaa | |
| 1609 | tgagaacttcctactgtgttga | M33212 | 44213 | gcaagacatacattccactaggt | AA021692 | 86817 | aactgacgctatgatgaaggaagc | |
| 1610 | cttccctactgtgtttgataaatg | M33212 | 44214 | caagacatacattccactaggtc | AA021692 | 86818 | aagcagtgggccatcaacttcac | |
| 1611 | ttccctactgtgtttgataaatg | M33212 | 44215 | agacatacatttccactatgtgcg | AA021692 | 86819 | ccagtggccatcaacttcactgt | |
| 1612 | tcccctactgtgtttgataaaatgt | M33212 | 44216 | catacatttccactatgtcggtt | AA021692 | 86820 | ggcccatcaactcactgtcttcct | |
| 1613 | tccctactgtgtttgataaaatgtg | M33212 | 44217 | acatttccactatggtcggttcag | AA021692 | 86821 | ccatcaactcactgtcttcctgac | |
| 1614 | algcctgttagttcaaggatgg | M33212 | 44218 | cattccactatggctcggttcagg | AA021692 | 86822 | tcaacttcactgtcttcctgaccat | |
| 1615 | tgcctgttagttcaaggatga | M33212 | 44219 | ttccactatggctcggtttcaggaat | AA021692 | 86823 | aagggagctcaacgtctctccat | |
| 1616 | atgtttccggatgactgaccagga | M33212 | 44220 | aaaatctgacgtcaatgcaattatcc | AA021692 | 86824 | ggagtcaacgtctctccatgtt | |
| 1617 | gttccggatgactgaccaggaggc | M33212 | 44221 | atctgacgtcaatgcaattatccat | AA021692 | 86825 | ccaagtctctccatgtttgacca | |
| 1618 | ttccggatgactgaccaggaggcta | M33212 | 44222 | cgtcaatgcaattatccattattta | AA021692 | 86826 | acgtcttccatgtttgaccagac | |
| 1619 | tccggatgactgaccaggaggctat | M33212 | 44223 | gcccacattgaggtcatctcta | AA021692 | 86827 | tctctccatgtttgaccagactca | |
| 1620 | atgactgaccaggaggctattcaag | M33212 | 44224 | attgaggtggctcatctagaacctg | AA021692 | 86828 | tgtttgaccagactcagatccagga | |
| 1621 | aggctattcaagatctctggcagtg | M33212 | 44225 | ggtggctcatctagacctgccaaga | AA021692 | 86829 | ttgaccagactcagatccaggagtt | |
| 1622 | gctattcaagatctctgcagtga | M33212 | 44226 | gtgctcatctagacctgccaaga | AA021692 | 86830 | aggatctgggacacttcgagc | |
| 1623 | atccagatctctcgcagtgga | M33212 | 44227 | gctcatctagacctgccaagaatgt | AA021692 | 86831 | tggagctactgcctgccccaga | |
| 1624 | actactaatgtctctcctgtgg | L30104 | 44228 | tcatctagacctgccagaatgtat | AA021692 | 86832 | gggagctactgcctgccccagga | |
| 1625 | gacgatgacttctcttcagtgaca | L30104 | 44229 | catctagacctggcaagaatgtata | AA021692 | 86833 | ggcacccaagaaggccaagaaag | |
| 1626 | cccatcgcaacgcagtggccacg | L30104 | 44230 | tctagacctggcaagaatgatata | AA021692 | 86834 | gcacccaagaaggccaagagaaagg | |
| 1627 | ttgcaacgcgtggccacggagagt | L30104 | 44231 | taatactttcaaagttctcacaag | Z37164 | 86835 | taagacatggcacccaagaaggcca | |
| 1628 | acacacaaagatgcattaaaca | L30104 | 44232 | caaagttctcacaaggatgaagctgt | Z37164 | 86836 | aagacatggcacccaaggaaggccaa | |
| 1629 | gatccaaagtggctgcctggaga | L30104 | 44233 | tgaagtccctgctgtaagagatag | Z37164 | 86837 | agacatggcacccaagaaggccaag | |
| 1630 | aatctgatccaattccaaggttg | L30104 | 44234 | ggctattaaacttggccactaatgct | Z37164 | 86838 | gacatggcacccaagaaggccaaga | |
| 1631 | aaggttgcactcactactcaaga | L30104 | 44235 | tattaaacttggccactatgtgca | Z37164 | 86839 | acatggcacccaagaaggccaagag | |
| 1632 | cagtactcaagaaccatctctact | L30104 | 44236 | cactaatgctcagtcactactaga | Z37164 | 86840 | catggcacccaagaaggccaagaga | |
| 1633 | ttcaagaaccatctactgtctcca | L30104 | 44237 | taatgctgcagtcactactaaga | Z37164 | 86841 | atggcacccaagaaggccaagaga | |
| 1634 | aaccatctctactgtctccactaaa | L30104 | 44238 | tgcagtcactgtactaagagttggat | Z37164 | 86842 | tggcacccaagaaggccaagaagg | |
| 1635 | ccaagaccaagaatcgcaataaaca | L30104 | 44239 | agtcactgtactaagagttgatcag | Z37164 | 86843 | tggagctactgccttgccccagga | |
| 1636 | gactttctcagcgacaagacca | L30104 | 44240 | catcatggcaaaaccagctgggagg | Z37164 | 86844 | gggagctactgccttgccccagga | |
| 1637 | ctctcagcgacaagaccaagatg | L30104 | 44241 | tgtactctgcgggtgtacaataa | Z37164 | 86845 | ggcacccaagaaggccaagaagaag | |
| 1638 | actaccagttcaggctgctgtatg | L30104 | 44242 | actctgctgggtgtacaataaaatg | Z37164 | 86846 | gcacccaagaaggccaagaaggccaag | |
| 1639 | tcattccaggcctgcgacggttc | L30104 | 44243 | agttctcacagagggatacagtctt | Z37164 | 86847 | taagacatggcacccaagaaggccaa | |
| 1640 | ggctttccggatgcagttgacca | L30104 | 44244 | ggataaggctgttgacctgccggagt | Z37164 | 86848 | aagacatggcacccaagaaggccaa | |
| 1641 | ccggatgcagttgaccagcggcg | L30104 | 44245 | taaacaaatcacatatggagctg | Z37164 | 86849 | agacatggcacccaagaaggccaag | |
| 1642 | ttcttggctcacgaacaacctcc | L30104 | 44246 | aatcacatcatatggagacgtgt | Z37164 | 86850 | gacatggcacccaagaaggccaaga | |
| 1643 | tttgatccatcgcacgagtgg | L30104 | 44247 | agagacgtgtcctgggctgaacag | Z37164 | 86851 | catggcacccaagaaggccaagag | |
| 1644 | gagcagcagttgcactttgacag | M30514 | 44248 | gttgaagcgattccacgggcactg | Z37164 | 86852 | acatggcacccaagaaggccaagag | |
| 1645 | tgagcgagtctgttcaccaagccat | M30514 | 44249 | agcgattccacgcactgccagaa | Z37164 | 86853 | atggcacccaagaaggccaagaga | |
| 1646 | tcctccctgggccttggggaggtcgct | M30514 | 44250 | ttctggtgaaggccaatgaagtt | Z37164 | 86854 | tggcacccaagaaggccaagaagg | |
| 1647 | gctgagtgtcttctgtgggaatta | M30514 | 44251 | aagtcctggcaittgatctgaccgt | X84311 | 86855 | tggatttcagaacatcagttgcaa | |
| 1648 | aggcttccctgggaagatagagga | M30514 | 44252 | tggcattttgatctgaccgttcaac | X84311 | 86856 | cccaatctggcacctgattcac | AA107868 |
| 1649 | caccactgacttgacagtctga | M30514 | 44253 | cagaaacacttctgcattacgg | X84311 | 86857 | ctgattcacgcattgggtatgct | AA107868 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 1650 | M30514 | tgacttgagcagtctgataggc | 44254 | X84311 | atgagattgcctgcctgagtga | 86858 | AA107868 | tggattcacgcattgggtatggtc |
| 1651 | M30514 | cacttgaagcctcaagagctctgc | 44255 | X84311 | ctgccgaatgagctgcataaagc | 86859 | AA107868 | ggattcacgcattgggtatggctcc |
| 1652 | M30514 | ctaagagctctgcctttcctgatgt | 44256 | X84311 | acaaggcttgaagtaccctgcacgt | 86860 | AA107868 | gattcacgcattgggtatggctcct |
| 1653 | M30514 | gctcgtgcctttcctgatgcattga | 44257 | X84311 | tcatgagccgcctgagttcttcc | 86861 | AA107868 | ctcctacatagtctcggaagaactt |
| 1654 | M30514 | tttcctcgccatttgtaagatt | 44258 | X84311 | agccgcctgagttcttccctgca | 86862 | AA107868 | tcctacatagtctcggaagaactg |
| 1655 | M30514 | ctatatttctaactatgtatgta | 44259 | X84311 | ttggccacacagcaggcttgctct | 86863 | AA107868 | cgttcacatagtctcggaagaaggctatagctc |
| 1656 | M30514 | gagtcgtcttcctagccatgctctc | 44260 | X84311 | gcaggctgtctgaggttctgag | 86864 | AA107868 | cgttcacagagggcgtataggtcc |
| 1657 | M30514 | tcatctgtggcactgctggcatct | 44261 | X84311 | ggccaactaaggcagttgtacata | 86865 | AA107868 | gttcacagagggcgtataggtccc |
| 1658 | M30514 | ctgcdggcatctcctcatggccca | 44262 | X84311 | gtacataacaccttcacatgagaa | 86866 | AA107868 | ggcgctataaggtccccttgggtct |
| 1659 | M30514 | gcatctctcatggccactacaa | 44263 | X84311 | tcctccttcagtacctaaggcgtca | 86867 | AA107868 | atctggggcacactggattcacgca |
| 1660 | M30514 | tcctcatggccctactacaaccaagt | 44264 | X84311 | tgagcctctggaagtgaccgtt | 86868 | AA107868 | gggcacactggattcacgcattggg |
| 1661 | M30514 | tgcctgacctgccgtccccgaga | 44265 | X84311 | ttcctggaacgtgaccgttctgaa | 86869 | AA107868 | gggcacactggattcacgcattgggt |
| 1662 | M30514 | acctgccttgccagactgggtgaccga | 44266 | X84311 | aagctgaccgtctgaagtatct | 86870 | AA107868 | gcacactgcgattcacgcattgggta |
| 1663 | M30514 | cttgccagactgaggccaccaa | 44267 | X84311 | tgctgcagcagcttactgctggc | 86871 | AA107868 | cacactggattcacgcattgggtat |
| 1664 | AA168633 | atcacagccaaggtgcagtacatca | 44268 | X84311 | cttactgcctgcaaatatatgt | 86872 | AA107871 | acactggattcacgcattggtatg |
| 1665 | AA168633 | attcattactgccaggaaagtgtg | 44269 | X84311 | gacactctggccagaaaacacttgc | 86873 | AA107871 | cactggattcacgcattggtatgg |
| 1666 | AA168633 | caccaagtgctcgtcgtgtaccac | 44270 | X84311 | tctgaccgaaaacattgctgcatt | 86874 | AA107871 | actggattcacgcattggtatggc |
| 1667 | AA168633 | caattggctctgctcgtgtaccacgag | 44271 | X84311 | acgacagctgaccatcgtagtctc | 86875 | AA107871 | cagccagcaggtctggagcatat |
| 1668 | AA168633 | tggctctgtgtaccacgaggtc | 44272 | X84311 | cgcagctgaccatcgtagtctcgg | 86876 | AA107871 | cccagcaggtctggagcatagta |
| 1669 | AA168633 | tgtcgtaccacgaggtcatcaac | 44273 | X84311 | tacaccagtgatgatcaaggaatgc | 86877 | AA107871 | aacacaatgtgcgctggaaatga |
| 1670 | AA168633 | ccgtgtaccagaggtcatcaacgcc | 44274 | X84311 | tcaagaatgtgctggagagatgc | 86878 | AA107871 | acaatgtgcctggaaattgaatc |
| 1671 | AA168633 | gtaccacgaggtcatcaacgccatg | 44275 | X84311 | ggagatcatcgcaagcaagagtacat | 86879 | AA107871 | atgtgcctggaaatgaatctgc |
| 1672 | AA168633 | cgaggtcatcaagccatgcagtgc | 44276 | X84311 | agatcatcgcaagcaagagatcca | 86880 | AA107871 | ttctcaggggaaccatgggatcca |
| 1673 | AA168633 | ggtcatcaaagccatgcagtgcagg | 44277 | X84311 | atcattcgcaagcaagagtacatgc | 86881 | AA107871 | ctcagggaaccatggggatccatgc |
| 1674 | AA168633 | catcaacgccatgcagtcgcaggtgt | 44278 | X84311 | tacatcaagacagaccatgccatgcc | 86882 | AA107871 | aggaaccatggagaatccatgccgga |
| 1675 | AA168633 | cgccatcagtgccaggtgcagtgtg | 44279 | X84311 | acgagcatggcctacacatgtagat | 86883 | AA107871 | gaaccatggagaatccatgccgggag |
| 1676 | AA168633 | aagtgccagcaaaagctgtgatact | 44280 | X84311 | ggcctacatcgtagatgctttaac | 86884 | AA107871 | ccatggagaatcatggcgagacgat |
| 1677 | AA168633 | tgtgccaggcaaaagctgtgactccca | 44281 | X84311 | cctacatctagatgctttaaccg | 86885 | AA107871 | atgggatccatgcgggagacgat |
| 1678 | AA168633 | aaagctgtgatactccattgacatcg | 44282 | X84311 | gatgctttaacgctagtatagacgct | 86886 | AA107871 | ggatccatgcggagacgatcaaaa |
| 1679 | AA168633 | gctgtgtatactcattgacatcgag | 44283 | X84311 | agctgaccatcgctggagat | 86887 | AA107871 | acagggcctggacattacgcattgtagac |
| 1680 | AA168633 | gtgtactccattgacatcgagatg | 44284 | X84311 | gtatagacgctacgtaggtggtga | 86888 | AA107871 | agtctggagcatatgagacatt |
| 1681 | AA168633 | gcctgcactgcaccaatggctct | 44285 | X84311 | gacatcgtagtctcggagatgcta | 86889 | AA107871 | atatgtagacatttccgaacacaa |
| 1682 | AA168633 | ctgcactgcaccaatggctctgtc | 44286 | X84311 | ccatcgtagtctcggagatctata | 86890 | AA107871 | tgtagacatttccgaacacaatg |
| 1683 | AA168633 | gcactgcaccaatggctctgtgg | 44287 | X84311 | atcgtagtctcggagatgctataga | 86891 | AA107871 | agacattcccgaacacaatgtgcg |
| 1684 | D76440 | aggtcaccagggcactgatcatcca | 44288 | AA022321 | cgtagtctcggagagatctatagatg | 86892 | AA107871 | catttcccgaacacaatgtgccgct |
| 1685 | D76440 | alagtttcgaccatactaggct | 44289 | AA022321 | ccgttcccgaagttgaatcagtt | 86893 | AA107871 | tcccgaacacaatgtgccgctgga |
| 1686 | D76440 | gcaacagaccgcagacaagagaaa | 44290 | AA022321 | gaatcaggtgccggaggtacaca | 86894 | AA107871 | ccgaacacaatgtgcctggaaat |
| 1687 | D76440 | aggcctttcctatagcttcac | 44291 | AA022321 | atcaggtggccgaggtaccaca | 86895 | AA107871 | cggcactgaccaatactaggcc |
| 1688 | D76440 | ttctcatatgacttcaactgcac | 44292 | AA022321 | ctggttgcactgctgtctgagcctg | 86896 | AA107871 | ctgtaccaatacataggccaggag |
| 1689 | D76440 | atatgactttcaactgcacaggaag | 44293 | AA022321 | ggtctgagctctgtgaatgaagtaa | 86897 | AA107871 | ccaaacctgccagttgaagcctctg |
| 1690 | D76440 | cttcaactgcacaggaagcatcca | 44294 | AA022321 | tagcatataggcacctttggaa | 86898 | Z26580 | tccaagccaagttggaccctgtgta |
| 1691 | D76440 | tgaactgactgctcagttgtagg | 44295 | AA022321 | cttaagcacatagtctaaccgc | 86899 | Z26580 | ccagtggaccctgtatggagg |
| 1692 | D76440 | ggactgttcagttgtaggtccactta | 44296 | AA022321 | agagtcctaacgctcccatcccag | 86900 | Z26580 | ggaccctgtatggaggatgaagc |
| 1693 | D76440 | ttctcagtgtaggcactagcaccc | 44297 | AA022321 | tcctccagtcaaggagagctcccaag | 86901 | Z26580 | cactgtagcaccatgcctggtac |
| 1694 | D76440 | gcaactgcaccttttacaaaacat | 44298 | AA022321 | aagtaagtagctcctgcagctctg | 86902 | Z26580 | catttcctgtccaatgtag |
| 1695 | D76440 | agccacccttacaaaacatgtatgc | 44299 | AA022321 | gtagctcctgcagctctgaaaatt | 86903 | Z26580 | ctgccctggggagaaagtgctgtc |
| 1696 | D76440 | tctgaccatactagggctgtgtaa | 44300 | AA022321 | atglaggccagatgctcaattc | 86904 | Z26580 | agtgctgtgactgcccagagttag |
| 1697 | D76440 | ccatactagggctgtgtaagggtg | 44301 | AA022321 | atgctcaattcttgctaccaggac | 86905 | Z26580 | gctgtgcactgcccagagttaggag |
| 1698 | D76440 | tagagtatcccacagtgcacactgtga | 44302 | AA022321 | ttgcaccaggacgccccatgaaa | 86906 | Z26580 | gctgtgcccagagttaggagacg |
| 1699 | D76440 | atcccaaatccacagtgcagtattt | 44303 | AA022321 | gtttgccattttctctgaacag | 86907 | Z26580 | caatactgcacataggccggatgggatg |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1700 | ttttccatacagtgctttgtacct | D76440 | 44304 | atataacagtcactgtatcccatc | Z26580 | 86908 | gtcattgagatctcatagaagact | X97650 |
| 1701 | atacagtgctttgtacctgtaat | D76440 | 44305 | cagctcactgtatcccatctgtcct | Z26580 | 86909 | ctcatagaagactcatctgctggt | X97650 |
| 1702 | tctgtctcttttgtatgggactgat | D76440 | 44306 | tcccatctgtcctgagtgggtcac | Z26580 | 86910 | cttcatgccaggaaggtctcttc | X97650 |
| 1703 | ttaacagcaacgcagatacgagcaa | D76440 | 44307 | ctctgaaagtgccccattttatag | Z26580 | 86911 | gaaggtcttccaggaaacatatg | X97650 |
| 1704 | gatggtcctacgacattctgactga | D76440 | 44308 | ctctggctccaaataatcattttct | Z26580 | 86912 | ctctttccaggaaacatgtggaga | X97650 |
| 1705 | ggtcctctacgacattctgacatc | W45807 | 44309 | ctccaaataatcattttcttctt | Z26580 | 86913 | aagatctgatgtcatccaccagc | X97650 |
| 1706 | caagttcagcctctagcagatac | W45807 | 44310 | ttcactactctgatagcactatagg | Z26580 | 86914 | tgggatccaaacctgccatggaa | AA107887 |
| 1707 | caatgacattcattcttggctgccc | W45807 | 44311 | atctgatgacactatagggggacct | Z26580 | 86915 | ctggcgactaggcctctgtggcaga | AA107887 |
| 1708 | cattttcattctggctgccctctgag | W45807 | 44312 | cgcatcagtagccgacgccgaagag | Z26580 | 86916 | tggcgactaggcctctgtggcagag | AA107887 |
| 1709 | ttcattctggctgccctctgagaac | W45807 | 44313 | atcagtagccgacgccgaagagac | X17500 | 86917 | aagccaaagagctccaacaagcacg | AA107887 |
| 1710 | ctggctccctgagaactacacag | W45807 | 44314 | gctgctcatctgcagcaggcggtg | X17500 | 86918 | gccaaagagctccaacaagcacga | AA107887 |
| 1711 | gccctctgagaactacacgagaat | W45807 | 44315 | cctgcagcaggcggtgcaggtcatc | X17500 | 86919 | ccaaagagctccaacaagcacgaa | AA107887 |
| 1712 | tgatttctatgacatgtcgaaca | W45807 | 44316 | gcaggtcatccggcctggcgagcag | X17500 | 86920 | caaagagctccaacaagcacgaagg | AA107887 |
| 1713 | ttctatgacatgtcgagccgtcagt | W45807 | 44317 | cgggcacctgtgagccgtcacagtt | X17500 | 86921 | aagagctccaacaagcacgaagga | AA107887 |
| 1714 | ctatgacatcgtcgaacatgtcgga | W45807 | 44318 | gcacctgtgagccgtcacagttct | X17500 | 86922 | aagagctccaacaagcacgaaggga | AA107887 |
| 1715 | catgtcgaacatcgtcggaagagag | W45807 | 44319 | gtgagccgtcacagttctcttgtt | X17500 | 86923 | agagctccaacaagcacgaaggaa | AA107887 |
| 1716 | ccgcctttctggatgtggaggaag | W45807 | 44320 | ggaccatcgtccaaccatatctgc | X17500 | 86924 | gagctccaacaagcacgaaggaaa | AA107887 |
| 1717 | ccttttctggaggatgagcgc | W45807 | 44321 | gtcatcagagcggttcgtgatgag | X17500 | 86925 | agctccaacaagcacgaaggaaaa | AA107887 |
| 1718 | cctgaagcagttcctcgtcggaac | W45807 | 44322 | tgagcaggtcctcatcgaagcatg | X17500 | 86926 | gcgactaggcctctgtggcagaga | AA107887 |
| 1719 | gaagcagttcctcgtcggacatc | W45807 | 44323 | tctccatcgaagcatgacagagag | X17500 | 86927 | cgactaggcctctgtggcagagaa | AA107887 |
| 1720 | gtccctctgagaatcatcgacca | W45807 | 44324 | ggaactgaaggtcccaccacgcgc | X17500 | 86928 | gactaggcctctgtggcagagaatc | AA107887 |
| 1721 | ggacatcaaccagagtgtcaagtt | W45807 | 44325 | caagccgaccacgcagtacagatgag | X17500 | 86929 | agttcaagccaaagagtccaacaa | AA107887 |
| 1722 | catcaaccagagtgtcaagtttcag | W45807 | 44326 | cattaacagaggcttccgggagctg | X17500 | 86930 | gttcaagccaaagagctccaacaag | AA107887 |
| 1723 | tgtcaagtttcagcctctagcag | W45807 | 44327 | catgtccgtgcacctcaagtcg | X17500 | 86931 | ttcaagccaaagagctccaacaagc | AA107887 |
| 1724 | cactgcctctgacatacgagct | X74671 | 44328 | ccagctcgacctcaagtcggataag | X17500 | 86932 | tcaagccaaagagctccaacaagca | AA107887 |
| 1725 | ctcctgacataccgagctgcat | X74671 | 44329 | gcacctcaagtcggataaggcggca | X17500 | 86933 | caagccaaagagctccaacaagcac | AA107887 |
| 1726 | agaagagcaaagcaactcgagaggca | X74671 | 44330 | gcgcagaccaagctgctcatctg | X17500 | 86934 | aaggaatgcctgctctatcattt | AA107893 |
| 1727 | cggcctggacgtcctacacagtga | X74671 | 44331 | gaccaagctgctcatctgcagcag | X17500 | 86935 | aggaatgcctgctctatcatttt | AA107893 |
| 1728 | agagctcagagaggggcgggcccag | X74671 | 44332 | cctgttcggtccaatctatctag | X17500 | 86936 | ggtatcctcagcactgaccaagac | AA107893 |
| 1729 | atacccatttaaaagtactactctga | X74671 | 44333 | cggtccaatcctatcatgcaagat | U62523 | 86937 | gtatcctcagcactgaccaagaac | AA107893 |
| 1730 | agctcactctgcagagcgccaagtc | X74671 | 44334 | gggtatctgcagtccaagcccac | U62523 | 86938 | tatcctcagcactgaccaagaccg | AA107893 |
| 1731 | ctcgagagccagtcccagtcccgagt | X74671 | 44335 | tctcggccagtccaagcaagtc | U62523 | 86939 | cctcagcactgaccaagaccgcg | AA107893 |
| 1732 | ctgcagacatcgtcgtctgacca | X74671 | 44336 | aagccacgtccaggaaaactgcgt | U62523 | 86940 | cctcagcactgaccaagaccgcga | AA107893 |
| 1733 | acatctgctctcgtcgaccaacca | X74671 | 44337 | tgtttccacaggacactttgctgc | U62523 | 86941 | tcagcactgaccaagaccgcgaga | AA107893 |
| 1734 | ctctgagttgaggtcgccgtgcca | X74671 | 44338 | acactttgctgcaatctcagacct | U62523 | 86942 | agcaactgaccaagaccgcgagaga | AA107893 |
| 1735 | agttttccacaagttgtctaggt | X74671 | 44339 | tccatcagctccaaagtaaaaccga | U62523 | 86943 | cacttgaccaagaccgcgagagaga | AA107893 |
| 1736 | acatacggagctgacattatgc | X74671 | 44340 | aaccgaaaagctaaactgcatgg | U62523 | 86944 | acttgaccaagaccgcgagagaga | AA107893 |
| 1737 | cgagcttgacatttgcaggt | X74671 | 44341 | gaattgacagtctcgcctgtc | U62523 | 86945 | ctgaccaagaccgcgagagagact | AA107893 |
| 1738 | ttatgctgacagctgcattcga | X74671 | 44342 | tattgacagtcctcgcctgtc | U62523 | 86946 | ggtatacctaacctgctgttag | AA107893 |
| 1739 | ctgacagttgcattgcatctgcat | X74671 | 44343 | tctgcccctgtcctgtgaaaat | U62523 | 86947 | gtatacctaacctgctgtttatg | AA107893 |
| 1740 | gcttgcattttgacttcaagaagaa | X74671 | 44344 | gagaccaaatgctcactatgtaggg | U62523 | 86948 | tatacctaacctgcgttattatgg | AA107893 |
| 1741 | cattgctcaaggatacggacat | X74671 | 44345 | agggcactaatacaccccatggct | U62523 | 86949 | acctgcgttattgggtatccta | AA107893 |
| 1742 | tgaaggagctttccatgagatgaa | X74671 | 44346 | acacacagtcgttccacagga | U62523 | 86950 | ttatgggtatcctcagcactgacc | AA107893 |
| 1743 | gacttttcatggagatagagaaaga | X74671 | 44347 | tgtttccacaggacactttgctgc | U62523 | 86951 | tatgggtatcctcagcactgacca | AA107893 |
| 1744 | ctgtcaacatagacatagacaca | W45834 | 44348 | acactttgctgcaatctgcagagact | U62523 | 86952 | atgggtatcctcagcactgaccaa | AA107893 |
| 1745 | tgctcacacatagcacagcagga | W45834 | 44349 | tttagctgagtgtgttgagggctc | U62523 | 86953 | gggtatcctcagcactgaccaaga | AA107893 |
| 1746 | ttttcatctgagagtcgcaggag | W45834 | 44350 | ctgagtcacagcccagggacttg | U62523 | 86954 | cacatgctcaggaccatagatgaa | AA107893 |
| 1747 | gatgctaccgagcgaaatctgctc | W45834 | 44351 | aatttcactgatagatggcccag | U62523 | 86955 | ctcaggaccatagatgaactatta | AA107893 |
| 1748 | ttgcttccgtcacacagttatagtt | W45834 | 44352 | cctcacgaacacactgagcctctt | X85169 | 86956 | agagcctgccaaggctgccctggac | U26459 |
| 1749 | tcaactaccaaattcgaactggc | W45834 | 44353 | gaaccacctgagcctctgggta | X85169 | 86957 | ggctgcctgccctggacctgg | U26459 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1750 | actaccaaattcagaacttggccag | W45834 | 44354 | tccctcctgactgccagtggaagt | X85169 | 86958 | ccccttatcaaacctgatgctgtt | U26459 |
| 1751 | ttcagaacttggccaggaagatcaa | W45834 | 44355 | atcagtggacccttagtcaagtcca | X85169 | 86959 | acacgaattgctcaatgcatgagtc | U26459 |
| 1752 | agatcaatcagtccatcgtctggat | W45834 | 44356 | tctatagagggccctgccactgc | X85169 | 86960 | attgctcaagcatgagtcgcaac | U26459 |
| 1753 | atcagtccatcgtcggattggag | W45834 | 44357 | ccgtccagcgcctgcgtctggag | X85169 | 86961 | atgagtgcaaccttcaacagga | U26459 |
| 1754 | agtccatcgtctggattggaggcat | W45834 | 44358 | gcataaatgtctcgccacgtga | X85169 | 86962 | ctgcaaccttcaacagggagccctc | U26459 |
| 1755 | ccatcgtctggattggaggcatct | W45834 | 44359 | atgtctctgccacgctgactgtc | X85169 | 86963 | aagtctaatatgtcggtgctgt | U26459 |
| 1756 | tcaacatagcacagaccaggatcc | W45834 | 44360 | ctgccacgtcgactgcagaatt | X85169 | 86964 | aaatagtcggtgctgttttaat | U26459 |
| 1757 | atagcacagaccaggatcccaactg | W45834 | 44361 | actgtccaagattgtgtgagaggca | X85169 | 86965 | ggtcaaggccgttctacgcta | U26459 |
| 1758 | gcacagaccaggatcccaactggg | W45834 | 44362 | agaggcagtcagccagggtgtcttc | X85169 | 86966 | caaggatgacctctgctttgaat | U26459 |
| 1759 | cagaccaggatcccaactgggaggc | W45834 | 44363 | ttcctctgctacttttgagatgag | X85169 | 86967 | gtcaaggccctgttctatcgtat | U26459 |
| 1760 | agacatgaaacagccctgatcctg | W45834 | 44364 | ggataccacagcacagcctagcttt | X85169 | 86968 | tgacctctgctgtgaatgagatc | U26459 |
| 1761 | catgaaacagccctgatcctgtcc | W45834 | 44365 | ccagcagccgtagcttttttcagt | X85169 | 86969 | tgagatctcagcacttcctgcctg | U26459 |
| 1762 | gaaacagccctgatcctgtcctt | W45834 | 44366 | ctccctcgggagttggggatcag | X85169 | 86970 | cactctgcctgatggaggagag | U26459 |
| 1763 | ttctgtttcatctggagagtctg | W45834 | 44367 | gggccactgtagcctcaggaacct | X85169 | 86971 | caagcccagatagctccggatc | U26459 |
| 1764 | aactcagtacgtcctggaagag | M35131 | 44368 | actgtagccctcaggaactgccaag | X92664 | 86972 | aggtccggatcctccgtccacag | U26459 |
| 1765 | atgatagtctctgtagccgaagt | M35131 | 44369 | aatgtctccagttattacgcag | X92664 | 86973 | gtccagcttttagaccaaaaatag | U26459 |
| 1766 | tcttgttttccaaagagtgtcag | M35131 | 44370 | gtccagttattacgcagtggcag | X92664 | 86974 | tctccaggcctctgcaagagct | U26459 |
| 1767 | tgcccactacacgtcctggaagag | M35131 | 44371 | ttattacacaggggctccctc | X92664 | 86975 | atgctgtaccttaagcttgtca | U26459 |
| 1768 | tggccactgaaccacgccagggtgt | M35131 | 44372 | gtcaactatacttggtccaacagtt | X92664 | 86976 | aggccagtctcgggcactgatgaa | U26459 |
| 1769 | cacgccaggtgtactctccactga | M35131 | 44373 | tatactgtccaccagttcgta | X92664 | 86977 | ctatcttattatagctcgatgt | U26459 |
| 1770 | aggggtactctccactgaagtcca | M35131 | 44374 | agtcactgcctgatatctgtaaa | X92664 | 86978 | gcctatgtaccaccagtagaataa | U26459 |
| 1771 | tactctccactgaagtccactttca | M35131 | 44375 | ctggagtcgtcttgtactattca | X92664 | 86979 | tatgtaccaccagtagaataagg | U26459 |
| 1772 | ccactgaagtccactttcaattgct | M35131 | 44376 | ctcatttgttcccttgtacagat | X92664 | 86980 | ttatctgtactctactcactccaa | U57343 |
| 1773 | aagtccactttcaattgttccag | M35131 | 44377 | tgttcccttgtacagattgcaac | X92664 | 86981 | gtactatctctactcaaatactgt | U57343 |
| 1774 | acttccagttccatgcaatag | M35131 | 44378 | ttgcaaccgcggatcctgggtc | X92664 | 86982 | tatctactcaaatactgtgactc | U57343 |
| 1775 | aattgttccagtcaataaaaccaa | M35131 | 44379 | catagccactcagatatttgaccaac | X92664 | 86983 | cttactcaaatactgttgactcgt | U57343 |
| 1776 | gcttctgttagccgaacgtgatga | M35131 | 44380 | aacataattcacatcattgtatgc | X92664 | 86984 | actcaaatactgttgactcgtaca | U57343 |
| 1777 | atgtgaacgtacgctaacacac | M35131 | 44381 | attcacacatttgtatgcagtgtg | X92664 | 86985 | atactgttgactcgtacattaaag | U57343 |
| 1778 | gcattatttctgatgtccaact | M35131 | 44382 | ttcccactgctgcgatcttat | X92664 | 86986 | ctgttgactcgtacattcaattat | U57343 |
| 1779 | atttcctgtatgcccaactgacaga | M35131 | 44383 | ctgtcgcggatcttataagctt | X92664 | 86987 | ccagctcctgggcactgatgaagt | U57343 |
| 1780 | tgtatgtccaactgacagatgaacg | M35131 | 44384 | tggtccacccaggttctgtatatgaa | X92664 | 86988 | ctcatalatgatgtctccggaattc | U57343 |
| 1781 | tccaactgacagatgaccgcaataa | W45896 | 44385 | agccttacaaatacggacttcctgt | X92664 | 86989 | atgtaactagcatctgtagct | U57343 |
| 1782 | gtgtaacctattcctgaatgcctt | W45896 | 44386 | ggatatcacattttctcagattat | X92664 | 86990 | cttagcagcatgctagcttttcat | U57343 |
| 1783 | tctgaatgcctttgttctcccaa | W45896 | 44387 | cacattttctcagattatcattt | X92664 | 86991 | agcatctgagttttcattgtgg | U57343 |
| 1784 | cagaagcgatgatgacctctgacaag | W45896 | 44388 | ttcttcagattatccattaagcca | X92664 | 86992 | gtgttatatccagctggagatca | U57343 |
| 1785 | agacgatgatgacctctgacagaga | W45896 | 44389 | agattatccattaagccaccaaag | X92664 | 86993 | tgagagatcaccttcaaaaggcca | U57343 |
| 1786 | gatcaacgactatcgcgttagtc | W45896 | 44390 | ttttccgtccagaatctcactgc | X92664 | 86994 | ttcaaaaggccagcctactctatt | U57343 |
| 1787 | atcaacgactatcgcgttagtcg | W45896 | 44391 | aatctatctgcaacatcacactg | X92664 | 86995 | cccagcctactctattatagctgca | U57343 |
| 1788 | gactatcgcgtattagtcgagtcgc | W45896 | 44392 | caacatcaacagtcaggagtcatc | AA021860 | 86996 | tatgcaaagagccactcttgtgtt | AA107984 |
| 1789 | ctatcgcgtattagtcgagtcgcag | W45896 | 44393 | gtcttcacagccaacgtgcagat | AA021860 | 86997 | cgcaaagcgcactcttgttatg | AA107984 |
| 1790 | cgtattagcgcgtcgagtcgcagtgaa | W45896 | 44394 | gcttcacagccaacgtgcagatta | AA021860 | 86998 | aacgtctctagctaaagcagcac | AA107984 |
| 1791 | gtattagcgcagtccgagtttgggt | W45896 | 44395 | acgagacttcccagccatccgtaa | AA021860 | 86999 | aaagatagactactgcctggaacga | AA107984 |
| 1792 | attagtgcgagtgcagtcgagtttcc | W45896 | 44396 | ccgagacttccgacatccgtacaac | AA021860 | 87000 | gcatgactactgcctggaacgacca | AA107984 |
| 1793 | ttagtcgagtcgcagttgcgtcca | W45896 | 44397 | agacttccagcagtccgtacaacac | AA021860 | 87001 | atgaactccgtagatactaca | AA107984 |
| 1794 | agtcgagtcgcagttgcggtccatc | W45896 | 44398 | gacttccagcagccgtcacacacg | AA021860 | 87002 | atgactacgtagatacacagta | AA107984 |
| 1795 | cgagtcgcagttgcggtccatcgc | W45896 | 44399 | cttccagcactccgtacacacgct | AA021860 | 87003 | acatcagtatcgtgtatgata | AA107984 |
| 1796 | acgatcgattgcctctgacaagag | W45896 | 44400 | tttccagatccgtacaacacgctg | AA021860 | 87004 | tacagatcgtgtatgtataaca | AA107984 |
| 1797 | cgatcgattgacctctgacaagagt | W45896 | 44401 | tccagatccgtacaacacgctgaa | AA021860 | 87005 | tgtgataacacctatgtatgatcat | AA107984 |
| 1798 | agtcgatgacctctgacaagagttg | W45896 | 44402 | ccgagatccgtacaacacgctgaag | AA021860 | 87006 | gataacacctatgtatgatcatga | AA107984 |
| 1799 | gatgatgacctctgacaagagttgcag | W45896 | 44403 | agcatccgtacaacacgctgaagta | AA021860 | 87007 | aacacctatgtatgatcatgtactt | AA107984 |

| SEQ ID NO | sequence | DBAxnID | SEQ ID NO | sequence | DBAxnID | SEQ ID NO | sequence | DBAxnID |
|---|---|---|---|---|---|---|---|---|
| 1800 | ttgcagctgatcaacgactactcgg | W45896 | 44404 | gcatccgtacaacagctgaagtac | AA021860 | 87008 | gagccactctgtgttatgccaggc | AA107984 |
| 1801 | cagctgatcaacgactatcgcgtat | W45896 | 44405 | cttcaacgccaacggtgcagattac | AA021860 | 87009 | acggtccagacgccgctggcaatgct | AA107984 |
| 1802 | gctgatcaacgactatcgcgtatta | W45896 | 44406 | cacagccaacggtgcagattacagg | AA021860 | 87010 | gctccagacgcctggcaatgctgat | AA107984 |
| 1803 | ctgatcaacgactatcgcgtattag | W45896 | 44407 | aacacagagctgaacagccgctcaa | AA021860 | 87011 | ccagacgccgcaatgctgatcgatac | AA107984 |
| 1804 | actcggtcatccgtgttgaatga | M61909 | 44408 | cacagagctgaacagccgctgcaag | AA021860 | 87012 | gccatccaatgctgatcacgcgaatga | AA107984 |
| 1805 | ttgatagctcctgctcggtaggga | M61909 | 44409 | ggaagccatgtcgttctggaacga | AA021860 | 87013 | tcacgaatgaacgctcctatgcta | AA107984 |
| 1806 | agcacatgggggccgctcttcgt | M61909 | 44410 | gaagccatgtcgttctggaacgag | AA021860 | 87014 | cgaatgaacgctctatgctaaag | AA107984 |
| 1807 | ctgcagctctccatgctgagctgt | M61909 | 44411 | agccatgtcgttctggaacgagtc | AA021860 | 87015 | atgaacgtctctatgctaaagcat | AA107984 |
| 1808 | gctcccatgctgagctgtggccaa | M61909 | 44412 | gaacgagacttccagcatccgtac | AA021860 | 87016 | gggttcgcaaacattgcgtgaagt | AA107984 |
| 1809 | ttgctgccgcctccagaatcagg | M61909 | 44413 | agcccttgctgttccactgccgcg | AA021860 | 87017 | ttcgccaaacattgcgtgaagtgca | W14830 |
| 1810 | ttagtcgagacatcccgctccc | M61909 | 44414 | tgtccactgccgcagattccgcg | AA021860 | 87018 | aagctgcggcagcgttcaacg | W14830 |
| 1811 | tttccaaggcctaatagcagggca | M61909 | 44415 | ctgcatccaccgagggtctgctt | AA021860 | 87019 | cagcgttccaccgctgtgaaggacc | W14830 |
| 1812 | ctagaatgctcagccacaagacag cc | M61909 | 44416 | gcatctccaccgaggtctgcttat | AA021860 | 87020 | ttcaccgctgtgaggaccagtatt | W14830 |
| 1813 | tggactctgctcttctagctcg | M61909 | 44417 | gtcgtctttgggtgcgatgaatg | AA021860 | 87021 | gaccagtattacgctgtggatgct | W14830 |
| 1814 | cttgctcttctagctctgaactaa | M61909 | 44418 | ctttggtgcgatgaatgtgcact | AA021860 | 87022 | cagtattacgctgtggattgctaca | W14830 |
| 1815 | cttctagctctgaactaatataaatg | M61909 | 44419 | gaatgtgcactgcgaccaacgtgg | AA021860 | 87023 | aaaggctccagtgtgggtggcctatg | W14830 |
| 1816 | gagatcctccatctccagctt | M61909 | 44420 | atgtgcactggcaccaacgtgac | AA021860 | 87024 | agtgtggcctatgaaggacaat | W14830 |
| 1817 | gagccatgcctaggccatatagcc | M61909 | 44421 | gtgcactccggcaccaacgtggaccc | AA021860 | 87025 | ggacaatccggcacgactactgat | W14830 |
| 1818 | tgcctaggccatatagccttacta | M61909 | 44422 | ctgccgactgccggcgatgcttt | AA021860 | 87026 | tcctggcacgactactgcttccact | W14830 |
| 1819 | tatagccttactacaagtgtctc | M61909 | 44423 | ccggatgccgggcgatgcttgcca | AA021860 | 87027 | cacgactacttgcttcactgcaaaa | W14830 |
| 1820 | tacaacttgatccaagcagtgctc | M61909 | 44424 | cgatgcttgccacggcagcacct | AA021860 | 87028 | tgcaacaaggccatcacatctggag | W14830 |
| 1821 | ttgatccaagcagtgctcccaaga | M61909 | 44425 | tcccactgccgggacagctcggct | AA021860 | 87029 | tactgcttccactgcaaaaatgct | W14830 |
| 1822 | caaagcagtgctcccaagacagct | M61909 | 44426 | ccactgccgggcagagctcggctgg | AA021860 | 87030 | ggaatcacttaccaggatcagccct | W14830 |
| 1823 | agcagctccacgtgtgctgccgg | M61909 | 44427 | ctgcacgcaccagatgcatc | AA021860 | 87031 | atcacttaccaggatcagcccggc | W14830 |
| 1824 | aaagccatatttgtaggccgtgcac | M61909 | 44428 | ctacgcaccagatgcatctcac | AA021860 | 87032 | taccagatgcagtttccatgccg | W14830 |
| 1825 | aagccatatttgtaggccgtgcaca | W45901 | 44429 | acgcaccagagtcgcatctccacg | AA021860 | 87033 | gatccgcctgcagtccgagtgct | W14830 |
| 1826 | tgagcgctcaagcaggagaggatt | W45901 | 44430 | ccaccagagtctgcatctcaccgag | AA021860 | 87034 | tgtgttacctgctctaagaagctgg | W14830 |
| 1827 | agcagctcaaggcaggagaggattag | W45901 | 44431 | gagtctgcatctcaccgagggtgt | AA021860 | 87035 | acctgctctaagaagctggctgggc | W14830 |
| 1828 | tgaatctctcaattaagaactgga | W45901 | 44432 | gctcgcatctcaccgagggtgtcc | AA021860 | 87036 | tctaagaagctggctgggcagcgtt | W14830 |
| 1829 | gaatctctcattaagaactggat | W45901 | 44433 | gtcttacatgattgtctgcaca | AA021860 | 87037 | cgactacactcaatgtaggcctica | W14830 |
| 1830 | aatctctacattaagaactggatg | W45901 | 44434 | cttacatgattgtctgcacaga | X92665 | 87038 | ctacactcaaatgtaggccttcagg | AA107961 |
| 1831 | atctctacattaagaactggatga | W45901 | 44435 | gtccattgatcagcttaaattgt | X92665 | 87039 | tggaaccaccaggagactgctgtgg | AA107961 |
| 1832 | tctctacattaagaactgggatgac | W45901 | 44436 | tttgttacctgtatatgtaaaatg | X92665 | 87040 | gcattgtagttccagaagtcggag | AA107961 |
| 1833 | gagagttttccccttggatcaat | W45901 | 44437 | aatggacacctggctacaagaccacc | X92665 | 87041 | tgttagttccagaggtcggagtggg | AA107961 |
| 1834 | agccatatttgtaggccgtgcacag | W45901 | 44438 | ggacacctggctacaagaccaccatg | X92665 | 87042 | ttccagaggtcggagcggacgaaa | AA107961 |
| 1835 | ccatatttgtaggccgtgcacaga | W45901 | 44439 | cacctggctacaagaccaccatgg | X92665 | 87043 | gttcagccaggcaggaggaagag | AA107961 |
| 1836 | atatttgtaggccgtgcacagaa | W45901 | 44440 | gctacaagaccacgatagttaatg | X92665 | 87044 | cagtccaggcaggaggaaagaact | AA107961 |
| 1837 | tatttgtaggccgtgcacagaaaa | W45901 | 44441 | acaagaccaccatgtagttaatgat | X92665 | 87045 | aacagactcgagtcgcctgt | AA107961 |
| 1838 | atttgtaggccgtgcacagaaaaa | W45901 | 44442 | taccttaagctgtaactgtaatg | X92665 | 87046 | agactctgcagtcgcctatagt | AA107961 |
| 1839 | agtttgcagctcaagcaggaggag | W45901 | 44443 | gttagacttctacgtctgcattt | X92665 | 87047 | tcagtctgcctgtagttggaaag | AA107961 |
| 1840 | gttcagctcaagcaggaggaggat | W45901 | 44444 | tagactttacgtctgcatttgtg | X92665 | 87048 | agtcgcctgtagttggaaagcaa | AA107961 |
| 1841 | ttgagcagctcaagcaggaggat | W45901 | 44445 | tgattgtgtcacagaagagagc | X92665 | 87049 | cactcaatgaggcctcaggtga | AA107961 |
| 1842 | ctagtgctgctagagcgtggttc | X55315 | 44446 | agactttcactgctgcatttgcc | X92665 | 87050 | aagggcaaacctctctgcagttggt | AA107961 |
| 1843 | tagagcgtggttcccatgtgaatgg | X55315 | 44447 | tttgttctcaacgaagagagctgc | X92665 | 87051 | gcaaacctctctgcagttgctcta | AA107961 |
| 1844 | tgctctccatggcagctgattct | X55315 | 44448 | atatattcagtcttactcccag | X92665 | 87052 | aacctctgcagttggctacca | AA107961 |
| 1845 | tgattcctggtgcagttccact | X55315 | 44449 | ttattcagtcttactcccagatt | X92665 | 87053 | tcctgcagttggctaccacgtgc | AA107961 |
| 1846 | ttctctgaggcctgcagcaaggt | X55315 | 44450 | ttcagttactctccaggatttg | X92665 | 87054 | agttgctcaccacgctgcgcgga | AA107961 |
| 1847 | gtaggcctgcagcaaggttgctc | X55315 | 44451 | atctgctacagtagacaaatcgt | X92665 | 87055 | ctgcgtgaccaccaccaggacgat | AA107961 |
| 1848 | ctgcagcaaggtttgctcactga | X55315 | 44452 | actgtgttccattgatcagcttaa | X92665 | 80756 | ccgtggaccaccaccaggaccgatcg | AA107961 |
| 1849 | tttgtcactgcatcagctgtag | X55315 | 44453 | tgtgtccattgatcagcttaaatt | X92665 | 87057 | agaagatgccaccaagccgcatact | AA107997 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1850 | cactgcatcagtgctgtaggacca | X55315 | 44454 | catcccgagctctgtgtcatagcc | AA030190 | 87058 | agatgccaccaagcgcatactaag | AA107997 |
| 1851 | aactcagctgcgaaggatcctgc | X55315 | 44455 | cccggagctctgtcatagccagc | AA030190 | 87059 | agaaccaggcttggtgctgacactg | AA107997 |
| 1852 | ggaacaagcactaccactgagcca | X55315 | 44456 | cgactagccctgccagcagccac | AA030190 | 87060 | ggtgccctctgcaggatgtgg | AA107997 |
| 1853 | taccactgagccacacatacata | X55315 | 44457 | ccttgcagcagccacactagaggc | AA030190 | 87061 | cctctgcaggatgtgtgcaggct | AA107997 |
| 1854 | gtggttccagtggatgagat | X55315 | 44458 | tggcagccacatgccagcaga | AA030190 | 87062 | tctgcaggatgtgcaggctgag | AA107997 |
| 1855 | gcatgacttaggctgaagaaacc | X55315 | 44459 | cagagccacatgccagggccagagc | AA030190 | 87063 | gatgcatacgtgtgctgagcca | AA107997 |
| 1856 | acattgacacctcgcgctgcact | X55315 | 44460 | tcagccagcacctggtcatgaag | AA030190 | 87064 | tgcaactgtgtctgagccaaag | AA107997 |
| 1857 | cttatatgctgaagaagcactgt | X55315 | 44461 | gccagcacctgtgtcatgaagcag | AA030190 | 87065 | atactgtgtgctgagccaagtgg | AA107997 |
| 1858 | ttgagctagctgctggctgcagg | X55315 | 44462 | agcacctgtgtcatgaagcagca | AA030190 | 87066 | gtggccagtctactccttggctg | AA107997 |
| 1859 | gatgtcttcatccctgcctgggt | X55315 | 44463 | gcagcaattctcttcagcccgctt | AA030190 | 87067 | gccaggtctactccttggctgcaa | AA107997 |
| 1860 | tgctgaccgaggtgaatgctctt | X55315 | 44464 | gcaattcttcagccgctggc | AA030190 | 87068 | aggtctactccttggctgcaatga | AA107997 |
| 1861 | ggtgaatgctctccatgcagct | X55315 | 44465 | gagtgatctctgccttcagcagcc | AA030190 | 87069 | tgccaccaaggcatactcaagaga | AA107997 |
| 1862 | caltgaagtgctcatcttgatgag | W45951 | 44466 | ctgtgtcatagccagcttggaatga | AA030190 | 87070 | cacccaagcgatactaagaagg | AA107997 |
| 1863 | tgaagtgctcatcttgatgaggt | W45951 | 44467 | catctgactcagccaggtccaaagg | AA030190 | 87071 | agtctcacacaggtcccacaacaca | AA107997 |
| 1864 | ggtctccttaaagaatcctgtcgg | W45951 | 44468 | tgtcatagccagcttggagtagcaa | AA030190 | 87072 | acacaggtcccacacacagaaccaa | AA107997 |
| 1865 | ctccttaaagaatcctgtcggata | W45951 | 44469 | catagccagcttggagtagcaacct | AA030190 | 87073 | caggtcccaacacagaaccaggc | AA107997 |
| 1866 | cttaaagaatcctgtcggatatt | W45951 | 44470 | ggagtagcaacctaccacatgtga | AA030190 | 87074 | cccaacacagaaccaggcttggtg | AA107997 |
| 1867 | gaatcctgtcgggatatttgaac | W45951 | 44471 | gcaacctcatcacctgcatgtagcc | AA030190 | 87075 | caacagaaccaggcttggtcgctg | AA107997 |
| 1868 | tcctgtcgcgatatttgaacagc | W45951 | 44472 | acctcatcacctgcatgtagccctt | AA030190 | 87076 | cagaaccaggcttggtcgctgaca | AA107997 |
| 1869 | gaacagcaacacagatgtcgctccc | W45951 | 44473 | tcatcacctgcatgtagccctggc | AA030190 | 87077 | taaatgccgtgctctccaggcaca | AA107997 |
| 1870 | tccctcctgcgaagagttcata | W45951 | 44474 | cctcgtagccctttgccagcage | AA030190 | 87078 | gtgctccaggccgcacacaggtattt | AA107997 |
| 1871 | cttcctgcgaagagttcataacgg | W45951 | 44475 | tctgaacttcctgatgctgcactg | AA030190 | 87079 | acagtggctattccttcaagcacat | AA107997 |
| 1872 | agagtcatacggatccggcctaat | W45951 | 44476 | actttccgatgctgcactggtacac | AA030190 | 87080 | atttcctcacgcacatgttcctta | AA107999 |
| 1873 | gttcatacggatccggcctaatgg | W45951 | 44477 | aggccaagctggactagagacccctg | AA030190 | 87081 | tcacgcacatgttcctactg | AA107999 |
| 1874 | catgctctctgccggtctccata | W45951 | 44478 | tttatgccactgaagtaatttga | AA030190 | 87082 | tcacgcacatgttcctactg | AA107999 |
| 1875 | gctctctgccggtctccacatga | W45951 | 44479 | aattgccctttgtctcactaa | AA030190 | 87083 | acattgttcctactgctaagaagcaa | AA107999 |
| 1876 | cttctgccaccatgcacatgatgag | W45951 | 44480 | agcccttgctcactaaaacag | AA030190 | 87084 | taacgaaccatctaaaagagatcat | AA107999 |
| 1877 | ctcgggccaccatgacacagatgaggtg | W45951 | 44481 | ttgtgctcactaaaacaaggatcac | AA030190 | 87085 | aagagatcatatcctacaggcgagt | AA107999 |
| 1878 | gaaagatctggctctgctccctta | W45951 | 44482 | ggatcacatttaactgtggcaaac | AA030190 | 87086 | agatcatatctacagccagctga | AA107999 |
| 1879 | agatctggcttcgtccctgcaga | W45951 | 44483 | gttgccccatgcgggacacatgaacatt | AA030190 | 87087 | tatcctacaagcagctgcattgat | AA107999 |
| 1880 | tctggcttcgtccctaaagaat | W45951 | 44484 | cccatgcgggacacagacaggaacatt | AA030190 | 87088 | acaggcagctgcatgtgatgatga | AA107999 |
| 1881 | ttcggcttcctaaagaatcctgg | W45951 | 44485 | gaacatttggattccaaggaggga | AA030190 | 87089 | tcaggcacacaggtatccgaga | AA107999 |
| 1882 | tcctctgcaggatgatggttaagc | W45951 | 44486 | tttgattccaaggagcaaagag | AA030190 | 87090 | ataacctctgagctgtgctgcat | AA107999 |
| 1883 | atggttaagccatgcctgccagagca | W45951 | 44487 | tgatgccgcactgtacacacaaacc | AA030190 | 87091 | cttctgagctgtgctgcatcatgt | AA107999 |
| 1884 | agctctgtactgtaagctgctggtga | M86829 | 44488 | tgcactgtacacacaacaaagag | AA030190 | 87092 | ctgagctgtgctgcatcattgtcga | AA107999 |
| 1885 | tccctagctcaggctgcagtct | M86829 | 44489 | tgactagctcttactggcacac | AA030190 | 87093 | agctgtgtctgcatcattgtcgacag | AA107999 |
| 1886 | gctcaggctcgtcagttctgagttt | M86829 | 44490 | gagctcttactggcacacaaag | AA030190 | 87094 | gctcattgtcgacatggcta | AA107999 |
| 1887 | gctcgtcagttctagttacctga | M86829 | 44491 | ttactgcacacagaagtcctag | AA030190 | 87095 | gcatcattgtcgacgtggctatc | AA107999 |
| 1888 | cagtctgagttcttacctctt | M86829 | 44492 | ggcaacctactataagccagcact | AA030190 | 87096 | tcattgtgacagtggctattcctt | AA107999 |
| 1889 | ttctgagttcttacctgagtcttta | M86829 | 44493 | tacctataagcccagcacttggag | AA030190 | 87097 | ggacgagacctgcttcacctgcag | AA107999 |
| 1890 | catctccaagggttatcaagat | M86829 | 44494 | acagtcatctgaactatacaggga | AA030190 | 87098 | ggaccgttcacctgccagccgc | AA107999 |
| 1891 | agatactcagagaactgcgaaatg | M86829 | 44495 | aacgctggtcaggaggacggagactgt | AA021852 | 87099 | tgtgtcccagccactgcaagaacag | AA107999 |
| 1892 | tgtatgcttgcattgtatatggaa | M86829 | 44496 | tcaggagtcctctctgctaactc | AA021852 | 87100 | cacagcctgcaagaagcagtatct | AA107999 |
| 1893 | agaactgtgcatcaagtatgtat | M86829 | 44497 | gcttagcgtccttggtcgaaagcaaa | AA021852 | 87101 | gctatctggcaacgcttcacagca | AA107999 |
| 1894 | gttaagccaltgtcctgagacaaaa | M86829 | 44498 | tagctcctggtcctgagacaaagat | AA021852 | 87102 | tgagttccalactgccgaccgc | U77040 |
| 1895 | ccatgctcctggagacaaagtaact | M86829 | 44499 | cgtctcctggaagacaaagatcta | AA021852 | 87103 | tccatactgcctgacctgcttcgt | U77040 |
| 1896 | tcttaagggctgctgtcgagtctc | M86829 | 44500 | tgcaatgtagcctgtctgttacca | AA021852 | 87104 | tcattgtgacagtggctattc | U77040 |
| 1897 | ctgagtcctcactcaagtggctgg | M86829 | 44501 | gtagctggtctgtgttaccaggggga | AA021852 | 87105 | tttcgggaagccacgaccactgcttaac | U77040 |
| 1898 | cctcactcaagtggctgggatgct | M86829 | 44502 | gtggtcttgttaccagggcagca | AA021852 | 87106 | ccaacgactgttttaactgtaag | U77040 |
| 1899 | tcaaggctgaggctctgtccta | M86829 | 44503 | ggtctgttaccaggggcagcacag | AA021852 | 87107 | cttcctgcagagagatgactc | U77040 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1900 | tgtccagctctgctactgtaagcta | M86829 | 44504 | cttgttacagggggcagcacaggca | AA021852 | 87108 | tattgaagggcacagaagccac | U77040 |
| 1901 | cctagctctgtactgaagctatgt | M86829 | 44505 | ggcctgtcctgcaggatgagatgg | AA021852 | 87109 | cttcacgctcagcgctgccagcag | U77040 |
| 1902 | tgaccttgctgtcctctgccctg | M77677 | 44506 | cttgtcctgcaggatgagatgcca | AA021852 | 87110 | aggcggcacagaagccacagcgcgt | U77040 |
| 1903 | ttgctgctctgccctgagtca | M77677 | 44507 | ggaagtcctctcctgtcaactcga | AA021852 | 87111 | caagaticcattcatacctaaggagaat | U77040 |
| 1904 | aactgagctctgggcacgtgatgcc | M77677 | 44508 | agtcctctctgctaactcgtcgca | AA021852 | 87112 | tcagaatcgtgctgcctgctat | U77040 |
| 1905 | tgatgcctaccaggccatgatgt | M77677 | 44509 | ccttctctgctaactcgcagcagca | AA021852 | 87113 | cttctcgtgcctgctctatgagaag | U77040 |
| 1906 | atgatgtaccagacagacccctgagcc | M77677 | 44510 | gagccacccaagtcgccatggtgc | AA021852 | 87114 | gtgcaaaagctatcaccacagga | U77040 |
| 1907 | gctagctctcagtcctcattactg | M77677 | 44511 | ccatggctcagccgcattagcgtc | AA021852 | 87115 | tatcaccacaggagggttacttac | U77040 |
| 1908 | cttctcagctcattactggagag | M77677 | 44512 | ctgccagccgcttagcgtccgtgc | AA021852 | 87116 | tacttacggagcagccctggac | U77040 |
| 1909 | agctccattactggcagaagggccc | M77677 | 44513 | ccagccgcttagcgtccgtggcga | AA021852 | 87117 | gcagcctggccaccaaggaatgctt | U77040 |
| 1910 | atactggctgagaggggccttctt | M77677 | 44514 | gccgttagcgtccgtggctggaaagc | AA021852 | 87118 | tgtacatccagcaggtgacaacatc | U77040 |
| 1911 | tgccgctctttttgctcagtttgc | M77677 | 44515 | ctgcaaccacagtatacactcat | AA021852 | 87119 | aggtgacaacatcatctgtgcagc | U74815 |
| 1912 | ccttttgctcagttgttctcaca | M77677 | 44516 | ccatgtataacctcatcctagag | AA021852 | 87120 | agatctggtgttctgatgtgcc | U74815 |
| 1913 | cttcagttcttcttccatgatt | M77677 | 44517 | tgctcatagcagagagagccatct | AA021852 | 87121 | tggcattgtgactcttcagctaa | U74815 |
| 1914 | gtctctgccctgaggtcactgcag | M77677 | 44518 | tgatcttcatctctggaggactc | AA021852 | 87122 | catctgactcttcagctaagccaac | U74815 |
| 1915 | gacagcctcggaagactcatattgggaa | M77677 | 44519 | tctctcattctgtgagggactcata | AA021852 | 87123 | actcttctcaagctccaacacacta | U74815 |
| 1916 | ctactaggcaaccacaactgaggaa | M77677 | 44520 | tcaatcctggagagactcatta | AA021852 | 87124 | gggttgctccacacagaatcctc | U74815 |
| 1917 | ggaccacaactgaggaatagaat | M77677 | 44521 | aggactcatactctaggtgatcgca | AA021852 | 87125 | acacgaatcctccaatagaatccca | U74815 |
| 1918 | aatttgctccaaatgacaccagaa | M77677 | 44522 | actctagtgattgcaatggcgcat | AA021852 | 87126 | cctgtctcctgatctcagcctccag | U74815 |
| 1919 | ctctccaaatgacaccaagaagccag | M77677 | 44523 | attgcaatgggcatgaagatgct | AA021852 | 87127 | ttcctgattcagctccagcaactg | U74815 |
| 1920 | ggttaaatagcaccacatatcct | M77677 | 44524 | tgaagatgctccatctgcagctg | AA021852 | 87128 | gcaactgccagcctgacctaca | U74815 |
| 1921 | aatagcaccacatatctggtaa | M77677 | 44525 | ggctgtgcatcaacaccgatgct | AA021852 | 87129 | ttgataccaagtcacccactgagt | U74815 |
| 1922 | aggccaacagttctgtatatgggg | M77677 | 44526 | gcatccaaccacgatgctggagga | AA021852 | 87130 | caacatactgggcagctatgac | U74815 |
| 1923 | tccatgttccgtggcatgaccca | M77677 | 44527 | tgtatacactcatccctagatgg | AA021852 | 87131 | tgacctggatctttccaccagca | U74815 |
| 1924 | tgccagctgactttccaggtca | M77677 | 44528 | atacaactcatcctctagaatgttc | AA021852 | 87132 | ttccacaaccatacaaagtgctg | U74815 |
| 1925 | ttccaggtcaagctcatccggtctgt | M77677 | 44529 | tcatccctagagtgggtccatt | AA021852 | 87133 | caagccatacaaagtgctgaggcac | U74815 |
| 1926 | ctgtatagtcctactcagctcca | M77677 | 44530 | tcccgcctcaatctaagaaccatg | AA021852 | 87134 | agtgctgaggccaccaagaagaagcc | AA107137 |
| 1927 | ctatcagtctcagaggccaggtca | M77678 | 44531 | cctcaatctaagaaccatcataaa | AA021852 | 87135 | agcaaccaccggcgtccgcagttcgg | AA107137 |
| 1928 | agtcctcagaggccaggtcaagtgc | M77678 | 44532 | taaacatagcgtgtcagaagct | AA021852 | 87136 | ctgcacctggagactctgaggctcc | AA107137 |
| 1929 | tgtcagctgacttccaggtca | M77678 | 44533 | tgaatccggtctcatagcacgaga | AA021852 | 87137 | tatcgtgccatggcatggtgac | AA107137 |
| 1930 | ttccaggtcaaagatgaatctga | M77678 | 44534 | atccggtctcatagcacgagagaga | AA021852 | 87138 | cctgctcgaaccatgctggtg | AA107137 |
| 1931 | aatctgaaatgtcccattggctagt | M77678 | 44535 | aaagctctgtggactcttgaggct | AA021852 | 87139 | tcgggcaaccacggcgtccgcagttcgg | AA107137 |
| 1932 | tcccccaacaaggggtatgggat | M77678 | 44536 | agctctgctggactctgaggctcc | AA021852 | 87140 | agcaaccaccggcgtccgcagttcgg | AA107137 |
| 1933 | tgactttccgggtgtactgtcctg | M77678 | 44537 | aaccaccattcgtatcagtttcta | AA021852 | 87141 | ctgcacctggagtactacgctttaca | AA107137 |
| 1934 | ttgcatcagaggagtctgacctgttc | M77678 | 44538 | ccacattcgtatcagtttaat | AA021852 | 87142 | gcacctggatgcctttacagagag | AA107137 |
| 1935 | tttcctgggcatgaaccatactgg | M77678 | 44539 | accattcgtatcagttctctccaacat | AA021852 | 87143 | ctggagtaccgctttacagagag | AA107137 |
| 1936 | alactgggctgctctggcttgag | M77678 | 44540 | aagtagtgcatactctccaaccat | AA021852 | 87144 | agtaccgctttacagagctcag | AA107137 |
| 1937 | ggctgctctggcttgagctctac | M77678 | 44541 | gtagtgcatactctccaaccatgga | AA021852 | 87145 | taccgctttacagctcagca | AA107137 |
| 1938 | ctctgggctgagctctacaacatac | M77678 | 44542 | agtgcatactctccaaccatagga | AA021852 | 87146 | ccgcttttacaagctcagcacg | AA107137 |
| 1939 | gtttaccagcctcatatctccagt | M77678 | 44543 | catactctccaaccataggaagct | AA021852 | 87147 | gctttacagctcagcagcagcag | AA107137 |
| 1940 | tcatatctccagtctctgcatgcc | M77678 | 44544 | tactctccaaccataggaagcgt | AA021852 | 87148 | ttacaagctcagcagcacgacgag | AA107137 |
| 1941 | ctccagtctctgcatgccctgggaa | M77678 | 44545 | tactctccaaccataggaagcgat | AA021852 | 87149 | gcagtcagcacgagagggggtc | AA107137 |
| 1942 | aaactgccagcagggcatccag | M77678 | 44546 | cttctccaaccataggaagcatg | AA021852 | 87150 | gaccagtccaggggtcctgatggtg | AA107137 |
| 1943 | agtccaggctgccgaaaagagccc | M77678 | 44547 | tctccaaccataggaagcgatgttg | AA021852 | 87151 | agtgcctaggaaagaatctgta | AA107137 |
| 1944 | aagtgaccacctcattctggggg | L09104 | 44548 | acctgccgagtgctgccaggaa | AA021852 | 87152 | gtacgtgctatcaagctggagcc | AA107137 |
| 1945 | tggactacaaggctgttgggagag | L09104 | 44549 | cgagtgctgccccgaagtctgtcc | AA021852 | 87153 | acgtgctatcaagctgggccat | AA107137 |
| 1946 | gactacaaggctgtgggagaagct | L09104 | 44550 | ctgccaggaagtctgtccgtccg | AA021852 | 87154 | ggctatcaagctggagccatcaag | AA107137 |
| 1947 | ctacaaggctgttgggagaagctgg | L09104 | 44551 | ctgatcttgctcaactgtggagc | AA021852 | 87155 | ctatcaagctgagccacccaagtc | AA107137 |
| 1948 | cctccctgttgaagctgatgaagg | L09104 | 44552 | tcttgctaaacttgggagcttt | AA021852 | 87156 | ggcccacagtcgaactggagac | AA107137 |
| 1949 | ttgacgggtcatgttgttcgact | L09104 | 44553 | ttttttaaccaagcacagagta | AA021852 | 87157 | acagctgcacctggattaccgctt | AA107137 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 1950 | gacgtgtcagtgttctgacctgt | L09104 | 44554 | ggaaaaccaccattctgatcagtt | AA021858 | 87158 | agtatgtcataccaatgctcttgta | U04269 |
| 1951 | tcatgtttgtgacctgtatttca | L09104 | 44555 | acctagaacgcatcctgcacagcgt | Z48670 | 87159 | caatgccttgtcacctgtgtg | U04269 |
| 1952 | atgtgttctgacctgtatttcaca | L09104 | 44556 | aacgcatcctgcacgcgtgcacct | Z48670 | 87160 | ggttgtgcactgatctcagaagga | U04269 |
| 1953 | cacccagctagaataaagacacct | L09104 | 44557 | atctattaacaattcgatgcgaagg | Z48670 | 87161 | tgcactgatctcagaagaatgctta | U04269 |
| 1954 | tgggacatcaacagctgaccagt | L09104 | 44558 | acactgctatccgtttaacgttgag | Z48670 | 87162 | ttgtaatttctcttcctcatagga | U04269 |
| 1955 | ggacatcaacagtcgaccagtgg | L09104 | 44559 | cgcagtctgctggaattccaaaat | Z48670 | 87163 | tttctatagaatccagttcattc | U04269 |
| 1956 | acatcaacaagcttcgaccagtgggg | L09104 | 44560 | agagactcaaacgaactatgcaaaat | Z48670 | 87164 | atccagttcatttctatgtacctat | U04269 |
| 1957 | ggcagctctgtgacctccatg | L09104 | 44561 | tccaaactccagaaagacatccta | Z48670 | 87165 | ttcatttctatgtacctatgctgag | U04269 |
| 1958 | ctagaataaactccagccgccct | L09104 | 44562 | catcctaatttactgacatgtt | Z48670 | 87166 | tacctatgctgagaatcctgcgccaat | U04269 |
| 1959 | agttggcctggactacaaggctgtt | L09104 | 44563 | tctgtgacatgttttcagttacctc | Z48670 | 87167 | taagagccaatacttccttagaatg | U04269 |
| 1960 | ttgggcctggactacaaggctgttgg | L09104 | 44564 | catgtttcagttacctctaggtg | Z48670 | 87168 | gccaatacttcctagatgatgcaa | U04269 |
| 1961 | cctagatacaaggctgtggggaga | L09104 | 44565 | tacctctaggtgaagcctccagga | Z48670 | 87169 | acttctagatgatgcaataaaata | U04269 |
| 1962 | aagccttgtcatcgaagggaacca | AA050852 | 44566 | gaagcctcaggagactctctcttac | Z48670 | 87170 | tagtaaacaatcgatcctgatccaa | U04269 |
| 1963 | cctgtcatcgaagggaccatgg | AA050852 | 44567 | acaggtgcacctctaccacacagt | Z48670 | 87171 | gatcctgatccaagtttctcatttt | U04269 |
| 1964 | gaggacttctcaaggagcactaca | AA050852 | 44568 | tctaccacatagtcaaagagaagg | Z48670 | 87172 | tcctatctcaggttggctgctatga | U04269 |
| 1965 | gacttctcaaggagcactacactg | AA050852 | 44569 | tttacataaacgaagtatgcatt | Z48670 | 87173 | ctcaggttggctgctatgagaccaaa | U04269 |
| 1966 | aaggagcactacactgacctgaagg | AA050852 | 44570 | tgagcatcgacgttgaaggaaagat | Z48670 | 87174 | acttacactgccttggcctcttct | U04269 |
| 1967 | gagcactacactgacctgaaggacc | AA050852 | 44571 | tctccataaacacacaggcctctct | Z48670 | 87175 | ctctctctctgtgaggtatata | U04269 |
| 1968 | cactacactgacctgaaggacgcc | AA050852 | 44572 | taacacacaggcctctctgtggaa | Z48670 | 87176 | accagcatacagtgtgcactg | U04269 |
| 1969 | tttactggcctgggaataatacgc | AA050852 | 44573 | acaggcctctctgtggaaatacca | Z48670 | 87177 | attacaggtgtgcactgatctca | U04269 |
| 1970 | gtgaaatacatgcactccagaacag | AA050852 | 44574 | aataccacatcatcattacaatt | Z48670 | 87178 | cctactccatgacaacatactg | U04269 |
| 1971 | tacatgcactcagaccagtggttg | AA050852 | 44575 | tcctcttggggcaagctgactc | Z48670 | 87179 | ttatctgtatcacatcgtttc | U04269 |
| 1972 | cactcagaccagcagtggtctaagg | AA050852 | 44576 | ccaagctgactccacgtccatcga | D29678 | 87180 | atgatgccatggcgactggagaagac | U29055 |
| 1973 | tcaggaccaggttgctatgtct | AA050852 | 44577 | aatggcctgccatgaccaagctgcc | D29678 | 87181 | ccattccaaccttgaatcgttacag | U29055 |
| 1974 | tcggaccatggccacactggagcgca | AA050852 | 44578 | tgcaacaaggctgcagactaaggcc | D29678 | 87182 | caacctgaatcgttacgacgtatag | U29055 |
| 1975 | atggccaacagtgcgcgcaacttca | AA050852 | 44579 | caatgtaccccagtacaacatcct | D29678 | 87183 | gcgatagaatcctatccaactactaac | U29055 |
| 1976 | gccaacagtgcgcgcaccttcatg | AA050852 | 44580 | catcctggctgaacgtgcgccaa | D29678 | 87184 | gcatatcctatccaactactaac | U29055 |
| 1977 | aacagtgcgcgcaccttcatgcca | AA050852 | 44581 | gggacctgaacctattgaaggtaa | D29678 | 87185 | ttccttcacttattgctgaaccaa | U29055 |
| 1978 | cgccttgtgtcaggttctgc | AA050852 | 44582 | tgttgcagaacctattgaaggtaa | D29678 | 87186 | tcactattgctgaaccaagagcgac | U29055 |
| 1979 | aagtttctgcaggcttcagaggaa | AA050852 | 44583 | agtgtaaacctgtcgcagcgatctc | D29678 | 87187 | attgcgaaccaagagcacaattcc | U29055 |
| 1980 | caggcttcagaggacctctcaagg | AA050852 | 44584 | acccctgcagcgcatctcagagagc | D29678 | 87188 | gaaccaagagcacaatcccattaa | U29055 |
| 1981 | gcttcagaggacctctcaaggagc | AA050852 | 44585 | tgcagcgcatctcagagaggagc | D29678 | 87189 | aaattgtgcatttctgggccatt | U29055 |
| 1982 | caaacagttcgaggattccaag | W46016 | 44586 | catagcgctctgaacccagtggc | D29678 | 87190 | tcacatctgttcctcctccaagag | U29055 |
| 1983 | gttcctgaggattccaaggaaacag | W46016 | 44587 | tgtactccagctccatcgacatgtg | D29678 | 87191 | ctgttccttctccaagagtggccg | U29055 |
| 1984 | cttgtgcacaaggactttagccggt | W46016 | 44588 | ccacagtcgcatcgacatgtggctcagc | D29678 | 87192 | tcctctggtatgatgactcaa | U29055 |
| 1985 | tgtgcacaaggactttagccgctgc | W46016 | 44589 | ggtcacgccgtgcatcttgcaga | D29678 | 87193 | cactcaaagtgacagagcaggtgt | U29055 |
| 1986 | gcacaaggactttagccgctgcaactgcctg | W46016 | 44590 | ccggcccatcttgccgcagagctgc | D29678 | 87194 | tcttagcggacacgacaaccgagt | U29055 |
| 1987 | cttagccgctcgaactgctgatc | W46016 | 44591 | gcatcttgcagagctgctaatgc | D29678 | 87195 | ctggacacgacaaccgagtcagctg | U29055 |
| 1988 | agccgctcgcaactgctgatcagt | W46016 | 44592 | tctccctggccaatgatgtggata | D29678 | 87196 | acgaacaaccgagtcgctgcttggg | U29055 |
| 1989 | tcgcaactgctgatcagtgccag | W46016 | 44593 | tggatgaccagtcgaaganggattctt | D29678 | 87197 | tggaacagggtcctggacagctt | U29055 |
| 1990 | caacgcctgatcagtgccagagg | W46016 | 44594 | tgctagcaaccgacgatgaggaaca | D29678 | 87198 | ctaacaggtggcctggactacatcaa | U29055 |
| 1991 | ctgccagtgccagagggccag | W46016 | 44595 | ttagccgcaacgcttgtagtgt | D29678 | 87199 | tggaatacacaaagtcacctggaa | D50095 |
| 1992 | cgcactgggcctgagccaaggatgta | W46016 | 44596 | cagcaacgcttgtagtgtcactct | D29678 | 87200 | tggtcattgcctctcgcaacagctg | D50095 |
| 1993 | tgagtactccactccgccaggcc | W46016 | 44597 | agagaattcgcagcgccctagcctgga | D38379 | 87201 | ttgccttcgcaacgctgcag | D50095 |
| 1994 | cctagcaccaaaacagaaggtggcc | W46016 | 44598 | gccatgggcagggagtcaggacaacg | D38379 | 87202 | tctgcaacactcgtcgcagcgaacc | D50095 |
| 1995 | cagcaccaaaacagaaggtggcctg | W46016 | 44599 | tagatgacgactctgccgctggc | D38379 | 87203 | gcgaacctgcacatgtcaccat | D50095 |
| 1996 | catgggacaccgtccaacaaccgc | W46016 | 44600 | tctgccctggccctgacctgttt | D38379 | 87204 | ctgtgcacagtcacattggct | D50095 |
| 1997 | gagcaactgtccaacaaccgttg | W46016 | 44601 | cctgacctgctttccaacactgttt | D38379 | 87205 | acatgttcaccatttgctgggcta | D50095 |
| 1998 | gacctgtccaacaaccgcttgtg | W46016 | 44602 | tgcactccactctgtcactgcaga | D38379 | 87206 | tggctacaactccactccacgctgaa | D50095 |
| 1999 | gtccaacaaccgcttgtgcacaag | W46016 | 44603 | cactctccacctgttgtcacatgt | D38379 | 87207 | tcatctaccccgctgcaacgagaa | D50095 |

| SEQ ID NO | sequence | DBAxnID | SEQ ID NO | sequence | DBAxnID | SEQ ID NO | sequence | DBAxnID |
|---|---|---|---|---|---|---|---|---|
| 2000 | caacaacgctttgtcacaaggac | W46016 | 44604 | ccacctgtattctgcagtccag | D38379 | 87208 | atgtccaaggatgtcacatgtgg | D50095 |
| 2001 | caaccgctttgtcacaaggacta | W46016 | 44605 | tctccagcctgtgctatagtgcc | D38379 | 87209 | gggtcgtagaccctgagcctag | D50095 |
| 2002 | ctgtgccaccaagaactgtcagc | M63445 | 44606 | ttgctataglgccactgaatgc | D38379 | 87210 | acatcaaagtcaactgaagaggct | D50095 |
| 2003 | tcgtgccaccaagaactgtcagca | M63445 | 44607 | cgcttgtgctcactcgggca | D38379 | 87211 | aagtcacctgaagaggctcgctc | D50095 |
| 2004 | gttggctttcctgtaagctatccag | M63445 | 44608 | agtgcccacctgaatgtcaataaag | D38379 | 87212 | tccgtcacattccagacagtatgt | D50095 |
| 2005 | ttggctttcctgtaagctatccag | M63445 | 44609 | tcactctgggcctagtgtgcgct | D38379 | 87213 | cacattccagacagtatgtccgg | D50095 |
| 2006 | ttccgtaagctatccaggagtt | M63445 | 44610 | attaatgctctaaacatgcaata | D38379 | 87214 | ccagacagtatgtcggttgca | D50095 |
| 2007 | ttccgtaagctatccaggagctg | M63445 | 44611 | cagctattattcagggcctacctg | D38379 | 87215 | ggattcctatttcatcttctcat | D50095 |
| 2008 | cctgtaagctatccaggagcttggg | M63445 | 44612 | ggaaacctgactttatcacagag | D38379 | 87216 | ccatattcatctctctcatggtcat | D50095 |
| 2009 | ctgtaagctatccaggagctggt | M63445 | 44613 | cctgacttattcacagaaggcgc | D38379 | 87217 | tcttcatgtcatctgcctctgcaa | D50095 |
| 2010 | gtaagctatccaggagcttggtta | M63445 | 44614 | cagcatctcggacttgctctgt | D38379 | 87218 | tcggaagtccagtccaataggttt | D50095 |
| 2011 | agctatccaggagctggttaata | M63445 | 44615 | ctctgagacttgtctgtagaaag | D38379 | 87219 | ctgctgaccaagtcagcagagtgca | D50263 |
| 2012 | gctatccaggagcttgggtaatat | M63445 | 44616 | atggttcgtcgcctgcagtcg | AA022006 | 87220 | gacctcagctttctctagctccata | D50263 |
| 2013 | taaatatagcatcgtcggggt | M63445 | 44617 | cgtcgtcctcgcagtcgtctct | AA022006 | 87221 | agtttctctagctccctagtctag | D50263 |
| 2014 | gtgccaccaaagaactgtcagagc | M63445 | 44618 | tgtgccagccaggacgaaactgg | AA022006 | 87222 | tcccagtcgcactttaacctaggg | D50263 |
| 2015 | tgccaccaaagaactgtcagcagct | M63445 | 44619 | gaaccagagttcactgaaaccg | AA022006 | 87223 | cagctgcacttaacctaggggag | D50263 |
| 2016 | ccaccaaagaactgtcagcagctgc | M63445 | 44620 | gaaacggaatgcctcctcctgggg | AA022006 | 87224 | cctctgtccctgatatgctgtac | D50263 |
| 2017 | caaagaactgtcagcagctgcctgc | M63445 | 44621 | gaatgcctcctgccggtgaaagg | AA022006 | 87225 | ctgtccctgatatgctggtaccat | D50263 |
| 2018 | agaactgtcagcagctgcctgcacg | M63445 | 44622 | tgccttcctgccggtgaaagcgaat | AA022006 | 87226 | atgctggtaccatgtgttgtgtcca | D50263 |
| 2019 | tgtcagcagctgcctgcacgtctt | M63445 | 44623 | agcgaattcctagacaacctggaaca | AA022006 | 87227 | ttgtttgtccagggatgccagc | D50263 |
| 2020 | gtcagcagctgcctgcacgtcttc | M63445 | 44624 | gaattcctagacaacctggaacaa | AA022006 | 87228 | tttgtcaggggatgccagctca | D50263 |
| 2021 | cagcagctgcctgcacgtcttcac | M63445 | 44625 | agagaacacgctcaccagcaca | AA022006 | 87229 | taactagtccatctcccctggaac | D50263 |
| 2022 | tctcggaaaccgtagccctgcagg | W55117 | 44626 | cactgccaccagccacaaatactgcg | AA022006 | 87230 | ctgactcaagtgcagagtgcactg | D50263 |
| 2023 | tcggaaaccgtagccctgcagca | W55117 | 44627 | tgcaccccgccacaaatactgcgacc | AA022006 | 87231 | ctccctggaatcttagctctct | D50263 |
| 2024 | tagcctgcagcctgtgaccaa | W55117 | 44628 | ctgcctgcagtgcctctggg | AA022006 | 87232 | tctggaaccttaggaaagtagctg | D50263 |
| 2025 | agccctgcagcatgctgtgaccaac | W55117 | 44629 | cctctcagtcgcgctctggggct | AA022006 | 87233 | gtagctgcagccagcctgctgct | D50263 |
| 2026 | gccctgcagcatgctgaccaact | W55117 | 44630 | ctgcagtcgcgtcctcggggctgct | AA022006 | 87234 | gccggtctctgaaagaggtgatg | D50263 |
| 2027 | ccctgcagcatgctgaccaactg | W55117 | 44631 | ttgcaccgcgtccatccagaac | AA022006 | 87235 | gatggtccatctccatccaccctgga | D50263 |
| 2028 | cctgcagcatgctgaccaactga | W55117 | 44632 | cccactgcagtcagagaaaaacagt | AA022006 | 87236 | tctccaccgggaccataggtgg | D50263 |
| 2029 | ttgcagcatgctgaccaactgact | W55117 | 44633 | tacctaaaaacagtcagtgcgtt | AA022006 | 87237 | actgacctcagttctctagctcc | D50263 |
| 2030 | tgcagcatgctgaccaactgactg | W55117 | 44634 | aacagtcagtgctgttcttgtgcc | AA022006 | 87238 | attaccaaggacatgttgaagaag | D50263 |
| 2031 | ggtctcggggctgaccaaccacagaa | W55117 | 44635 | tctttgtgccaggacagaaac | AA022006 | 87239 | gccctgcgagcttgggctgatgatg | D50263 |
| 2032 | tctctgggagcagaaccacacagaagc | W55117 | 44636 | gcctacactcgtccatccagcag | AA022006 | 87240 | ttaccgtttgtacacagagagcct | D26089 |
| 2033 | ctctgggagcagaaccacacagaagca | W55117 | 44637 | atcccgtccattcaagcaacgagc | AA022006 | 87241 | acacagagagctaagcccagttt | D26089 |
| 2034 | cggaaaccggtagccctgcagcat | W55117 | 44638 | ctaactgaggaggagctgaatct | AA022006 | 87242 | ctgtgcctttgtgtgttgcaatgc | D26089 |
| 2035 | gaaaccggtagccctgcagcatgg | W55117 | 44639 | gaaatctctgtgagatagagaga | AA022006 | 87243 | gtaccatgtcatgctgtgatgtagagg | D26089 |
| 2036 | aaaccggtagccctgcagcatggc | W55117 | 44640 | atctctgtgagatagagaaacg | AA022006 | 87244 | gctagtccttactgtgrgggacat | D26089 |
| 2037 | aaccggtagccctgcagcatggct | W55117 | 44641 | tcctctgacagaatgatgcgctg | AA022006 | 87245 | tataactgcagccgtacatcttt | D26089 |
| 2038 | accggtagccctgcagcatggctg | W55117 | 44642 | tgacagaactgatgcgctggaatta | AA022006 | 87246 | tggcagccgtacatccttttactg | D26089 |
| 2039 | ccggtagccctgcagcatggctga | W55117 | 44643 | atgcatgcctaaagcctaacctcac | AA022006 | 87247 | ccgtacactcttttactgtgatatga | D26089 |
| 2040 | cggtagccctgcagcatggctgac | W55117 | 44644 | catgctcaaaagcctaacctcaaac | AA022006 | 87248 | atcctttactgtgatatgatgggct | D26089 |
| 2041 | ggtagccctgcagcatggctgacca | W55117 | 44645 | taactgcctcaaacttaaatagtat | AA022006 | 87249 | tccataactatttagaacaaag | D26089 |
| 2042 | cttgccctgcctgcagtttc | M36660 | 44646 | atctatccaatttccccatgtaaat | X01023 | 87250 | gatttctaacacgtgactgggaaga | D26089 |
| 2043 | tttcgccttgttccacaaggatag | M36660 | 44647 | tatccaatttccccatgtaaatag | X01023 | 87251 | gctgcatggccctgcagtgcactac | D26089 |
| 2044 | gctattagttaccctctctgtgttt | M36660 | 44648 | gacgagacaagctcacctctgaaa | X01023 | 87252 | tggcatggcagtccactgaggtcactcac | D26089 |
| 2045 | ttgctcaaacaatggctgagggact | M36660 | 44649 | cacaagctcacctctgaaggact | X01023 | 87253 | tagagtcactcactgttattgc | D26089 |
| 2046 | ctcaaacaatggctgagggactaac | M36660 | 44650 | ctcacctgaaaggactaattga | X01023 | 87254 | aggcagtatccactaactataaacct | D26089 |
| 2047 | cagtgactgcacagccgtgcgggat | M36660 | 44651 | caaaactgcgaacagttcgaaact | X01023 | 87255 | actataaaacctcttcatctg | D26089 |
| 2048 | tgcactgcacaggccggggatgc | M36660 | 44652 | aaacttcgaacagttctgaacctg | X01023 | 87256 | taaacctcgttcctcgaatgt | D26089 |
| 2049 | ctgacacaagccgggggatgtgctct | M36660 | 44653 | cagctcgaaacttctggtgcataaa | X01023 | 87257 | tgcctcttaccgtgttgtacacaga | D26089 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 2050 | M36660 | acaagcctcggggattgctctcca | 44654 | X01023 | gcataaactgacctaactgaagag | 87258 | U27457 |
| 2051 | M36660 | agcctcggggattgctctccagct | 44655 | X01023 | actgacctaactgaggaggagctg | 87259 | U27457 |
| 2052 | M36660 | tctccgcctcattctgctatctt | 44656 | J00612 | tgttccggcaacggagatgaaca | 87260 | U27457 |
| 2053 | M36660 | cgcctcatctgctattcttct | 44657 | J00612 | agtacgtcatggtgcacttccgctg | 87261 | U27457 |
| 2054 | M36660 | tgcctcatgcgtttttgatagtt | 44658 | J00612 | acaagcgttacggtggcttcatgac | 87262 | U27457 |
| 2055 | M36660 | cctcatgcgttttgatagtctg | 44659 | J00612 | gtggttcatgacctccgagaagag | 87263 | U27457 |
| 2056 | M36660 | agtctgccacggcgtggacngca | 44660 | J00612 | tcatgacctcgaagagccagac | 87264 | U27457 |
| 2057 | M36660 | tctgccacgcggtggacagcaaa | 44661 | J00612 | agaagagccaagcgccccctggtac | 87265 | U27457 |
| 2058 | M36660 | ttcttcgggctagctggctaaat | 44662 | J00612 | cgccctggtgacgctctcaagaa | 87266 | U27457 |
| 2059 | M36660 | cgggctagcctggctaaatgcatc | 44663 | J00612 | cgctcttcaagaacgccatcatcaa | 87267 | U27457 |
| 2060 | M36660 | gctagcctggctaaatgcatccaa | 44664 | J00612 | tcaagaacgccatcatcaagaacgc | 87268 | U27457 |
| 2061 | M36660 | ccactgtgctaatgtacctct | 44665 | J00612 | acgcatcatcaagaacgcgcacaa | 87269 | U27457 |
| 2062 | M29211 | atgcggaccacacagactagtgag | 44666 | J00612 | tcatcaagaacgcgcacaagaagg | 87270 | U27457 |
| 2063 | M29211 | ttgagtcaactcaaggatgattga | 44667 | J00612 | agaacgcgcacaagaaggcccagtg | 87271 | AA108106 |
| 2064 | M29211 | tcctaatgcatttgtctctcggacc | 44668 | J00612 | tcatgggtcacttcgctgggaaccg | 87272 | AA108106 |
| 2065 | M29211 | gacctgcatttcttaatgcatagt | 44669 | J00612 | gcccaggaacgacagcagtgctgg | 87273 | AA108106 |
| 2066 | M29211 | cctgcatttcttaatcgattagtcca | 44670 | J00612 | gcagtcagggaacgctcagcgag | 87274 | AA108106 |
| 2067 | M29211 | ttcttaatgcattagtccaattgt | 44671 | J00612 | cagagccgcagtccacgcgagggcaa | 87275 | AA108106 |
| 2068 | M29211 | ctcaacaatatcaccagctgaagcc | 44672 | J00612 | cgagtccacgcgagggcaagcgtc | 87276 | AA108106 |
| 2069 | M29211 | aaatatcaccagctgaagcctataga | 44673 | J00612 | agggcaagcggtctactactccatgga | 87277 | AA108106 |
| 2070 | M29211 | atcaccagctgaagcctatagagta | 44674 | J00612 | agcgctcctactccatgagcactt | 87278 | AA108106 |
| 2071 | M29211 | tcaccagctgaagcctatagactac | 44675 | J00612 | cctactccatggagcactccgctg | 87279 | AA108106 |
| 2072 | M29211 | caccagctgaagcctatagactacg | 44676 | J00612 | ttttcattatatctcgaatgagttcca | 87280 | AA108106 |
| 2073 | M29211 | accagctgaagcctatagagctacga | 44677 | J00612 | ttattgctacactgcgatcagcagc | 87281 | AA108106 |
| 2074 | M29211 | ctacatatagggaccccctcaatgt | 44678 | J00612 | tgaccctcatgtgaatttcgaa | 87282 | AA108106 |
| 2075 | M29211 | ccattataggagcccctcaattgact | 44679 | J00612 | gtgaattctgtcaacctcaggaatg | 87283 | AA108106 |
| 2076 | M29211 | ttatggacccctcatgtactcct | 44680 | J00612 | tctgtcaacctcaggaatgttaacg | 87284 | AA108106 |
| 2077 | M29211 | tgggaccccctcatgtactccat | 44681 | J00612 | gtttgctctttggaatatagctgt | 87285 | AA108106 |
| 2078 | M29211 | gaccccctcattgtactcctaat | 44682 | J00612 | tgtacattgcacgtaggttttga | 87286 | AA108106 |
| 2079 | M29211 | cccccattgtactcctaatgtatt | 44683 | J00612 | gtttaggctggccttaaactcacag | 87287 | AA108106 |
| 2080 | M29211 | tcattgtactcctaatgtattgt | 44684 | J00612 | cttaaactcacagtctctgcctc | 87288 | AA108106 |
| 2081 | M29211 | tcattgtactccaatgatttgct | 44685 | J00612 | gtctctgctcagcctcgagt | 87289 | AA108106 |
| 2082 | W46716 | gaaagttggcctgtgtgtgtctga | 44686 | M60285 | tgcttgatttacggatgtgggccag | 87290 | AA108106 |
| 2083 | W46716 | aagttggcctgtgtgtgtgctgagt | 44687 | M60285 | gattacgtgatttggggccagaaatac | 87291 | AA108106 |
| 2084 | W46716 | aagggatatcctccacctgctcaa | 44688 | M60285 | ctacactggatcagcagcctgcaa | 87292 | AA108106 |
| 2085 | W46716 | ggggatatcctccacctgctcaaca | 44689 | M60285 | aatactgggccatttcattagagga | 87293 | AA108106 |
| 2086 | W46716 | ggatatcctccacctgctcaacagc | 44690 | M60285 | gctagctacaggtcagttgaagg | 87294 | AA108106 |
| 2087 | W46716 | atcctccacttgctcaacagcacaa | 44691 | M60285 | ggaagacctcaagctctgcaaagg | 87295 | AA108106 |
| 2088 | W46716 | tcacctgctcaacagcacaacaca | 44692 | M60285 | agaggttagcctttgtgctgacta | 87296 | AA108106 |
| 2089 | W46716 | accctgctcaacagcacaacaagg | 44693 | M60285 | ttgttgctactaggtcttcgtg | 87297 | AA108106 |
| 2090 | W46716 | ctgctcaacagcacaacaaggcca | 44694 | M60285 | tgtactaggctctctgctcatgtc | 87298 | AA108110 |
| 2091 | W46716 | tgctcaacagcacaacaaggccag | 44695 | M60285 | cctgctgctcggagagtttct | 87299 | AA108110 |
| 2092 | W46716 | ctcaacagcacaacaaggccaagg | 44696 | D64160 | cttgataccgaattgcagcagagaa | 87300 | AA108110 |
| 2093 | W46716 | caacagcacaacaaggccaaggcac | 44697 | D64160 | tatcaccccagcttactcacaactcc | 87301 | AA108110 |
| 2094 | W46716 | agtggccccatggtgatgaggact | 44698 | D64160 | acctccaagaaacgcaagtgtc | 87302 | AA108110 |
| 2095 | W46716 | agctggctcttctatgacta | 44699 | D64160 | acagcaaggtccttgctgctgag | 87303 | AA108110 |
| 2096 | W46716 | ctgtctggctctcatagactc | 44700 | D64160 | agtgctctttgtactgctgccttat | 87304 | AA108110 |
| 2097 | W46716 | ggtcttggctctcatagacact | 44701 | D64160 | cttgctactgagcctatctccct | 87305 | AA108110 |
| 2098 | W46716 | tcttggctctcatagactatcaa | 44702 | D64160 | tcctctaatacattcttaataaga | 87306 | AA108110 |
| 2099 | W46716 | ttgctctctatagactatcagaga | 44703 | D64160 | ggcaagtccccacagttcaagcttcaa | 87307 | AA108110 |

| SEQ ID NO | sequence | DBAxnID | SEQ ID NO | sequence | DBAxnID | SEQ ID NO | sequence | DBAxnID |
|---|---|---|---|---|---|---|---|---|
| 2100 | agaagagccctcgtgaggtcaccat | W46716 | 44704 | tcccacgtaagcttccaataaag | D64160 | 87308 | gccaacttccacatgcagtgctcaa | AA108110 |
| 2101 | aagagccctcgtgaggtcaccaga | W46716 | 44705 | gactgtcatggccagttatccacta | D64160 | 87309 | ttccacatgcagtgctcaagcgtta | AA108110 |
| 2102 | cagatgctgtcctggagccggcata | L03814 | 44706 | cagttatcacatcgttgtagcaat | D64160 | 87310 | cacatgcagtgctcaagcgttacgt | AA108110 |
| 2103 | ctagagtcagttcctccgatgagga | L03814 | 44707 | tcacacgtttagcaatgtatga | D64160 | 87311 | atgcagtgctcaagcgttacgttcag | AA108110 |
| 2104 | cctgccaggagatcctccgcctt | L03814 | 44708 | tcccagccactcactcttaagaaa | D64160 | 87312 | tgtccaagcgttacgttcagatgtcag | AA108110 |
| 2105 | gattctccgccttatgtcgggagac | L03814 | 44709 | tatctctgtcggactcatctcata | D64160 | 87313 | tcaagcgttacgttcagagatgattt | AA108110 |
| 2106 | ggagatctagacatcgctgcacat | L03814 | 44710 | attatttgcatttgcatttgcaatg | D64160 | 87314 | tggttctcgatagcgtcggacatgtag | AA108110 |
| 2107 | ctagcatctgcacatcctg | L03814 | 44711 | tgcatttgcatttgcaatgtgaaga | D64160 | 87315 | tcgatagccggacatgtaggatcgt | AA108110 |
| 2108 | tctgctgcacattctctgctggt | L03814 | 44712 | tattatacccaaggagggccgag | D64160 | 87316 | aattcagcgaacaatgtggaactg | AA108110 |
| 2109 | tgccacattctctgctgctgatgaac | L03814 | 44713 | catcggatcctggagaactggagtt | D64160 | 87317 | agttatcatggccacaaaccgaata | U39302 |
| 2110 | gctctgtatgaacctccaaactgga | L03814 | 44714 | actgaatccaggacctctccaagaa | D64160 | 87318 | gatggcctgcgggaaggcagaaag | U39302 |
| 2111 | ccctcaaactgagactccaagtcca | L03814 | 44715 | tccaggacctccaagaacagcaa | D64160 | 87319 | ctatctctagtggccacagtgtc | U39302 |
| 2112 | aggaacctagagccaggacatgga | L03814 | 44716 | cctcgaacaggcatcggtgcctag | D64160 | 87320 | ccattccagtcattttgccag | U39302 |
| 2113 | cctagagccaggacatgggatagaga | L03814 | 44717 | aacagcatcggtgccgtaggaagtg | D64160 | 87321 | tccagttcattttgccagtagaaa | U39302 |
| 2114 | tcagcttcctccgatgaggaaatg | L03814 | 44718 | ttcatcaggatgccaagtgcttg | D64160 | 87322 | agccgtatcgtgagggacaactgtg | U39302 |
| 2115 | gtgcgcaaccactgtttgaccatt | L03814 | 44719 | gtgcttgcttttacatcggctgcttt | D64160 | 87323 | cactgcctccatatgtgttggt | U39302 |
| 2116 | ctgtttgaccattcacctgtcag | L03814 | 44720 | catccgctgcttggaacaatcagg | D64160 | 87324 | gcctccatatgtgttggtcattgt | U39302 |
| 2117 | gaccattccacgctgcagcaccag | L03814 | 44721 | attggccagtatctttccagtaaca | D64160 | 87325 | atatgttggtcattgtgccgtg | U39302 |
| 2118 | ttgccgctgccagtgactcctag | L03814 | 44722 | cagtatctttccagtaacacagggatc | D64160 | 87326 | tgttggtcattgccgtgctctc | U39302 |
| 2119 | cagtgactcctaggcccacatgcct | L03814 | 44723 | ctttccagtaacagggatcataaag | D64160 | 87327 | tgccgtgctctctactccccat | U39302 |
| 2120 | cacagccccacagtggacgatgtca | L03814 | 44724 | aagatgccacactctccgctatc | D64160 | 87328 | catggccacaaaccgaatagaaact | U39302 |
| 2121 | ctgtgttccacatggaaaagagca | L03814 | 44725 | gccacacttctcgtatcgggtc | D64160 | 87329 | tttggatccagcacttatcaggca | U39302 |
| 2122 | cacacaacatatggccaagtg | W46723 | 44726 | cttctccgtatcgggtcctccag | D64160 | 87330 | caggccaggccatttgacagaaag | AA108121 |
| 2123 | caaacaatatggggccaaggtgct | W46723 | 44727 | gcgtatctggtcctccagacaca | D64160 | 87331 | gcgtatcttcagatcacacag | AA108121 |
| 2124 | cgtactacatgacagttggtgcaa | W46723 | 44728 | tttctcagatcatcaatcctgcca | D64160 | 87332 | cttccagatcaccacgaggatg | AA108121 |
| 2125 | ttttcagccatcattcaggaccg | W46723 | 44729 | agatccatcaatcctgccattgtct | D64160 | 87333 | caccagcaggatgacaactggtgat | U39302 |
| 2126 | gacccccatcattcaggaaccggcaag | W46723 | 44730 | atcaatcctgccattgtctgccgt | D64160 | 87334 | tgacctctgcgggcgacatcaag | U39302 |
| 2127 | accccatcattcaggaaccggcaag | W46723 | 44731 | atgtctgccgtatgaagcaggga | D64160 | 87335 | tggctgagccctgctgtgggaacgc | U39302 |
| 2128 | ccccatcattcaggaaccggcaagcg | W46723 | 44732 | agcattgccaatcatgactgttca | D64160 | 87336 | gatgccaatcaggcctctatggcaa | U39302 |
| 2129 | ccatcattcaggaaccggcaagcgg | W46723 | 44733 | agcaacttgactggcacgaaggt | D64160 | 87337 | atggcaactaggccttctatggcaa | AA108121 |
| 2130 | atcattcaggaaccggcaagcgcgct | W46723 | 44734 | tcagatgtcccacaagtgatgcag | D64160 | 87338 | caagccaactaggaactccggacaagca | AA108121 |
| 2131 | tcattcaggaaccggcaaggcgcta | W46723 | 44735 | catagtcttccttcatcagcgatg | D64160 | 87339 | agcctaggaactccggacaagca | AA108121 |
| 2132 | attcaggaccgggcaaggcgcagtctagc | W46723 | 44736 | cctggccactgctgcacgagtcatc | AA021926 | 87340 | gcctaggaactccggacaagcaga | AA108121 |
| 2133 | ttcaggaccggcaaggcgtagca | W46723 | 44737 | ctggcacctgctgcacgagtcatcg | AA021926 | 87341 | gcctaggaactccggacaagcagaa | AA108121 |
| 2134 | caaccatatgggccaaggtctgac | W46723 | 44738 | gagtcatcttggtgatgccacact | AA021926 | 87342 | ctaggaactccggacaagcagaaag | AA108121 |
| 2135 | aggaccggcaaggcggctagcaagc | W46723 | 44739 | agtcacttggtgatgccacactg | AA021926 | 87343 | taggaactccggacaagcagaaagg | AA108121 |
| 2136 | aggcctgaccccgagctgtacgcg | W46723 | 44740 | tggatgcgcacactgccgaagtcaa | AA021926 | 87344 | gaagcgagtcctgtgtctggtgttg | AA108121 |
| 2137 | ggtgtcgaccccgagctgtacgcg | W46723 | 44741 | ggagcgcacactgccgaagtcaac | AA021926 | 87345 | tggcaactaggcctctatggcaaa | AA108121 |
| 2138 | cgtcgaaggtgacgccgaagcgg | W46723 | 44742 | gatgccgcacactgccgaagtcaact | AA021926 | 87346 | ggcaactaggcctctatggcaaaaa | AA108121 |
| 2139 | ctgcgtagacaatgcgggcccacc | W46723 | 44743 | atgccgcacactgccgaagtcaactg | AA021926 | 87347 | caactaggcctctatggcaaaaat | AA108121 |
| 2140 | caccgtacatcatgacatggg | W46723 | 44744 | tggccacactgccgaagtcaactgc | AA021926 | 87348 | caactaggcctctatggcaaaaaat | AA108121 |
| 2141 | cccgtacatcatgacaagtgggtg | W46723 | 44745 | gcgcacactgccgaagtcaactgcc | AA021926 | 87349 | agatcaagcctaggaactccggaca | AA108121 |
| 2142 | ccgtacatcatgacaagtgggtgc | W46723 | 44746 | cgcacactgccgaagtcaactgcct | AA021926 | 87350 | gatcaagcctaggaactccggacaa | AA108121 |
| 2143 | ttgacagttgtccaggccca | M58691 | 44747 | gcacactgccgaagtcaactgcctc | AA021926 | 87351 | atcaagcctaggaactccggacaag | AA108121 |
| 2144 | cttccaggcccaagtctctgttg | M58691 | 44748 | tggatcctgcacgtcaactgcctc | AA021926 | 87352 | tcaagcctaggaactccggacaagc | AA108121 |
| 2145 | tctcctgaatctaagtgctgtga | M58691 | 44749 | ggccctctgcacgagtcatcgtt | AA021926 | 87353 | gaatccagaacaatcagggaacgt | AA108121 |
| 2146 | agccggtccaataactatccta | M58691 | 44750 | gcacctgctgagagtcatcgtt | AA021926 | 87354 | agaggccatcagggaacgtgcaggg | AA108121 |
| 2147 | ttttactagacctgaagtcagtg | M58691 | 44751 | cactgcctgcagagtcatcgtttg | AA021926 | 87355 | cacatgccctagtgaaccccacatgt | U70068 |
| 2148 | tagacctgaagtcagtgctcggt | M58691 | 44752 | acctccaagccagtcacttgg | AA021926 | 87356 | cacatgcagcctgcctcttctt | U70068 |
| 2149 | ctgaagtcagtgctcggtgtcga | M58691 | 44753 | cacctccaagccagtcacttggtg | AA021926 | 87357 | ctgcctctctgctggtcaaag | U70068 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2150 | tggtcgaagctctcctgagaatcc | M58691 | 44754 | acctccaagccgagtcacttgtgg | AA021926 | 87358 | gtgctcgaccaatgctcgactcca | U70068 |
| 2151 | ctgagaatccgtgctcaaattc | M58691 | 44755 | cctccaagccgagtcacttggtga | AA021926 | 87359 | gaccaatgctcgactccagcctct | U70068 |
| 2152 | gtgctcaaattccctcctaaagca | M58691 | 44756 | caggaggacccaacagttgagcgg | X85993 | 87360 | agcctttcacgccacattgaagt | U70068 |
| 2153 | aatatattgctaccgtacaagtcta | M58691 | 44757 | acccagaagtgctgagctgagccgca | X85993 | 87361 | tttcacgccacattgaagttaggg | U70068 |
| 2154 | atatgctaccgtacaagtctatt | M58691 | 44758 | cttagtgttcctcgaaagtcat | X85993 | 87362 | gcatcaccgatcttccaggattg | U70068 |
| 2155 | gcttattatggtacccaggctggc | M58691 | 44759 | gttccctgaaagttcatatggt | X85993 | 87363 | tgggcaacacgcctcacagaaatca | U70068 |
| 2156 | tattatggtacccaggctggctt | M58691 | 44760 | tatggttcctcttttgcctgaga | X85993 | 87364 | ccaagctccacagaaatcaagataa | U70068 |
| 2157 | accccaggctggtttgaactcaat | M58691 | 44761 | tggttccttcttttgcctgagaata | X85993 | 87365 | cggccacactaaatgcaggctgta | U70068 |
| 2158 | tgaactcaataataatcctgcttag | M58691 | 44762 | aatgtcattgccatcgaaagaga | X85993 | 87366 | agcccaggggagtcaggccaggt | U70068 |
| 2159 | caatataatcctgccttagcctt | M58691 | 44763 | tgcatcagcaaagccattttattga | X85993 | 87367 | tagagctgactccttcattctcta | U70068 |
| 2160 | tataatcctgccttagcctttcca | M58691 | 44764 | atcagcaaagccattttattgaagc | X85993 | 87368 | ctgactcctccatcctcagtgatg | U70068 |
| 2161 | tccaagttctggggttacaggtatg | M58691 | 44765 | ttggctaccagcactcgtgttgta | X85993 | 87369 | cctlcatlctcagtgatgtttgac | U70068 |
| 2162 | caactcggtctctggaacttaa | M58691 | 44766 | accagcactcgtgttgtatgtact | X85993 | 87370 | gtttgacaacaacagatagtagcg | U70068 |
| 2163 | tcttatatgggtcctaagagga | M58691 | 44767 | agcactcgtgttgtatgtactgga | X85993 | 87371 | ccaaaggatatccaagcaaggat | U70068 |
| 2164 | ggcatccagcaagcaaagaggcaac | L13732 | 44768 | catttcatggcattatgtggatgt | X85993 | 87372 | tgtccactgtcaccctagcccagg | AA108088 |
| 2165 | tccagttccagaacaacctcaaaaca | L13732 | 44769 | ttcaggcattatgtggatgtttac | X85993 | 87373 | actcagtggggcgtctccacaa | AA108088 |
| 2166 | cagaacaacctcaaacagaactgcca | L13732 | 44770 | actttccagcagggcttttcctagt | X85993 | 87374 | cgctctccaaaggcctctggt | AA108088 |
| 2167 | aacacctcaaacagaactgccacaa | L13732 | 44771 | ggcttctlcagtataccaacgctt | X85993 | 87375 | attcctgagaccggcactccaaaat | AA108088 |
| 2168 | tcaaacagaactgccacaactccat | L13732 | 44772 | tataccaacgctgacagatcac | X85993 | 87376 | gagaacgcactccaaaatgccc | AA108088 |
| 2169 | aacagaactgccacaactccattgt | L13732 | 44773 | gatgttcacgtccgctgacttagtg | X85993 | 87377 | tccctcaaacatcagaagagctgg | AA108088 |
| 2170 | agaactgccacaactccattgtctc | L13732 | 44774 | gtccgctgacttagtgttccctg | X85993 | 87378 | aagttgcaagctgaggcagcaga | AA108088 |
| 2171 | acaactccattgtctcactccagt | L13732 | 44775 | cgctgacttagtgttccctgaaa | X85993 | 87379 | tcttgcaagctgaggcagcagatag | AA108088 |
| 2172 | actccattgtctcactccagctgt | L13732 | 44776 | tccaggagacaaccaactcctag | D63679 | 87380 | gggaagcagctcctcaacttagttgg | AA108088 |
| 2173 | ttgtcactccagctcgtcgaaga | L13732 | 44777 | agtttcgcaaccagcatgtacct | D63679 | 87381 | aagcgctcctcaacttagttggtca | AA108088 |
| 2174 | cactccagctcgtcggaagaatgaag | L13732 | 44778 | cttgacatccccaagaagagttac | D63679 | 87382 | ctcaactctgggtcattgtgtcag | AA108088 |
| 2175 | agacacagcagcaatlggaggtc | L13732 | 44779 | ctactgatatactctagtttgtta | D63679 | 87383 | ttagtggtcattgtcatgtgatg | AA108088 |
| 2176 | cttacctcggaatatgacacat | L13732 | 44780 | atatactctagtttgttagactgt | D63679 | 87384 | attggtcatgttgatgctggagaaa | AA108088 |
| 2177 | atgaaccattctlatccaccacac | L13732 | 44781 | tttgttagactgtccaagaagaatg | D63679 | 87385 | tcctcaaaggcctctggtggtgat | AA108088 |
| 2178 | ccattctlatccaccacaactaga | L13732 | 44782 | agtgtgttgtctgcatgctgtc | D63679 | 87386 | caaaggcctctggtgatgatgtg | AA108088 |
| 2179 | ttctlatccaccacaactaagagac | L13732 | 44783 | gttgtctgcatgctgctgtc | D63679 | 87387 | agggcctctggtgatgatggagc | AA108088 |
| 2180 | tcaactgaaggtgactccagttccc | L13732 | 44784 | tagacaaattcacacaattgcatgg | D63679 | 87388 | gctctctggatgatgagcgta | AA108088 |
| 2181 | ggtgactccagttccccagaacaccct | L13732 | 44785 | caacattgcatggctctcctttcaa | D63679 | 87389 | gagcgtactctcctaacatcctg | AA108088 |
| 2182 | gactccagttccagaacacctcca | L13732 | 44786 | tgcatggctctclttcaaaaagtg | D63679 | 87390 | cgtacttcctaacatcctgaga | AA108088 |
| 2183 | ctaaaatcacacactggtgtccta | L13732 | 44787 | ttcagactaagtgtagaagaacagta | D63679 | 87391 | cctaacatcctgagaccggcactc | AA108088 |
| 2184 | aatltcacactgaglggtcctaaagt | W47695 | 44788 | tgtacctgttaccaagacaacagta | D63679 | 87392 | aacattcctgagaccggcactccaa | AA108088 |
| 2185 | ccagttcaaagtcctcgatgtaga | W47695 | 44789 | tgttaccaagacaacagtacgtcat | D63679 | 87393 | aatgtctccatcaggccttcactat | AA108088 |
| 2186 | agtctcaaagtcctcgatgtagatg | W47695 | 44790 | aacagtacgtactgacaatagcca | D63679 | 87394 | gtctccatcaggccttcactatct | AA108088 |
| 2187 | tctcaaagtcctcgatgtagatgt | W47695 | 44791 | ttttaatcctlgacagtttgcat | D63679 | 87395 | ttatgacgaggctgaccggttcag | AA108088 |
| 2188 | aaagtctccgatgtagatgtagtg | W47695 | 44792 | aaccttgacagtttgcatgtgatg | U01840 | 87396 | ttgcagtttcccgccagatgtc | AA108088 |
| 2189 | agtctccgatgtagatgtagttgtt | W47695 | 44793 | tgtatgctatcactcattggctac | U01840 | 87397 | tcccgcatgctgtggccaactt | AA108088 |
| 2190 | gggcctgagtggcctcaaaagtg | W47695 | 44794 | gctatcactcattggctactlgaca | U01840 | 87398 | cgccatgtctgtgggcaacttaga | AA108088 |
| 2191 | ctgcactcaaagtcgaagtaaaaatc | W47695 | 44795 | actcactgaagtctactlgacataggca | U01840 | 87399 | atctggtctgtcatcacacacg | AA108088 |
| 2192 | atctccaaagtcaagaactaacag | W47695 | 44796 | ggacctcattcacagaagttacag | U01840 | 87400 | tgtgctacgtcatcacacacgcga | AA108088 |
| 2193 | aaatgtactttccagatgagaat | W47695 | 44797 | gttacagcacgatgtcaacgccgg | U01840 | 87401 | tcatcacacacggcgaggaagaga | AA108088 |
| 2194 | atgtactttccagatgagaatt | W47695 | 44798 | acgatctggcccggtgagtca | U01840 | 87402 | tgtgtctctcatacctggagtca | X65979 |
| 2195 | ttcacactggtcctaagtta | W47695 | 44799 | agatactlgcaggtggtcaggcag | U01840 | 87403 | atacctggagtcagccaagatggggg | X65979 |
| 2196 | attgaattlcctgagggtgagat | W47695 | 44800 | tttgcaggtggtcaggtcagtcagg | U01840 | 87404 | cagtttgcaactcctaagttaa | X65979 |
| 2197 | ttgaatattccgagggagatg | W47695 | 44801 | gggcctgcagcgaactgacattag | U01840 | 87405 | atcaggccttcactlgcactgtcg | X65979 |
| 2198 | gaatatttccgagggagagatgt | W47695 | 44802 | acacgcttccagagacacacttag | U01840 | 87406 | gggcacttgctcactgggtcg | X65979 |
| 2199 | atlcctgagggtlgagatltgatacca | W47695 | 44803 | ttcagagacacactatggagagcc | U01840 | 87407 | cctltgctcactgggtccataaa | X65979 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2200 | gattgataccagtctcaagctcct | W47695 | 44804 | aggaagacactcccgatgagctat | U01840 | 87408 | tcaagggacggaccagagagac | X65979 |
| 2201 | ttgatacagtctcaaagctcctga | W47695 | 44805 | acactccgatgagctattttcgt | U01840 | 87409 | ctatactgcagccttcaaagtgtt | X65979 |
| 2202 | taccagtctcaaagtcctgatgta | W47695 | 44806 | gagctattttcgtcacttcttctc | U01840 | 87410 | tactgcacgccttcaaagtgttga | X65979 |
| 2203 | tctccgtttgatatctgttgca | W47695 | 44807 | taactcacacggctaaagaagcaat | U01840 | 87411 | tgcacgccttcaaagtgttgacac | X65979 |
| 2204 | ctgtttgcaagtctcatgaagatg | W47695 | 44808 | ccgccggctcacatcgatgagatc | U01840 | 87412 | agttatgcacggaggctgaccggtt | X65979 |
| 2205 | gatccaggcctcatacagtgcttt | W47695 | 44809 | ccttaaccactgctgggtgcagcc | U01840 | 87413 | ttcagtgcacggggaatttgaccca | AA108166 |
| 2206 | ccagcctccatacacgtgcttcac | W47695 | 44810 | ccacgtgctcctcctggagccatc | U01840 | 87414 | caaagtctcatggtatcgctggctc | AA108166 |
| 2207 | gcgcctcatacagtgcttcaccg | W47695 | 44811 | acgcaggtcgtcctcgagccatc | U01840 | 87415 | tatcgctgctcaaccaatgtgact | AA108166 |
| 2208 | catacagtgcttcaccgagccac | W47695 | 44812 | tctgtcctcgagccatcaacag | U01840 | 87416 | atcgctggctcaaccaatgtgactg | AA108166 |
| 2209 | ctgggtctctgccataatctc | W47695 | 44813 | ctcatggatcctgaacctgtgct | U01840 | 87417 | tggctcaaccaatgtgactgggat | AA108166 |
| 2210 | ccttctgccataatctcctctaa | W47695 | 44814 | tgaacctggtctgataagaagtct | U01840 | 87418 | ggctcaaccaatgtgactgggata | AA108166 |
| 2211 | tctgccataatctcctctaagat | W47695 | 44815 | tgccacaagtggagcctaaggaa | U01840 | 87419 | gctcaaccaatgtgactggggataa | AA108166 |
| 2212 | gccctaaatctcctctaagatctg | W47695 | 44816 | ttataaacctgcacgaaccactg | U01840 | 87420 | ctcaaccaatgtgactggggataat | AA108166 |
| 2213 | aattctctctaagatctggcgctg | W47695 | 44817 | actctgccagaacacctgtttc | AA022083 | 87421 | tcaaccaatgtgactgggggataatg | AA108166 |
| 2214 | ctaagatctggcgctgttgaagaa | W47725 | 44818 | agcctcgagctgttgcagcagtc | AA022083 | 87422 | caaccaatgtgactggggataaagt | AA108166 |
| 2215 | agagcactgctcatggagactctt | W47725 | 44819 | gttgcacagtcttcagaagcct | AA022083 | 87423 | aactggacatattccaaatgacct | AA108166 |
| 2216 | gcactgctcatggagactcttgag | W47725 | 44820 | cgagctctgcaaacctgaccgca | AA022083 | 87424 | cctggacatattccaaatgaccctg | AA108166 |
| 2217 | ctgtctatggagactcttgaggcg | W47725 | 44821 | agctctgcaaacctgaccgcagt | AA022083 | 87425 | aaagctctatggtatcgctggctca | AA108166 |
| 2218 | ggtgtaactgctctccatactt | W47725 | 44822 | cttctgcaaacctgaccgagtcg | AA022083 | 87426 | aagctctatggtatcgctggctcaa | AA108166 |
| 2219 | cttcctcatatctgaagaaagcaga | W47725 | 44823 | tctgcaaacctgaccgcagtcgg | AA022083 | 87427 | agctctatggtatcgctggctcaac | AA108166 |
| 2220 | aagcagatgccagatccagcgcctc | W47725 | 44824 | tgggctcaccgctgctaaggag | AA022083 | 87428 | tatggtatcgctggctcaaccatg | AA108166 |
| 2221 | cagagctcagatccagcgcctcata | W47725 | 44825 | ggcagctcaccgctgctaaggaga | AA022083 | 87429 | atggtatcgctggctcaaccaatgt | AA108166 |
| 2222 | actgcagatccagcgcctctacag | W47725 | 44826 | cagctcaccgctgctaaggagagt | AA022083 | 87430 | tggtatcgctggctcaaccaatgtg | AA108166 |
| 2223 | ccccatctcaagtccgcctcgagg | W47725 | 44827 | gctcaccgctgtaaggaggagtct | AA022083 | 87431 | ggtatcgctggctcaaccaatgtga | AA108166 |
| 2224 | catcccacaagttaactgaa | W47725 | 44828 | tctgcagaacactgttttc | AA022083 | 87432 | gtatcgctggctcaaccaatgtgac | AA108166 |
| 2225 | ggagccatcgatgcacactgct | W47725 | 44829 | gaaacctgtgttctctgtttca | AA022083 | 87433 | gtccctcagctggcctcggagct | AA108166 |
| 2226 | agccatctgatgccacaactgctac | W47725 | 44830 | gaccacaatgtgaccggagcccc | AA022083 | 87434 | tcctcatgctggcctcggagcctt | AA060105 |
| 2227 | gatgccacaactgctacccttgcc | W47725 | 44831 | ccacaatgttgtgaccggagcccg | AA022083 | 87435 | catgctggcctcggagcctgcc | AA060105 |
| 2228 | taccctgctagctctctgagcg | W47725 | 44832 | tgtgtgaccggagccctgaagctg | AA022083 | 87436 | catggctcggagaacactcaagaa | AA060105 |
| 2229 | cagctgcatcaagctcctgctg | W47725 | 44833 | ttggaccggagcctgagcgtt | AA022083 | 87437 | tctaaggctcatcctgagagaact | AA060105 |
| 2230 | cacgcatcaagtcctgctgctg | W47728 | 44834 | gaccggagccctgagctgtgcag | AA022083 | 87438 | ctaaggctcatcctgagagaactg | AA060105 |
| 2231 | cagatcaagctcctgctgctggg | W47728 | 44835 | ggagccctgagctgtcgcagc | AA022083 | 87439 | taaggctcatcctgagagaactgc | AA060105 |
| 2232 | gatcaagctccctgctgctggcc | W47728 | 44836 | cagggcctctgagccctgagatc | AA022083 | 87440 | aggtccatcctgagagaactggcta | AA060105 |
| 2233 | ccttgctgacactgactgctggt | W47728 | 44837 | gtgattcatccccagtggccagcat | U25652 | 87441 | ggtccatcctgagagaactggctac | AA060105 |
| 2234 | ctcagcagcctaactctgtggtgg | W47728 | 44838 | ggatctctgtgggatccaaacattt | U25652 | 87442 | catgctggcatcggagcctgcc | AA060105 |
| 2235 | tcctcacaagcttttaactgaagtc | W47728 | 44839 | gatccaacattccgttcgtatt | U25652 | 87443 | catggcatggagaacactcaagaag | AA060105 |
| 2236 | ctccaagcttttaactgaagctcag | W47728 | 44840 | ttctaaagcacaaaacacttccat | U25652 | 87444 | tggccatggagaacactcaagaaga | AA060105 |
| 2237 | agctttaactgaagctcagatcg | W47728 | 44841 | agcacaaaacacttccataattag | U25652 | 87445 | ggccatggagaacactcaagaagaa | AA060105 |
| 2238 | aactgaagctcagatcggccaagat | W47728 | 44842 | ctcctgtattctgaattgccaaa | U25652 | 87446 | gccatcggagaacactcaagaagaag | AA060105 |
| 2239 | ctcagactggccaagatggagcca | W47728 | 44843 | tggattgccaaacaccaccattga | U25652 | 87447 | catcggagaacactcaagaagaaga | AA060105 |
| 2240 | cagactggccaagatggagccatc | W47728 | 44844 | ccataactctacaactctg | U25652 | 87448 | ctttcaaggctccatcctgagagaac | AA060105 |
| 2241 | aagatggagccatctgatgccaca | W47728 | 44845 | attatttctgcatccatctact | U25652 | 87449 | aatcagagaacttgcaccggggcg | AA060105 |
| 2242 | ttgagccatctgatgccccattcct | W47728 | 44846 | tctgcaatccatctacacatatata | U25652 | 87450 | ctgagcaatcctgcgcagagatctgc | U77630 |
| 2243 | gggcacttctgagcccccattcct | M21532 | 44847 | atccatctacatataatagcaaac | U25652 | 87451 | gcataagcctcattactactgaact | U77630 |
| 2244 | ttctgagccccattccctgcgg | M21532 | 44848 | catccagttgcagcatccgta | U25652 | 87452 | taagcctactactgaactct | U77630 |
| 2245 | caggccagaacccagaaagcaggg | M21532 | 44849 | agtgtcgcatcctgacaatgg | U25652 | 87453 | gcctcattactactgaacttcca | U77630 |
| 2246 | atatgtcggtcaacaccagggcg | M21532 | 44850 | ccagatcccgtacaatgggcaagg | U25652 | 87454 | tccaaacctagcggaacctgca | U77630 |
| 2247 | taacagttaatccctgcctgctt | M21532 | 44851 | tcccgtacaatgggcaaggctacc | U25652 | 87455 | tgcaaagcttgtgtcagccaaag | U77630 |
| 2248 | cagttaattccctgccgctcca | M21532 | 44852 | gctatccaggtagtgtctgctcatc | U25652 | 87456 | aatgttgtgtcagccaaggta | U77630 |
| 2249 | ctatccgccccaaggatggaatgca | M21532 | 44853 | tgttgccatcataaggagactcca | U25652 | 87457 | tgcagccaaggtaactatagta | U77630 |

| SEQ ID NO | sequence | DBAxnID | SEQ ID NO | sequence | DBAxnID | SEQ ID NO | sequence | DBAxnID |
|---|---|---|---|---|---|---|---|---|
| 2250 | aggatctgctgaactcagttcg | M21532 | 44854 | tgccatcataaggactccagttcc | U25652 | 87458 | aatgtctcagcaaggtgtaaggttg | U77630 |
| 2251 | atcctgctgcactcagttccgag | M21532 | 44855 | agataggatctgtgcgatccaa | U25652 | 87459 | gcgcctgattatcgcctgggatga | U77630 |
| 2252 | cccagacacaagctcctgagagtt | M21532 | 44856 | ctgttctgtttgaatcctatgt | AA022093 | 87460 | cctgattatcgcctgggatgaaga | U77630 |
| 2253 | agaacaagctcctgagagttcta | M21532 | 44857 | ctctgttttgaatccctatggaa | AA022093 | 87461 | tgcagagatccgcctggctgcccct | U77630 |
| 2254 | gagagttctagccatcctgggcctc | M21532 | 44858 | tgatgtggtccatcgcgggaggt | AA022093 | 87462 | aaaccaataaacgtctccaatgctg | U77630 |
| 2255 | tgagcccattcctgcaggttc | M21532 | 44859 | tgagttgtccatcgcgggaggaactaac | AA022093 | 87463 | gatctgcctggctgccctaggga | U77630 |
| 2256 | tggcaggttcaccgaccaggaagg | M21532 | 44860 | tacctgcacagtgacctgcatc | AA022093 | 87464 | cagaggaaccaagaccaagccagg | U77630 |
| 2257 | aggaaggcttcttcaacctgctgac | M21532 | 44861 | cttgcacagtgacctgcatcc | AA022093 | 87465 | ccaagaccaagccaggctcatgcca | U77630 |
| 2258 | aaggctctcaacctgctgaccca | M21532 | 44862 | gcacagtgacctgcatccctt | AA022093 | 87466 | catgccagaaccgagacttacagg | U77630 |
| 2259 | cccacgtgcaggcggatcggatgga | M21532 | 44863 | ctgcatcctcttagaagaagccac | AA022093 | 87467 | gccttgccgctcataaactggttt | U77630 |
| 2260 | agcgcgtgttcctgcaggctgg | M21532 | 44864 | tagaagaagccacactcctcgaatt | AA022093 | 87468 | gctcataaactggtttccacgggg | U77630 |
| 2261 | cctgcaggctgggcaggccagaa | M21532 | 44865 | ctgcctccaaggttcctcaagtca | AA022093 | 87469 | gttctcacgggcataagcctcat | U77630 |
| 2262 | ggccaggccagaaccccagaaagcca | M21532 | 44866 | tcctcaagagttcctaagtcaagg | AA022093 | 87470 | ctgctcacacaactggtgaccatggac | U07808 |
| 2263 | gtttgtcacatgataccaagatgt | X13664 | 44867 | tcaagagcttccacttcaaggcca | AA022093 | 87471 | acacacctgaccatggaccctggg | U07808 |
| 2264 | aagatgtaactcagctcagtaattc | X13664 | 44868 | atccctatgtgaagcgttccattaa | AA022093 | 87472 | ctgtccccagctgccaagtgt | U07808 |
| 2265 | gattacaggccaattccaccacaca | X13664 | 44869 | gcttcctaagtcaaggccaagtatt | AA022093 | 87473 | tccccccagctgtcccaagtgcc | U07808 |
| 2266 | gactgagctcgtcctaatgagttt | X13664 | 44870 | gcctaaatgacatcaccaaaaga | AA022093 | 87474 | ctgtgccaagtgccgccggtgcc | U07808 |
| 2267 | catcacctgaaactaatcagaaag | X13664 | 44871 | ctaccaacctgatcaattgctgc | AA022093 | 87475 | tgccaagtgtgcccggggctgcatc | U07808 |
| 2268 | gctaacactgggctcattcacatgg | X13664 | 44872 | acctgatcaattgctgctgaaaa | AA022093 | 87476 | caagtgcagtcgtcgtccccgaaac | U07808 |
| 2269 | ctcattcacatgggtttgcattcc | X13664 | 44873 | tcaatttgcttgctgaaaatgtcg | AA022093 | 87477 | tccctgaaaccaccctatggccagcg | U07808 |
| 2270 | gcattctaggcaaactaaactgct | X13664 | 44874 | gattaagcaataaccaaggagtcgt | AA022093 | 87478 | ctgaaaccaccctatggccagcggga | U07808 |
| 2271 | tgcctttacaacaaggctcagtca | X13664 | 44875 | gcaatacccaaggagtcgttctgc | AA022093 | 87479 | cccacctatggcagcgggagagatc | U07808 |
| 2272 | caaggctcagtcatcttcctgaagc | X13664 | 44876 | cctttctaccagtgagtgtcca | AA022093 | 87480 | aagtgactacacagtacctgagtca | U07808 |
| 2273 | ctgctgagaccagcacttggtctg | X13664 | 44877 | gatctgggccaatgtcatcttgtta | AA022093 | 87481 | cacaglacctgagtcaaggagtta | U07808 |
| 2274 | agaccagcacttggtctgttttgt | X13664 | 44878 | caatgtcatcttgttatacagaagc | AA022093 | 87482 | gaccaggaccctgggggaatgcacg | U07808 |
| 2275 | aatggccattttctctgatctt | X13664 | 44879 | gggcaatcttctcctgacgaatc | AA022093 | 87483 | cacgtatgtcgtggggatccgc | U07808 |
| 2276 | ctctctgatctgtaataccttaaa | X13664 | 44880 | tctttctcctgacgaatcaatctg | AA022095 | 87484 | aggagatctgcatcgcggagataat | U07808 |
| 2277 | ataacaggatctgtcgtgtagtcc | X13664 | 44881 | ttctcctgacgaatcaatctggcc | AA022095 | 87485 | gatctgcatcgcgggagataattgc | U07808 |
| 2278 | ggatcttgctgtagtcctagctg | X13664 | 44882 | aatcaatctggccacagaaatcata | AA022095 | 87486 | ttgcaaatgcacaacctgcagcgt | U07808 |
| 2279 | ctagctggcctcaaaatcacaattac | X13664 | 44883 | cataaatccacatatgctgtacaa | AA022095 | 87487 | atgcaacctgcagctgtaaaacc | U07808 |
| 2280 | ggcctcaaactcacaatactctcc | X13664 | 44884 | atatgctgtacaagcctcttattag | AA022095 | 87488 | cacaacctgcagctgtaaaacctgt | U07808 |
| 2281 | aaactcacaatactctctcctgatc | X13664 | 44885 | tgctgtacaagcctcttatagatt | AA022095 | 87489 | aaccttgcagctgtaaaaaacctgct | U07808 |
| 2282 | ctctcctgatcaatcccaagt | X13664 | 44886 | tgtacaagcctcttatagattcca | AA022095 | 87490 | agccttgctgggggctagtactact | U07808 |
| 2283 | tgtatgtcagcctgctccggaagtg | X13664 | 44887 | ctctttatagattccagtgcattca | AA022095 | 87491 | cttgctgggggctagtactactata | U39473 |
| 2284 | tttctcatcgctgacgttggcac | W47743 | 44888 | ttatagatccagtgcattcatag | AA022095 | 87492 | cggatctttccattgctagagcaaa | U39473 |
| 2285 | tgaaccgctgcagcagcggaagtg | W47743 | 44889 | tggatcatttcgatcttcaggtta | AA022095 | 87493 | agactgaagcttgctccagagttat | U39473 |
| 2286 | gaaccgctgcagcagcggaagtg | W47743 | 44890 | atcatttcgatcttcaggttagcc | AA022095 | 87494 | atcaaggctgagctgctgtacaaga | U39473 |
| 2287 | aaccgcgtgcaggcagcggaagttggtcat | W47743 | 44891 | tcgatcttcaggttagccgtagca | AA022095 | 87495 | ttactaaaccagttgcagtactgt | U39473 |
| 2288 | acgcgcggcagcggaagttggtcatc | W47743 | 44892 | ttcaggttagccgtagcattggca | AA022095 | 87496 | ctaaaccagttgcagtactgtgagg | U39473 |
| 2289 | ccgcggcggcagcggaagttggtcatcc | W47743 | 44893 | tttagccgtagcattggcaatttct | AA022095 | 87497 | cagttgcagtactgtgagaggccag | U39473 |
| 2290 | cgccggcagcggaagttggcac | W47743 | 44894 | ttattcattccaaagcaagctgg | AA022095 | 87498 | ggcatcccacgtggtggccatcatttg | U39473 |
| 2291 | ttctcatcgtgacggtggcact | W47743 | 44895 | cattccaaagcaagctggtttca | AA022095 | 87499 | ccactggccatcattggtgtgag | U39473 |
| 2292 | ctcatcggtgacggtggcactgc | W47743 | 44896 | ctgttttcatcgatgggcaatctt | AA022095 | 87500 | gtggccatcattggtgagcaggaac | U39473 |
| 2293 | tcatcgtgacggtggcactgct | W47743 | 44897 | gatgcccgttaagaaaaatgcagc | U34920 | 87501 | gccatcattggtgagcaggaactca | U39473 |
| 2294 | catcggtgacggtggcactgcta | W47743 | 44898 | atgcagctggccctgcctcccagag | U34920 | 87502 | ctagactatactgggtcatct | U39473 |
| 2295 | agctggtgacggaacgaagtgaa | W47743 | 44899 | cggctggcctgcagctccgta | U34920 | 87503 | ccatctgcaactggaacaactat | U39473 |
| 2296 | aagtgaaccgctgcagcgaagttg | W47743 | 44900 | ctggcctgatgtttcgtatct | U34920 | 87504 | gactactatactgggtcatctatg | U39473 |
| 2297 | agtgaaccgcctggcagcgaagttgg | W47743 | 44901 | ccttgatgcttgcgatcttatcg | U34920 | 87505 | tatactgggtcatctatgaggcag | U39473 |
| 2298 | gtgaaccgcctggcagcgaagttggt | W47743 | 44902 | tgatgcttgcgatcttatcgtag | U34920 | 87506 | gtgctgcagatgccaaccaagtg | U39473 |
| 2299 | gccgatgctccgcagcgcgagaagct | W47719 | 44903 | tgcttcgtactctatctgtagaga | U34920 | 87507 | ctgctcagatgcaaccaagctg | U39473 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2300 | ccgatgtcgacagcgagaagctc | W47719 | 44904 | cttgtctatacaaacacgcctg | U34920 | 87508 | atgccaaccagctggggaagagc | U39473 |
| 2301 | aagtgcagggctcctcgctggaa | W47719 | 44905 | cttgccttctagactcagcttaa | U34920 | 87509 | tacgaggcctggttggcatgttg | U39473 |
| 2302 | tggtcttgcctcaaatccacggga | W47719 | 44906 | gccttctagagctcagcttttaa | U34920 | 87510 | ggcatgtttgacccaagggcgca | U39473 |
| 2303 | gtcttgcctcaaatccacggaga | W47719 | 44907 | ttctagactcagcttttaaccagg | U34920 | 87511 | gtatacagcagttgctgagaaac | U27455 |
| 2304 | tttgcctcaaatccacgggagatt | W47719 | 44908 | tagactcagcttttaaccaggga | U34920 | 87512 | tcatcatcatgccaatgaagactc | U27455 |
| 2305 | ttgcctcaaatccacgggagattt | W47719 | 44909 | tctccagagcaccaccatctaagg | U34920 | 87513 | tgtcagctcataccaaagaaat | U27455 |
| 2306 | caaatccacgggagattttctgag | W47719 | 44910 | tccagagcaccaccatctaaggca | U34920 | 87514 | cagtcataccaagaaatactga | U27455 |
| 2307 | ctctcaagatctgtgggtgacactcc | W47719 | 44911 | cagtttaacccctgtgagctcagt | U34920 | 87515 | acggctggtgcctactgacag | U27455 |
| 2308 | ggtgacactccatggccagtactat | W47719 | 44912 | attgcactagatcatgtcttgacag | U34920 | 87516 | tggtgcctactgacaggccct | U27455 |
| 2309 | gtgacactccatggccagtactatg | W47719 | 44913 | ctagacatgtcttgacaggtcctg | U34920 | 87517 | cagaagactgagcctttcgtgct | U27455 |
| 2310 | acactccatggccagtactatgacc | W47719 | 44914 | catgtctgacaggtcctgagatc | U34920 | 87518 | gataattctcccaggacagtgt | U27455 |
| 2311 | atgtccgaacagcgagaagctcaac | W47719 | 44915 | gtctttgacaggtctgagattccc | U34920 | 87519 | tggcctttcgagccaattccagga | U27455 |
| 2312 | gctccgacagcgagaagctcaacct | W47719 | 44916 | cctgagattcctcggctgtgcct | U34920 | 87520 | aaccacactcagtgaccacttcat | U27455 |
| 2313 | acagccgagaagctcaacctggattc | W47719 | 44917 | atcattggccctgggtgatggctc | U34920 | 87521 | gtgaccacttcatgtgaagactt | U27455 |
| 2314 | cgagaagctcaactggattccatc | W47719 | 44918 | cattgggccctgggtgatggctctg | AA022099 | 87522 | agacattgtgaagctactgaaggt | AA022099 |
| 2315 | gctaacctggattccatcatcggg | W47719 | 44919 | gccgttgccatgttgacggtgagag | AA022099 | 87523 | tggtgcctttgatgctctacatgcc | AA022099 |
| 2316 | tcaacctggattccatcatcggga | W47719 | 44920 | gccatgttgacggtgagagctcaca | AA022099 | 87524 | ctttgatgctctacatgccggcca | AA022099 |
| 2317 | cctgattccatcatcggggcctg | W47719 | 44921 | ccggttcatcattggcttcagcgca | AA022099 | 87525 | tgctcacatgccggccaaatgg | AA022099 |
| 2318 | tgcaagtcagggtctccggctgg | W47719 | 44922 | gcttcagcgcaccatgccatcgt | AA022099 | 87526 | ttcctcacccgatcattgagtc | AA022099 |
| 2319 | tgctactttgctcgttctctgtc | M96823 | 44923 | accagtccatcgttgctgcagt | AA022099 | 87527 | ctacccgatcattgagtccagagc | AA022099 |
| 2320 | cttgctctctctgttcctcagat | M96823 | 44924 | ccagtccatcgttgctcagtta | AA022099 | 87528 | ttgagtccagagcgatttgcct | AA022099 |
| 2321 | ctgcctctgtggagcaatgatct | M96823 | 44925 | atgtccatcgtgtcgtcagtag | AA022099 | 87529 | ccagatttgcctgctgcagctccaa | AA022099 |
| 2322 | atgatctcaattcctttggtggct | M96823 | 44926 | atcgttgctcagttatggggctta | AA022099 | 87530 | ttgcctgcagctcagctcataccaa | AA022099 |
| 2323 | cccagatatgctcacacccctagct | M96823 | 44927 | cgttgctgcagttatggggctatt | AA022099 | 87531 | gctcttgcacattctcggcat | AA022099 |
| 2324 | tatgctcacacccctagctgaggtc | M96823 | 44928 | ttgctgcagttatggggcttaatgc | AA022099 | 87532 | cttgcacattctcggcatct | AA022099 |
| 2325 | ccaacctgctctgggtcctgtaaa | M96823 | 44929 | gggccctggtgatggctctgctcc | AA022099 | 87533 | ttactactactagctgggtgttc | AA022099 |
| 2326 | ctgctcaggctctgaaaatggt | M96823 | 44930 | tgatggctgctctcacattgcc | AA022099 | 87534 | gatgtctcagtcatatcgcgatatcg | AA107289 |
| 2327 | aactccccggctcaggccacact | M96823 | 44931 | tctgctctcacatgccagtat | AA022099 | 87535 | gtctcagtcatatcggatatcggaa | AA107289 |
| 2328 | gctcctctgtgccccagttcca | M96823 | 44932 | ctgctccacatgccagttaca | AA022099 | 87536 | gatatcgcattgtacgccgcagc | AA107289 |
| 2329 | tccaaatatagccggcacaaataa | M96823 | 44933 | tcattcgtgactacagtacctggt | AA022099 | 87537 | attggtacgcgcagcagtgtctc | AA107289 |
| 2330 | tatagccggcacaaataacatta | M96823 | 44934 | tcgtgtgactacagtacctggtaaa | AA022099 | 87538 | ggtacgcgcagcagtgtctcata | AA107289 |
| 2331 | tcgtcctgttccaggctcagct | M96823 | 44935 | gacagtagcctgcacttaacttt | AA022099 | 87539 | ccgcagtcagttgtcctatagtcgtc | AA107289 |
| 2332 | tcagcctctgctgttctcaccta | M96823 | 44936 | taaatgtggccgttgccatgttgaac | AA022099 | 87540 | cagtgttcatatgtcgtctgtat | AA107289 |
| 2333 | cttcctactctagtctcactgaat | M96823 | 44937 | agagtcaaccaggcaacaccgtagg | U43836 | 87541 | tgttctcatatgtcgctctgtatct | AA107289 |
| 2334 | aggtgcactggatcacaggacctg | M96823 | 44938 | gtgacaagctgcttttccagactcca | U43836 | 87542 | catagtcgtctgtgatatcggcccg | AA107289 |
| 2335 | actggatcacaggacctggttag | M96823 | 44939 | atctccagagctgccatctaacaa | U43836 | 87543 | aagagctgatctccatgtgccat | AA107289 |
| 2336 | tcacaggacctggttagtgtctc | M96823 | 44940 | cagagtgccatctaacaattgtca | U43836 | 87544 | tgatcccacatgccattagtac | AA107289 |
| 2337 | gaccttggcttagtgtctcgactc | W47721 | 44941 | tgccactaacaattgtcaaggaac | U43836 | 87545 | tcacatgccattagtactacct | AA107289 |
| 2338 | gtgctctgactcgcctctgtgg | W47721 | 44942 | aaggaacctcatgtccacctcagg | U43836 | 87546 | ttagtacgtacccatgcagtcat | AA107289 |
| 2339 | gtcttggttcagcattgctggag | W47721 | 44943 | cctcacgtccaccgtcaggggccag | U43836 | 87547 | gtaagtaccccatgcagtcatcga | AA107289 |
| 2340 | tctgggttcagcactggaagt | W47721 | 44944 | gtctcacctcaggggccaggtact | U43836 | 87548 | cgtacctccatgcagtcatgatta | AA107289 |
| 2341 | acatctcgggatataacagcatcta | W47721 | 44945 | cctcaggggccaggtactctctcta | U43836 | 87549 | attaagcacgtagccagtgtcag | AA107289 |
| 2342 | cattctcggggataaacgcatcat | W47721 | 44946 | tctctcaacttaaccacctgtcaa | U43836 | 87550 | gagtactcatgtactagctggat | AA107289 |
| 2343 | taacgcatctagtaaccagcaaata | W47721 | 44947 | ccaccctgctcaagtgagcatctc | U43836 | 87551 | ggaacttcacacgtgagaccagac | AA107289 |
| 2344 | aggtgcacacaacaaggacggcaaa | W47721 | 44948 | acactcaactgtgataaagagat | U43836 | 87552 | ctcagctgagaccagacaactag | AA107289 |
| 2345 | gtgcacacaacaaggacggcaaact | W47721 | 44949 | agctgcttccagactcaccggcc | U43836 | 87553 | atctccggtggaggcgtgactc | U64199 |
| 2346 | tgcacacaacaaggacggcaaact | W47721 | 44950 | tttcagactccacgggccggttg | U43836 | 87554 | gagcggctgacctcatgttaac | U64199 |
| 2347 | gcacacaacaaggacggcaaactc | W47721 | 44951 | gcttttaggccctgcttcacagg | U43836 | 87555 | ctgactctagatccctcagagcat | U64199 |
| 2348 | cacaagacaaggacggcaaacttca | W47721 | 44952 | atggccctgcttcaaggagaaga | U43836 | 87556 | ggtatgactccctcatgagtaatg | U64199 |
| 2349 | cagcacaacaaggacggcaacttcagat | W47721 | 44953 | ctgctccaggggaggaagatggag | U43836 | 87557 | gactccctaaggtcaagtaatgaggtt | U64199 |

| SEQ ID NO | sequence | DBAxnID | SEQ ID NO | sequence | DBAxnID | SEQ ID NO | sequence | DBAxnID |
|---|---|---|---|---|---|---|---|---|
| 2350 | acggcaaacttcagattggagacaa | W47721 | 44954 | gcacaggcgaacctcctcagtcgg | U43836 | 87558 | gtacctcatttatctgcccagttc | U64199 |
| 2351 | tggttcagcattgctggaggtgtgt | W47721 | 44955 | tagagagctctcgccatctttta | U43836 | 87559 | catttatctgcccagttctcactc | U64199 |
| 2352 | gttcagcattgctggaggtgttgga | W47721 | 44956 | tcgccatctttatctccagagct | U43836 | 87560 | gaagacaagccagctgtcgtcggat | U64199 |
| 2353 | ttcagcattgctggaggtgtgaa | W47721 | 44957 | tgcctcctggattcctggatccag | U47281 | 87561 | tagcttccaataggtacttaagtc | U64199 |
| 2354 | tcagcattgctggaggtgttggaaa | W47721 | 44958 | cctggattcctggatccaggtcag | U47281 | 87562 | atacacaactggtatcatatag | U64199 |
| 2355 | cagcattgctgaggtgttggaaac | W47721 | 44959 | ctgcctgctgaattgaaaacagca | U47281 | 87563 | agcagagaccctgactcaaaactgg | U64199 |
| 2356 | agcattgctgaggtgttggaaacc | W47721 | 44960 | ccaagaagcctggtcttctgaccaa | U47281 | 87564 | aaaggacccaagatagatcatgctc | U64199 |
| 2357 | gcattgctgaggtgttggaaacca | W47721 | 44961 | agcctgcttcttgaccaaccgtct | U47281 | 87565 | ttgacagtcaccccagtgaactacc | U64199 |
| 2358 | cacatccttgggataacagacatct | W47721 | 44962 | gctctctgaccaaccgtctctgcta | U47281 | 87566 | ccagtgaactaccttcctagccatg | U64199 |
| 2359 | tttattacaatcatctcctcaatag | W47721 | 44963 | acgtctgtctatcatagggaacca | U47281 | 87567 | ccctccaacatagaagatctgtcac | U64199 |
| 2360 | ttattacaatcatctcctcaatagc | AA071834 | 44964 | tctgtctatcatagggaccatctggc | U47281 | 87568 | gaagatctgccacaactgagatctg | U64199 |
| 2361 | acactcagtgcgccactgactaatc | AA071834 | 44965 | atcatagggaccatctggctgagcc | U47281 | 87569 | gaggctgaccccactgatcttttg | U64199 |
| 2362 | cactcagtgcggcactgactaatca | AA071834 | 44966 | ctgagccacagcccacaaagatgc | U47281 | 87570 | actgatcttttgactgagacac | U64199 |
| 2363 | actcagtgcggcactgactaatcaa | AA071834 | 44967 | cgggacctgcagatgcacttaata | U47281 | 87571 | attttgcatcaagtctcctcgcc | U64199 |
| 2364 | ctcagtgcggcactgactaatcaaa | AA071834 | 44968 | ctcgagtgcactaataagglatc | U47281 | 87572 | tccactggtgagaaccctgcagg | U78085 |
| 2365 | tcagtgcggcactgactaatcaaac | AA071834 | 44969 | ccaggacgcttctggaaggagtc | U47281 | 87573 | gagaaccctgcaggtcctggtga | U78085 |
| 2366 | agtgcggcactgactaatcaaact | AA071834 | 44970 | cacagacctggcctgactggcc | U47281 | 87574 | ctcattaatgtgccaaggcctcc | U78085 |
| 2367 | cagcaaccgactacactcagtgcgg | AA071834 | 44971 | gctggccaacttcttgcttttgtc | U47281 | 87575 | aatgtcgccaagggctcctccaatt | U78085 |
| 2368 | agcaaccgactacactcagtgcggc | AA071834 | 44972 | caactcttgcttttgtcaacag | U47281 | 87576 | agggctctccaattcctatgcca | U78085 |
| 2369 | gcaaccgactacactcagtgcggca | AA071834 | 44973 | cttttgtctcaacgctgctg | U47281 | 87577 | ggctcctccaattcctatgccatca | U78085 |
| 2370 | caaccgactacactcagtgcgggca | AA071834 | 44974 | tttgtcaacgctgctgaaccca | U47281 | 87578 | aatcctatgccatcaagaagaaag | U78085 |
| 2371 | aaccgactacactcagtgcggcact | AA071834 | 44975 | ctgctgaaccactgattatgtc | U47281 | 87579 | tcctatgccatcaagaagaaagatg | U78085 |
| 2372 | actacactcagtgcggcactgacta | AA071834 | 44976 | actgattatgttctgcaggccgg | U47281 | 87580 | aagtcaaccgtgatttcccagct | U78085 |
| 2373 | ctacactcaglgcggcactgactac | AA071834 | 44977 | ctgagcagttcacaaagggtgca | U47281 | 87581 | tctaaccgtcgattttcccagctgct | U78085 |
| 2374 | tacactcagtgcggcactgactaat | AA071834 | 44978 | agcttcacaaagggtggaaggat | U47281 | 87582 | aaccgtcgatttccagctgcgc | U78085 |
| 2375 | ctcacctatggagacaagatctt | AA071834 | 44979 | tgtctctcttatcccagagt | U47281 | 87583 | ccagctgctgctccctaaataactg | U78085 |
| 2376 | agatcttatggacacataccctgt | X16995 | 44980 | ctgtgtcctcactgcgaatgcgac | D45858 | 87584 | aacctctgcaggtctgcgtgaatg | U78085 |
| 2377 | cattttaacacataccactctgt | X16995 | 44981 | cctcactgtgaatgtgacagacca | D45858 | 87585 | gtgaatcaggccatgctggctgct | U78085 |
| 2378 | ttttttaacacataccactctgta | X16995 | 44982 | tgtcgcagaccaaatcctgatgtc | D45858 | 87586 | caggccatgctggctgcacagg | U78085 |
| 2379 | cacatacactctgtgtaaataag | X16995 | 44983 | cagacaatcctgatgctccctga | D45858 | 87587 | atctggctgtggcacagggggctc | U78085 |
| 2380 | atacactcctggtgtaaataagctg | X16995 | 44984 | aatcctgatgctccctgaacagac | D45858 | 87588 | gctcgtgaggctgcttccggaaca | U78085 |
| 2381 | gcggagctccaactgagatctctt | X16995 | 44985 | tgatgccctgaacagacaccccc | D45858 | 87589 | gcttccggaacatcaagaaca | U78085 |
| 2382 | tccgctcctctcactgtcatcta | X16995 | 44986 | gccgctcaacctcaccagaaata | D45858 | 87590 | atcaagaacatcgccgagtgcctg | U78085 |
| 2383 | gtacataactgtcactcaagaaggt | X16995 | 44987 | gctatcatccaagaaataaacaca | D45858 | 87591 | aagatcatttccagatggacaaac | AA139606 |
| 2384 | cataactgtcactcaagaaggtgat | X16995 | 44988 | atcaccagaaataaaacactctgt | D45858 | 87592 | aagatacaaccagatgacaacac | AA139606 |
| 2385 | aactgtcactcaagaaggttgatga | X16995 | 44989 | ttggaccaggcacctcaggaaccca | D45858 | 87593 | tccaggatgacaacaccttcct | AA139606 |
| 2386 | tgtattctcggattaataagg | X16995 | 44990 | tcctgccgactgtgaactcatct | D45858 | 87594 | attgatcctcagtgccggaagg | AA139606 |
| 2387 | cttctgcaccatgccttagg | X16995 | 44991 | tgtgaactcatctcctgagccat | D45858 | 87595 | ttccagtccggaaggtggcttta | AA139606 |
| 2388 | ctgtcaccaccatgcctttag | X16995 | 44992 | ctcatctctcgaagccataatgtc | D45858 | 87596 | aaggtggcttaccatccgcaatg | AA139606 |
| 2389 | cagcctggttttgagctaagactga | X16995 | 44993 | tcctgaagccataatgtccgagcg | D45858 | 87597 | gtggctttaccatcgcaatgtct | AA139606 |
| 2390 | agactgacgtaacctccactccag | X16995 | 44994 | aagccataatgtgcactgtgtaga | AA021930 | 87598 | cttacatctgaatgtctccatca | AA139606 |
| 2391 | ctcctccgaagatgataaga | X16995 | 44995 | tccgagccatctgcatcgaggagtt | AA021930 | 87599 | accatcgcaatgctccatcacct | AA139606 |
| 2392 | tattgtctatcctccagctcag | X16995 | 44996 | ggccccgctcctgtttcagggttgg | AA021930 | 87600 | atctcaagtctccatcacctgt | AA139606 |
| 2393 | agctcagtcctggcctctgtgt | X16995 | 44997 | aactgccccaaagcaatgaagaggc | AA021930 | 87601 | gtctccatcacctgtcaaaaga | AA139606 |
| 2394 | tcgatcctggcctctcgtgttttt | X16995 | 44998 | aggctgtagtgactgtgtgaaga | AA021930 | 87602 | agatgccccaactgcaggaaaatg | AA139606 |
| 2395 | agcagtcactcaacctggccaatca | M34381 | 44999 | tccgagccatcctcactcggggag | AA021930 | 87603 | atggccccaactgcaggaaatggaa | AA139606 |
| 2396 | ctcacactgccaatcagttgggct | M34381 | 45000 | gcagccaactgaggatcacaatg | AA021930 | 87604 | tccatggactcctcgctagtgg | AA139606 |
| 2397 | cactgctggctctccatgcat | M34381 | 45001 | gatatcaatgctgcagctgacca | AA021930 | 87605 | catgaactcctctgctagtgggct | AA139606 |
| 2398 | ggcctctggctccatgccattcaaactga | M34381 | 45002 | aggctgcctgctctctagtgact | AA021930 | 87606 | ttgtgctgctctcataacca | AA139606 |
| 2399 | ctctccagtctctaagactccatagagga | M34381 | 45003 | ctgcctctcttagtgacttgc | AA021930 | 87607 | tgtgctctcctcataaccaagacta | AA139606 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 2400 | M34381 | tcccatgcattcaaactgaggcacc | 45004 | M34381 | ttctagttgacttgcacctgtctt | 87608 | AA139606 |
| 2401 | M34381 | gcattcaaactgaggcaccagccct | 45005 | M34381 | tagttgacttgcacctgtctcag | 87609 | AA139606 |
| 2402 | M34381 | tcctggggalgctgrggccaagg | 45006 | M34381 | actttgcaccigtcttcaggctgcc | 87610 | AA139606 |
| 2403 | M34381 | tcaggagcctggcctgtcgtcact | 45007 | M34381 | cacctgtctcaggctgccaggga | 87611 | AA139606 |
| 2404 | M34381 | gcctgtccctgtcgtcactcatcat | 45008 | M34381 | agaagccagcaggcaccacttct | 87612 | AA107510 |
| 2405 | M34381 | cctgtcgtcactcatcatttgt | 45009 | M34381 | ttcccagatccgtcttccattg | 87613 | AA107510 |
| 2406 | M34381 | tgtcactcatcatttgtcttaaa | 45010 | M34381 | cccagatcctgtcttccattgagc | 87614 | AA107510 |
| 2407 | M34381 | acatcagcttgggctgggctagca | 45011 | M34381 | ctgtctccagttgagctgccaac | 87615 | AA107510 |
| 2408 | M34381 | ccaatcagttgggctagagaagga | 45012 | M34381 | tcttccattgagctgctccaacat | 87616 | AA107510 |
| 2409 | M34381 | atcagttgggctagagaagagtt | 45013 | M34381 | tccattgagctgctccaacactctc | 87617 | AA107510 |
| 2410 | M34381 | ttgagatccacgaagaagagta | 45014 | M34381 | ctacgaagatcaaccggacgcgtt | 87618 | AA107510 |
| 2411 | M34381 | attccaaccgagaagaagatagaggc | 45015 | M34381 | atcaaccggagcgttccagccat | 87619 | AA107510 |
| 2412 | M34381 | tggcaccccaggcctatggaagccc | 45016 | M34381 | gcttccggccatcctgcatcgg | 87620 | AA107510 |
| 2413 | M34381 | acttactagtccctttcctag | 45017 | M34381 | tgtatctataggtctttttgatggg | 87621 | AA107510 |
| 2414 | M34381 | cgtcactgctcggggctcccatg | 45018 | M34381 | atctataggtcttttgaggctg | 87622 | AA107510 |
| 2415 | M34381 | tattcacttttcagacatgataca | 45019 | J03733 | aacacattatgtgttgggaagagg | 87623 | AA107510 |
| 2416 | M34381 | tcagctgtgaagcagtcgttgtag | 45020 | J03733 | cacacattatgtgttgggaagagga | 87624 | AA107510 |
| 2417 | M34381 | cacttctaggagacatctgaag | 45021 | J03733 | acacttatgtgttggggaaggaat | 87625 | AA107510 |
| 2418 | M34381 | tctgaagtcctgcctgcagaaacc | 45022 | J03733 | agttatttacatagtcctgaagag | 87626 | AA107510 |
| 2419 | M34381 | gtcctgcctgcagaaacctgact | 45023 | J03733 | gttattttacatagtcctgaagagc | 87627 | AA107510 |
| 2420 | M34381 | gcctcagaaacctgactgttccc | 45024 | J03733 | ttatttacaatgtctgaagagt | 87628 | AA107510 |
| 2421 | M34381 | tgttcctcaacctgtgactccat | 45025 | J03733 | attttacatagtcctgaagagctaa | 87629 | AA107510 |
| 2422 | M34381 | ctcaacctgtgactccaattgcatc | 45026 | J03733 | ttttacatagtcctgaagagctaaa | 87630 | AA107510 |
| 2423 | M34381 | ttgcacacactagtaacagttg | 45027 | J03733 | tacatagtcctgaagagctaaagac | 87631 | AA107510 |
| 2424 | M34381 | atcatacaactggtcaactt | 45028 | J03733 | acatagtcctgaagagctaaagaca | 87632 | AA107510 |
| 2425 | M34381 | caaacacggcagtcaactcctgta | 45029 | J03733 | tctataggtcttttgatgggctga | 87633 | AA107510 |
| 2426 | M34381 | cggcagtcaactcctgtaataat | 45030 | J03733 | tcttttgatgggctgaacatagaa | 87634 | AA107515 |
| 2427 | M34381 | ttaggttgcccatggaaaat | 45031 | J03733 | atagaagcaaacacacattatgtgtt | 87635 | AA107515 |
| 2428 | M34381 | ccaacatcgcacagtctgctgtgt | 45032 | J03733 | tagaagcaaacacacacttatgttg | 87636 | AA107515 |
| 2429 | M34381 | cagtctgtgtgtgcaggaagaacc | 45033 | J03733 | gaagcaaacacacattatgtgttgga | 87637 | AA107515 |
| 2430 | M34381 | agaaccacggcctggatctga | 45034 | J03733 | aagcaaacacacattatgtgtgggaa | 87638 | AA107515 |
| 2431 | M34381 | cagcatcagtctgctagccatcc | 45035 | J03733 | agcaaacacacttatgtgtggggaa | 87639 | AA107515 |
| 2432 | M34381 | tttgttgcccagagtctgtgtga | 45036 | J03733 | caaacacacttatgtgtgggaaga | 87640 | AA107515 |
| 2433 | M34381 | gtcaactgcctaggaccggttggc | 45037 | J03733 | attatgacatacaaactgactg | 87641 | AA107515 |
| 2434 | M34381 | catggccactccagagagaccat | 45038 | J03733 | atgacatacaaaactgactgctcc | 87642 | AA107515 |
| 2435 | M34381 | ccagtgagctccgattctgcta | 45039 | J03733 | actgtcctagcattgaacattgc | 87643 | AA107515 |
| 2436 | M63850 | tggattctgtgtgaccagcacactc | 45040 | M63850 | cttgctcctagcattgaacattgc | 87644 | AA107515 |
| 2437 | M63850 | tgacctctgctcctatgccctct | 45041 | M63850 | ttgctcctagcattgaacattgta | 87645 | AA107515 |
| 2438 | M63850 | ttctatgcctctatcctcatag | 45042 | M63850 | tgtcctagcattgaacattgctaa | 87646 | AA107515 |
| 2439 | M63850 | tatcctatcatagataacattccc | 45043 | M63850 | gctcctagcattgaacattgctaaa | 87647 | AA107515 |
| 2440 | M63850 | atcatagtaaatcttccagagcc | 45044 | M63850 | ctcctagcattgaacattgctctag | 87648 | AA107515 |
| 2441 | M63850 | ctcactcattccaactattcctg | 45045 | M63850 | tcctagcattgaacattgctaaaaa | 87649 | AA107515 |
| 2442 | M63850 | tcattccactattcctgaaata | 45046 | M63850 | tgacatacaaaactgactgctcct | 87650 | AA107515 |
| 2443 | M63850 | ttctgaaaatatccccgagaga | 45047 | M63850 | acatacaaaactgactgctcctag | 87651 | AA107515 |
| 2444 | M63850 | aatgaaattccagcctgactttct | 45048 | M63850 | catacaaaaactgactgctcctagc | 87652 | AA107515 |
| 2445 | M63850 | gccttgatttctcctgtgacctg | 45049 | M63850 | atacaaaactgactgctctaaaa | 87653 | AA107515 |
| 2446 | M63850 | acttttctgtgcacctgatggga | 45050 | M63850 | tacactacaaaactgactgctctaga | 87654 | AA107515 |
| 2447 | M63850 | caccatcctgaatgccagttgcat | 45051 | M63850 | aaactgactgctcctagcatgaa | 87655 | U41568 |
| 2448 | M63850 | aatgcaagtcccagggggaaag | 45052 | M63850 | actgactgtctcctagcatgaac | 87656 | U41568 |
| 2449 | M63850 | tatctggaccagtcctcattc | 45053 | M63850 | actgactgtctcctagcatgaaca | 87657 | U41568 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2450 | gaccagttccttcatttcaggtgg | M63850 | 45054 | ttcacgagcagttgtcacttacga | X83930 | 87658 | gtaaaatccctcgtctccatactg | U41568 |
| 2451 | ttccttcatttcaggtgggactct | M63850 | 45055 | acaccacagtcatgatgtcagt | X83930 | 87659 | atccctgtccatactggcttct | U41568 |
| 2452 | ggacttctgatccaggaagacaaa | M63850 | 45056 | tgagcaccaattcctccgactctga | X83930 | 87660 | ctgtccatacggcttcttgtgaa | U41568 |
| 2453 | agctcctcagtgcagctgtgtataa | M63850 | 45057 | cctcgactcgacatcgattatga | X83930 | 87661 | gcaaacaaatcactattctgtata | U41568 |
| 2454 | gctcctcgactctggcctctatg | M63850 | 45058 | attatgactcctcaacgactggg | X83930 | 87662 | aaatcactatttcgtatatctcta | U41568 |
| 2455 | agtcaggcaacagttcctcctgccg | M29395 | 45059 | acggctcagatcccaccaggagaact | X83930 | 87663 | ctattctgtatatctcaagagtg | U41568 |
| 2456 | cttgcgcctctgatccaagaag | M29395 | 45060 | cagatcccaaggaggaactcatcat | X83930 | 87664 | ttactgagcacatccgatgatgca | U41568 |
| 2457 | tgcctccactagtgatcgaccg | M29395 | 45061 | aggaactcatcatcctaggggttctgg | X83930 | 87665 | agcaacatccggatgatgcagaagaga | U41568 |
| 2458 | tgtgatctgaccgctcttaacca | M29395 | 45062 | ccaacctcattgcaacctgatcag | X83930 | 87666 | agtaccagatcagatccgctgaact | U41568 |
| 2459 | ctgaccgctcttaacacatagacc | M29395 | 45063 | caacctgatcagaacaccggacact | X83930 | 87667 | agatcagatccgtgaactgaacag | U41568 |
| 2460 | gctcttttaacacatagacctagcc | M29395 | 45064 | ccctgatttccaaggagtgacacca | X83930 | 87668 | gatccgtgaactgaacagtgccct | U41568 |
| 2461 | taacacatagacctagccgtgtcc | M29395 | 45065 | tttccaaggagtgacccagactct | X83930 | 87669 | ctgaactgaacagtgcccttttcct | U41568 |
| 2462 | cttagccgtgtcatgcaagtgga | M29395 | 45066 | tgtcagtgcttaatctgtcgcgga | X83930 | 87670 | gtgcccttttcctgctgagattcat | U41568 |
| 2463 | accagttgccccctgggtccgcatg | M29395 | 45067 | attctgtcgcggtggctcccactaa | X83930 | 87671 | tcgtcactgaactctttttcaggcc | U41568 |
| 2464 | tgtggtccgcatgcttactgagcaa | M29395 | 45068 | agatggccaccatgcatgacgtgaa | X83930 | 87672 | tttgaactgaggcccctggcggtg | U41741 |
| 2465 | ccgcatgcttactgagcaaagacc | M29395 | 45069 | ccacatgatcgacgtgaagaaaga | X83930 | 87673 | gccctggcgttgccagtcgtcagt | U41741 |
| 2466 | cctccacatcactgtacct | M29395 | 45070 | cacagacaactgcacatctcag | X83930 | 87674 | tacctggctgctgggaagcaggc | U41741 |
| 2467 | cccactgtcattgtgtgttctaa | M29395 | 45071 | tgcacatctacggctacgagggcgc | X83930 | 87675 | ctgagtactctggggagcaggctta | U41741 |
| 2468 | acatcatcagtgtgtacttaagtt | M29395 | 45072 | tctacggctacgagggcgcgagtc | X83930 | 87676 | agtactctggggagcaggcttactc | U41741 |
| 2469 | ttgctaataactggggggtcatag | M29395 | 45073 | gttccctgagccaccaatttcctccga | X83930 | 87677 | gctagctgcgtatcccagagagt | U41741 |
| 2470 | aaagcaactgtctctcttatgtagg | M29395 | 45074 | ctgggcatgctcagctggacataca | X83930 | 87678 | agctggctcatccaggagtaga | U41741 |
| 2471 | acgttcctctatgtaggatcagc | M29395 | 45075 | tgggactgtcagctggacatacag | X83930 | 87679 | tggctgtatcccagagtagaagg | U41741 |
| 2472 | catctgtaactccaattccaggga | M29395 | 45076 | gctgactccctacattatgcagc | X83930 | 87680 | gaggccctacagaaggctcggag | U41741 |
| 2473 | taactccaattccaggatccagt | M29395 | 45077 | ctgtactccctacattatgcagct | X83930 | 87681 | gccctacagaaggctcgagcca | U41741 |
| 2474 | agacagtctttgccagtcagatccagt | M29395 | 45078 | tgtactccctacattatgcagct | X83930 | 87682 | cctacagaaggctctggagccagg | U41741 |
| 2475 | tctttgccagtcgtaagaggaaaa | M29395 | 45079 | gtactccattacattatgcagctc | X83930 | 87683 | ggctctggagccaggagaactgta | U41741 |
| 2476 | gcaacaacagcagtaccatatc | M29395 | 45080 | tactccattacattatgcagcttcg | X83930 | 87684 | ccttgcacactgctctgctgctct | U41741 |
| 2477 | gcagtaccatatcgcacagcaacag | M16362 | 45081 | tccattacattatgcagctcgaaa | AA022148 | 87685 | tgcatgctgtcctctgctggaa | U41741 |
| 2478 | tcaacaacagctctaataccag | M16362 | 45082 | ccctacattatgcagctctaatacaca | AA022148 | 87686 | atgtcgtctccttgcgaaacac | U41741 |
| 2479 | acagctctaataccagcacag | M16362 | 45083 | ccttacattatgcagctcgaaaaa | AA022148 | 87687 | ttcctgtcggaacactgaccacac | U41741 |
| 2480 | caccaacatattggacgctactga | M16362 | 45084 | ttacattatgcagctcgaaaaca | AA022148 | 87688 | gtcgcggcctagtactccactg | U41741 |
| 2481 | catattggacgctactgagtcact | M16362 | 45085 | gatcctgagctgctggaagc | AA022148 | 87689 | ggctcctcctttcctggagcagaa | U41741 |
| 2482 | tggaGctactgagtcacttggagg | M16362 | 45086 | gggcatgctcagctggacatacaga | AA022148 | 87690 | tctccttctcggagcagaagtt | U41741 |
| 2483 | ctactgagtcacttggaggaactgc | M16362 | 45087 | ggcatgctcagctggacatatacaga | AA022148 | 87691 | tccttctctggagcagaagttaag | U41741 |
| 2484 | cttgtacactgagtgggccagcc | M16362 | 45088 | catgctcagctggacatacagaaat | AA022148 | 87692 | tggtcctactaggcagtccagttt | U41741 |
| 2485 | cccagcttcttgcttaatccccagt | M16362 | 45089 | atgctcagctggacatacagaaatt | AA022148 | 87693 | gagtccagttctgctgtcat | U41741 |
| 2486 | cctttcctaggcgagctcagtgact | M16362 | 45090 | aaatggctgtactccctacattat | AA022148 | 87694 | tttccttactgtcactccagatta | U41741 |
| 2487 | tcctaggcgagctcggacagatggtt | M16362 | 45091 | aatggctgtactccctacattatgca | AA022148 | 87695 | acagataaccctgaaggccgatgc | U73029 |
| 2488 | ccatatccgaagcaaccagcagag | M16362 | 45092 | tggctgtactccctacattatgca | AA022148 | 87696 | aaacctgaaggcagatgctgaatc | U73029 |
| 2489 | gatgctacggcaaacagcagcaaca | M16362 | 45093 | ggctgtactccctacattatgcag | AA022148 | 87697 | tcctccacagttctcagttgat | U73029 |
| 2490 | cagcaggcagagaggcagcagtcct | M16362 | 45094 | tctgaagtccatatgtcagatat | AA022148 | 87698 | ccacagttcagtttgtagttcat | U73029 |
| 2491 | gagcagcaaacgccccagcttg | M16362 | 45095 | agattatcacgtaacactgcatga | AA022148 | 87699 | ttccagttgtatgtcatgtagca | U73029 |
| 2492 | gcaacagcccgcagtttcgttgtccg | M16362 | 45096 | tcaaaagctgttttgccaacctgc | AA022148 | 87700 | ttgctccactatgtctgctg | U73029 |
| 2493 | gcccgcagcttggcgccaactt | M16362 | 45097 | gctgtttgccaactgccgcaggcac | AA022148 | 87701 | tatgttctgctgactgccaa | U73029 |
| 2494 | ggtcggcaacttcacacaacagtc | M16362 | 45098 | tttgccaacctgcaggcacggtccg | AA022148 | 87702 | ctgttgacctgcactgccaacttga | U73029 |
| 2495 | gccaactctcaacaacagctctaat | M16362 | 45099 | aacctgcaggcacggtcagggaat | AA022149 | 87703 | gactgactgccaactggaaagtca | U73029 |
| 2496 | tgaatatctcgatgctgagcagctgtg | M16362 | 45100 | cgaataggatgcgttgggaagtt | AA022149 | 87704 | cttgcatcttttcggaatgctggg | U73029 |
| 2497 | atatctcgatgctgagcagctgggcag | W47892 | 45101 | tctgtcattgcaatatcactagcag | AA022149 | 87705 | tatgttcttaactactcatgagaactg | U73029 |
| 2498 | gatttctctcactaaagggcagagga | W47892 | 45102 | attgacttgactactgccagctgtttat | AA022149 | 87706 | gaggacactacagcagcagatctt | U73029 |
| 2499 | agccaaattcttctgctttctag | W47892 | 45103 | atatcactagcagcttataagcca | AA022149 | 87707 | acactactgcagatctccttctg | U73029 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2500 | ccaaattattctgtcttctagtat | W47892 | 45104 | gctttataagccactaggctgtct | AA022149 | 87708 | ggatctctctgtcatattcagta | U73029 |
| 2501 | tttccagaatactacagctctctg | W47892 | 45105 | taagccactagcgtgttccgcag | AA022149 | 87709 | tctcttgcatatcagtaagcttt | U73029 |
| 2502 | tccagaatacagctctttgcat | W47892 | 45106 | tcacgtaacaactgcatgataagtg | AA022149 | 87710 | gtagataccaagtcccagggctc | U73029 |
| 2503 | cagaatacagctctgcatgac | W47892 | 45107 | tccttatagcttcttcactcgcg | AA022149 | 87711 | ctaagttcccaatgctcccattca | U73029 |
| 2504 | actacagctcttgcatgacaacctg | W47892 | 45108 | tagctttcactcagcgtatcca | AA022149 | 87712 | cagctgtcttctccgcctcatt | U73029 |
| 2505 | acagctcctgcatgacaacctgaag | W47892 | 45109 | tcttcactcagcgtatccagtctg | AA022149 | 87713 | tgaatctctgaccgttcagaaga | AA107591 |
| 2506 | gctctgtcatgacaacctgaagtct | W47892 | 45110 | ctcagcgtatccagtctgcaattg | AA022149 | 87714 | gaatcctgacctgttcagaaggaa | AA107591 |
| 2507 | cttgcatgacaacctgaagtctctc | W47892 | 45111 | gtatccagtctgcaattgcatcat | AA022149 | 87715 | tgcctaagggcaactaagggatct | AA107591 |
| 2508 | agcagctgggcagtatgcggaacag | W47892 | 45112 | agtctgcaattgcatcatcaaaag | AA022149 | 87716 | ggcacctaagggatctgtgcatta | AA107591 |
| 2509 | gcatgacaacctgaagtctctcctg | W47892 | 45113 | gcatcatcaaaagctgctttgcca | AA022149 | 87717 | atcttgcatatctttaacgagt | AA107591 |
| 2510 | ttgsggacaggaccatccaggaggc | W47892 | 45114 | cgtgtcgcccagaatgtgactc | AA022149 | 87718 | tgtgcatatatcttaacgagttta | AA107591 |
| 2511 | cggcaggaccaccagaggctga | W47892 | 45115 | caattacctgccagctgatccgc | AA022149 | 87719 | cgagtttagccacactctaaag | AA107591 |
| 2512 | acaggaccaccaggaggctgacca | W47892 | 45116 | aaggtcatctgctcaggggcaag | AA022149 | 87720 | gagtttagccacactctaaagg | AA107591 |
| 2513 | ccatccaggaggctgaccaagatgg | W47892 | 45117 | atctgctgcagggcaagtggat | AA022149 | 87721 | tttagccacactctaaagggtg | AA107591 |
| 2514 | gtgccatatttacagaattcgt | W47892 | 45118 | atccggatcctggtagatgatggatgg | AA022149 | 87722 | tctgcccgtgtgaagtccccttc | AA107591 |
| 2515 | gcatccgatttcttcactaagggc | W47892 | 45119 | atccggtagatgatggccctct | AA022149 | 87723 | agactcgttcaaacaccagtga | AA107591 |
| 2516 | tccgatttcactaaggcgaa | W47892 | 45120 | ttcgctccgcctctagtaatctaa | AA022149 | 87724 | gactcgttcaaacacctagtgat | AA107591 |
| 2517 | atgcatcatctaccggaccctat | W47892 | 45121 | caggcctctagtaatctaagggtca | AA022149 | 87725 | atctctgacctgttcagaagaag | AA107591 |
| 2518 | tgcatcatctaccggaccctatc | W47863 | 45122 | gcaagcccgaacatctatgcagcat | L39373 | 87726 | actcgttcaaacacctcagtgatt | AA107591 |
| 2519 | cgagagtcgctcatcggcgtaaat | W47863 | 45123 | ccggacatctatgcagcattgt | L39373 | 87727 | aaatctaccggagaatgcctgc | AA107591 |
| 2520 | acgagtcgctcatcggcgtaaatgc | W47863 | 45124 | atctatcagcattgtgtcccag | L39373 | 87728 | atctacctggagaatgcctgct | AA107591 |
| 2521 | cgagtcgctcgcgtaaatgct | W47863 | 45125 | gcagcatttgtgtcccagagtgc | L39373 | 87729 | tctacctggagaatgcctgccta | AA107591 |
| 2522 | gagtcgctcatcggcgtaaatgtca | W47863 | 45126 | tgcggacccgagtgaacacatgtat | L39373 | 87730 | ctacctggagaagccttgcctaa | AA107591 |
| 2523 | gtcgctcatcggcgtaaatgctacc | W47863 | 45127 | cagcatttgtccaggagtgcc | L39373 | 87731 | gaggaatgcctgccaaggggaac | AA107591 |
| 2524 | cgctcatcggcgtaaatgctacc | W47863 | 45128 | tgaacacatgatgctctaaatac | L39373 | 87732 | gaatgcctgccaagggcaccta | AA107591 |
| 2525 | ctcatcggcgtaaatgctaccggcg | W47863 | 45129 | catgtactctaaatacctgctc | L39373 | 87733 | atgcctgcctaagggcaacctaag | AA107591 |
| 2526 | gtaaatgctaccggcgaaggtgtcg | W47863 | 45130 | ctatgaccagttccgctactgctg | L39373 | 87734 | gcttaccccacaagtgtgtcgaag | AA107591 |
| 2527 | taaatgctaccggcgaaggtgtcg | W47863 | 45131 | ccagttccgctactgctggaaaat | L39373 | 87735 | ctaaagctgctgacgaggtccg | AA107591 |
| 2528 | atgctaccggcgaagggtcggacg | W47863 | 45132 | tccctaccgggagcccaagacact | L39373 | 87736 | tctacctctacgatgagcagcc | AA107591 |
| 2529 | acgagtcgctcatcggcgtaaatgc | W47863 | 45133 | gcgccagaaccaaggctcagatgga | L39373 | 87737 | gtcagccatagcctgtcctggg | AA107591 |
| 2530 | atcatctaccggaccctcatcacg | W47863 | 45134 | gaaccaggctcagatgaaggtca | L39373 | 87738 | ctgttcctgggtagcctgcatc | AA107591 |
| 2531 | atctaccggaccctcatcacgat | W47863 | 45135 | taattggctgcaaggagagatca | L39373 | 87739 | gtagcctgcatcgacagctgtat | AA107591 |
| 2532 | acccgggaccctcatcacgcgatga | W47869 | 45136 | atggagaaccttgcatgtatcgatcg | L36244 | 87740 | ctgcatcgacagtgtatcccc | AA107591 |
| 2533 | ccgggccatcgacgagtcgctcat | W47869 | 45137 | tgatgaacctacctatcaaagaga | L36244 | 87741 | ctgggtctactgcagcatctga | AA107591 |
| 2534 | cgggggccatcgacgagtcgctcatc | W47869 | 45138 | actactcagaagactctaggcttcc | L36244 | 87742 | tctactgcagcatctctgagcact | AA107591 |
| 2535 | ccatcgacgagtcgctcatcggcgt | W47869 | 45139 | acgacattcaggacattcaaagtt | L36244 | 87743 | gcagcatctcgagcaacctgaacag | AA107591 |
| 2536 | atcgacgagtcgctcatcggcgtaa | W47869 | 45140 | cattgcaccccctgtcatggtcgaa | L36244 | 87744 | ttgaactcgtgtcgtcgcagt | AA107591 |
| 2537 | atgagagtcgctcatgtgatgaat | W47869 | 45141 | atccctcagcctatggggcaaaag | L36244 | 87745 | tgctggcgagtcagtaagttggac | AA107591 |
| 2538 | agcccgactgttcgatgaact | W47869 | 45142 | gatcagcgatgcatgaacaagt | L36244 | 87746 | tgagctgcgagggctcagtaggaa | AA107591 |
| 2539 | gcccgactgttcgatgaactc | W47869 | 45143 | ccctctcctgttgctgataga | L36244 | 87747 | gtaaagcctgtggctcacacagtggg | AA107591 |
| 2540 | gtcataggctcttctcatgatccc | W47869 | 45144 | aggccatctcgaccggaatgatct | L36244 | 87748 | tcacaacgtcgtggaacctcctgat | D50060 |
| 2541 | cataggctctctcatgatgcccgtc | W47869 | 45145 | tgatctgactaatctcagtaaca | L36244 | 87749 | agctggaacctcctgcatcaccaa | D50060 |
| 2542 | ataggctctcctcatgatgcccgtc | W47869 | 45146 | tgactaatctcaggtaacatgaagt | L36244 | 87750 | cgtgcagaatgcgatgagacctt | D50060 |
| 2543 | gtcgttagcccgcactgttgtcg | W47869 | 45147 | acagctccccttgatgggccag | L36244 | 87751 | ccgatgagacctctgcgagatgt | D50060 |
| 2544 | tcgttagcccgcactgttgtcga | W47869 | 45148 | ggaacactctaggctcatgccttgc | L36244 | 87752 | tgaagtcaatcggctcgagaagcg | D50060 |
| 2545 | agcccgcactgttgcgatgaact | W47869 | 45149 | gagtgaactctcgtttgctgcac | L36244 | 87753 | tcttcatccagttgctgccgcac | D50060 |
| 2546 | gcccgcactgttgctgatgaactc | W47869 | 45150 | actcctgtttgctgccaccatga | L36244 | 87754 | aatcagtagccctgagcattaac | D50060 |
| 2547 | ccgcactgttgctgatgaactcc | W47869 | 45151 | tgtttgctgccaccatgaatttg | L36244 | 87755 | tagccctgagccattaacagcagt | U68058 |
| 2548 | cgcactgttgctgatgaactcca | W47869 | 45152 | aattttgccactctcgggctgag | L36244 | 87756 | gctcctctaaatcaaaccatttg | U68058 |
| 2549 | tgaatcagccgcctgctgtctact | W47869 | 45153 | gccactctgggtgagtcactc | L36244 | 87757 | tcctctaaatcaaaccattgtg | U68058 |

| SEQ ID NO | sequence | DBAxnID | SEQ ID NO | sequence | DBAxnID | SEQ ID NO | sequence | DBAxnID |
|---|---|---|---|---|---|---|---|---|
| 2550 | cgcctlgcggtctcactggtgatca | W47869 | | cttcgttccggtactgtgatgta | L36244 | 87758 | catgatgtgcaccagggtgttatt | U68058 |
| 2551 | gcctlgcggtctcactggtgatcat | W47869 | 45154 | tctaactcagatgactgctcccga | X80937 | 87759 | gcatgtgcaccagggtgttatttaa | U68058 |
| 2552 | tggacagctcataggtcttctcatg | W47869 | 45155 | gactgctcccgatctgggaggt | X80937 | 87760 | tttaagctcattgcacattcaagttg | U68058 |
| 2553 | ggacagctcataggtcttctcatga | W47869 | 45156 | ttgtgactgtgccattattga | X80937 | 87761 | ctaggctcattggcctagacattat | U68058 |
| 2554 | gacagctcataggtcttctcatgt | W47869 | 45157 | atgtacaaagcctgtcgcatcc | X80937 | 87762 | ggctcattggcctagacattatgat | U68058 |
| 2555 | cagctcataggtcttctcatgatgc | W47869 | 45158 | ctlgctgactccgtccggtgtaca | X80937 | 87763 | tcattgctagacattatgatttg | U68058 |
| 2556 | agctcataggtcttctcatgatgcc | W47869 | 45159 | gcatccgtccggtgtacaacatcc | X80937 | 87764 | tttaagctccatcaagatgctaa | U68058 |
| 2557 | cctgtagtcccaagggtcacctg | W47869 | 45160 | atatttgctggcaatatgaagaat | X80937 | 87765 | gctccatcaagatgctcaataaag | U68058 |
| 2558 | gccaggtcccaagggtcacctgg | W47869 | 45161 | tttcattacaaatgtctgatgtg | X80937 | 87766 | ccctgggccataaacagcagtgt | U68058 |
| 2559 | tcccagactacacaggccacggct | M55171 | 45162 | tacaaatgtctgatgtgtgttaac | X80937 | 87767 | cattaacgcagtgtctcttctggca | U68058 |
| 2560 | acaggccacggctctgagcgaaag | M55171 | 45163 | tgtctgatgttggttaactaatt | X80937 | 87768 | taacagcagtgtctcttctggcaagt | U68058 |
| 2561 | gtgagagaccttagctgggtggag | M55171 | 45164 | ctaattttgccaggaccatattg | X80937 | 87769 | tattccacgagcattagagatgaact | U68058 |
| 2562 | ttaccctgaagaacattgagggt | M55171 | 45165 | ttgccaggaccatattgatcaag | X80937 | 87770 | taactagacatcgtgttatctct | U68058 |
| 2563 | tgaccccagatatataggggaataa | M55171 | 45166 | taggcagcagatctcactgctcaag | X80937 | 87771 | tgtatctctatagctctgctt | U68058 |
| 2564 | aaacaagtcaaacactactgata | M55171 | 45167 | gccagatctcactgtcaagtgagtg | X80937 | 87772 | ctctatagctctgcttcctctaaa | U68058 |
| 2565 | agtcaaacatctgataatcata | M55171 | 45168 | tctcactgtcaagtgagtggcccca | X80937 | 87773 | agctcgttccttctaaatcaaac | U68058 |
| 2566 | tttgcattctaatgaatggatcg | M55171 | 45169 | gtccctgtggctctgaagacaaat | X80937 | 87774 | cagtgccaggctgggcagtgcctc | U75839 |
| 2567 | ggatctgctgcttttcacaagga | M55171 | 45170 | tcccacactcaaagtgagcgacaa | X80937 | 87775 | ggagctgcttccagacagtgggcga | U75839 |
| 2568 | gcttgcttttcacaaggaataa | M55171 | 45171 | aagtgagcgacaaaccgcaggag | X80937 | 87776 | ccagccatgggtcaagaggtgtg | U75839 |
| 2569 | ctccaagcaagcctttgtggaa | M55171 | 45172 | tgttgcctctgccattgcactgt | X80937 | 87777 | tgttcctacatgttaaggagctg | U75839 |
| 2570 | atgatctgtgactgcaggtcgaa | M55171 | 45173 | gcactgttgctcctggccatt | X80937 | 87778 | ttcactgaaaacgcfggactgcac | U75839 |
| 2571 | gcaagcagcctttgtggaacataca | M55171 | 45174 | tattacccagaaagtgggagct | X80937 | 87779 | cgtggactgcacatctccaacagc | U75839 |
| 2572 | ctcagccaatcacagtcagacagg | M55171 | 45175 | ttaccccagaaagtgggggctgg | X80937 | 87780 | ctctgaccagtacaaggctactc | U75839 |
| 2573 | ctcagccaatcacagtcagacagg | M55171 | 45176 | atagagccaaaacgcggatcagctgg | X80937 | 87781 | ccaaggcctacctccaggactggtg | U75839 |
| 2574 | ggctgtcacccaataagagacac | M55171 | 45177 | agagccaaaacgcggatcagctgg | X80937 | 87782 | catgagctccaggctaggccagcaat | U75839 |
| 2575 | ctgggcccagaagaaacacagt | M55171 | 45178 | agccaaaacgcggatcagctggaa | X80937 | 87783 | cttccagccacgaaatactcga | U75839 |
| 2576 | acacagtgccagtccaggtaagt | M55171 | 45179 | aagtgttgcagagcccagcctga | X80937 | 87784 | actcagtcgtaccaataaagcagt | U75839 |
| 2577 | tgcagtcccaggtaagccctag | M55171 | 45180 | ttgcagaggccagcctgatcat | AA022172 | 87785 | cgtgtacccaataaagcagttatgc | U75839 |
| 2578 | agatttcccatgcgcagtctgtgc | AA125097 | 45181 | agaggcccagcctgatcata | AA022172 | 87786 | cctcagcccctgcctggccagtactg | U75839 |
| 2579 | gatttcccatgcgcagtctgtgc | AA125097 | 45183 | agaggcccagcctgatcattataga | AA022172 | 87787 | gccctgcggctagtctgatgcc | U75839 |
| 2580 | gcagtctgtgcttaccaaataat | AA125097 | 45184 | aggcccagcctgatcattataga | AA022172 | 87788 | agatctgatgccttcatggaagga | U75839 |
| 2581 | cagtctgtgcttaccaaataata | AA125097 | 45185 | ccaagaacagcagctggctt | AA022172 | 87789 | gatgccttcatggaaggaagtga | U75839 |
| 2582 | taatataacacattcctcagtcgt | AA125097 | 45186 | ccaagaacagcagctggctt | AA022172 | 87790 | tctgtggtcatgggggaaatg | U75839 |
| 2583 | atataacacattcctcagtcgtla | AA125097 | 45187 | ggatgatacagcaggacaggaa | AA022172 | 87791 | gtcatgcatgggggaaatgtggccc | U75839 |
| 2584 | tataacacattcctcagtcgttat | AA125097 | 45188 | atgacaccagacaggagacagg | AA022172 | 87792 | gtggccccaggaaccagccatggggtc | U75839 |
| 2585 | ataacacattcctcagtcgttata | AA125097 | 45189 | gacaccagacaggacaggagcaagc | AA022172 | 87793 | ccagaccagccatggcaagagg | U75839 |
| 2586 | acacattcctcagtcgttataaag | AA125097 | 45190 | caggaagcaaagccccctattgata | AA022172 | 87794 | aaatgtttcatgaaggtcaagc | AA107615 |
| 2587 | cacattcctcagtcgttataaagt | AA125097 | 45191 | ggaagcaaagccccctattgataga | AA022172 | 87795 | tgtttccagaaggtcaagccaaaa | AA107615 |
| 2588 | acctlgccatagtaacctccactg | AA125097 | 45192 | aagcaaagccccctattgatagagc | AA022172 | 87796 | cacattggcttacaaactggcaaa | AA107615 |
| 2589 | ttgccatagtaacctccactgcct | AA125097 | 45193 | ccaagcccccatagtagagca | AA022172 | 87797 | tttatgcttagaaggtctgtg | AA107615 |
| 2590 | atttccccatgcagtctgtgct | AA125097 | 45194 | attgatagccggatcag | AA022172 | 87798 | ttatgcttagaaggtctgtgct | AA107615 |
| 2591 | ttcccatgcgcagtctgttta | AA125097 | 45195 | actcctgctcctgttagcttta | AA022172 | 87799 | tgccttagaaggttctgtgctata | AA107615 |
| 2592 | ttcccatgcgcagtctgtttac | AA125097 | 45196 | gcacccagacgagctgataattc | U49739 | 87800 | aatccgctggctaaggagacaattcc | AA107615 |
| 2593 | tcccatgcgcagtctgtttacc | AA125097 | 45197 | gcttcacacaaatctaggaaatt | U49739 | 87801 | atccgctggctaaggagacaattccg | AA107615 |
| 2594 | ccatgcgcagtctgtttaccaa | AA125097 | 45198 | ttcaacaaatctatggaaattgat | U49739 | 87802 | ctcgtgccaccattggcttacaaa | AA107615 |
| 2595 | catgcgcagtctgtttaccaaa | AA125097 | 45199 | tgatttcctactaataattgaa | U49739 | 87803 | tctgaccacattggcttacaaact | AA107615 |
| 2596 | atgcagtctgttttaccaaaat | AA125097 | 45200 | gaggctgtcttactgcttagctta | U49739 | 87804 | tctgaccacattggcttacaacta | AA107615 |
| 2597 | cgcagtctgttgcttaccaaatag | AA125097 | 45201 | gctgcttactgcttagactacc | U49739 | 87805 | ctgaccacattggcttacaaactag | AA107615 |
| 2598 | aggcgctactcaggaaaagctga | W47969 | 45202 | ctgttagacttacccctctggt | U49739 | 87806 | tgaccacattggcttacaaactagg | AA107615 |
| 2599 | aagctcgtactctgctatccgtcc | W47969 | 45203 | cttaccctgttggctgcttgcatt | U49739 | 87807 | gaccacattggcttacaaactaggc | AA107615 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2600 | taacctcaggactgctgctagcct | W47969 | 45204 | accctgcgttggtcctgctgattgat | U49739 | 87808 | accacaatggcttacaaactaggca | AA107615 |
| 2601 | caggacatgctgctagccttcttgg | W47969 | 45205 | ctcgtggtccgtgattgatggc | U49739 | 87809 | ccacatggcttacaactaggcaa | AA107615 |
| 2602 | atgctgctagccttctgggactat | W47969 | 45206 | tggtcctgattgatggcagaggt | U49739 | 87810 | tcttcggcccgtcaatcatgaaga | U10440 |
| 2603 | ctagcctctggagctatttgccac | W47969 | 45207 | cccagacagagctgataatttctg | U49739 | 87811 | actctggaagcactgccgggatat | U10440 |
| 2604 | gcctctggagactattggcacgac | W47969 | 45208 | ctgataattctgtctgccacactg | U49739 | 87812 | aggaaaactctgaggaccgggattt | U10440 |
| 2605 | ggactatttggcacgactgcagaaa | W47969 | 45209 | cttgctctgcacactgaccaccta | U49739 | 87813 | actctgaggaccggcattgtgga | U10440 |
| 2606 | ctattggcacgactgcagaaagt | W47969 | 45210 | cacactgaccacctattgctgagt | U49739 | 87814 | accaaatgcctgactcgtcagacaa | U10440 |
| 2607 | ttggcacgactgcagaaatgttgc | W47969 | 45211 | atgtccagcgtccgtgattaacgag | U49739 | 87815 | actcgtgacaacatcaggctgggtt | U10440 |
| 2608 | cagtcaaaatcgtactacagaactg | W47969 | 45212 | ctgatttttggctgtttcacac | U49739 | 87816 | ggaaggacctgctgcagaagatc | U10440 |
| 2609 | aaatcgtactacagaactgatcatc | W47969 | 45213 | tattttggctgtttcacacaaa | U49739 | 87817 | acgctggcactgtggagcagagcgc | U10440 |
| 2610 | ctgtatccgtccgcccagaattag | W47969 | 45214 | ctgttccacaaaatctaggaa | U49739 | 87818 | tggacgagcgccaagaagccgg | U10440 |
| 2611 | ctatccgtccgtccagaattgtat | W47969 | 45215 | atgtccagccatgccatgaagaac | U49739 | 87819 | gccttgcccagacgtaaactagc | U10440 |
| 2612 | catgcctcagaaggactgatccacaga | W47969 | 45216 | catgcctgaagaacctgatccacaga | U49739 | 87820 | agatacactgcttatgaagca | U10440 |
| 2613 | agttcactcttgaggaacagga | W47969 | 45217 | tgtgtcaccaatgctgtgaccttc | U49739 | 87821 | atcacgcttatgaagcaagaag | U10440 |
| 2614 | atgacgaaatttctcctgtatgagag | W47969 | 45218 | taccaatgctgtgacctctcagtctt | U49739 | 87822 | agaagaactgccggatatggaaga | U10440 |
| 2615 | acgaatttctcctgtatgagagaac | W47969 | 45219 | tgctgacctcagtcttaatccc | U49739 | 87823 | aagcgagtcagccaagtgaatttt | U10440 |
| 2616 | gagcatttccaataacctcaggaca | W47969 | 45220 | gttgactccatccatctcaag | U49739 | 87824 | tcgacttcagaatcataagcccct | U10440 |
| 2617 | caataacctcaggacatgctgctag | W47969 | 45221 | tctcatcctcatctcaagggctcc | U49739 | 87825 | agccctgcgaggcaggatacgaatg | U10440 |
| 2618 | tgacctcatgaatcctcgcctctg | M84005 | 45222 | cctcatcttcaagggtctgagcc | U49739 | 87826 | gcagctgccgagttctactacag | U10440 |
| 2619 | gtggcttaggcaactcgtgattca | M84005 | 45223 | gggctcctgagcctttaacatgc | U49739 | 87827 | ccccaagagcgcctgcaaggtgct | U10440 |
| 2620 | ttgctcaggcaggtgatgaagatccg | M84005 | 45224 | ggctacactttcagtcaggat | U49739 | 87828 | agagcgctgcaagtgcggcgca | U10440 |
| 2621 | tagtgttcctctatggctctcgc | M84005 | 45225 | actttcatggctcaggattcatct | U49739 | 87829 | tgccttaattggtctcaggcaa | U10440 |
| 2622 | ttcctctatggctctcgatcta | M84005 | 45226 | catggctcaggattcatctgaaggg | X91824 | 87830 | cagctactcagttcttcttcagtcc | X91824 |
| 2623 | gctctcgatctaggtgtatctgct | M84005 | 45227 | tgaagacctgatcaccagatgctga | X91824 | 87831 | tgatgcctttcgtcttctcaaccgca | X91824 |
| 2624 | atgggtatctctccagctaagag | M84005 | 45228 | caccagatcgaggcgctgtcta | X91824 | 87832 | tatatctggacccatgaagcttcatc | X91824 |
| 2625 | atctgctcccagctaagagcagtaa | M84005 | 45229 | atgctgaggctgtctatctgcttga | X91824 | 87833 | atgaagctcatccgcctttaggag | X91824 |
| 2626 | tctactctggtcacaccatggt | M84005 | 45230 | aggctgaggctgtctatcctgcttatga | X91824 | 87834 | gttatacgctagctcgagggcaa | X91824 |
| 2627 | tccagataagcgtcatccgtgtcc | M84005 | 45231 | ctgctatccgtctcaaggtgaatcc | X91824 | 87835 | cagctgtagctcgaggcaacagaga | X91824 |
| 2628 | tcacaccaggtgaatccgtccat | M84005 | 45232 | atccgcttaagtccatggtt | X91824 | 87836 | acagactacaacattgctgcaca | X91824 |
| 2629 | cgctcactatactctaagaacaa | M84005 | 45233 | ctatgagtccatgcctggct | X91824 | 87837 | actacaacattgctgcacagagcc | X91824 |
| 2630 | taggcaactccgtgattcagtcaac | M84005 | 45234 | agtccatgcctgtgctaccaat | X91824 | 87838 | acattcgtcacaagcgcagagag | X91824 |
| 2631 | ctccagctccattgtcggaca | M84005 | 45235 | acctccgagccatgcgctcacaa | X91824 | 87839 | cagacccaatatcctggccagagac | X91824 |
| 2632 | taccgccatgattaaattggcctg | M84005 | 45236 | tgagccatgctcacaagtcaag | X91825 | 87840 | ccaatacttctggcacggaaggag | X91825 |
| 2633 | acacaagtccaatgaggcggtgct | W48442 | 45237 | tccaatactagcccaacagaagaca | X91825 | 87841 | tccttgccaggatctggaaggatg | X91825 |
| 2634 | ctgtggccaagaaggtcatcct | W48442 | 45238 | gatgctgagcctcaattgcattct | X91825 | 87842 | gtctaaccgccaattgtcagtct | X91825 |
| 2635 | tccagataagcgtcatccgtctc | W48442 | 45239 | gctgagcctcaattgtcatccgtt | X91825 | 87843 | ccgccaattgtcagtctcatgt | X91825 |
| 2636 | taaggtcatcctcggtctcttactg | W48442 | 45240 | cctcaattgcattcgttggggaata | X91825 | 87844 | aatttgcagtcattcgttgccaat | X91825 |
| 2637 | tcatcctggtctcttactgcttcat | W48442 | 45241 | atactatgcccctaatatcacagtcc | X91825 | 87845 | gtctcagtggcacggtcatggtgca | X91825 |
| 2638 | gcctattgtctcaactactggcgag | W48442 | 45242 | ctatgcctcaaatacacagtcccac | X91825 | 87846 | atgactgagggcttttccgctctg | X91825 |
| 2639 | tttgctccaactactggcaggcac | W48442 | 45243 | ccctaaatacacagtccccactc | X91825 | 87847 | gctcttgtgcaggtctgcactga | X91825 |
| 2640 | gtcctgacagctcctagctcacact | W48442 | 45244 | aatatcacagtcccactctcatt | X91825 | 87848 | tcactgacacagtgaaatttgt | X91825 |
| 2641 | gagccaggttcatcctgtcgtcc | W48442 | 45245 | ttaatcctataattgtgggtcct | X91825 | 87849 | ccaaccagctgtataactgtga | X91825 |
| 2642 | agccaggttcattgcttgttgcta | W48442 | 45246 | atccattaatgttgtgggtctcggg | X91825 | 87850 | cctgctcgattactccttactacaga | AA107705 |
| 2643 | gccccaggtcattgctcgttgcgac | W48442 | 45247 | atggtctcaagtcaagaacacacc | X91825 | 87851 | tgattacttcctacaggaacatgg | AA107705 |
| 2644 | ccccaggtcattgcttgttctacg | W48442 | 45248 | tgttgggctctggtctagaattc | X91825 | 87852 | gctcttgtcaggtctgctacctatt | AA107705 |
| 2645 | caggtcattcgttgctgctacgtg | W48442 | 45249 | ctctacaagtcaagaacccctgtgac | X91825 | 87853 | tcaaggacaggcaacaggaaacat | AA107705 |
| 2646 | aggttcattcgttggctacgtgg | W48442 | 45250 | acagtcaagacaccctgtgacac | X91825 | 87854 | ggaacatccttggacgcagaagg | AA107705 |
| 2647 | tgcgctatgacacgcgatgtgggagaa | W48442 | 45251 | gacaccctgacaccaaggttcct | X91825 | 87855 | tcctctgacgcagaaggtcacat | AA107705 |
| 2648 | ctgctatgacacgcagatggtgggagat | W48442 | 45252 | acctggtgacaccaaggttcctgag | X91825 | 87856 | cagaaggtcacatcatccaacatcga | AA107705 |
| 2649 | gaacctcaaagtcaggaatcaggaac | W48442 | 45253 | ctcaactgtcactcaatactagcc | X91825 | 87857 | gtcatccaacatccaactggttgg | AA107705 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 2650 | W48442 | gctccaactactggcaggcaccatg | 45254 | W48442 | aactgtcactccaatactagcccaa | 87858 | X91825 | tcatccacatcgactttggcttcat | AA107705 |
| 2651 | W48442 | actactggcaggcaacatggtcctg | 45255 | W48442 | tgtcactccaatactagcccaacag | 87859 | X91825 | acatcgactttggcttcatccttc | AA107705 |
| 2652 | W48442 | ctactgcaggcaccatggtcctga | 45256 | W48442 | ggaagccaacttcactgtatcctca | 87860 | AA022139 | gaaacctgggcttgagacatcagc | AA107705 |
| 2653 | W48442 | accatgtcctgaccagactagct | 45257 | W48442 | agccaacttcactgtatcctcaatg | 87861 | AA022139 | tcgagacatcagcgttaagctgac | AA107705 |
| 2654 | W48442 | ccatggtcctgaccagactagtc | 45258 | W48442 | tccctcaggtgtccctcatcattaa | 87862 | AA022139 | actcctcaaggaacatgcagtta | AA107705 |
| 2655 | W48442 | catggtcctgaccagactagtca | 45259 | W48442 | ctcaggtgtccctcatcattaacta | 87863 | AA022139 | agcgttaagctgaccacagaagtt | AA107705 |
| 2656 | W48442 | atggtcctgaccagactagctcac | 45260 | W48442 | aggtgtccctcatcattaactatga | 87864 | AA022139 | gcagttataccactgcaggcatcct | AA107705 |
| 2657 | W48442 | ggtcctgaccagactagctcacac | 45261 | W48442 | tgtccctcatcattaactatgatct | 87865 | AA022139 | ataccactgcaggcatcctcagtgc | AA107705 |
| 2658 | W48442 | acagctctgtcactaccaagctta | 45262 | W48442 | ccctcatcattaactatgatctcc | 87866 | AA022139 | catcctcagtgccagccaatt | AA107705 |
| 2659 | X73359 | gctcctgtcactaccaagttacac | 45263 | W48442 | tcattaactatgatctcccaataa | 87867 | AA022139 | tcagtgccagcgcaatttgtgca | AA107705 |
| 2660 | X73359 | ttcctgcagtattctatgcta | 45264 | X73359 | ttaatatgatctcccaataaacag | 87868 | AA022139 | cccagccaatttgtcaaagctg | AA107705 |
| 2661 | X73359 | atagctatcatctcagaaggaaaa | 45265 | X73359 | atgatctcctaataacagagaatt | 87869 | AA022139 | tgtgcaaagctgtgctgctactg | AA107705 |
| 2662 | X73359 | gctatcatctcagaaggaaagaaa | 45266 | X73359 | alctcctaataacagagaatigta | 87870 | AA022139 | aaagtgtgctgctactgcttggt | AA107705 |
| 2663 | X73359 | aggaagcccagagggtgtctgtcat | 45267 | X73359 | tgtacatacacagaagattgggagac | 87871 | AA022139 | gtctcctctgagctgctcttc | AA107705 |
| 2664 | X73359 | aagcccagagggtgtctgtcatagg | 45268 | X73359 | caactttcactgtatcctcaatgcat | 87872 | AA022139 | ttcctcgagctgcctctacgtgg | AA108524 |
| 2665 | X73359 | cttgttgtcgcctggtctcgt | 45269 | X73359 | cttcactgtatcctcaatgcatgaa | 87873 | AA022139 | ctgtaaatgctctccaacaatgc | AA108524 |
| 2666 | X73359 | tgttggtcgcctggtctctgtca | 45270 | X73359 | cactgtatcctcaatgcatggaga | 87874 | AA022139 | atgctccacaacaatgcaacagc | AA108524 |
| 2667 | X73359 | tcgcctggtctctgtccagaggc | 45271 | X73359 | tgtatcctcaatgcatggagacatg | 87875 | AA022143 | ctctccacaacaatgcaacagccgg | AA108524 |
| 2668 | X73359 | cctggtctctgtccagaggtcaaa | 45272 | X73359 | gggccgccagagtgcttatttctac | 87876 | AA022143 | caccatgagccgccagatgacaac | AA108524 |
| 2669 | X73359 | tggtctctgtccagaggtcaaggc | 45273 | X73359 | cgcagagtgcttattctcaga | 87877 | AA022143 | acaatgcaacagcgcggccagccgt | AA108524 |
| 2670 | X73359 | gtctgctgtgcacctgggccta | 45274 | X73359 | ttctcagagtgcttactcaggg | 87878 | AA022143 | atgcaacagccagcgcggact | AA108524 |
| 2671 | X73359 | ttcaactttccctggccacagc | 45275 | X73359 | ctacagatgtctgggcaggggggt | 87879 | AA022143 | ggagctctgaccatgcagctg | AA108524 |
| 2672 | X73359 | atttcctggccacagcccaccaat | 45276 | X73359 | ttcaggccgttcctacatgtatat | 87880 | AA022143 | ccgatgagccgccagtgacaac | AA108524 |
| 2673 | X73359 | agccaccaatctggcccgaaagt | 45277 | X73359 | aggcgtcctacatgtatatgcgt | 87881 | AA022143 | cctgctctccatggttctct | AA108524 |
| 2674 | X73359 | tctcgccagaagtacacacgc | 45278 | X73359 | tgatcgtgaacatgctggcc | 87882 | AA022143 | tctctcatggttctctgttacc | AA108524 |
| 2675 | X73359 | tgcactgcaacctgctagtcccag | 45279 | X73359 | tctgtggcacactgctggcctg | 87883 | AA022143 | cttcagctgccttctacggtggctg | AA108524 |
| 2676 | X73359 | aagcattgctctggacctgtgcagtg | 45280 | X73359 | catctggctgctggtgtg | 87884 | AA022143 | cgagctgcctttctacgctggctgccc | AA108524 |
| 2677 | X73359 | tcttctgtgccagattctag | 45281 | X73359 | gctggcctgtctgtgtgcgagcc | 87885 | AA022143 | ttctacgctgccaagctcgg | AA108524 |
| 2678 | M17030 | ggtcattagttccagaggeggtac | 45282 | M17030 | gcgagcatcctcatctgctgcta | 87886 | AA022143 | ggggcgccaatccatcagatac | AA108524 |
| 2679 | M17030 | cattagtgtccagaggcaggag | 45283 | M17030 | agccatcctcagtctgctact | 87887 | AA022143 | tcctcatgagattacctgtaga | AA108524 |
| 2680 | M17030 | atccctagtgcatgtatgattatg | 45284 | M17030 | gtctctgctactcttttcgtcca | 87888 | AA022143 | tccatgagattacccctgtagaaat | AA108524 |
| 2681 | M17030 | gtaatlgtttgctcatttagaaat | 45285 | M17030 | cagatacctttacaLcaagttagat | 87889 | AA022143 | atgagattacccctagaaatcg | AA108524 |
| 2682 | M17030 | acactctctcatttacaacctct | 45286 | M17030 | atacctttacatcaagttagatag | 87890 | AA022143 | tggctgcaatactcctcacaacaa | AA108524 |
| 2683 | M17030 | ctctctcaatttacaacctgtga | 45287 | M17030 | ccttacatcaagttagatgggga | 87891 | AA022143 | gcttataaacttagcctcagggc | AA120244 |
| 2684 | M17030 | atttacaacctgtgaatgacattg | 45288 | M17030 | ggtccatgtatatcggtgaaatt | 87892 | AA022143 | tataaacttagcctcagggctca | AA120244 |
| 2685 | M17030 | tacaacctgtgaatgacatttggt | 45289 | M17030 | cggtgaaatlgtccaacgctctc | 87893 | AA022143 | catcagctcctgctttgtatactg | AA120244 |
| 2686 | M17030 | aacctgtgaatgacatttgggtac | 45290 | M17030 | tccaacgctcagggggagcactt | 87894 | AA022143 | cagctcctgctttgtatactgag | AA120244 |
| 2687 | M17030 | tatcatacaacttgttcctccactaa | 45291 | M17030 | aaccgctcagggggagcactt | 87895 | AA022143 | agagactgcggaactgaggagcc | AA120244 |
| 2688 | M17030 | aacattaacacttgttcttacaatg | 45292 | M17030 | tggcacttttcatcagctggccatc | 87896 | AA022143 | caaagcgccgaactcagcaactaatgaa | AA120244 |
| 2689 | M17030 | attaaacactlgttcttacaatgct | 45293 | M17030 | cactttcatcagctggccatgc | 87897 | AA022143 | gaactgcggccactcagcaactgcct | AA120244 |
| 2690 | M17030 | gggaatcatggtgtcatggtatc | 45294 | M17030 | tcatcaggtccatcgcaagggc | 87898 | AA022143 | actggcccactcagcaaacgcctcat | AA120244 |
| 2691 | M17030 | tcatgtatccctgtcgacagacta | 45295 | M17030 | atccatccatcgcaagggg | 87899 | AA022143 | ggccactcagcaacgcctcattg | AA120244 |
| 2692 | M17030 | tggtatccctgtcgacagacta | 45296 | M17030 | aittatctggccaattatgatctg | 87900 | AA022143 | tcagaacgctcattgtcaag | AA120244 |
| 2693 | M17030 | tgctgacagactacttcaacctgcct | 45297 | M17030 | gaagatccttgactgagactagta | 87901 | AA022193 | gcaactgcctcattgtcaaggac | AA120244 |
| 2694 | M17030 | tgacagactacttcaactcctgtctcca | 45298 | M17030 | ccctcttgactcgagaccggaaatgct | 87902 | AA022193 | aaacttgctcaaggagagtg | AA120244 |
| 2695 | M17030 | tgctcagaagccaaagtttgatg | 45299 | M17030 | ctcctcagagaccggaaatgctat | 87903 | AA022193 | aaacttgctccaggtccagat | AA120244 |
| 2696 | M17030 | ccctcgtcttttagcaataagaata | 45300 | M17030 | ccttcagaacggccggaaatgctatgg | 87904 | AA022193 | tcatttgtcaaggagctgggctct | AA120244 |
| 2697 | M17030 | gtaaacacatccctagtcatggt | 45301 | M17030 | gagcagtccctgagcagtgccagca | 87905 | AA022193 | cagctcagggctccagatcgtta | AA120244 |
| 2698 | W47953 | gtcctttagtctcttttggacactt | 45302 | W47953 | agtccctgagcagtgccagcacaga | 87906 | AA022193 | ctcaggggctccagatcgttagt | AA120244 |
| 2699 | W47953 | gtcctcttgacacttccaaatat | 45303 | W47953 | tcctgagcagtgccagcacagatt | 87907 | AA022193 | cagggctccagatcggttagctgca | AA120244 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 2700 | W47953 | ttcagaagcttgccaacaactccta | 45304 | AA022193 | tgagcagtgccagcacagatttgg | 87908 | AA120244 |
| 2701 | W47953 | agaagctgccaacaactcctatgc | 45305 | AA022193 | agcagtgccagcacagatttgggg | 87909 | AA120244 |
| 2702 | W47953 | agcttgccaacaactcctatgcatg | 45306 | AA022193 | cagtgccagcacagatttgggggt | 87910 | AA120244 |
| 2703 | W47953 | ttgccaacaactcctatgcatgcaa | 45307 | AA022193 | gtgccagcacagatttgggggtt | 87911 | AA120244 |
| 2704 | W47953 | ccaacaactcctatgcatgcaaaca | 45308 | AA022193 | ccettgactgagactagtaggag | 87912 | AA120244 |
| 2705 | W47953 | acaactcctatgcatgcaaacacc | 45309 | AA022193 | gccagcacagatttggggttca | 87913 | D83146 |
| 2706 | W47953 | catgcaaacacctgaagtcaatc | 45310 | AA022193 | acaacctgctcgggcgactgga | 87914 | D83146 |
| 2707 | W47953 | gcaaacacccgaagtcaatccta | 45311 | AA022193 | aacctctgctcgggcgactgagg | 87915 | D83146 |
| 2708 | W47953 | ctgagtcaatcctattgaaaat | 45312 | AA022193 | gctgcaagggcgtatgggggtct | 87916 | D83146 |
| 2709 | W47953 | ttcaatcctatttgaaaatctcca | 45313 | AA022193 | tgcacaagggcgtatgggggtctgt | 87917 | D83146 |
| 2710 | W47953 | tctttgaacacttccaatatcgg | 45314 | AA022193 | tatggggctctgtctgatgacaa | 87918 | D83146 |
| 2711 | W47953 | caagtccctccaacaatccaacct | 45315 | AA022193 | gtagccaagcaactgggcgttga | 87919 | D83146 |
| 2712 | W47953 | gacacttccaaatatcgggcgat | 45316 | AA022193 | gcaactggcgttggaagtccct | 87920 | D83146 |
| 2713 | W47953 | cgatgacgtgcaaaaccgaggctgc | 45317 | AA022193 | atgacagactctgaagtgctga | 87921 | D83146 |
| 2714 | W47953 | tgacgtgcaaaaccgaggctgctcg | 45318 | U49861 | catgtgtccaattgccactata | 87922 | D83146 |
| 2715 | W47953 | tggatagccaatccatcgttcat | 45319 | U49861 | tctctggccactgagccaaagctt | 87923 | D83146 |
| 2716 | W47953 | tagcaatcctcatcgtttcatgaa | 45320 | U49861 | gcactgatgccaaagcttataact | 87924 | D83146 |
| 2717 | W47953 | caatcctcatcgtttcatgaaaca | 45321 | AA022193 | tgccatglaggcccgtgtcactc | 87925 | D83146 |
| 2718 | W47953 | ttattcagaagctgccaacaactc | 45322 | U49861 | gtaggccctgtcactctgtcct | 87926 | D83146 |
| 2719 | W47953 | tatgcatctgcagtcagcgaggt | 45323 | U49861 | gtcactctgtcctccgggtcacag | 87927 | D83146 |
| 2720 | W47953 | cgaggtcactgcaatctataaat | 45324 | U49861 | ctgcctcctgggtcacagtgct | 87928 | D83146 |
| 2721 | W48544 | gcaaatatcatcagcgacatcgacaa | 45325 | U49861 | tcctggtccacagtgctcttcactg | 87929 | D83146 |
| 2722 | W48544 | aatatcatcagcgacatcgacaatt | 45326 | U49861 | ttcactgtctttgtttcgatagc | 87930 | D83146 |
| 2723 | W48544 | atatcatcagcgacatcgacaattg | 45327 | U49861 | gtcttttgttttcgatagcattga | 87931 | D83146 |
| 2724 | W48544 | tatcatcagcgacatcgacaattg | 45328 | U49861 | gcttcatctcatgtctgccct | 87932 | AA108230 |
| 2725 | W48544 | tcatcagcgacatcgacaatttgca | 45329 | U49861 | tccaatttgccactatagaccca | 87933 | AA108230 |
| 2726 | W48544 | catcagcgacatcgacaatttgcag | 45330 | U49861 | tttgccactatagaccaatgta | 87934 | AA108230 |
| 2727 | W48544 | atcagcgacatcgacaattgcagc | 45331 | U49861 | acttatagaccaatgtatatgc | 87935 | AA108230 |
| 2728 | W48544 | taggcaccccggacgcagtgcgcta | 45332 | U49861 | ataatgtgaacatggttgtgca | 87936 | AA108230 |
| 2729 | W48544 | caccccgggacgcagtgcgctactgg | 45333 | U49861 | tgttctgcttgtaggaaccatagaa | 87937 | AA108230 |
| 2730 | W48544 | accgggacgcagtgcgctactggt | 45334 | U49861 | tttccatgcaacatagaatcttca | 87938 | AA108230 |
| 2731 | W48544 | agggtcatcgcaatctataaaatgt | 45335 | U49861 | atctcatctactccctactact | 87939 | AA108230 |
| 2732 | W48544 | agggtcatcgcaatctataaaagt | 45336 | U49861 | ctaccatctgaaatagattgcaat | 87940 | AA108230 |
| 2733 | M88355 | gtcatcgcaatctaggggtgtgg | 45337 | AA022196 | gaggaatctatccatatgaggcaa | 87941 | AA108230 |
| 2734 | M88355 | tcatctgcaatctataaaatggt | 45338 | AA022196 | gaatctatccatatgaggcaacag | 87942 | AA108230 |
| 2735 | M88355 | tccagcaatatcatcagcgacatc | 45339 | AA022196 | ggctttgtggacatcctaagcagg | 87943 | AA108230 |
| 2736 | M88355 | cccagcaatatcatcagcgacatcg | 45340 | AA022196 | tttgtggacatcctaagcaggaa | 87944 | AA108230 |
| 2737 | M88355 | cagcaatatcatcagcgacatcgac | 45341 | AA022196 | gacatcctaagcaggaagaggaga | 87945 | AA108230 |
| 2738 | M88355 | agcaatatcatcagcgacatcgaca | 45342 | AA022196 | aaggcagttgcaactgtgggggcca | 87946 | AA108230 |
| 2739 | M88355 | ccatactcacggcgatcctcagac | 45343 | AA022196 | attctgtgtctattgatgcaggtc | 87947 | AA108230 |
| 2740 | M88355 | tcaactacggcgatcctcgactga | 45344 | AA022196 | ggtcagtgtcctcctgtctata | 87948 | AA108230 |
| 2741 | M88355 | gctgtcgactgggatatgcgca | 45345 | AA022196 | catgagtcctttgctatataag | 87949 | AA108230 |
| 2742 | M88355 | gtgctgaccctggatatgcgcaagt | 45346 | AA022196 | tccctgtcctataaagaaggcattt | 87950 | AA108230 |
| 2743 | M88355 | gacctggatatgcgcaagtgctct | 45347 | AA022196 | tattttgagcagactgagcagtg | 87951 | AA108230 |
| 2744 | M88355 | gccaacgcatctgctcagcgcccgg | 45348 | AA022196 | tttgagccagactgagcagtgaag | 87952 | AA108234 |
| 2745 | M88355 | acagccatctgctcagcgcccggatg | 45349 | AA022196 | tcctatccatagaggcaacagaag | 87953 | AA108234 |
| 2746 | M88355 | ggcatctgctcagcgcccggatggt | 45350 | AA022196 | tgtaagtacaatcccaagtatcctg | 87954 | AA108234 |
| 2747 | M88355 | atctgctcagccccggatggctgcc | 45351 | AA022196 | aagtacaatcccaagtatcctgttg | 87955 | AA108234 |
| 2748 | M88355 | tcggaccccgagctcgccttctgg | 45352 | AA022196 | tacaatcccaagtatcttgttgcta | 87956 | AA108234 |
| 2749 | M88355 | tgagcccactctctgggaatacctt | 45353 | AA022196 | cccaagtatcttgtcaatgaca | 87957 | AA108234 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 2750 | M88355 | cgttcccatggccactgcagaa | 45354 | AA022196 | tatctcgttgctaatgacaccggct | 87958 | AA108234 | taacaggctaggcagctcaatcg |
| 2751 | M88355 | cctacagcggatctcagactgagca | 45355 | AA022196 | gttgctaatgacaccggcttgtgg | 87959 | AA108234 | gctaggcagctcaatcgcttaa |
| 2752 | M88355 | acagccggatctcagactgagca | 45356 | AA022196 | aatgacaccggctttgggacatcc | 87960 | AA108234 | gcagctcaatcgtttaacaacaa |
| 2753 | M88355 | gatctcagactgagcaacatcgcca | 45357 | U17698 | atttacattgactcagtgaaaggaa | 87961 | AA108234 | tcaatcgctttaacaacactgtta |
| 2754 | M88355 | ctcagactgagcaacatcgccatgg | 45358 | U17698 | tacattgactcagtgaaaggaaaat | 87962 | AA108234 | atggcatcatcctgggactlatta |
| 2755 | M88355 | agactgagcaacatcgccatggcct | 45359 | U17698 | agaccatgttcctaccaaatcaat | 87963 | AA108234 | tcatcctgggactlattaacagcgg |
| 2756 | M88355 | ctgcttggcttactggctcgact | 45360 | U17698 | ccatgttcctaccaaatcaatgat | 87964 | AA108234 | tggctggccctgatggtatcat |
| 2757 | M88355 | ggcttactggctgacctcggcct | 45361 | U17698 | ttgttcctaccaaatcaatgattcc | 87965 | AA108234 | gtatcatctactatccaagcctga |
| 2758 | M88355 | agggctgtcgtgacctggatatgc | 45362 | U17698 | ttcctaccaaatcaatgattccata | 87966 | AA108234 | tctactatctcaagcctgactgtc |
| 2759 | W48010 | atcggccaccgatgggctgcacact | 45363 | U17698 | ctaccaaatcaatgattccatattt | 87967 | AA108234 | agcctgacttggtcaaagctagggtc |
| 2760 | W48010 | tcggccaccgatgggctgcacactg | 45364 | U17698 | actatgtccatlagcacccagatagc | 87968 | AA108234 | caaagctagggtctcctcaggtatg |
| 2761 | W48010 | gatgatcgaccgcaacctcgggag | 45365 | U17698 | atgtcatlagcacccagatagcttt | 87969 | AA108234 | tagggtctccagagctgcccctg |
| 2762 | W48010 | atgatcgaccgcaacctcggggagg | 45366 | U17698 | atlatgcattlccttttgaagcaa | 87970 | AA108234 | atgcttggaccagatttcttc |
| 2763 | W48010 | aaattatccacgagctggctactc | 45367 | U17698 | atgcattlccttttgaagcaaaatgt | 87971 | Y09585 | ggaccagatttctcttcttagg |
| 2764 | W48010 | aattatccacgagctggctactca | 45368 | U17698 | gcatttcctttltgaagcaaaatgt | 87972 | Y09585 | accagcacagcacacatcgattag |
| 2765 | W48010 | attatccacgagctggctactcag | 45369 | U17698 | acttgatgcaacacgcacttg | 87973 | Y09585 | acacacagcatgaggacaga |
| 2766 | W48010 | ttatccacgagctggctactcaga | 45370 | U17698 | atgcaacacgcacttgtgtc | 87974 | Y09585 | ccatctgccagatctgccctg |
| 2767 | W48010 | tatccacgagctggctactcagga | 45371 | U17698 | caacacatgcactttgtgtctcc | 87975 | Y09585 | gttcaaccaaccattaatggatc |
| 2768 | W48010 | acgaggctgactcaggagagaaga | 45372 | U17698 | cactttgtgtcctgattcaa | 87976 | Y09585 | gtcggtlcaactcaccagcaactlc |
| 2769 | W48010 | aggctggctactcaggagaagaagtg | 45373 | U17698 | acttcttgtatataagactgtac | 87977 | Y09585 | tcacagcaacttcctcttgggtc |
| 2770 | W48010 | cggccaccgatgggctgcacactga | 45374 | U17698 | tataagactgtactgctlaggatat | 87978 | Y09585 | caactlcttggttggctgctca |
| 2771 | W48010 | ggccaccgatgggctgcacactgag | 45375 | U17698 | aagactgtactgctlaggatattaa | 87979 | Y09585 | ctcctttggctgtcagccagt |
| 2772 | W48010 | gccaccgatgggctgcacactgagc | 45376 | U17698 | gttctatgtagggttgcaga | 87980 | Y09585 | tgglgctcagccagtgatact |
| 2773 | W48010 | caccgatgggctgcacactgagcgc | 45377 | U17698 | cctgtctatcaccaaccctgg | 87981 | Y09585 | gactcgtltctctgctggcta |
| 2774 | W48010 | accgatgggctgcacactgagcgct | 45378 | U17698 | tgctatccaaacctggacagtc | 87982 | Y09585 | ggactgttttccttctggct |
| 2775 | W48010 | ccgatgggctgcacactgagcgctg | 45379 | U17698 | gatcctgccatgttgaccgactg | 87983 | Y09585 | tctctccaaggcttccaagca |
| 2776 | W48010 | aggatgatcgaccgcaacctccggg | 45380 | U17698 | gccactgttgaccgactgcaaat | 87984 | Y09585 | cacatcgatgaggacgagaccaa |
| 2777 | W48010 | ggatgatcgaccgcaacctccggga | 45381 | U17698 | agcactagctgacgagtatgaaggcc | 87985 | Y09585 | caaggttccaagagagagggcaa |
| 2778 | M62860 | cctgctctcttgttgctg | 45382 | U17698 | agtttgcaatggtgtccagcacc | 87986 | Y09585 | agaccaaggccaagactttatg |
| 2779 | M62860 | ctctctctttggtgctctcca | 45383 | U17698 | ctgcgtatctataagccgtgtt | 87987 | Y09585 | ctttatgtcatcatgggctgtt |
| 2780 | M62860 | ggtctcagatgacatctctttacc | 45384 | U17698 | tatcctataagcgtlcatgc | 87988 | Y09585 | tcatgggctgctctgttctgtg |
| 2781 | M62860 | ctcagatgacatctctttacctgg | 45385 | U17698 | actcaccccatgcatacggactcctg | 87989 | Y09585 | ttgtggaccctttcatagactacac |
| 2782 | M62860 | tgacatcttlacctggccgctac | 45386 | U17698 | ccactgcatacggactctgcctata | 87990 | Y09585 | ggactgcttlccttctgctlggcta |
| 2783 | M62860 | calctcatlctttacctggctaccag | 45387 | U17698 | catacggactctgcctatagcaatt | 87991 | Y09585 | ttctcatgcctltgaataagtc |
| 2784 | M62860 | ctctttacctggctactcagcct | 45388 | U17698 | gactctgcctatagcaattggtat | 87992 | Y09585 | ctttcagacggcctltctcatcat |
| 2785 | M62860 | ccgagatgccatttcgatlttccac | 45389 | U17698 | aactgctlggatcaacaccccat | 87993 | X91043 | aatgaatgcatccaggctctgaaa |
| 2786 | M62860 | catttcgatltlccactagccaag | 45390 | U17698 | ctlgatcaacagccccattccatg | 87994 | X91043 | agcatccatggtatccagaglct |
| 2787 | M62860 | ttcgatltlccactagccaagga | 45391 | U17698 | agctgagtlccctaagctgcaagtt | 87995 | X91043 | ctttaactctgggggatttagcg |
| 2788 | M62860 | gatttlccactatgccaagggacaa | 45392 | U17698 | tggtttcatlgactlcgtatgact | 87996 | X91043 | taactctcggggagattagctgaaa |
| 2789 | M62860 | clatgccaagggacaaccttacatc | 45393 | U17698 | catlgactlcgtatgactlctgta | 87997 | X91043 | ttccttcctgtatgtgactgtag |
| 2790 | M62860 | tlcttggctgtctcagcctg | 45394 | U17698 | ggaattttlcgatttcagaagag | 87998 | X91043 | atgtlcactgtaggggtcttagaa |
| 2791 | M62860 | ggtgtctctcagcctggccatt | 45395 | U17698 | atttcacgaagatgctgccatt | 87999 | X91043 | tgcactgtagggcttagaaatgg |
| 2792 | M62860 | gtctcagcctggccatgtggtt | 45396 | U17698 | cgaaggatcctgccatgttgac | 88000 | X91043 | tgaagactgcctctggagccagg |
| 2793 | M62860 | tccagcctggccatlggttac | 45397 | U17698 | tagcagaagcaccatggtatctga | 88001 | X91043 | agcctcaaggctcaggcttca |
| 2794 | M62860 | agcctggccattgtggttacacg | 45398 | U17698 | cagaagcaccatggtatctgagag | 88002 | X91043 | ggcttcatcctcgcaccaacaaat |
| 2795 | M62860 | aatctatlggtgcgtgggctcccag | 45399 | U17698 | tlctgattgctacgcaagattt | 88003 | X91043 | gccagctaaaacactctgtgacact |
| 2796 | M62860 | ctgctccttgtcccagtgaatgg | 45400 | U17698 | tgctatlgcccaagattgcttlc | 88004 | X91043 | gtaaacactctgtgacactgaagaa |
| 2797 | M62860 | ctccttcgtcctgaatgggggc | 45401 | U17698 | ctatlgcccaagattgcttlat | 88005 | X91043 | atccatlggttatcacgagctcct |
| 2798 | W48055 | tcagctccaatgaatltggctct | 45402 | U17698 | ttgcccaagatltgcttlctatga | 88006 | X91043 | ggttatcacgagtctcctgcc |
| 2799 | W48055 | gctccaatgaatltggctctta | 45403 | U17698 | atlttgtctltctatgcacgtaltgta | 88007 | X91043 | tcagctccggtacttcaaaccctg |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2800 | ctcatcattatatcgtcctactg | W48055 | 45404 | tgctttctatgcacgtattgtcaa | D14636 | 88008 | tcaaacctgaccactactgctgcg | X91043 |
| 2801 | atcattatatcgtcctactactgcta | W48055 | 45405 | aattgtgcttgtgccacaggtcat | D14636 | 88009 | cactctgctgccgagaaaactcc | X91043 |
| 2802 | atatgtcctacactgtctaatctgg | W48055 | 45406 | gcttgtgccacaggtcatgatcgt | D14636 | 88010 | ccctgccatgcgacatgttgcag | X91043 |
| 2803 | tacactgctaatctgctgatcgcc | W48055 | 45407 | ttgtgccacaggtcatgatccgtga | D14636 | 88011 | gccatgcacatgttgcaggcgatc | X91043 |
| 2804 | actgctaatctggctgcatgccta | W48055 | 45408 | tgccacaggtcatgatcgtggaa | D14636 | 88012 | catcgacatgttgcagggcatcatg | X91043 |
| 2805 | gctgcatgcctactgtcgagagga | W48055 | 45409 | aagcaaccatggtatctgagagagc | D14636 | 88013 | gactctacgcaggagaaccctg | X91043 |
| 2806 | tgcctacgtgggaggatggtct | W48055 | 45410 | gatccccaagcttagaattgtt | D14636 | 88014 | ccatctgtcattttaaacagtc | X99572 |
| 2807 | tccccatagaaagtgcagaagacc | W48055 | 45411 | tgtggagacttcttcgtctgt | D14636 | 88015 | tgattcccagtactctgacaaatg | X99572 |
| 2808 | agtgcagaagaactgcgccaagacgac | W48055 | 45412 | tgtcgttactcatgttatcaa | D14636 | 88016 | tagctcagatgtcttttgccatc | X99572 |
| 2809 | gcagaagaactgcgccaagacgacaga | W48055 | 45413 | tttactctagtttcaaataatg | D14636 | 88017 | cagatgtctttgcgccatcagcact | X99572 |
| 2810 | tcaccagatcctgtcaggtcgcga | W48055 | 45414 | tatatcagccaaaaccataactac | D14636 | 88018 | ggccatcagcacctgcaagaaggag | X99572 |
| 2811 | cccagatcctgtcaggtcggattg | W48055 | 45415 | gtctactgttctaggtttctgtgg | D14636 | 88019 | gaggagccctgtgtttgatgaata | X99572 |
| 2812 | agatcctgcaggtcggattgttg | W48055 | 45416 | ttttctgattgatattgcccaaga | D14636 | 88020 | tagtaggtgccactcgattgtttc | X99572 |
| 2813 | tcctgtcaggtcggattgttggag | W48055 | 45417 | cctgcgtccgtgggtcccatatct | D14636 | 88021 | ctcgattgttcctgcggctggcaa | X99572 |
| 2814 | tggtctcacactcatcattat | W48055 | 45418 | ggtccatatctggtcccaacgaa | D14636 | 88022 | aatgtcatgagttattgtctct | X99572 |
| 2815 | ttcttcacactcatcattatgt | W48055 | 45419 | atgtcacttacgtttgggcattgt | D14636 | 88023 | agcactgatcaattcccatccact | X99572 |
| 2816 | ttcacactcatcattatcgtcct | W48055 | 45420 | cttacgtttgggcattgtgagctg | D14636 | 88024 | ctgaagcactgccgtcatgtttata | X99572 |
| 2817 | acactcatcattatcgtcctaca | W48055 | 45421 | gaaggtctcttgtctcccaacaca | D14636 | 88025 | ctgtcattttaaacagtcactgt | X99572 |
| 2818 | aaagtccaatcattgtacgtgtg | L14751 | 45422 | ctctgtttctcaacacacatgctg | U47810 | 88026 | cactgcttttgtcaagttcgtcaac | X99572 |
| 2819 | atcattgtacgtgtgagttgggaa | L14751 | 45423 | ttttctcaacacaatgtcgaagcta | U47810 | 88027 | tttgtcaagttcgtcactgttgc | X99572 |
| 2820 | agagccaggctaccgcgattagga | L14751 | 45424 | gtatagttagttcctccagagctg | U47810 | 88028 | aagttgctgccactgttgcccacta | X99572 |
| 2821 | caggctaccgcgattaggagtagaa | L14751 | 45425 | ttagttctccagagctgccaaga | U47810 | 88029 | ttgattgacctagtgtcatggtaa | X99572 |
| 2822 | cccctgtttccatcgtgatgta | L14751 | 45426 | aagcaactccactggctagtccta | U47810 | 88030 | atggtaaagccacatttccatcatgcaa | X99572 |
| 2823 | ttcccatgggtaggatggact | L14751 | 45427 | tttttagaatctgccatataacta | U47810 | 88031 | aagccacattccatgcaatgggg | X99572 |
| 2824 | ccctcaggagagacaacctct | L14751 | 45428 | aatctgccatataactaccaataa | U47810 | 88032 | cattccatgcaatgcggctaggt | X99572 |
| 2825 | caagagacaaactctgagagctaa | L14751 | 45429 | catactgttccaaacgaatgacag | U47810 | 88033 | gcaatgctgcagctggctaggactaa | X99572 |
| 2826 | gagacaaaactctgagagctaatgt | L14751 | 45430 | accaaaaagtctactcactcaggtg | U47810 | 88034 | atgtctgcagctggctaggactct | AA108443 |
| 2827 | gagctaatgtcaggtccctggagac | L14751 | 45431 | taggcaactgtctcagtttacc | U47810 | 88035 | tcaatagcctggactctcgggagac | AA108443 |
| 2828 | ctgctggcacaggtggggaaccat | L14751 | 45432 | actgctctcagttttaccagagtcg | U47810 | 88036 | gagaccaagactccaatgctacca | AA108443 |
| 2829 | tctcttatctccaagcatgaga | L14751 | 45433 | ctcagtttaccagatcgctacta | U47810 | 88037 | agaccaagactccaatgctaccat | AA108443 |
| 2830 | ccgactcctatgcgagacagtgcca | L14751 | 45434 | tttaccagatcgctactatgaaga | U47810 | 88038 | accaagactccaatgctaccatgt | AA108443 |
| 2831 | atgagaacagccggtccattccgca | L14751 | 45435 | aggataccaaccaaatgtcactacgt | U47810 | 88039 | agacttccaatgctaccatgtctg | AA108443 |
| 2832 | cagacagtccgcatcctgccaagg | L14751 | 45436 | aggataccaaccaaatgtcactacgt | U47810 | 88040 | agactccaatgctaccatgtctgt | AA108443 |
| 2833 | acagtccgccatcctgccaagtc | L14751 | 45437 | ccaagcaactgctgagtgctgcacca | U47810 | 88041 | cttccaatgctaccatgtctgata | AA108443 |
| 2834 | gccatcctgccaagtaccctaggc | L14751 | 45438 | ggcactgctgagtgctgcaccaaag | U47810 | 88042 | accatgtctaccatgtctggttgaa | AA108443 |
| 2835 | gtaccctaggctgaccctcagcctcc | L14751 | 45439 | gaatattccactaattacggacaag | U47810 | 88043 | catgtctgatacttgttggttaat | AA108443 |
| 2836 | ctgagatctcagcctcccagatccaa | L14751 | 45440 | tattccactaattacggacaagctc | U47810 | 88044 | gtaatgctgagtcgcgatgcacatcg | AA108443 |
| 2837 | ttgagtctcccagatccaaggggga | L14751 | 45441 | tccactaattacggacaagctctc | U47810 | 88045 | actctgagaactgcagacctcaata | AA108443 |
| 2838 | atgaccctcaaggatgccatactat | W48926 | 45442 | actaattacggacaagctctcgt | AA022241 | 88046 | tgagaactgcagacctcaatagccg | AA108443 |
| 2839 | acctcaaggatgccatactatctg | W48926 | 45443 | caagcctcctgtcacttttagtca | AA022241 | 88047 | gaaactgcagacctcaatagccgaa | AA108443 |
| 2840 | agaaggatgccatactatctgtgc | W48926 | 45444 | gctcctctgctcactttttagt | AA022241 | 88048 | actgcagacctcaatagccggact | AA108443 |
| 2841 | acagatccagagggctgtgcat | W48926 | 45445 | ccctcgctcatttagtcagttaca | AA022241 | 88049 | actgcagacctcaatagccggactc | AA108443 |
| 2842 | gacatccgagggctgcatgcatgg | W48926 | 45446 | ctgtcactttagtcagttacacca | AA022241 | 88050 | ctgcagacctcaatagccggactcc | AA108443 |
| 2843 | cagagggctgtcatgaggtcatg | W48926 | 45447 | ttagtcagttacacaagagttatc | AA022241 | 88051 | gcagacctcaatagccggactcctg | AA108443 |
| 2844 | agaggctgtcatgaggtcatgg | W48926 | 45448 | gtcagttacacaagagtattctt | AA022241 | 88052 | gacctcaatagccggactccggg | AA108443 |
| 2845 | ggcttgctcatgaggtcatggagc | W48926 | 45449 | tgctgccaaagagggggctggaac | AA022241 | 88053 | aagagctgttgccacgcaccgga | AA108443 |
| 2846 | ttgctgcatgagtcatgagcagc | W48926 | 45450 | tgcaccaaagagggggctggaacgaa | AA022241 | 88054 | cgtttgccacgcaccggcagga | Y09632 |
| 2847 | aattgccaggcacgtgagttccca | W48926 | 45451 | gaaagctgcatgcgtgctctga | AA022241 | 88055 | agccctgccaaaagcgctggga | Y09632 |
| 2848 | attgcccagcacgtgagttccca | W48926 | 45452 | agctcgcatgcgtctctgaaac | AA022241 | 88056 | acctacctgccaaagctcaacgac | Y09632 |
| 2849 | tgccaggcacgtgagttccagc | W48926 | 45453 | ctctgcatgctgctctgaaacacc | AA022241 | 88057 | ctgcaaagtctcaacgacgacagc | Y09632 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 2850 | aggatgccatactatctgtcttt | W48926 | 45454 | atggctgctgaaccaccagccac | AA022241 | 88058 | aagtcaacagacagcagccctat | Y09632 |
| 2851 | ggatgccatactatctggtcttt | W48926 | 45455 | ctgaaacaccagccacaggaatcc | AA022241 | 88059 | aacagacagcagccctatgcgcgg | Y09632 |
| 2852 | tggccatactatctggtcttgtg | W48926 | 45456 | atctgagggttcaggaaagatc | AA022241 | 88060 | ccttatgcgcggattctgctca | Y09632 |
| 2853 | gccatactatctggtcttttgtgt | W48926 | 45457 | gccatgctgcagggcatgacatctg | AA022241 | 88061 | atggtttgccctgaggttgtca | Y09632 |
| 2854 | ccatactatctggtcttttgttg | W48926 | 45458 | tctggcatgaactacctcagtaatc | AA022241 | 88062 | ttggccagctgttagctgataagt | Y09632 |
| 2855 | atactatctggtcttttgttggc | W48926 | 45459 | atcacaattagtccacgggaact | AA022241 | 88063 | ttaagcttcagcatacaccagaac | Y09632 |
| 2856 | ctggtcttttgttggctgctgct | W48926 | 45460 | tggctgccgaaacatctcggtga | AA022241 | 88064 | atacaccgaactgtattcagaat | Y09632 |
| 2857 | gtcttttgttggctgctgctga | W48926 | 45461 | gctgccagaaacatctcggtaat | AA022241 | 88065 | ccacgcaaccgggcagggaaacct | Y09632 |
| 2858 | atgctactccaaagacagagcagt | W48926 | 45462 | ctgccagaaacatctcggtgaatc | AA022241 | 88066 | tcgtcaagcattaaccaactgtgat | Y09632 |
| 2859 | cctccaaagacagagcagtacgtgg | W47946 | 45463 | gccagaaacatctcggtgaatcaa | AA022241 | 88067 | cttaatcaagcagaaccagaccctg | Y09632 |
| 2860 | catatcattgactgatacctgtaat | W47946 | 45464 | ccagaaacatctcggtgaatcaaa | AA022241 | 88068 | gaccctggctgagctgcagaataac | Y09632 |
| 2861 | atcattgactgatacctgttgtgtt | W47946 | 45465 | aacatctcggtgaatcaaaacctg | AA022241 | 88069 | cattgctgcagtatcacacactgtg | Y09632 |
| 2862 | taatatgcaacggcacagctagttt | W47946 | 45466 | acatcttcggtgaatcaaaaactgt | AA022241 | 88070 | gtatcacactgctaaagctccaa | Y09632 |
| 2863 | tatgcaacggcacagctagtttttc | W47946 | 45467 | gacagccctgaagccattgccatg | AA022242 | 88071 | gctaaagctcaaggccaagcctct | Y09632 |
| 2864 | gcaacggcacagctagtttttctga | W47946 | 45468 | agccctgaagccatgccattgccatgg | AA022242 | 88072 | tccaaggcaaggctctgccaaa | Y09632 |
| 2865 | cagctagtttttctgatctggataa | W47946 | 45469 | ctgcatgaactacctcagtaatca | AA022242 | 88073 | gctccatttcaacgctcggagca | Y09632 |
| 2866 | ctagtttttctgatctggataaag | W47946 | 45470 | ggcatgaactacctcagtaatca | AA022242 | 88074 | atttcaacaagctcggagcatga | D86603 |
| 2867 | agtcaacatctgaactatatttca | W47946 | 45471 | gcatgaactacctcagtaatcacaa | AA022242 | 88075 | ggaggcctgctgtcatcctcagtatt | D86603 |
| 2868 | agaataaatcaacagacaactct | W47946 | 45472 | atgaactacctcagtaatcacaat | AA022242 | 88076 | tatcctcagtattgactaggagtt | D86603 |
| 2869 | aatctcaacagacaactctattctg | W47946 | 45473 | tgaactacctcagtaatcacaatta | AA022242 | 88077 | aagtgtatcatcgttccgtttctc | D86603 |
| 2870 | cttcacaaggcgaggtgggtagatg | W47946 | 45474 | aactacctcagtaatcacaatatg | AA022242 | 88078 | atcatgtccctgttctcagttct | D86603 |
| 2871 | aacagacaactctattctgattata | W47946 | 45475 | tacctcagtaatcacaattatgtcc | AA022242 | 88079 | cagttcgttccctcttttagtcc | D86603 |
| 2872 | gatgctcatggtccattggacgctat | W47946 | 45476 | acctcagtaatcacaattatgtcca | AA022242 | 88080 | tgccccgagagctgcacactgcac | D86603 |
| 2873 | gtcattggtcattggacggcgctagat | W47946 | 45477 | ctttccattcgccttttgtcatg | AA022242 | 88081 | ctgcacactgcacaaggctgtcgat | D86603 |
| 2874 | atggtcattggacggctatgatggt | W47946 | 45478 | ttccattcgccttttgtcatttg | AA022242 | 88082 | actgcacaaggctgtcgatcatctc | D86603 |
| 2875 | tttgatgcatgcacacatatgg | W47946 | 45479 | tgtctcccaaactctcgtttcaga | AA022242 | 88083 | tgtcgatcatcatttgcaggtcg | D86603 |
| 2876 | gatgcatgcacacatatcattgact | W47946 | 45480 | gtctcccaaactctcgtttcagag | AA022242 | 88084 | cagctcattgaatccagtgaagaa | D86603 |
| 2877 | gcatgccacatatcattgactga | W47946 | 45481 | tctcccaaactctcgtttcagagat | AA022242 | 88085 | caagctggagctcatcgcacgcagt | D86603 |
| 2878 | cacatatcattgactgatcctgt | W47946 | 45482 | tcccaaactctcgtttcagagatg | AA022242 | 88086 | aagagcccttcctactgcggagcagt | D86603 |
| 2879 | actagccacatctggacacacacg | W47946 | 45483 | caaactctcgtttcagagatgtga | AA022242 | 88087 | ttgaactctaatgcctgcacctc | D86603 |
| 2880 | cacggtcaccatggtcagcgctgat | W74814 | 45484 | aactcctgttttcagagatgtgaac | AA022242 | 88088 | gcactcagtcctccaaagtccag | D86603 |
| 2881 | gggctcttcatccaccaacaggtg | W74814 | 45485 | ttcctgttcagagatgtgaacct | AA022242 | 88089 | ctcaaagtccagtcatggctgtg | D86603 |
| 2882 | tcttcatccaccaacaggtcgcgctg | W74814 | 45486 | gatgtgaacctttatcccccaaag | AA022242 | 88090 | agtccagtcatggctgttgacctg | D86603 |
| 2883 | tcatccaccaacaggtgcgtgtg | W74814 | 45487 | tgtgaacctttatccccaaagt | AA022242 | 88091 | gcatgtggttgacctgaggctg | D86603 |
| 2884 | tccaacaggtgcgctgttggcc | W74814 | 45488 | atcagagaacccaactcctccatg | AA022242 | 88092 | ccacgtggcctgctgagctgaggc | D86603 |
| 2885 | acagggcgctgttggccacacagc | W74814 | 45489 | catcggcctttgtcatagggaca | AA022242 | 88093 | aatctcaaactcacctaccctgctgc | AA108506 |
| 2886 | caagggaacacactcagtgcagtg | W74814 | 45490 | atcggcctttgtcatagggacag | AA022247 | 88094 | ttccaaactcacctactctgcag | AA108506 |
| 2887 | cggaacacatcgaatgctggg | W74814 | 45491 | tcggcctttgtcatagggacaga | AA022247 | 88095 | gacagaagaccctaggtggtac | AA108506 |
| 2888 | aacacatcgagtgcagctggag | W74814 | 45492 | cctttgtcatagggacagaatct | AA022247 | 88096 | cagaagaccctattggtgtacag | AA108506 |
| 2889 | catgcagtgcagtgcagggaccag | W74814 | 45493 | cccaaactctgcctagaaggacat | AA022247 | 88097 | caagaaccccttaggtggtacagt | AA108506 |
| 2890 | ggccatagtgtacgcactgctgct | W74814 | 45494 | ccaaactccgcctagaaggacatg | AA022247 | 88098 | agaagaaccagcgagactccctca | AA108506 |
| 2891 | cagctgatgtcagcagactcag | W74814 | 45495 | aggacatgcccatgtctcccaa | AA022247 | 88099 | accagcgagactgtactccctca | AA108506 |
| 2892 | cgtacgactgtctgcatgcacgaa | W74814 | 45496 | acatgaccccatgtctcccaaact | AA022247 | 88100 | cagcgagactctgtactccctcaga | AA108506 |
| 2893 | tcagccgcacactctctccc | L75822 | 45497 | atctggaacgtcactgctgccaagg | L75822 | 88101 | gcgagactctgtactccctcagatt | AA108506 |
| 2894 | cgtcaacaatcattacctgggc | L75822 | 45498 | gtgtcttgctgtgaggtcatcg | L75822 | 88102 | gagactctgtactccctcagattt | AA108506 |
| 2895 | aatcattacctcggggcctggtg | L75822 | 45499 | ccatgcctctgagtaggtcatcg | L75822 | 88103 | gactctgtactccctcagattgct | AA108506 |
| 2896 | cattaccttcggcctgctggact | L75822 | 45500 | gcctctgagctaaggtgtctcag | L75822 | 88104 | gtactcccctcagattgtgagg | AA108506 |
| 2897 | tacctctgggcctggtgtgactgag | L75822 | 45501 | gtagctaaggtgctctcagacagcc | L75822 | 88105 | acctactgctcgcaggactcactca | AA108506 |
| 2898 | tgggccttgctgactgtgggactca | L75822 | 45502 | cttcagacgccgacagctataac | L75822 | 88106 | ctccctcagatttgctgagggtc | AA108506 |
| 2899 | tgaggactccaaggctggtggtcttt | L75822 | 45503 | gacacgccgacagctataaccgct | L75822 | 88107 | ctacctctgcgaagactcactcagt | AA108506 |

| SEQ ID NO | sequence | DBAxnID | SEQ ID NO | sequence | DBAxnID | SEQ ID NO | sequence | DBAxnID |
|---|---|---|---|---|---|---|---|---|
| 2900 | atgaatactggccccaggggctg | X56824 | 45504 | tctgcctgacacacttcttaac | L75822 | 88108 | acctgctgcaggactcactcagtgg | AA108506 |
| 2901 | gtgaactgtccaatgtggcctc | X56824 | 45505 | ccactaacacttattacagccagc | L75822 | 88109 | gctgcaggactcactcagtggtgac | AA108506 |
| 2902 | gtctgagccagtgccatggttg | X56824 | 45506 | acactttatcagcagctggttt | L75822 | 88110 | caggactcactcagtggtgacagca | AA108506 |
| 2903 | gtaagccatcatgttgactgaccac | X56824 | 45507 | tattacagccagctggtttacaca | L75822 | 88111 | ggactcactcagtgtgacagcaag | AA108506 |
| 2904 | atccatgttgactgaccacgactgc | X56824 | 45508 | gataacacttacaagactatctacaa | L75822 | 88112 | tcactcagtggtgacagcaagccc | AA108506 |
| 2905 | tgaccacgactgtgtccccagtg | X56824 | 45509 | ttgagctgtgaggtcatcggaatcc | L75822 | 88113 | gtgacagcaagaccctatggtgt | AA108506 |
| 2906 | cccagtgccatggccactttgatat | X56824 | 45510 | cctgtccatcggaacaaggtaa | L75822 | 88114 | gactcggtcgcgttcaaggcacccttcg | AA108508 |
| 2907 | gccatggccacttgatatccgttt | X56824 | 45511 | gatcactctggagttcagcggacag | L75822 | 88115 | tgcgttcaaggacctttcgcgaggat | AA108508 |
| 2908 | ttgatccgttccagacattct | X56824 | 45512 | cggacgaactgtgctggtgacc | L75822 | 88116 | tcagaggctgttgactcggtggtg | AA108508 |
| 2909 | tttcccagttctaccagagtaatg | X56824 | 45513 | ttgcctgtgaccgggaaaatctgg | L75822 | 88117 | gaaagctgtaactgctgcaggctt | AA108508 |
| 2910 | cagttctaactctgtgtgaata | X56824 | 45514 | gagtgccacgcatccaaactcccaag | L75822 | 88118 | aagctgtaactgctgcaggcttc | AA108508 |
| 2911 | tggtctcaactctgctgaaatc | X56824 | 45515 | tccaactcccaagggcagccttccg | L75822 | 88119 | aagctgaactgcagctgcaggcttcc | AA108508 |
| 2912 | ggcctctctctgtaagggagaat | X56824 | 45516 | cagttataacctcgaatccatgca | L75822 | 88120 | tgtaactgcgccaggcttccagct | AA108508 |
| 2913 | gagaatctgcctgctctctc | X56824 | 45517 | tacaaatctgcataagtacataa | L75822 | 88121 | gtaactgcctgcaggcttccagctg | AA108508 |
| 2914 | ctgcctggctctcttcctggc | X56824 | 45518 | catatacctttcagaatacaaatg | L75822 | 88122 | taactgctgcaggcttccagctga | AA108508 |
| 2915 | tggctctctctctggggcctaa | X56824 | 45519 | tcaagcaaatcttccacagtgttc | L75822 | 88123 | aactgctgcaggcttccagctgac | AA108508 |
| 2916 | cacatcagcagctggctgaactt | X56824 | 45520 | agcaaatcttccacagttgtcaag | L75822 | 88124 | ggtacctcttattcagaagatccg | AA108508 |
| 2917 | ttgaaacagcagcccaaatcctg | X56824 | 45521 | aaatcttccacagttgttcaagaat | L75822 | 88125 | gtacctccttattcagaagatccgg | AA108508 |
| 2918 | aatctgcagcagagcccaaaact | X56824 | 45522 | gaatcttcaaaggcacacctcggt | L75822 | 88126 | gcgttcaaggacctttcgcggaggatc | AA108508 |
| 2919 | gcagcagagcccaaaactggcctg | X56824 | 45523 | tctctaaaggcacacctcgtctt | L75822 | 88127 | ttcaaggacctcgcggaatcttc | AA108508 |
| 2920 | aaatgttcatcaagaacctggac | X56824 | 45524 | ttagcttccagtccaaaaccattca | L75822 | 88128 | gacctcgcggagatctccagaag | AA108508 |
| 2921 | tgtcttcatcaagaacctggaca | W48104 | 45525 | tccagtccaaaccattcagccgtg | AA022064 | 88129 | cttcgcgaggatcttcagaactgat | AA108508 |
| 2922 | tttctcgcctttgaaacatctg | W48104 | 45526 | aaaccattcagccgtgcaaatgcag | AA022064 | 88130 | ctgataacttcgttttggtcagag | AA108508 |
| 2923 | ctctgcctttgaaacatctgtcc | W48104 | 45527 | ccattcagccgtgcaaaatgcagctg | AA022064 | 88131 | tgataacttcgtttttggtcagat | AA108508 |
| 2924 | tggaaacatctgtcctgtaagtg | W48104 | 45528 | agccgtgcaaatgcagctgaaacca | AA022064 | 88132 | ttcgtttttggttcagtaggctg | AA108508 |
| 2925 | caatctgcctgtaagtggctgt | W48104 | 45529 | atacctttcactcgttacaatga | AA022064 | 88133 | ttcagcttttgactcgggt | AA108508 |
| 2926 | ctgtcctgcaaggtggctctgat | W48104 | 45530 | aatacaaatgccaattgaacatga | AA022064 | 88134 | ggactccgtcgcgatgaagtaccct | AA108509 |
| 2927 | gtcctgtaaggtggctgtgatgag | W48104 | 45531 | aatgttgttcactctgaatctg | AA022064 | 88135 | tccgtcgcgatgaagtaccctcct | AA108509 |
| 2928 | cggctcaaggcctatgctttgt | W48104 | 45532 | gctttgttcactctgaatctg | AA022064 | 88136 | agatgccgaacacactggttgtac | AA108509 |
| 2929 | ctcgaaggctatgctttgtcac | W48104 | 45533 | gtcactctgaatctgatgttgca | AA022064 | 88137 | gtcggacacactggttgatgcctac | AA108509 |
| 2930 | ctatgcttttgtcacttcgagacc | W48104 | 45534 | cactctgaatctgatgatgtgca | AA022064 | 88138 | cggacacactggttgatgcctacaa | AA108509 |
| 2931 | atgtttgtcacttcgagaaac | W48104 | 45535 | ggaaacattcaagcaaatcttcca | AA022064 | 88139 | cacacactggtgatgctactaaatgca | AA108509 |
| 2932 | cttcatcaagaacctggacaaatcc | W48104 | 45536 | cattcaagcaaatcttccacagttg | AA022064 | 88140 | ggttgatgcctacaatgcagccct | AA108509 |
| 2933 | tgcttgttcactcgagaccca | W48104 | 45537 | tatacctactctcgttacaatggct | AA022064 | 88141 | ttgatgcctacaatgcagcctcta | AA108509 |
| 2934 | caagaacctgacaaatccatagaac | W48104 | 45538 | tacttccgttacaatggtcactaa | AA022064 | 88142 | tgcctacaatgcagcctctcagtcc | AA108509 |
| 2935 | gaaacctggacaaatccatagacaac | W48104 | 45539 | ccaggacagctgctgtcttgtccc | AA022064 | 88143 | caatgccctcagtccagtcagctt | AA108509 |
| 2936 | caaatctagacaacaggcactg | W48104 | 45540 | tgcctgtagccaacttcctccagt | AA022064 | 88144 | atgcagcctcagtccagtccagtgg | AA108509 |
| 2937 | agacaacaggcactgtatgacact | W48104 | 45541 | gtagccaacttcctccagttatggc | AA022064 | 88145 | agccacagtggttgaaacacga | AA108509 |
| 2938 | gtatgacacttctctgcttgga | W48104 | 45542 | cccactctggatatctgaccttg | AA022064 | 88146 | cgtctgatgagtaccctcctat | AA108509 |
| 2939 | tgacacttctctgcttgggaaac | W48104 | 45543 | tctgtatctgacctgaccca | AA022064 | 88147 | tgcgatgagtacctccttatcagc | AA108509 |
| 2940 | cacttctgccttgaaacatc | W48104 | 45544 | tatctgacctgacctcagctt | AA022064 | 88148 | cgatagctacccctcttatcagcaa | AA108509 |
| 2941 | gacatcaccgctcctgtttg | W48104 | 45545 | acctcgactcagctttagagga | AA022064 | 88149 | agtactcacacagaatcatgaacac | AA108509 |
| 2942 | cagcaccacatggggcatcagagac | X14045 | 45546 | gactcagccttagaggacatggc | U37091 | 88150 | tagcttcccaagatgtcggacac | AA108509 |
| 2943 | gctgacaatggcctcacagaaatca | X14045 | 45547 | atgaggaactggctgtgtggcgcac | U37091 | 88151 | ttccaagatgtcggacacactg | AA108509 |
| 2944 | gaaatcaagactctgcctttc | X14045 | 45548 | tgtgcacacttaccgcctt | U37091 | 88152 | ctccaagatcggacacactggt | AA108509 |
| 2945 | gtcctttcctgaaagccatgc | X14045 | 45549 | cgttacaatggcctcactcagtgat | U37091 | 88153 | caagatctggacacactggttgat | AA108509 |
| 2946 | ttcctgaaaagccatgccaaccag | X14045 | 45550 | aatggctcactcagtgatccaaaat | U37091 | 88154 | cagaagctcactgacaataatgtca | AA108509 |
| 2947 | cgaaaaggccatgccaaccagaccatg | X14045 | 45551 | accacaacccaactgatgatgactg | U37091 | 88155 | ctcactgacaataatgtcagcttc | AA108509 |
| 2948 | gccatgccaaccagaccatgcaggc | X14045 | 45552 | tctctctgcttgacctgacca | U37091 | 88156 | ggtgcccgaaaagcgcattcaca | D86604 |
| 2949 | caaccagaccatggcaggcaacaca | X14045 | 45553 | gtgacgtcatctgactgtaca | U37091 | 88157 | accccgaccatgaaataagtacctggaca | D86604 |

| SEQ ID NO | DBAxnID | SEQ ID NO | sequence | DBAxnID | SEQ ID NO | sequence | DBAxnID |
|---|---|---|---|---|---|---|---|
| 2950 | X14045 | 45554 | cccatcaagatccacaaaaccagt | U37091 | 88158 | ttctggtactcggtctagcaaacat | D86604 |
| 2951 | X14045 | 45555 | gaattctcaaaaatctgtactatg | U37091 | 88159 | aatagcctgctgatatgagagtat | D86604 |
| 2952 | X14045 | 45556 | ctgcagccgctggaaaacgccag | U37091 | 88160 | cttttcaaacacttcatatgtctga | D86604 |
| 2953 | X14045 | 45557 | tcccagtactagacggctgtgtca | U44795 | 88161 | cagattgccatcagaggctggagt | D86604 |
| 2954 | X14045 | 45558 | agaacatggactccaagctccagg | U44795 | 88162 | ttcatgcctttggcaaaaagtcta | D86604 |
| 2955 | X14045 | 45559 | ccgtagctgcctcctgtctgcatg | U44795 | 88163 | taagtatccaagtactgaggtag | D86604 |
| 2956 | X14045 | 45560 | gctgcctcctgtccatgcattcc | U44795 | 88164 | ttccaacttgaggagccgaagatc | D86604 |
| 2957 | X14045 | 45561 | tcctgctgcatgcattcgatgtctc | U44795 | 88165 | gaagatcagccctgctgctgaccttta | D86604 |
| 2958 | X14045 | 45562 | gcattccgtgcagtactacacag | U44795 | 88166 | aatgtcagtcttccggagccacc | D86604 |
| 2959 | X14045 | 45563 | ggtctgcagtactaccagtaggta | U44795 | 88167 | agcctgctgcacctagaagaa | D86604 |
| 2960 | X14045 | 45564 | cagtactacacagtaggtatgacaca | U44795 | 88168 | tgagacaactgtcacctggctcccc | D86604 |
| 2961 | X14045 | 45565 | atgcacactggcacgtaggacagt | U44795 | 88169 | ccattctcaaaadcgcagtctct | D86604 |
| 2962 | W89599 | 45566 | atgagcacgtaggacacgtgaatg | U44795 | 88170 | ttcaaactgccagttctctagcgtc | D86604 |
| 2963 | W89599 | 45567 | caicattggcactgtgctcactg | U44795 | 88171 | tagcgtcaccacagcattgggtctc | D86604 |
| 2964 | W89599 | 45568 | cctgtgagcaccctgctctggttc | U44795 | 88172 | caccacagcattgggtttctctcc | D86604 |
| 2965 | W89599 | 45569 | cgactccacactgctagtcctg | U44795 | 88173 | ggggttcttctccacagcatacagc | D86604 |
| 2966 | W89599 | 45570 | ctgtagctcctggatagcccaac | U44795 | 88174 | ctgtttgcctgcccgaaaagcaga | D86604 |
| 2967 | W89599 | 45571 | ggaagctacggcctgtgaagctgt | U44795 | 88175 | cttcaaattgccagaaatatgg | D86604 |
| 2968 | W89599 | 45572 | tacggcctgtgaagtgttctaggg | U44795 | 88176 | aaattgccagaaatatgggaggagc | D88792 |
| 2969 | W89599 | 45573 | tctatggactttctgctattctg | U44795 | 88177 | gaaacagccgcacttggcactggg | D88792 |
| 2970 | W89599 | 45574 | gactttcctgctatatctgtaag | U44795 | 88178 | gccagcactggcactggggcacac | D88792 |
| 2971 | W89599 | 45575 | cctgctatttctgtaaggggaaga | U44795 | 88179 | cactgggcatcacgcagctgccgt | D88792 |
| 2972 | W89599 | 45576 | gagactccacaagaaactcaagagg | AA022254 | 88180 | actcacagcgctcaagcacacg | D88792 |
| 2973 | W89599 | 45577 | tcaggtccgtcggctggggtgac | AA022254 | 88181 | gcacacgaattcactcactgatcctg | D88792 |
| 2974 | W89599 | 45578 | tggcacagatcttggaagatc | AA022254 | 88182 | gaattcactacatcgattctggaacct | D88792 |
| 2975 | W89599 | 45579 | attttgaaggatgaccgggcctg | AA022254 | 88183 | actatctgattctggaacttcagg | D88792 |
| 2976 | U04055 | 45580 | cgggcctgctctcccatgacattt | AA022254 | 88184 | gatctggaacctttcagaggtctccc | D88792 |
| 2977 | U04055 | 45581 | cctcaagcaccaacacattctgg | AA022254 | 88185 | ggaacctttcagaggtctccctag | D88792 |
| 2978 | U04055 | 45582 | caagcaccaacacattttcggtga | AA022254 | 88186 | ttcagaggtctccctataggtagtc | D88792 |
| 2979 | U04055 | 45583 | acacattttggtgataccagg | AA022254 | 88187 | gtcggagtctacaaatctgactga | D88792 |
| 2980 | U04055 | 45584 | tattttactgcatatcaccagtctg | AA022254 | 88188 | ccctgtcatgctcagttaatggtg | D88792 |
| 2981 | U04055 | 45585 | tttactgcatatcaccagtctgaa | AA022254 | 88189 | ttcatgctcagttaatggtgtgaacc | D88792 |
| 2982 | U04055 | 45586 | actgcatatcaccagtctgaaag | AA022254 | 88190 | gtgaacccagtaagcacagacagaga | D88792 |
| 2983 | U04055 | 45587 | gcatatcaccagtctggaaaaggat | AA022254 | 88191 | acagagaatccattaccaaactg | D88792 |
| 2984 | U04055 | 45588 | tatcaccagtctggaaaaggatcag | AA022254 | 88192 | cattaccaaactgcagatggcgttt | D88792 |
| 2985 | U04055 | 45589 | cgacagatctggaagatcatc | AA022254 | 88193 | caaactgcagatggcgtttatgcgg | D88792 |
| 2986 | U04055 | 45590 | gagatctggaagatcatcccaaca | AA022254 | 88194 | gctcactactgtgaaacgccagca | D88792 |
| 2987 | U04055 | 45591 | catccgcaagaaatacagcaaata | AA022254 | 88195 | acactctacctgctgtaaatgata | D88792 |
| 2988 | U04055 | 45592 | ccgaagaaatacagccaaaatca | AA022254 | 88196 | aatgataccatcaactcctga | D88792 |
| 2989 | U04055 | 45593 | caagaataccagccaaaatcattt | AA022254 | 88197 | cttcagactaatcacagcagcg | L29006 |
| 2990 | U04055 | 45594 | gaaataccagccaaaatcattttg | AA022254 | 88198 | tcacagccgtctgtcctca | L29006 |
| 2991 | U04055 | 45595 | ataccagccaaaatcattttgaggtg | AA022254 | 88199 | gtctgctccatcacagaaccca | L29006 |
| 2992 | U04055 | 45596 | ccagccaaaatcattttgaggatg | U50595 | 88200 | tccttcatcagaaccccagtctt | L29006 |
| 2993 | U04055 | 45597 | tgcagaaatctgctgctgaagaa | U50595 | 88201 | ctcatctcctttgatctggatga | L29006 |
| 2994 | U04055 | 45598 | gctgcagtcctgttccagtctt | U50595 | 88202 | ttcctttgatctggatgaaaacga | L29006 |
| 2995 | U04055 | 45599 | tctgagccatgccatgccgg | U50595 | 88203 | agtccacgtcacagggcgttgag | L29006 |
| 2996 | U04055 | 45600 | gccatgcatgcagggccgaagcct | U50595 | 88204 | gtctcacagggcgttgagccagt | L29006 |
| 2997 | U04055 | 45601 | gaagcctgatacaacagagatgac | U50595 | 88205 | gctgagccagttgaaggatttta | L29006 |
| 2998 | U04055 | 45602 | acagagatctgctgtaagcat | U50595 | 88206 | ccctactccattagtgactat | L29006 |
| 2999 | U04055 | 45603 | acaggacatcatctgcaaagcat | U50595 | 88207 | ataccatccatcctgcaaagtct | L29006 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 3000 | U04055 | ctctattcaggtcatacacaccac | 45604 | U50595 | tcctgaaagatccaactgataa | 88208 | L29006 |
| 3001 | W48026 | tgcatccgaggaaccacaacc | 45605 | U50595 | ctgataaccccgggcacacagcaa | 88209 | L29006 |
| 3002 | W48026 | tcccactttggggtcaccatgcct | 45606 | U50595 | gggcacacgcaacctcacatcct | 88210 | L29006 |
| 3003 | W48026 | actgacttcagtgctgggcagagc | 45607 | U50595 | acagcaacctactactccacgg | 88211 | L29006 |
| 3004 | W48026 | gacttcagtgctgggcagcggcct | 45608 | U50595 | acatcctcacgggtcaccagagcag | 88212 | L29006 |
| 3005 | W48026 | cggccctggagctggtctcactt | 45609 | U50595 | atgtctgcctggaagctggcct | 88213 | L29006 |
| 3006 | W48026 | ccctcggagctggtctcactttgg | 45610 | U50595 | cacgggtcaccagagcagctactga | 88214 | L29006 |
| 3007 | W48026 | ctggtcttcacttggccctctg | 45611 | U50595 | ctggcctgactcagacatcctcat | 88215 | D88793 |
| 3008 | W48026 | gcccctctttggggtcctcactgtca | 45612 | U50595 | ggatcccagttcgcacagcaggt | 88216 | D88793 |
| 3009 | W48026 | cctctttggggtcctcactgtca | 45613 | U50595 | caggttctgcacagcaggtgatcca | 88217 | D88793 |
| 3010 | W48026 | gtcactccgggtctgctcaacatca | 45614 | U50595 | tcctggtcagtttgaacgtgt | 88218 | D88793 |
| 3011 | W48026 | tcgctcaacatcagccagctgatca | 45615 | U50595 | tcaggtttgaacgctgtggtgagaat | 88219 | D88793 |
| 3012 | W48026 | aacatcagccaccgatacacaccat | 45616 | U50595 | cctttgacttcactatgagactgt | 88220 | D88793 |
| 3013 | W48026 | cactttgggtcaccatgcctgtc | 45617 | U50595 | ctatttgagactgtggtgtctgca | 88221 | D88793 |
| 3014 | W48026 | gtcaccatgcctgctcgggtgctat | 45618 | U50595 | ttttaccactgcagtaccagtagcc | 88222 | D88793 |
| 3015 | W48026 | accatggctgtcgggtctatgt | 45619 | U50595 | ttaccactgcagtaccagtagccag | 88223 | D88793 |
| 3016 | W48026 | attgcctgcggtctatagtgtc | 45620 | U50595 | gcatccagacgagaaaggcgtgt | 88224 | D88793 |
| 3017 | W48026 | tagtgtcacccctagttcaacaagt | 45621 | U50595 | gcctgcagtcccagcgcagactttt | 88225 | D88793 |
| 3018 | W48026 | tgtcacccctagttcaacaaagtagc | 45622 | AA022273 | ctgcagtccccagcgcagactttct | 88226 | D88793 |
| 3019 | W48026 | cacccctagttcaacaagtagcag | 45623 | AA022273 | agtccccagcgcagactttcttc | 88227 | D88793 |
| 3020 | W48026 | gatactgacttactgctggagagc | 45624 | AA022273 | gctcccagcgagactttccttca | 88228 | D88793 |
| 3021 | M23998 | gcccagcaactctgagtctatggt | 45625 | AA022273 | ctcccagcgcagacttttcttcttcag | 88229 | D88793 |
| 3022 | M23998 | ccagcaactctgagtctatggtat | 45626 | AA022273 | agcgcagacttctcttcagccct | 88230 | D88793 |
| 3023 | M23998 | acactaatctcagacagctctgta | 45627 | AA022273 | cgcagacttttcttcagccccgt | 88231 | D88793 |
| 3024 | M23998 | actactctgagactgacgtctgta | 45628 | AA022273 | gcagactttctcttcagccccgtt | 88232 | D88793 |
| 3025 | M23998 | ctaattccagacagtctctgtaggg | 45629 | AA022273 | cagacttttctttcagcccgttc | 88233 | D88793 |
| 3026 | M23998 | aattccagacagtctctgtagggca | 45630 | AA022273 | taccactgcagtaccagtagccagt | 88234 | D88793 |
| 3027 | M23998 | atticcagacagtctctgtagggca | 45631 | AA022273 | accactgcagtaccagtagccagta | 88235 | D88793 |
| 3028 | M23998 | tccagacagctctgtaggcagtt | 45632 | AA022273 | ccactgcagtaccagtagccagtag | 88236 | D38218 |
| 3029 | M23998 | ccagacagctctgtaggcagtt | 45633 | AA022273 | actgcagtaccagtagccagtagcc | 88237 | D38218 |
| 3030 | M23998 | tagggcagtttcctgccatgtataa | 45634 | AA022273 | ctgcagtaccagtagccagtagccc | 88238 | D38218 |
| 3031 | M23998 | agggcagttcctgccatgtataat | 45635 | AA022273 | tgcagtaccagtagccagtagccca | 88239 | D38218 |
| 3032 | M23998 | ggcagtttcctgccatgtataatata | 45636 | AA022273 | gcagtaccagtagccagtagcccag | 88240 | D38218 |
| 3033 | M23998 | cagcaactcgagctctatgtatt | 45637 | AA022273 | agtaccagtagccagtagcccaggg | 88241 | D38218 |
| 3034 | M23998 | gcaactctgagtctatggtatatcct | 45638 | AA022273 | gaactaagttctgctctgtgagaaaa | 88242 | D38218 |
| 3035 | M23998 | caactctgagtctatggtatctctct | 45639 | U52945 | gaagttactcattccacagcccccac | 88243 | D38218 |
| 3036 | M23998 | ccagctctgctgtggtgtacgagac | 45640 | U52945 | gacctactgcacatgtctgtcag | 88244 | D38218 |
| 3037 | M23998 | agctctgctgtggtgtacgagaca | 45641 | U52945 | catgtctgcagtgtggagaccag | 88245 | D38218 |
| 3038 | M23998 | gctctgtgctgtggtgtacgagacca | 45642 | U52945 | gtgctgtcagctggagaccgactc | 88246 | D38218 |
| 3039 | M23998 | aggacctaatctcagacatgctct | 45643 | U52945 | ggagacctcgtagaccctaaagcat | 88247 | D38218 |
| 3040 | M23998 | gacactaatctcagacatgctctgt | 45644 | U52945 | gacccgactcccgtaaagcattct | 88248 | D38218 |
| 3041 | W48179 | acgagcaaggctcgcgctcaagccgc | 45645 | U52945 | catcagtgaacccaacaataagtta | 88249 | D38218 |
| 3042 | W48179 | gagcaaggctcgcgctcaagccgcg | 45646 | U52945 | cagtagaaccacacaataagttatg | 88250 | D38218 |
| 3043 | W48179 | gtccgcatccagaggaacaaggccg | 45647 | U52945 | ttattaatgcacttctaccctg | 88251 | D38218 |
| 3044 | W48179 | ccgcatccagaggaacaaggccgcg | 45648 | U52945 | atgcactttctacccctgtaageg | 88252 | D38218 |
| 3045 | W48179 | gcttcgcgagagaggaagcagca | 45649 | U52945 | ttctctaccctgtaaggctgtg | 88253 | D38218 |
| 3046 | W48179 | cttcgcgagagctgaagcagcag | 45650 | U52945 | acagccccacctgtataaacagattc | 88254 | D38218 |
| 3047 | W48179 | ggaagccgtactcgtcaagctaat | 45651 | U52945 | gcccactgtataaacagattctaa | 88255 | U63337 |
| 3048 | W48179 | gaagcgtactcgtcaagctaatg | 45652 | U52945 | atcctaaatctgtatgcagggaaa | 88256 | U63337 |
| 3049 | W48179 | aagccgtactcgtcaagctaatgg | 45653 | U52945 | attgaagacactatctttacctg | 88257 | U63337 |

| SEQ ID NO | sequence | DBAxnID | SEQ ID NO | sequence | DBAxnID | SEQ ID NO | sequence | DBAxnID |
|---|---|---|---|---|---|---|---|---|
| 3050 | agccgtacttcgtcaagctaatgg | W48179 | 45654 | gtcatagacctgatgatgttcctga | U52945 | 88258 | caccaatgagccaggttcctagcct | U63337 |
| 3051 | gccgtacttcgtcaagctaatgga | W48179 | 45655 | cagttccagctaaggcgcactaatgc | U52945 | 88259 | ttcctttgaagctcagttcttga | U63337 |
| 3052 | ccgtacttcgtcaagctaatggga | W48179 | 45656 | ggcctagtgacctctactgacatg | U52945 | 88260 | ttggaagtcagttctgagtgtc | U63337 |
| 3053 | tcagccgcagcagtctgcatccgt | W48179 | 45657 | cttagtgacctctactgacatgc | U52945 | 88261 | ttcttgagttcagagaggcctcat | U63337 |
| 3054 | cgtacttcgtcaagctaatggat | W48179 | 45658 | cctgcatactagacctcctcttta | U52945 | 88262 | ttgccgtcctccctgagacagg | U63337 |
| 3055 | gagcagctcgtcgtcgcatccagaga | W48179 | 45659 | agtagctctagctcctaaacatcc | L37297 | 88263 | tcctcctgagacgcagtcagatgcag | U63337 |
| 3056 | agcagctcgtcgtcgcatccagagga | W48179 | 45660 | tcataatcttcaaacacattggta | L37297 | 88264 | agcaggatgcggccaggagacat | U63337 |
| 3057 | cagctcgtcgtcgcatccagaggaa | W48179 | 45661 | tcttccaaccacattggtattact | L37297 | 88265 | tgccatgcacttggattttgt | U63337 |
| 3058 | agctcgtccgatccagaggaacaa | W48179 | 45662 | aaccacattggtattacctgcgtg | L37297 | 88266 | ctgtcccagtgtcgttaatat | U63337 |
| 3059 | ctcgtccgcatccagaggaacaagg | W48179 | 45663 | aggacgaaccctgtagacctcctgc | L37297 | 88267 | ctgttcatcggttcacagggcaa | U63337 |
| 3060 | tcgtccgcatccagaggaacaagc | W48179 | 45664 | gaaccttagtgactctgctctctg | L37297 | 88268 | atcaggttcacagggcaaggagaa | U63337 |
| 3061 | cgtccgcatccagaggaacaagcc | W48179 | 45665 | ctctctgcctagtcaatgcgaacacc | L37297 | 88269 | gcaatcttactgtttctggtctg | U63337 |
| 3062 | cattgactccagcattggagagtt | W48179 | 45666 | gcctagtcactgtgaccaccaaatgc | L37297 | 88270 | tactgttttctggtgctgactgct | U63337 |
| 3063 | gatcatcaattctgggcactcgat | M64863 | 45667 | tcactgtgaccaccaaatgccccttt | L37297 | 88271 | tttctcggtcgtgactgctacaccc | U63337 |
| 3064 | ggcctgtcgtcgcagaggtttgac | M64863 | 45668 | caaatgcccccttacctaccagat | L37297 | 88272 | tacaccaggaacttgccctcacta | U63337 |
| 3065 | caaacagctgcccgtctctgtgggt | M64863 | 45669 | tcacctgtgaggcctatagagag | L37297 | 88273 | caggactgccctcactaagcaaa | U63337 |
| 3066 | tctgatcgaccctttcaaagtgaaa | M64863 | 45670 | tctagtccaaaacatccatacct | L37297 | 88274 | tttgccctcactaagcaaatgacc | U63337 |
| 3067 | aatcacagtcgcgaacaatgggaag | M64863 | 45671 | cattgctcctctgctgggcct | L37297 | 88275 | ggctccattggacatcccagtaccc | U60328 |
| 3068 | tagcaactcagaggccgaatctaacg | M64863 | 45672 | tcctgcttaccctctatctgaaac | L37297 | 88276 | attggacatcccagtaccgatcca | U60328 |
| 3069 | gccgaatctaacgctccgatccat | M64863 | 45673 | ctgaaacctaatgattcttccag | L37297 | 88277 | gatacctcgatagaggatgggaat | U60328 |
| 3070 | tctaacgtccggatccatgcctg | M64863 | 45674 | ttgattcttcaagccaagttcaa | L37297 | 88278 | taatttggcgtctgtccaggaa | U60328 |
| 3071 | ccaatcttagagtgcctccaacaa | M64863 | 45675 | agagccaaagtcctgcccacatcag | L37297 | 88279 | tggcgtcgtccaggaaaagttg | U60328 |
| 3072 | ttagagtgcctccaacaatcctcc | M64863 | 45676 | ctgccacactagttcactactcataat | L37297 | 88280 | gctgatgaaccaacttcaccaccaag | U60328 |
| 3073 | tctactgtcagcaatgaagggtga | M64863 | 45677 | acatcagttcactcattaatttcaa | L37297 | 88281 | aggttccacacgacgatctcaccag | U60328 |
| 3074 | caatctgcgggcagtcatcacagat | M64863 | 45678 | acttcaacacagtgaacaacattga | L37297 | 88282 | ccacacgagatctcaagatactc | U60328 |
| 3075 | ggaccagcagatcggttatgcct | M64863 | 45679 | tcaacacactgaacaacattgatgt | L37297 | 88283 | caaagcagcaagcagccccacgtg | U60328 |
| 3076 | tatgccgagcgttctagatcca | M64863 | 45680 | gaattcatgaacattggagttcag | L37297 | 88284 | gtaccaggagatccgtctgatggtc | U60328 |
| 3077 | tgagcgttctagatccaacagga | M64863 | 45681 | aagagactggctgctactcaaagtt | L37297 | 88285 | aaatgcttatgctgtgttatgac | U60328 |
| 3078 | aacaggaagccatctcattacaccc | M64863 | 45682 | agactggctgctactcaaagttgtg | L37297 | 88286 | gcaaggctaaaacctgagatcaag | U60328 |
| 3079 | ctcggagctgtcccgatcgtgtc | M64863 | 45683 | ctggctgctactcaaagtgtgggag | L37297 | 88287 | cctaaacctgagatcaaggatgtc | U60328 |
| 3080 | agctcggagctgcccgatcgtgtga | M64863 | 45684 | gatttagccatggtgtaggtgaaaa | L37297 | 88288 | gcaactcaatccaatctgcact | U60328 |
| 3081 | ggagctcttatctcatcggcctg | M64863 | 45685 | ttagcaacagttcgacagtaga | L37297 | 88289 | gcaactccatcggtcactacctg | U60328 |
| 3082 | ttttcagggccaacatggcaagaag | M48222 | 45686 | gagactcccagtttcgtggaatgt | L37297 | 88290 | ggtcactacctggttgcagctacag | U60328 |
| 3083 | ttcagggccaccatggcaagaagta | W48222 | 45687 | actccatgtgtgaagttat | L37297 | 88291 | gttcagctacagataccggatagggat | U60328 |
| 3084 | agaagtccgatctttctggtcggag | W48222 | 45688 | tttgtcatgccatgtacaacact | L37297 | 88292 | gctctggggcagcagatgatgaag | U60328 |
| 3085 | tctttctggtcggaggaagaaatct | W48222 | 45689 | gtcatactagttcatacaacactatt | L37297 | 88293 | gcagctatgaaggccgttagggcca | U60328 |
| 3086 | gaaatctctagttcggtctcggtc | W48222 | 45690 | acacactgaacaacatgcatggat | L37297 | 88294 | gcgctaggcccattggctgctgaac | U60328 |
| 3087 | aatcctagttcggtctcggtctcca | W48222 | 45691 | gacaagacccatcctgtctgtcagc | L37297 | 88295 | aagcttgctctgctgctgttg | U60328 |
| 3088 | tctagttcggtctcggtctcca | W48222 | 45692 | accatctgtcctgtcttccct | L37297 | 88296 | ctggcctgctcgtttgttaagc | U60328 |
| 3089 | tagttggtctcggtctccacgag | W48222 | 45693 | catctgctcctgtcttccctag | M72394 | 88297 | atggattaccggcctggtgcatg | U60329 |
| 3090 | tggttcctccacgagaggaag | W48222 | 45694 | aaccccagttgtaattctgtgctg | M72394 | 88298 | tacgggcctgggcatagcgag | U60329 |
| 3091 | ttcggtccacgaggaagcctg | W48222 | 45695 | ctgtgaatttcgtgtgtaggatga | M72394 | 88299 | gcctgggcagcgagatgagag | U60329 |
| 3092 | cggtctccacgagagaagcctgaa | W48222 | 45696 | aatttctgcctgggatcaagc | M72394 | 88300 | gcagctatgggggcgttagggcca | U60329 |
| 3093 | gaatggcagctccagttccaaca | W48222 | 45697 | atgatcaagccattgaattccatg | M72394 | 88301 | gcgggctaggcagggtgctgaac | U60329 |
| 3094 | caggcatggtccaagaagtagt | W48222 | 45698 | gttcactctgatcaataagtgcca | AA023187 | 88302 | ctgaggcctctactgctgcgtt | U60329 |
| 3095 | gccacatggccaagaagtagtggat | W48222 | 45699 | ataagtccaaagtcccaaggatct | AA023187 | 88303 | gcttctatgctgagcttatcata | U60329 |
| 3096 | gataggctcgggtgtcctgtgcc | W48222 | 45700 | atttcacagacgtcaatggatcat | AA023187 | 88304 | gagcttttcatatcatcagcagca | U60329 |
| 3097 | gtcctggtcgccgtaatgcgaga | W48222 | 45701 | atgggatcattatcccacacagt | AA023187 | 88305 | tatcatatcagcagcaactaga | U60329 |
| 3098 | tccctggtccgtcctaatgcgaga | W48222 | 45702 | ggatcattatcccacagcagtcg | AA023187 | 88306 | atcatcagcagcaactagaagaaa | U60329 |
| 3099 | tgcctggtccgcctaatgcgaagtccg | W48222 | 45703 | ccacagcagtcggctctatctc | AA023187 | 88307 | gtcgactccaaagaagaagtgca | U60329 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 3100 | W48222 | gtgccgctaatgcgagaagtcgat | 45704 | W48222 | cagtcggtgtctattctcttaggt | 88308 | AA023187 | gtaatcacatgatccagcacctga | U60329 |
| 3101 | W48222 | cgagaagtccgatcttctgctgcg | 45705 | W48222 | tcggtgctctatctctaggtgag | 88309 | AA023187 | atccagcaactgatcccaagattg | U60329 |
| 3102 | W48073 | atgcctgtatacactgctgacgt | 45706 | W48073 | ttccatatagccctgctgaggga | 88310 | AA023187 | atcccaagattgaggatggaaatg | U60329 |
| 3103 | W48073 | cgcctgatacacgctgacgtcg | 45707 | W48073 | catatatagccctgctgaggaaga | 88311 | AA023187 | gcttccgacaacaatccaagt | U60329 |
| 3104 | W48073 | tgaccgtcgcactgcagtccgtcg | 45708 | W48073 | aagtgtccggtgtagcgtacgt | 88312 | AA023187 | cagacaaccattccaagtactyct | U60329 |
| 3105 | W48073 | accgtcgcactgcagtccggctact | 45709 | W48073 | atatctgcttaatggattgagtg | 88313 | AA023187 | tactttccagaacgaggggatgctg | U60329 |
| 3106 | W48073 | cctgtcgcactgcagtccggctacg | 45710 | W48073 | gccaaagtcccaaggatctccaat | 88314 | AA023187 | gacaccatgtaatggattaccggg | U60329 |
| 3107 | W48073 | gtcgcactgcagtccggctactgc | 45711 | W48073 | gcaactccactggcatttgcc | 88315 | AA023187 | tgtaccggttgacctgcaacgactg | AA108790 |
| 3108 | W48073 | tcgcactgcagtccggctactgct | 45712 | W48073 | aaagtcccaaggatcttcacatgga | 88316 | AA023187 | accggttgacctgcaacgactgcg | AA108790 |
| 3109 | W48073 | aaggcggaacttccaaggcatctctc | 45713 | W48073 | gtccaaggatcttcacatgacca | 88317 | AA023187 | acgacagctgcccacagagcgcat | AA108790 |
| 3110 | W48073 | tccaaggcatctccggagcgaag | 45714 | W48073 | atcttcacatggaccacgctccac | 88318 | AA023187 | acagctgcccacagagcgcatcct | AA108790 |
| 3111 | W48073 | tctccggagcgaagctatgctgacg | 45715 | W48073 | ttcacatgaccacgctccacggg | 88319 | AA023187 | ggcccacagagcatccttcalgt | AA108790 |
| 3112 | W48073 | cgaagtcatgctgactcatctgtg | 45716 | W48073 | accttgagcctatttcacagacgt | 88320 | AA023187 | ccacagaggcatcctcatgtcc | AA108790 |
| 3113 | W48073 | agctatgctgacgtcatctgtgca | 45717 | W48073 | tttgagcctatttcacagagcnaa | 88321 | AA023187 | tgtccagacgactgtcagcagtc | AA108790 |
| 3114 | W48073 | gcctgtatacactgctgaccgtgc | 45718 | W48073 | gagcctatttcacagacgtcaatgg | 88322 | AA023187 | ccacagacgactgtcagcagcgtc | AA108790 |
| 3115 | W48073 | gctatgctgacgtcatctgtgcca | 45719 | W48073 | ccgtcctgcaaacttgcttgc | 88323 | AA023187 | cagagacgctcagcagtcgtccca | AA108790 |
| 3116 | W48073 | tgtatacactgctgcgtgcaca | 45720 | W48073 | tcctctgcaaactgtcgttgcaca | 88324 | AA023187 | acgactgcagcagtgtcccagca | AA108790 |
| 3117 | W48073 | tatacactgctgaccgtcgcactgc | 45721 | W48073 | gcatgtccactaggtacgtgagcac | 88325 | AA023187 | ttacctgcaacaccaattcccacaa | AA108790 |
| 3118 | W48073 | atacactgctgaccgtcgcactga | 45722 | W48073 | tgtccactaggtacgtgagcaccgt | 88326 | AA023187 | ggaactgtcctcgcgcatcacga | AA108790 |
| 3119 | W48073 | acactgctgaccgtcgcactgagt | 45723 | W48073 | aggccacacagcacggaccagatgc | 88327 | AA023187 | tgacctgcaacgactgccgaactat | AA108790 |
| 3120 | W48073 | ctgctgaccgtcgcactgacgtccg | 45724 | W48073 | ccacacagcacggaccagatgccta | 88328 | AA023187 | cctgcaacgactgccgaactatgac | AA108790 |
| 3121 | W48073 | tgctgaccgtcgcactgacgtccgg | 45725 | W48073 | gaccagatgctatccaggtgtgcg | 88329 | AA023187 | cgcaatgcacagcacttatcga | AA108790 |
| 3122 | W48073 | ctgaccgtcgcactgacgtccgt | 45726 | W48073 | cagtcactcatgccgaagtacaa | 88330 | AA023187 | aatgcacagcacttatcgacca | AA108790 |
| 3123 | W48073 | ttaaaggatgccatgctacagg | 45727 | X01237 | ctcactcatgccgaagtactga | 88331 | AA023187 | ccatccacaggtcacgacagctg | AA108790 |
| 3124 | X01237 | gatgccatgctacagaggtctg | 45728 | X01237 | actctcatgccgaagtacatgga | 88332 | AA023187 | tccacacaggtcacgacagctgcc | AA108790 |
| 3125 | X01237 | ctggcccagtgaaattctatccage | 45729 | X01237 | catggcccgaagtacatgagccgt | 88333 | AA023187 | aggtgcacagacagtggccacaga | AA108790 |
| 3126 | X01237 | aatttcatccagccagttgttgac | 45730 | X01237 | tacatgagccctgaaacctgtgg | 88334 | AA023187 | tgcacgacagctgccacagagcg | AA108790 |
| 3127 | X01237 | gttggacctggcacctacaactgaa | 45731 | X01237 | cggtcctccacacagaacgccagga | 88335 | AA023187 | gccttcaaggctcatcgtgctca | AA108790 |
| 3128 | X01237 | cctgcaccaatgaaatctca | 45732 | X01237 | tccaacagaaagccaggcatgattagg | 88336 | AA023187 | gccttcaaggctcatcgtgctcag | AA108814 |
| 3129 | X01237 | cactcacaaatgaaatctcacctac | 45733 | X01237 | atgtaggccaccgcacgcgtgta | 88337 | AA023187 | agcaaccgcacgttggagttctccg | AA108814 |
| 3130 | X01237 | tctatcttggccctcatagggtcc | 45734 | X01237 | gcaccgctgtaacagccggacag | 88338 | AA023187 | gcaaccgcacgttggagttctccga | AA108814 |
| 3131 | X01237 | cctcatagggtccatatctccagg | 45735 | X01237 | ctgtaacagccgcgaccaggaaat | 88339 | AA023187 | ttggagtccgaaatttgctgt | AA108814 |
| 3132 | X01237 | cttcctccattcgcaagcctg | 45736 | X01237 | agctgaagcgccatgctccactag | 88340 | AA023187 | gagttcgcgaaatttgctggg | AA108814 |
| 3133 | X01237 | ttccattcgcaagcctgctgca | 45737 | X01237 | tgaagcgccatgtccactaggta | 88341 | AA023187 | tctccgaaatttgctgtggggaaaa | AA108814 |
| 3134 | X01237 | tccagctacctgaagacaagaagg | 45738 | X01237 | agcgccgcatgtccactaggtacgt | 88342 | X85802 | gttccagcatttgaaggtttatgg | AA108814 |
| 3135 | X01237 | tacgctacctgaagacaagaaggccagt | 45739 | X01237 | gggcttcagccacattcaaaataag | 88343 | X85802 | aagtacgccaaaggcgaagctaaca | AA108814 |
| 3136 | X01237 | tccttgctgtattgactcagg | 45741 | X01237 | tctttgacactttaaagagtctg | 88344 | X85802 | aagtacgccaaaggcgaagctacagt | AA108814 |
| 3137 | X01237 | ctgtctattgactccagggctgaga | 45742 | X01237 | tcatgctcggtcaccaagctgcc | 88345 | X85802 | gtacgccaaaggcgaagctacagt | AA108814 |
| 3138 | X01237 | tatgactctcaggggctgagacacaat | 45743 | X01237 | tctggtcaccaagctgcccagaa | 88346 | X85802 | tacgccaaaggcgaagctacaggtg | AA108814 |
| 3139 | X01237 | ttttactctgtagctaggggtcg | 45744 | X01237 | ctcagaacccattgctctctcct | 88347 | X85802 | ctcaaggtcatcgctgctcagta | AA108814 |
| 3140 | X01237 | tctctagtagtgctggtcccgaa | 45745 | X01237 | ttgaccccagatgtccagatgtt | 88348 | X85802 | aaggctcatcgctgctcagtacagc | AA108814 |
| 3141 | X01237 | tctctgctggcccagcgaattcta | 45746 | X01237 | ccagatgcccagatgttgccagtg | 88349 | X85802 | cgctcagtacagcggggcatca | AA108814 |
| 3142 | W48081 | cataatttccgaaatccccagtgtgc | 45747 | W48081 | tgtccctgtcttcgtctgtc | 88350 | X85802 | ctcagtacagcgggggcatcaggtcc | AA108814 |
| 3143 | W48081 | aatttccgaaatccccagtgtgc | 45748 | W48081 | cttccctcctatggagtgatag | 88351 | X85802 | tcagtacagcgggggcatcaggtccg | AA108814 |
| 3144 | W48081 | ttcttcgccccgaccccatag | 45749 | W48081 | ttctttcactgtttatctacaga | 88352 | X85802 | ttgggcaaagcaacccgcacgtgga | AA108814 |
| 3145 | W48081 | tttctgccccgaccccatatctga | 45750 | W48081 | gattcaacactgcactaagggggaa | 88353 | X85802 | gggcaaagcaacccgcacgtggagt | AA108814 |
| 3146 | W48081 | ccctgacctgccatagtcactctga | 45751 | W48081 | tcaaactgcactaagggggaaatg | 88354 | X85802 | caaagcaacccgcacgttggagtct | AA108814 |
| 3147 | W48081 | tgacctgccatagtcactctgatac | 45752 | W48081 | atctgactcgttgctcaatgaggtttattc | 88355 | X85802 | accaaagccagatgcagactgagtg | AA108814 |
| 3148 | W48081 | cctgcatagtcactctgatacct | 45753 | W48081 | ctcgttgctcaatgaggtttattg | 88356 | X85802 | gatggtcccacttcaagaagcgca | U60330 |
| 3149 | W48081 | gccatagtcactctgatacctgag | | | cactcctgccagcagtagacacagggac | 88357 | X85802 | gaggatctgccgcactgtcacag | U60330 |

TABLE 1-continued

| SEQ ID NO | DBAxnID | sequence | SEQ ID NO | DBAxnID | sequence | DBAxnID |
|---|---|---|---|---|---|---|
| 3150 | W48081 | atagtcactctgatacctgagcc | 45754 | X85802 | cagtacaggcacagccaagccac | 88358 | U60330 | gactatgccgcactgcacgaga |
| 3151 | W48081 | gtcactctgatacctgagcccaa | 45755 | X85802 | aagccaccataggccagccggagt | 88359 | U60330 | tatcgccgcactgcacgagatig |
| 3152 | W48081 | actctgatacctgagcccaagtc | 45756 | X85802 | ccataggccagcctgagtctttt | 88360 | U60330 | gaatacatcagcctccggtcatca |
| 3153 | W48081 | ctccgcgtctctggcttccacaca | 45757 | X85802 | gccagcctgagtctttcatgct | 88361 | U60330 | agcctccgctcatcatccagagc |
| 3154 | W48081 | ctgcgtcttggcttccacacce | 45758 | X85802 | tcttttcatgctgagtccacccaa | 88362 | U60330 | aatcagtatgtcactctccatgaca |
| 3155 | W48081 | ttccgaatccagtgctgctgtgat | 45759 | L43567 | tatgcaaatcctcgaatctacatg | 88363 | U60330 | tatgtcactctccatgacatgatcc |
| 3156 | W48081 | cgaaatccagtgctgctgtgatccc | 45760 | L43567 | gcaaatcctcgaatctacatggta | 88364 | U60330 | actctccatgacatgtcctgaaaa |
| 3157 | W48081 | aatccagtgctgctgtgatccctt | 45761 | L43567 | cacaggacctcaccatggatggag | 88365 | U60330 | aagatcaaacgcccccggagcagca |
| 3158 | W48081 | tgcctgaacgcgggaacatctcatt | 45762 | L43567 | aggacctcaccatgggatggagctg | 88366 | U60330 | acacgtactggggccaggccagg |
| 3159 | W48081 | ggaacatccatctcctggagcct | 45763 | L43567 | acctcaccatgggatggagctgtat | 88367 | U60330 | ggtccacttacaagaagcgcaggt |
| 3160 | W48081 | acatctccatctcctggagcctct | 45764 | L43567 | tccaacgcaggagtcaggacctga | 88368 | U60330 | gtgttttgatgccaatggagttga |
| 3161 | W48081 | tctcatcctcggagcctcttct | 45765 | L43567 | gatacaaattctactagtctgtat | 88369 | U60330 | tttgtgatgccaatggagttga |
| 3162 | W48081 | cattctcctgagcctcttctgc | 45766 | L43567 | cggtctatactgtgcaagatcggcta | 88370 | U60330 | gtaaaaccgagattcggctgctgta |
| 3163 | W48081 | ccaacaagcaactcaagctacggg | 45767 | L43567 | tctatactgtgcaagatcggccta | 88371 | U60330 | gagattcggctgctgatcgagaaat |
| 3164 | W48081 | agcaactcaagctacgggggcctat | 45768 | L43567 | attactgtgcaagatcggcctacta | 88372 | U60330 | ctgttgattccagaatagaagatg |
| 3165 | W48081 | cagtcagctgacactcaggatacg | 45769 | L43567 | gtgcaagatcggcctactactgatta | 88373 | U60330 | gatactttcgaccagatttcta |
| 3166 | W48081 | tcagctgacactcaggatacggcc | 45770 | L43567 | caagatcggcctactactgattacga | 88374 | U60330 | atagctaaaataccccatggggagg |
| 3167 | W48081 | gctgacactcaggatacggccaga | 45771 | L43567 | aatcctcgaatctacatacagtaaat | 88375 | U65313 | acctccacgaggtgggcatgacacag |
| 3168 | W48081 | tcaggatacggccagagcagtag | 45772 | L43567 | tgagatcacagttctcttctacagt | 88376 | U65313 | aggtacgcttcaaggagacagcgtcg |
| 3169 | W48081 | gggatacggccagagcagcctagggt | 45773 | L43567 | gatcacagttctctacagttact | 88377 | U65313 | gacacagcctttttgatcattctt |
| 3170 | W48081 | tacggccagagcagctatggttctt | 45774 | L43567 | agttcctccacagttactgagcac | 88378 | U65313 | acagcctttgatcattcttga |
| 3171 | W48081 | agctatggttctttatgacagca | 45775 | L43567 | tctctcacagttactgagcacaca | 88379 | U65313 | ttgatcatttcttgatgtgaaaag |
| 3172 | W48081 | tatggttctttatggacagacc | 45776 | L43567 | ctctacagttactgagcacacagga | 88380 | U65313 | atcatttcttgatgtgaaaagcat |
| 3173 | W48081 | tctttatggacagaccaaaaact | 45777 | L43567 | agttactgagcacaaggacctcac | 88381 | U65313 | gcatcttgttatcagttaaatt |
| 3174 | W48081 | tcttatgacagaccaaaactact | 45778 | L43567 | tgagcacacagagaccctccaccac | 88382 | U65313 | cattattccccaattcacaacag |
| 3175 | W48081 | gggctactccacagagagcagtcag | 45779 | L43567 | ctcacgcatgtcatattagtcc | 88383 | U65313 | ttcccaatttcacaacaggattca |
| 3176 | W48081 | ctccaacagagcagtcagcctgcctat | 45780 | AA023244 | cacgcatgtagtccattagtctt | 88384 | U65313 | aattcacacaggatltcatattgtaa |
| 3177 | W48081 | ccaacagagagcagtcagcctatggc | 45781 | AA023244 | gctttcactcgaggcagtccagag | 88385 | U65313 | ttcaacacaggattcatatgttaa |
| 3178 | W48081 | acagagagcagtcagccctatggcccaac | 45782 | AA023244 | ttcactcgaggcagtccagagac | 88386 | U65313 | tatctaaactgtctacaacaaaat |
| 3179 | W48081 | gagcagtcagccctatggccaacag | 45783 | AA023244 | tcactcggaggcagtccagagaca | 88387 | U65313 | gcttcacaggagacagcgtcgttgaag |
| 3180 | W48081 | cagtcagccctatggccacagagtt | 45784 | AA023244 | gcagtcagagacaaccactctgtt | 88388 | U65313 | caggagagcgcgtgaagtcccac |
| 3181 | W48081 | tcagccctatggccaacagagtaca | 45785 | AA023244 | tccagagacaaccactctgtctcg | 88389 | U65313 | gaagtccactgtggccagtttg |
| 3182 | W48081 | ggccagtcagtgacactccagagat | 45786 | AA023244 | cagagacaaccactctgtctcgga | 88390 | U65313 | ttggcagtttggcagtgtgaccta |
| 3183 | W48081 | gccatctgctgagcaatgatgt | 45787 | AA023244 | gagacaaccactctgtctcgaccgc | 88391 | U65313 | gtggtacctaactactgtgtttgc |
| 3184 | W48081 | gccagacttaagtctcttctcac | 45788 | AA023244 | accactctgtctcgaccgccctgg | 88392 | U65313 | cctaactcatcgtgtttgcatttctt |
| 3185 | W48081 | atgatcgtttcctgagggaca | 45789 | AA023244 | ctgtctcgaccgccgaactgc | 88393 | U65313 | tcatcgtttgcatlcttgttaag |
| 3186 | W48081 | tggcagtctttttcatgtagt | 45790 | AA023244 | tgtagtccatttagtctgcagttt | 88394 | U65313 | tgtgacacgcctttttgatcatt |
| 3187 | W48081 | ttagtctggcggaggcagctgctgtgat | 45791 | AA023244 | tagtccattagtcctgcagtt | 88395 | AA108891 | cacaacttagccaacggagaagca |
| 3188 | W48081 | agccatgtcgacctgctgcct | 45792 | AA023244 | tagtccatttagtcctgcagttt | 88396 | AA108891 | caacttagccaacgagaagcage |
| 3189 | W48081 | gtctgacctgctgtggccatagggcc | 45793 | AA023244 | gtccatttagtctgcagttca | 88397 | AA108891 | atttgcttcctgtctaatcctgc |
| 3190 | W48081 | ggtgcctagggcctagtggccct | 45794 | AA023244 | ccaatttagtctgcagttcact | 88398 | AA108891 | ttgctcctgtctaatcctgcta |
| 3191 | W48081 | ctgctagcctggagcgctgag | 45795 | AA023244 | ttagtctgcagttcactggga | 88399 | AA108891 | ttcctgtctaatcctgtcaatgag |
| 3192 | W48081 | agccctgtgaggctgaggtcga | 45796 | AA023244 | tcctgcagtttcactggaggca | 88400 | AA108891 | cctgtctaatctgtcaatgagaa |
| 3193 | W48081 | actggaggccttctaactgtcat | 45797 | AA023244 | ctgcagttttcactcgggaggcgt | 88401 | AA108891 | gctaatctgtcaatgagaaca |
| 3194 | W48081 | ctaactgtcatattcaaatagcgac | 45798 | AA023244 | cagtttttcactcggggaggcgtccag | 88402 | AA108891 | gtctaatctgtcaatgagaaca |
| 3195 | W48081 | tctctcctcccacgtgcagtga | 45799 | AA023244 | ctattgtcacataaggttaccaag | 88403 | AA108891 | tcgtcaatgagaacacccgaaggc |
| 3196 | W48081 | attaatgccaacgtctaactg | 45800 | D21850 | tcacataaacgttaccatggaaact | 88404 | AA108891 | gtcaatgagaacaccccgaaggccataga |
| 3197 | W48081 | gatcacacttaagtatgacacgga | 45801 | D21850 | ctggtgccaaagaccaatcatcaga | 88405 | AA108891 | atgagaacaccctgaaggcataga |
| 3198 | W48081 | tgaacatttctaactcaggaccgaga | 45802 | D21850 | ctgcaaagaccaatcagattcagt | 88406 | AA108891 | acacctgaaggcataggaaggcat |
| 3199 | W48081 | aatcaaaattcgctcgcagactt | 45803 | D21850 | aagaccaatcagattcagtaatgc | 88407 | AA108891 | acttagccaacgagaagcagcac |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3200 | aattctgtctcggcagactccctt | L22144 | 45804 | aatcctgggtcattgctcggctat | D21850 | 88408 | tttagccaacggagaggcagcacca | AA108891 |
| 3201 | gctccgcagactctcccttcagga | L22144 | 45805 | ggtcattgctcggctatcttcat | D21850 | 88409 | caaatgatgccggctgatcacaa | AA108891 |
| 3202 | cagacttctccttcaggatgatcg | L22144 | 45806 | tttgctcggctatcttcatgaacc | D21850 | 88410 | atgacaggaggtgccagcctgcc | AA108891 |
| 3203 | tatgcccaattcctcaattgttaat | U09928 | 45807 | gaaacgtgctgcactgagaatcct | D21850 | 88411 | ctgccctaggactgacagtgctt | AA108891 |
| 3204 | cattcctcaattgttaattgctcc | U09928 | 45808 | tgccaccagcctgagagtcctgtg | D21850 | 88412 | tgaggcacttcattgcttcctg | AA108891 |
| 3205 | caaagccaactgcgatgaggaaggac | U09928 | 45809 | cagcctgagagtcctgtcagaga | D21850 | 88413 | aggacacttcattgcttcctgtc | AA108891 |
| 3206 | gaaggactcggctttggcataaa | U09928 | 45810 | ctgattctgactcacactacc | D21850 | 88414 | tcattgcttcctgtctaatctcg | AA108891 |
| 3207 | aggtctgcagacagcagcagagac | U09928 | 45811 | ccactcaagatcaacttcagacgt | D21850 | 88415 | ccctatactggggagacacagatg | AA108891 |
| 3208 | agctgggctaccgagagactgcc | U09928 | 45812 | caagatccactctcagaagtcaacc | D21850 | 88416 | cctactccatggccagacagtcaa | U65593 |
| 3209 | gctacctgagagactgtcccagaaa | U09928 | 45813 | caaccgcactctgctgcaaagag | D21850 | 88417 | tggatctctcccaactgctcgcca | U65593 |
| 3210 | ccaacaacctcctatgcatataa | U09928 | 45814 | atccaacactcactgaatgcaaaag | D21850 | 88418 | caactgctgccagctaggctgcac | U65593 |
| 3211 | accttcctatgcatatagatgtc | U09928 | 45815 | gatctacactgcccgctgtgac | D21850 | 88419 | gctgcaccgtggccaactagtgct | U65593 |
| 3212 | agatgtctcagtgtcttatcatta | U09928 | 45816 | ccccgtctgtgacgtccttagg | D21850 | 88420 | ccgtgggccaactagctataggcctg | U65593 |
| 3213 | gtctttatcattaaacaccaagcag | U09928 | 45817 | ctgtgacagctccttagggaaag | D21850 | 88421 | gccaactagtatagcctgggtgct | U65593 |
| 3214 | atcattaaacaccaagcaggactgc | U09928 | 45818 | ggatcactgtgtgccaaagacca | D21850 | 88422 | tgtccagtcgagacagctgatgaa | U65593 |
| 3215 | ttgctgggcctggcctggctagct | U09928 | 45819 | aggtgtccactcgacatccagctg | D21850 | 88423 | aacatctgggctccctacaggtgct | U65593 |
| 3216 | tcattaaacaccaagcaggactgct | U09928 | 45820 | gtgtccactctcgacatcagctgct | D21850 | 88424 | tgggctccctcatcagggtcgtgcaa | U65593 |
| 3217 | tgggctggctagccaggccaaatgt | U09928 | 45821 | gaaactgtacagcagaagtcaggc | D21850 | 88425 | tgagtcagctgacgcgcaaacgtgt | U65593 |
| 3218 | taaatgttgttctcgtgccca | U09928 | 45822 | actggtaccagcagaagtcaggcac | D21850 | 88426 | atgcgctctgggaacaaatcgca | U65593 |
| 3219 | cttgtttctgtctgtgcccaaaga | U09928 | 45823 | gattatgacacatccaaactggct | D21850 | 88427 | ccatggccagaacagtcaatctgat | U65593 |
| 3220 | tctccgtctgcccaagaaaaggca | U09928 | 45824 | tttatgacacatccaaactggctc | D21850 | 88428 | gaacaaatcgcattccaagagtag | U65593 |
| 3221 | aaaggcaggctccgtgtgggaagt | U09928 | 45825 | ttatgacacatccaaactggctc | D21850 | 88429 | agtcaatctgatcctctcgtgtg | U65593 |
| 3222 | aggctccgtgtggaagtcacaga | U09928 | 45826 | atgacacatccaaactggctctgg | D21850 | 88430 | ctgtgcgagcaaggagagaacca | AA108925 |
| 3223 | agccccaagccaactggcgatgag | U09928 | 45827 | cttattactgccagtgggagcag | D21850 | 88431 | ctgagctaccacaaaatggcgt | AA108925 |
| 3224 | cgcgtgcacatgggactagag | U09928 | 45828 | ttattactgccagtgcaagtgcag | L43568 | 88432 | gcgagcctcattactgcaagtalga | AA108925 |
| 3225 | tctgcactgggactagaggctttct | U09928 | 45829 | actgccagcagtggaggcagtaacc | L43568 | 88433 | gagtccgatacttcgcaaagccac | AA108925 |
| 3226 | accagacacatcacactggatt | U50413 | 45830 | ctgcacagcagtgagccagtaaccca | L43568 | 88434 | aagccactgtcaagggctaccagtg | AA108925 |
| 3227 | acacaactcacactggattattcc | U50413 | 45831 | agaaggtcaccatgacctgcagtgc | L43568 | 88435 | cactaggcagaggtgggtggatct | AA108925 |
| 3228 | catcacactggattattcctt | U50413 | 45832 | gaaggtcaccatgacctgcagtgc | L43568 | 88436 | taaactataatcaaccaattaatgct | AA108925 |
| 3229 | tatcagagacgccgcgtcgctcacg | U50413 | 45833 | aggccaccatgacctgcagtgcag | L43568 | 88437 | aactataatcaaccaattaatgct | AA108925 |
| 3230 | ggtcgtcacgcaggcagcacttg | U50413 | 45834 | gtgccagctcaagtgaagttacatg | L43568 | 88438 | ttcaacacacaaaaggacgaccat | AA108925 |
| 3231 | tctgctcacgcaggcacacttgaga | U50413 | 45835 | tgccagctcaagtgtaagttacatg | L43568 | 88439 | ttacacttattacccactatccat | AA108925 |
| 3232 | acatgatgcagctgctgtcggagga | U50413 | 45836 | acatgatgccagctacccagaagtc | L43568 | 88440 | tacacttattaccccactatccta | AA108925 |
| 3233 | gagtcgtcacagggactgagag | U50413 | 45837 | catgaactggtaccagcagaagtca | L43568 | 88441 | cactttattaccccactatccataat | AA108925 |
| 3234 | taaactatcaagtcagcaaccaac | U50413 | 45838 | tgaactggtaccagcagaagtcagg | L43568 | 88442 | ttattacccactattccataatcct | AA108925 |
| 3235 | tatcaagtcagcaaccaaccaaccaa | U50413 | 45839 | gtgatgtccaggttacttgtgta | AA041645 | 88443 | attaccactatccattatccataatcctag | AA108925 |
| 3236 | acagcgtccactggactgtggatg | U50413 | 45840 | acgcgtccacatagatcttgtac | AA041645 | 88444 | ttaccactatccattatcctag | AA108925 |
| 3237 | aaaatgcaaaaatctcctctgcag | U50413 | 45841 | aacaggattctcatgtagaggcagg | AA041645 | 88445 | taccctatccatatcctaggt | AA108925 |
| 3238 | ctctccgtgcaggaacaaaggaggcc | U50413 | 45842 | ctccgacgtggtcatataagg | AA041645 | 88446 | cttataatcaaccaattaatgctat | AA108925 |
| 3239 | caaaggccttaaccatggtgct | U50413 | 45843 | cgcacgtggtcgtcaatatagaga | AA041645 | 88447 | ttataatcaaccaattaatgctat | AA108925 |
| 3240 | agaggccttaaccatggtgt | U50413 | 45844 | tcaatataggaacccccaggggt | AA041645 | 88448 | tataatcaaccaattaatgctattc | AA108925 |
| 3241 | gaaggcttaccacgtcacgttggg | U50413 | 45845 | ataaggaaccccccagggctgca | AA041645 | 88449 | ataatcaaccaattaatgctattca | AA108925 |
| 3242 | tggtcagcctgtgtagccctggggt | U50413 | 45846 | cccaggagcaactgagcccccaataa | AA041645 | 88450 | taatcaaccaattaatgctattcca | AA108925 |
| 3243 | tggtgaaccagcagacatcacactg | U50413 | 45847 | aggagcacctgagccccataagca | AA041645 | 88451 | aatcaaccaattaatgctattcaac | AA108925 |
| 3244 | tcgagcctgcactggactcactt | M33960 | 45848 | tgagcccaataagcagcaagtaca | AA041645 | 88452 | atcaaccaattaatgctattcaaca | AA108925 |
| 3245 | gagtcgcactggactcacttcaa | M33960 | 45849 | gcccaataagcagcaagtacaca | AA041645 | 88453 | tcaaccaattaatgctatcaacac | AA108925 |
| 3246 | ctagaggccactctgcatcgtta | M33960 | 45850 | aagtacacatcgtctggctcc | AA041645 | 88454 | tacctagaacagaaccagttcagag | AA108925 |
| 3247 | cactctgcatcgtatgtgtgt | M33960 | 45851 | gcatcacatagctcgtggctacga | AA041645 | 88455 | ctgcttccaagtgttagagaatagc | U68535 |
| 3248 | tctgcatcgtatgtctccacgg | M33960 | 45852 | atcatgtggcgtgtcggttac | AA041645 | 88456 | acctccataattctagatgatatga | U68535 |
| 3249 | gcatcgtatgtctccacgagaa | M33960 | 45853 | tccacatagatctgtacagaaag | AA041645 | 88457 | accccagctcagacaaatgtgtt | U68535 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 3250 | M33960 | cttttcattatgcactgcagcca | 45854 | AA041645 | agaataaatccacaggctggtccaa | 88458 | U68535 |
| 3251 | M33960 | atgcactgcagccacacaccgtg | 45855 | AA041645 | aatccacaggcgtggtccaaatacca | 88459 | U68535 |
| 3252 | M33960 | cactggcagccacacaccgtgtac | 45856 | AA041645 | caggctggtccaaatacccaacacg | 88460 | U68535 |
| 3253 | M33960 | gccacacaccgtaccatagggc | 45857 | AA041645 | gctggtccaaatacccaacactgaa | 88461 | U68535 |
| 3254 | M33960 | tagggccccaaatgtggggtcacat | 45858 | AA041645 | aataccaacatgtgaacaggattc | 88462 | U68535 |
| 3255 | M33960 | tgtggggtcacalgctctgaattt | 45859 | AA041645 | accaacatgtgaacagattccta | 88463 | U68535 |
| 3256 | M33960 | cactgcactcactcaatgtgtgc | 45860 | AA041645 | catactgaacctacactggggcaaa | 88464 | U68535 |
| 3257 | M33960 | tgactcactcaatgtcatttcc | 45861 | AA041645 | ttgattccgccaacggatcaatat | 88465 | U68535 |
| 3258 | M33960 | actcaatgtcatttccggctgc | 45862 | AA041645 | gtcacctaatggacgagggctctt | 88466 | U68535 |
| 3259 | M33960 | tcaatgtcatttccggctgcgt | 45863 | AA041645 | ctacacagagggtcctccgcatca | 88467 | U68535 |
| 3260 | M33960 | cggctgcgtattggagcagtgaac | 45864 | AA041645 | cagaggtcctccgcattcagaacat | 88468 | U68535 |
| 3261 | M33960 | gacagcagctctcgglcaaccacct | 45865 | AA041645 | tcctccgcattcagaacatctact | 88469 | U68535 |
| 3262 | M33960 | agcagctcctggtcaaccacctig | 45866 | AA041645 | gcatcagaacatctatccgagtaa | 88470 | U68535 |
| 3263 | M33960 | tggtcaaccacttagtagataat | 45867 | AA041645 | agccatcaggtgacaacgglatat | 88471 | U68535 |
| 3264 | W48325 | gatgttcacgacggaatggcata | 45868 | L48514 | tcgtaggcaacttataccagaaagc | 88472 | L48514 |
| 3265 | W48325 | tgtgggtcacgacggaatggcatatc | 45869 | L48514 | gcactttataccagaaagccttgta | 88473 | L48514 |
| 3266 | W48325 | accagacagatggcgtcagctgalg | 45870 | L48514 | tataccagaaagccttgtactgga | 88474 | L48514 |
| 3267 | W48325 | ccagacagatgcgctcagctgatga | 45871 | L48514 | cctigacgtgaactcaaatgt | 88475 | L48514 |
| 3268 | W48325 | agacagatgcgctcagctgatgaag | 45872 | L48514 | tcaatattcacctgataaaaagta | 88476 | L48514 |
| 3269 | W48325 | cagatgcgctcagctgatgaaggac | 45873 | L48514 | atgctcagttgctgacatactggc | 88477 | L48514 |
| 3270 | W48325 | agatgcgctcagctgatgaaggaca | 45874 | L48514 | acgtigctgacatactggcccatga | 88478 | L48514 |
| 3271 | W48325 | acggtcttctaaccgtatcaact | 45875 | L48514 | tactggcccatgaaatcatgttt | 88479 | L48514 |
| 3272 | W48325 | cggtcttctaaccgtatcaactg | 45876 | L48514 | aggttctgcagttgggcacgctggt | 88480 | L48514 |
| 3273 | W48325 | gtcttctataccgtatcaactga | 45877 | L48514 | attatctattgatcctccggg | 88481 | L48514 |
| 3274 | W48325 | tcttctataccgtatcaactgca | 45878 | L48514 | ctattgatcctctctccggacat | 88482 | L48514 |
| 3275 | W48325 | tctataccgtatcaactgcaagtt | 45879 | L48514 | tcggctgtcacctaatggcagag | 88483 | L48514 |
| 3276 | W48325 | gaatggcatatcacaccagacgat | 45880 | L48514 | tccactgctcactggcggcgagaa | 88484 | AA023285 |
| 3277 | W48325 | ctataccgtatcaactgcaagtt | 45881 | L48514 | ctgcagctcattcctcaaccgtt | 88485 | AA023285 |
| 3278 | W48325 | atggcatatcacaccagacagat | 45882 | L48514 | gatcctttcattcatcgatac | 88486 | AA023285 |
| 3279 | W48325 | tggcatatcacaccagacagatgc | 45883 | L48514 | ctctttcatttcatcgatcatacga | 88487 | AA023285 |
| 3280 | W48325 | gcatatcacaccagacagatgcg | 45884 | L48514 | tttcattcatctgcatcgacacag | 88488 | AA023285 |
| 3281 | W48325 | catatcacaccagacagatgcgctc | 45885 | L48514 | cattcatctgcatcgacacagag | 88489 | AA023285 |
| 3282 | W48325 | tatcacaccagacagatgcgctcag | 45886 | L48514 | atcgcatacccagacagaaggcgct | 88490 | AA023285 |
| 3283 | W48325 | atcacaccagacagatgcgctcagc | 45887 | L48514 | tgcatacgacagaaggcgctccca | 88491 | AA023285 |
| 3284 | W48325 | acaccagacagatgcgctcagctga | 45888 | L48514 | ccgacgaaggcgctccaaactig | 88492 | AA023285 |
| 3285 | W48325 | caactccttgatgtctgcccta | 45889 | L48514 | gaaggcgctccaaactigcccag | 88493 | AA023285 |
| 3286 | M69222 | agtgactaggtcggctgttcta | 45890 | L48514 | tccaaactigccccaggcctgaag | 88494 | AA023285 |
| 3287 | M69222 | agagccatcacatggctcgggtg | 45891 | L48514 | ccaggcctigaaggcacggtagg | 88495 | AA023285 |
| 3288 | M69222 | atcagcatggltcggggttggg | 45892 | L48514 | agctagctgcttcactcgtaaagc | 88496 | AA023285 |
| 3289 | M69222 | gaaggtctcttgaggctaggcaa | 45893 | L48514 | cttgaaggcacgglgatgcattg | 88497 | AA023285 |
| 3290 | M69222 | ttctctggaagcgcaagaggtgc | 45894 | L48514 | ctgttcactcgtaaagctattacc | 88498 | AA023285 |
| 3291 | M69222 | ttcaagtlaaggcgcactgtgtg | 45895 | L48514 | cttcactcgtaaagcttaatccc | 88499 | AA023285 |
| 3292 | M69222 | gctcgacttcacctgttaaacatgg | 45896 | L48514 | tctgtaaagcttatcctctgcgc | 88500 | AA023285 |
| 3293 | M69222 | cttcactcgttaaacatggctgcct | 45897 | L48514 | gtaaagcttatccctctgcgtcc | 88501 | AA023285 |
| 3294 | M69222 | ctgttaacatggcctttgaat | 45898 | L48514 | aagcttatccctctgcgtcctgg | 88502 | AA023285 |
| 3295 | M69222 | aacatggctgcttgaataaagga | 45899 | L48514 | tcgctcctggatctcttcattca | 88503 | AA023285 |
| 3296 | M69222 | aaagtctgaaactgcgctcagctggt | 45900 | L48514 | ctcctggatcttcattcatct | 88504 | AA023285 |
| 3297 | M69222 | atgtcaacccaaagaaagaacggaca | 45901 | L76193 | gtcaagttgtggcccaaggattca | 88505 | J03877 |
| 3298 | M69222 | actaglagcttatctcicagcag | 45902 | L76193 | gatccagtctgccaaggaatca | 88506 | J03877 |
| 3299 | M69222 | aggtatctatctcagcagatgc | 45903 | L76193 | gatatttgcaggcgcaccta | 88507 | J03877 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3300 | cagccagatatgcccaactctt | M69222 | 45904 | atctataatcctgagggcctccag | L76193 | 88508 | tgccaagctactactgaaagtc | J03877 |
| 3301 | gatatgcccaacactcctaatgta | M69222 | 45905 | tgtcagataagccaggtgagca | L76193 | 88509 | aaagctactactgaagtcacag | J03877 |
| 3302 | actcctaatgtacctccagagcca | M69222 | 45906 | acactgtatgcgaacaacggctctg | L76193 | 88510 | cctacctactgaaagtcacagt | J03877 |
| 3303 | taatgtacctccagagccacagca | M69222 | 45907 | tatgcgaacaacggctctgcttc | L76193 | 88511 | tacctactgaaagtcacagatca | J03877 |
| 3304 | acctccagagccatcagcatggttt | M69222 | 45908 | agcacgtgctctgtatcata | L76193 | 88512 | cctactgaaagtcacagatcatg | J03877 |
| 3305 | ccgtatccacttaactgagtgagc | AA162205 | 45909 | actatattccaaagctctgtact | L76193 | 88513 | tggtgttctccaggaaccgtatca | U73378 |
| 3306 | tatccacttaactgagtgagcaaa | AA162205 | 45910 | aaagctgtactgtgacctctaga | L76193 | 88514 | cacagcaaacaattaattctcata | U73378 |
| 3307 | ggatgatctagctctgccaaggctc | AA162205 | 45911 | ctgtactgtgacctctagatcttc | L76193 | 88515 | catttctgtgtgtgaaggatat | U73378 |
| 3308 | tgatctagctctgccaaggctctgc | AA162205 | 45912 | tgtgacctctagatcttctaaaac | L76193 | 88516 | tatgaccccatgtcccagacacatt | U73378 |
| 3309 | tctagctctgccaaggctctgcaga | AA162205 | 45913 | agtctgccaacggaatcacagtct | L76193 | 88517 | cccatgtcccagacacattacatc | U73378 |
| 3310 | agctctgccaaggctctgcagagac | AA162205 | 45914 | gccaaaggaatcacagtcactag | L76193 | 88518 | tcccagacacattacatcataact | U73378 |
| 3311 | tctgccaaggctctgcagagaccca | AA162205 | 45915 | ggaatcacagtctcactagacaga | L76193 | 88519 | caaaggtctctcctgactagca | U73378 |
| 3312 | ccctgtccccaatctgctggccatt | AA162205 | 45916 | aagttgtctatgtagctgatgtaa | L76193 | 88520 | tctcctcctgacctagcatcaaa | U73378 |
| 3313 | tgttgcccaactactcacttgc | AA162205 | 45917 | gatttaacctcagtgaaggtcaltc | L76193 | 88521 | tctgacctagctacacagaaaag | U73378 |
| 3314 | tgcccaatctggccattcacctg | AA162205 | 45918 | gtcattcagctggggacccttagtgg | L76193 | 88522 | aatcttacatgactgtcaagccat | U73378 |
| 3315 | ggccattcacctgcctgaaccaatc | AA162205 | 45919 | gataacctgaccgtgctccagcca | L76193 | 88523 | tacatgactgtcaagccatcttt | U73378 |
| 3316 | ctaacacacgcttcgccagagc | AA162205 | 45920 | gttgctccagccacggagatatt | L76193 | 88524 | gactatctgaacatgtgaaaaatt | U73378 |
| 3317 | tctgtgggtccaaccactcattgc | AA162205 | 45921 | ctggatacaacattcactgactccta | L76193 | 88525 | tgttcagacacagctgaattcccc | U73378 |
| 3318 | tgggtccaaccactcattgctgt | AA162205 | 45922 | acacattcactgactctacagaa | Z22111 | 88526 | tatgacatttcacacacataagt | U73378 |
| 3319 | gtccaaccactcattgctgtaca | AA162205 | 45923 | gtactagctacaacaagttcaa | Z22111 | 88527 | ctgttgaactcatctaattcaat | U73378 |
| 3320 | caaccactcattgctgtacagcc | AA162205 | 45924 | actagctacaacagaagttcaaggc | Z22111 | 88528 | taactcatcaattcaattactg | U73378 |
| 3321 | ccacttcattgctgtacagcctta | AA162205 | 45925 | tagctacaacagaagttcaaggc | Z22111 | 88529 | tttcaatttactgttaccagcagag | U73378 |
| 3322 | ctcattgctgtacagcctact | AA162205 | 45926 | gtagacaaatctccagcacgct | Z22111 | 88530 | gttaccagcagctgcgtgtgtt | U73378 |
| 3323 | ttgctgtacagccttactggc | AA162205 | 45927 | aaatctccagcacagcctacatgc | Z22111 | 88531 | agcagagtcgctgttgttgtct | U73378 |
| 3324 | aattttgtagtgcagagggatgat | AA162205 | 45928 | atctctacacagccactgacatgc | Z22111 | 88532 | gttgttgttctccattcacatga | U73378 |
| 3325 | aaagtggctcgcagaacgtcctgaa | AA162205 | 45929 | ctctcagacacagccacatgcagct | Z22111 | 88533 | tccattcacatgaaattctattaa | U73378 |
| 3326 | agactgtccgaactcatctctcaa | M55561 | 45930 | ctgcgtctactactgtgcagaga | Z22111 | 88534 | gcgtgagccatcccactcctgc | D31943 |
| 3327 | acaagccactacggcttctcttctgt | M55561 | 45931 | tctactactgtgcagagagatta | Z22111 | 88535 | gtagctcgaatgctcctgggccat | D31943 |
| 3328 | ggcctcatcatcacgcctcaagggt | M55561 | 45932 | tactactgcaagagagattact | Z22111 | 88536 | caccaggcttcatagagctgcgtt | D31943 |
| 3329 | atccatcacgatgcgggcggctcc | M55561 | 45933 | actgactctacaacatgaactgggta | Z22111 | 88537 | gatgctatccaaggcgcagatgttag | D31943 |
| 3330 | catcgatgcgggctcgctggagttc | M55561 | 45934 | tgcatcctccaaacatggggtgaag | Z22111 | 88538 | gcttatccaagggcccagaatgtag | D31943 |
| 3331 | cctcttcttgccaatactaatg | M55561 | 45935 | agagctgagggattgaagcgtgt | Z22111 | 88539 | caagggccgagatgtagtctcct | D31943 |
| 3332 | cttaatgtgcctcttccctcagc | M55561 | 45936 | agctgagtggtgaggacgtgta | Z22111 | 88540 | gtagctctgtgtccgttcctg | D31943 |
| 3333 | tgaaggcgcagttctgaagccccg | M55561 | 45937 | tgttaatcctacgcaatggtagtt | Z22111 | 88541 | gctccttgtccgtctcctg | D31943 |
| 3334 | ctgctgccaacaactagccgagag | M55561 | 45938 | ttaatcctagcaatggtggtgctag | Z22111 | 88542 | ttgtctcgtttcctgccctaggaag | D31943 |
| 3335 | ceaacacaatagccgaagacatcc | M55561 | 45939 | aatcctagcaatggtggtactagct | Z22111 | 88543 | cctgctaggaagttgctgccgact | D31943 |
| 3336 | cgtgaccccgcactagggccacaata | M55561 | 45940 | tgggtagcttacaaacagaagtc | Z22111 | 88544 | taggaagttgctgcacgtgagaga | D31943 |
| 3337 | tcctgaactcatcctcaagctgc | M55561 | 45941 | ctaccatatatcatgactgggta | X54352 | 88545 | tacatacaccatacaagacttta | D31943 |
| 3338 | ctctcaaagctgtcctccagagccag | M55561 | 45942 | atatatctacatgacttgaggacagag | X54352 | 88546 | tgaaatgtcctgggccatccacct | D31943 |
| 3339 | aagctgtctccagagccaggaagat | M55561 | 45943 | tgctgacccaggagactaccaccgc | X54352 | 88547 | gtcctgggccatccacctgcgtat | D31943 |
| 3340 | gatgaagagtttctctctcctc | M55561 | 45944 | caccaggctaccacccgtgactg | X54352 | 88548 | tccccaagctttggagtgtgccac | D31943 |
| 3341 | cactcatcatctctggttgtgatt | M55561 | 45945 | gagctaaccacgcagcactttg | X54352 | 88549 | tctcccagcctcttttggaggt | D31943 |
| 3342 | catttctctggtttctgattcgata | M55561 | 45946 | tgtctatgccagccaactgatgaa | X54352 | 88550 | ctcctcacaggcgcagcaaccatggct | D31943 |
| 3343 | aggatccttgggacactactacg | M55561 | 45947 | tggcagccaactgcatgaaaccaag | X54352 | 88551 | acaggccgcaccatgcttcatag | D31943 |
| 3344 | cttgggacactactacgccgt | M55561 | 45948 | catcaagcagtgcacaatcatat | X54352 | 88552 | cagcaccatggcttcatatagctgg | D31943 |
| 3345 | ggaagatacccctccctgggcc | M55561 | 45949 | actgacataccgcagcatcgtaa | X54352 | 88553 | atgcaccagaagaacattaaaag | AA108874 |
| 3346 | gaagtatgcctcacctttggggct | M28666 | 45950 | tacacattgacttcattgatct | X54352 | 88554 | tgcgtcaccagaagaacattaaaga | AA108874 |
| 3347 | ggctcatctcttttagagaaagtc | M28666 | 45951 | tgaatttatcttctgaggtgaata | X54352 | 88555 | agccatctcgacgatgagcgtgagt | AA108874 |
| 3348 | ctcatctcttttagagaaaggccat | M28666 | 45952 | aatgattcactaatctgccttg | X54352 | 88556 | ccatctcgacgatgagcgtgagtac | AA108874 |
| 3349 | gaaagtctcatgccaatcttgaatg | M28666 | 45953 | agcctaattagccgctgggcctg | X54352 | 88557 | | AA108874 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3350 | agtccatgccaatcttgaatgtaa | M28666 | 45954 | tcactaatcgtcctaattggtgcc | X54352 | 88558 | catctcgacgatgagcgtgagtacc | AA108874 |
| 3351 | gtccatgccaatcttgaatgtaac | M28666 | 45955 | aattagccgctgcctgccagag | X54352 | 88559 | tctcgacgatgagcgtgagtaccgc | AA108874 |
| 3352 | ccatgccaatcttgaatgtaacca | M28666 | 45956 | gcctctgccagagtacaggaaatca | X54352 | 88560 | taccgcttcacattccgaaggcag | AA108874 |
| 3353 | catgccaatcttgaatgtaaccaa | M28666 | 45957 | aggcaccagctccgcaggcgaa | X54352 | 88561 | ccgcttcacattccgaaggcagcagac | AA108874 |
| 3354 | tggttctctgatagagttggggaa | M28666 | 45958 | ttagtcttgccaccagcatgcctg | X54352 | 88562 | cttcacattccgaaggcagacgat | AA108874 |
| 3355 | gttcttctgatagagttggggaaga | M28666 | 45959 | tttgccaccagcatgccgaccaca | X54352 | 88563 | ttcacattccgaaggcagcagacgatg | AA108874 |
| 3356 | ttctctgatagagttgggggaagt | M28666 | 45960 | accagcatgcctgaccacagtatc | X54352 | 88564 | cacattccgaaggcagcagacgatgtc | AA108874 |
| 3357 | gatatgcctgaccacagtgagctcca | M28666 | 45961 | gagcattgcctgaccacaggagctac | X54352 | 88565 | acattccgaaggcagcagacgatgct | AA108874 |
| 3358 | tatgcctcacctgggggcctccata | M28666 | 45962 | ttgtcttcagccaggatgtccc | X54352 | 88566 | ageacttaaatggcatcctgataaa | AA108874 |
| 3359 | atgcctcacctgggggcctccatat | M28666 | 45963 | atgccctccagccttgacatgg | X54352 | 88567 | gcatcctgataaaaatccagaaaat | AA108874 |
| 3360 | tcacctgggcctccatatctgcc | M28666 | 45964 | tccagttacaagcgaaggcacact | X54352 | 88568 | attcaaagaagtcgccgaggcatat | AA108874 |
| 3361 | cctggggcctccatatctgccttt | M28666 | 45965 | tccccaaaggcaccagtgctcagg | AA023402 | 88569 | ttagacggcaggtgcaaggtcaagccatc | AA108874 |
| 3362 | ctccatatctgccttcctcagta | M28666 | 45966 | aaggcaccgatgcctagagtcttga | AA023402 | 88570 | aggtgcaagccatctgacgatgag | AA108874 |
| 3363 | tccatatctgccttcctcagtag | M28666 | 45967 | attttcacaaacatggactgtcca | AA023402 | 88571 | ggtgcaagccatctgacgatgagc | AA108874 |
| 3364 | catatctgccttcctcagtagtt | M28666 | 45968 | tgtctcatctgccctctcagcc | AA023402 | 88572 | tgcaagccatctgacgatgagcgt | AA108874 |
| 3365 | ggtcaggccctgaacactgaccag | M28666 | 45969 | atctggccttcagccgttgt | AA023402 | 88573 | aagccatctcgacgatgagcgtgag | AA108874 |
| 3366 | ggcctgaacactgaccagagtcc | M28666 | 45970 | ttcagccgttagttagactcct | AA023402 | 88574 | ggccatctcgaaggttcctgt | AA108874 |
| 3367 | gaagccaaactgcacagataaagg | W83658 | 45971 | tagttagactcctctgtagagga | AA023402 | 88575 | tcgcaaagggcgccttcccagagg | X84325 |
| 3368 | gccaacatgcacagataaaggtgt | W83658 | 45972 | tagagatcttccatctgctct | AA023402 | 88576 | tgcacctccaaatctggaacagc | X84325 |
| 3369 | gctgcactgatgcctactgtg | W83658 | 45973 | tgctggcctcacagagccagtt | AA023402 | 88577 | tagacctcgtaaggacaaggtgct | X84325 |
| 3370 | gctgactgatgcctactgtgagg | W83658 | 45974 | gcctgacatggccacttgattcc | AA023402 | 88578 | tgaccaccaggggccacgatat | X84325 |
| 3371 | ttgatgcctactgtgaggcactg | W83658 | 45975 | cagagcccagtcttggcattcct | AA023402 | 88579 | cctaccacaggggccaagatatggc | X84325 |
| 3372 | gcctactgtgaggcacatgccacag | W83658 | 45976 | gccaactgattccggttcaggacat | AA023402 | 88580 | gttcagctcggctccatgacaacgt | X84325 |
| 3373 | gcactgtgaggcacatgccacag | W83658 | 45977 | tgattccgttcaggacatcctct | AA023402 | 88581 | cagctcggctccatgacaacggga | X84325 |
| 3374 | gccaagaagacccctcgagaccc | W83658 | 45978 | aggacatcctcctcgagagtct | AA023402 | 88582 | aagcagtcttccagaagacaaaccga | X84325 |
| 3375 | gttctctgcgccatccttaagc | W83658 | 45979 | tcctcttcctgagagtctcatgg | AA023402 | 88583 | cagtcttcaggagcagcagaagt | X84325 |
| 3376 | cttctgccatccttaagtctct | W83658 | 45980 | ttcctgagtcttcatggcgtaca | AA023402 | 88584 | tggctctcagcagtcgcagacataa | X84325 |
| 3377 | cttgaacactgaccagagtctcga | W83658 | 45981 | agagtcttcatgggtacagagcgt | AA023402 | 88585 | tcagcagtcgcagacataacttttg | X84325 |
| 3378 | gaaactgaccagagtctctgaaga | W83658 | 45982 | tgagtgccagttacaacgcgagge | AA023402 | 88586 | gggccttcccagagagctacagtcc | X84325 |
| 3379 | atggccagcaacaccaccgccagca | W83658 | 45983 | agaattgcgttagcctgcataaa | AA023402 | 88587 | agagctacagtcccacagtgttga | X84325 |
| 3380 | gccagcaacaacaccgccagcatag | W83658 | 45984 | attgtcgttagcctgcataaactc | AA023402 | 88588 | gctacagtcccacagtgttgagcg | X84325 |
| 3381 | aacacgccagcatagcacaagcca | W83658 | 45985 | cgatctcagcctgtgggtcccgac | Z30174 | 88589 | gtcccacagtgttgagcgctaaa | X84325 |
| 3382 | gccagcatagcacaagccagcaagcca | W83658 | 45986 | gatagactggcttgtacttgtagt | Z30174 | 88590 | agccgtataatgccactctcgcagat | X84325 |
| 3383 | gcacaagccaggaagtctggtagaac | W83658 | 45987 | ccacaggtagcacagtaaagagt | Z30174 | 88591 | atgccactctgcagatgaaggtaa | X84325 |
| 3384 | atggaagccaactgcgacagataa | W83658 | 45988 | cgtgttccactgcgacattgtga | Z30174 | 88592 | ccactctgcagatgaaggtaaacc | X84325 |
| 3385 | cgcctcatggatctctggtagtt | W83658 | 45989 | gtcttccactgcgacattgtgat | Z30174 | 88593 | ctgttgcacctccaaatctgcgacac | X84325 |
| 3386 | cctcatggatctctggtagttgg | W48382 | 45990 | gtgatattccactctaactaacgc | Z30174 | 88594 | cagaggccactgggcgtgttgctg | U51037 |
| 3387 | ttggccattaatcatccaatgca | W48382 | 45991 | tcaaagcaaacctctaaatcaa | Z30174 | 88595 | cctgccagtcgagtgagagaaccatgtg | U51037 |
| 3388 | gtgaccattaatcatccaatgcatc | W48382 | 45992 | caccaaaccctctaaatcaatgagaac | Z30174 | 88596 | gagcctcagtcgtgactgatttcaaa | U51037 |
| 3389 | gaccattaatcatccaatgcatcag | W48382 | 45993 | aaacctctaaatcaatgagacaac | Z30174 | 88597 | tcctgtgtattcgtttaagagagc | U51037 |
| 3390 | ccattaatcatccaatgcatcagg | W48382 | 45994 | acctctaaatcaatgagacaacc | Z30174 | 88598 | gagccatcagttagctatcagaatc | U51037 |
| 3391 | attaatcatccaatgcatcaggctg | W48382 | 45995 | gttagcctcgataaactcctgcag | Z30174 | 88599 | ccatcagttagctatcagaattcag | U51037 |
| 3392 | taatcatccaatgcatcaggctga | W48382 | 45996 | aatcaatgagacaaccaccaacatt | Z30174 | 88600 | attttgacttagctgtactgt | U51037 |
| 3393 | atcatccaatgcatcaggctgtaat | W48382 | 45997 | cctgcataaactccgagtgactg | Z30174 | 88601 | tttgacttagctgtactgtgtgat | U51037 |
| 3394 | catccaatgcatcaggctgtaatgt | W48382 | 45998 | taaacctccgatgactgaaagtg | Z30174 | 88602 | ggacttagctgtactgtgatatt | U51037 |
| 3395 | tccaatgcatcaggctgtaatgtct | W48382 | 45999 | actctcccgatgactgaaaggtt | Z30174 | 88603 | ttttaggccaacatgacaggttg | U51037 |
| 3396 | caatgcatcaggctgtaatgtctg | W48382 | 46000 | ggtacacagttcttagtgttca | Z30174 | 88604 | gaggatctactgctgtacactaat | U51037 |
| 3397 | tcatgatctcctgtagttgcg | W48382 | 46001 | tgtttcatcagaatcacgcagagtc | Z30174 | 88605 | gatctactgctgtacactaataa | U51037 |
| 3398 | catgatctcctgtagttgcataaagttcag | W48382 | 46002 | atcagaatcacgcagagtcatatgg | Z30174 | 88606 | gccatcatggaacaaccatgtgaaa | U51037 |
| 3399 | agtcatccgggacatcaagttcagcc | W48382 | 46003 | atcacgcagagtcatatgaattaa | Z30174 | 88607 | agtcatggaacaaccatgtgaaaat | U51037 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3400 | ggaacatcaagttcagcctaggggt | W48382 | 46004 | actctataaagacettgtgtgagc | AA064208 | 88608 | tcctgatttccagctcagctggagcca | U51037 |
| 3401 | tgcagatatacatcacgacgtgaggag | W48382 | 46005 | ctataaagacettgtgtgagccaa | AA064208 | 88609 | tttccagctcatggagccagcgtt | U51037 |
| 3402 | cagatatacatcacgacgtgaggag | W48382 | 46006 | tggtattctgcagcatttctggct | AA064208 | 88610 | ccagctcatgggagccagcgttgaa | U51037 |
| 3403 | gatatacatcacgacgtgaggagat | W48382 | 46007 | ttctgcagcatttctgctgatgtc | AA064208 | 88611 | tcttgctgttgttagctgaatg | U51037 |
| 3404 | tacatcacgacgtgaggagatcagt | W48382 | 46008 | tgcagcatttctggctgatgtccgg | AA064208 | 88612 | ctctgtccaagccagaagagttgat | U51037 |
| 3405 | tgtacgcatggaagcgggagtctt | J02700 | 46009 | agcatttctgctgatgtccggcc | AA064208 | 88613 | tgattcttgcacatgaattgtcaca | U51037 |
| 3406 | gagtcttcactggggcgaggttgc | J02700 | 46010 | gcccaaaggatggctgtaatggt | AA064208 | 88614 | ctttggagcgcttctctgctcatg | D87990 |
| 3407 | cctggctggttgtgacgactca | J02700 | 46011 | taatttaacttctgtatcattgaa | AA064208 | 88615 | gctcaatctgcaccctgatgga | D87990 |
| 3408 | cgactcagcacatcgcagagtgtt | J02700 | 46012 | tttaacttctgtatcattgaact | AA064208 | 88616 | catcatctataacatcctgctctt | D87990 |
| 3409 | agcacatctgcagagtgtcctgtc | J02700 | 46013 | tatatttaggacctatccagcagta | AA064208 | 88617 | ctataacatcctgctcttggcctg | D87990 |
| 3410 | tcctgccgtgccatgcagactc | J02700 | 46014 | gactatccacgcagtaaaatgaaa | AA064208 | 88618 | gaccagtgcctgggtcagagctt | D87990 |
| 3411 | cctgccgtgccatgcagactc | J02700 | 46015 | ctatccacgcagtaaaaatgaaaat | AA064208 | 88619 | tgcctgcagagtttatctc | D87990 |
| 3412 | ccatgcagactctgctaagaat | J02700 | 46016 | agaccttgtgtgagccaagtgatc | AA064208 | 88620 | gagtttatcttcatgacagtcgtg | D87990 |
| 3413 | agactctgctaagaattagatg | J02700 | 46017 | cctgtgtgagccaagtgatcagt | AA064208 | 88621 | catgacagtcgtgtacttccggtcc | D87990 |
| 3414 | gagtaaagacactccacctcacacc | J02700 | 46018 | ccaagtgcagtgtgaggaatc | AA064208 | 88622 | gaagttcacctcaccatcttgctct | D87990 |
| 3415 | ttcacctcacactcgaagtcgt | J02700 | 46019 | attcgggcaatgttaaagtg | AA064208 | 88623 | cctggtcctgtctgatgccaag | D87990 |
| 3416 | tcacacctgaagttctttaaagg | J02700 | 46020 | tagttctcatccagtcacaaacag | AA064208 | 88624 | tatttatcgaacagggcatcttg | D87990 |
| 3417 | ctgacctgcacagagcctggggtca | J02700 | 46021 | ttctacatccagtcacagcaggat | AA064208 | 88625 | ctcgaacagttgcatcttgggaaaa | D87990 |
| 3418 | gtggaactcatcagcgctcagt | J02700 | 46022 | tacatccagtcacacaggatgt | AA064208 | 88626 | gtcctgacccttgatgaactgaca | D87990 |
| 3419 | actgggcctctactccacagaacc | J02700 | 46023 | cagtcaacagaggatgtgttat | AA064208 | 88627 | aacctgatggatgactgacagggtt | D87990 |
| 3420 | gtttcgaacctgcagttgaaa | J02700 | 46024 | gtccttgcctatatagaacagaaa | AA064208 | 88628 | actgcaacggttccagggaaccat | D87990 |
| 3421 | acacattgccatcttcagccaag | J02700 | 46025 | cttgccctatgaacagaaacag | AA064208 | 88629 | ttaccaacagttccaaccacatg | D87990 |
| 3422 | ttgcccatctcagccagaagact | J02700 | 46026 | cttgcaacactttccacagtgaaaat | X83202 | 88630 | aacaggtccacacacatgatgttg | D87990 |
| 3423 | cagtcctcacactttgcattgt | J02700 | 46027 | acacttttgcaacagagaaagtaatt | X83202 | 88631 | ttggtccagttctgtgggct | D87990 |
| 3424 | gatgtccctgccggttgtgtgac | J02700 | 46028 | tgtcacaaaccactttgggctgca | X83202 | 88632 | tggatcctttctgtgggagctc | D87990 |
| 3425 | tttgtaacgctacatgcacggct | W48402 | 46029 | aaaccacttttgggctgcagttgtg | X83202 | 88633 | cccgaccatcatatacatcacctg | D87990 |
| 3426 | gtaacgctacatgcacgctctgtc | W48402 | 46030 | cttgggcctcagttggaactg | X83202 | 88634 | aacataatctcgacgcctctac | U36575 |
| 3427 | gctactgcgtttggcagatcgc | W48402 | 46031 | tgggctgcagttgtgaacttgatt | X83202 | 88635 | cgacgcttctactctgaccgtt | U36575 |
| 3428 | gctactgcgtttgcccagatcgc | W48402 | 46032 | gttgtatcgcagtgctgaactgac | X83202 | 88636 | ctgaccaaagctcattccaactc | U36575 |
| 3429 | ttcgctttgcagatctgtactca | W48402 | 46033 | tcggcttttaccctcaccactgaa | X83202 | 88637 | aaagcctcatcccaactcaccagg | U36575 |
| 3430 | ttggcagatcgctactcattctg | W48402 | 46034 | ttacctcacactgaatgaaacaatg | X83202 | 88638 | tcattccaactccaccaccaggatcg | U36575 |
| 3431 | gcagatctgctactcattctgga | W48402 | 46035 | cctcacactgaatgaaacaatgata | X83202 | 88639 | caccaggatgctgaactggagagc | U36575 |
| 3432 | gatctgctactcattctggacct | W48402 | 46036 | gcctcatacttcagtaagcctacc | X83202 | 88640 | tgcgctgcagagaactggtgagaa | U36575 |
| 3433 | ctactcattctgggacctccctgg | W48402 | 46037 | taccacaaagtatctttccagag | X83202 | 88641 | atagccacagactggttcattt | U36575 |
| 3434 | ctcattctgggacctccctgggag | W48402 | 46038 | ccacaaagtatctttccagagata | X83202 | 88642 | tctcttccaaaggcaaacagcctt | U36575 |
| 3435 | gagcctttgccagttgtctgaag | W48402 | 46039 | aagtatctttccagagataccaaa | X83202 | 88643 | tccaaagccaaacagcctttgccctg | U36575 |
| 3436 | gagcctgtttgccagtgtctgaag | W48402 | 46040 | tatctttccagagatacacaaatt | X83202 | 88644 | tgcccaactctcagccttagtt | U36575 |
| 3437 | gccagttgtctgaagcagtacaga | W48402 | 46041 | cttccagagatacaacaaatttg | X83202 | 88645 | tatctaccagatcagtatgttatt | U36575 |
| 3438 | acagtacatgcagtggtgtcgaa | W48402 | 46042 | gggtacacccttcatcatgagaaaattc | X83202 | 88646 | ctgaaacagctgcatgcgcacagt | U36575 |
| 3439 | tgcacggtgtcgaaggtcctcc | W48402 | 46043 | gaaattctgcaacactgcacagt | X83202 | 88647 | gccgcacagtgcacagtgcacgc | U36575 |
| 3440 | gagcctggcctgcaaggttcctac | W48402 | 46044 | tagtctcacttgctctctcagctga | X83202 | 88648 | gcatggcaacagcaagcaggtcacg | U36575 |
| 3441 | cctgcaaggttcctactccatcc | W48402 | 46045 | cttcactgcttcctcagctgacct | AA023390 | 88649 | ctgctgccgcaaacagcatctta | U36575 |
| 3442 | gcaaggttcctactccatatggctg | W48402 | 46046 | tctcatcctacagagatggagtgc | AA023390 | 88650 | ccgccaaacagatctctgcgtt | U36575 |
| 3443 | aggttcctactccatatggctact | W48402 | 46047 | atctctcacagagagatggggagctcatttt | AA023390 | 88651 | cactctagccgttgtcatggtgac | U36575 |
| 3444 | catatggctgacttcgttggcag | W48402 | 46048 | atctacacagagtggagtcattt | AA023390 | 88652 | agaaaagcaactgcctgctgacca | U36575 |
| 3445 | agctggcctgagagctcatctgt | W48402 | 46049 | tcctacacagagtggagtcattc | AA023390 | 88653 | tgcctgctgaccaagcctcattt | U36575 |
| 3446 | gactggcgctactgctgttaac | W61537 | 46050 | ggagtcatttccttattgatggggt | AA023390 | 88654 | tcacatcaggtatacgctgatcact | U36575 |
| 3447 | aagttgagctgcctggcctccgg | W61537 | 46051 | gagtcatttccttattgatggggtg | AA023390 | 88655 | catcagctataccgatcactagg | AA109180 |
| 3448 | tccagtccagtcctggcctgtata | W61537 | 46052 | agtcatttccttattgatgggggtg | AA023390 | 88656 | tgcgctctgacttctctgatata | AA109180 |
| 3449 | cggcccgtgactgactgactgtataga | W61537 | 46053 | tcattccttattgatgggggtgcaa | AA023390 | 88657 | gctctgacttctctgatatatgg | AA109180 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3450 | gccgctgactgactgagtatagaca | W61537 | 46054 | catttccttattgatggggtgcaaa | AA023390 | 88658 | acttcctgtatatggagatgt | AA109180 |
| 3451 | agaatcgcgactgaccgccagc | W61537 | 46055 | ttccttattgatgggggtgcaaatg | AA023390 | 88659 | gagatgtcatccaatatcaatat | AA109180 |
| 3452 | gcgactgaccgccagcctgtc | W61537 | 46056 | ttcacttgcttccagctgacccg | AA023390 | 88660 | tcatctccaatatcaatatctgcag | AA109180 |
| 3453 | actgtaccgccagtcctgttcagtg | W61537 | 46057 | ttctcagctgaccctgtgtctcca | AA023390 | 88661 | ccaatatcaatatctgcagagcct | AA109180 |
| 3454 | tgtaccgccagtcctgttcagtgt | W61537 | 46058 | ttcaaagtccagtctcccagtccgt | AA023390 | 88662 | tcaaatatctgcagagcctggagga | AA109180 |
| 3455 | taccgccagtcctgttcagtcga | W61537 | 46059 | agtccgtcggctgtgtatagaagag | AA023390 | 88663 | atatctgcagagccctggaggaaca | AA109180 |
| 3456 | ccgcagtcctgttcagtcgatg | W61537 | 46060 | gtccgtctggctgtgataagaagt | AA023390 | 88664 | tctgcagcccggaggaacacag | AA109180 |
| 3457 | ctgactactgtcgttgtaacca | W61537 | 46061 | tccgtctggctgtgatagaagagtg | AA023390 | 88665 | gagccctggaggaacacaggttaag | AA109180 |
| 3458 | gagctactgtctgttgtaaccaga | W61537 | 46062 | aagagtgacctctcctctcacc | AA023390 | 88666 | cagagctataccgatcactaggaga | AA109180 |
| 3459 | gctactgtctgttgtaaccagacc | W61537 | 46063 | ctctcatcctacgcaggagtgagt | AA023390 | 88667 | tataccgatcactaggagactgtcct | AA109180 |
| 3460 | tgtgtctaaccagacccaaagtg | W61537 | 46064 | gtcgcgagattcatcaccctggaa | AA023390 | 88668 | acgtcctccgtgacgtcgatgccaa | AA109180 |
| 3461 | ctgttctaaccagacccaagtgag | W61537 | 46065 | cgcgagattcatcacctcggaact | AA023390 | 88669 | tccggacgtgatgccaagccct | AA109180 |
| 3462 | gttgctaaccagacccaagtgagct | W61537 | 46066 | ttattcaagcatcgacgataagc | AA023390 | 88670 | atgccaaggcctggtcgcctga | AA109180 |
| 3463 | ctaaccagaccaaagtgagctgc | W61537 | 46067 | attcaagcatctgcagataagctg | AA023390 | 88671 | ccaaggcctggtcgcctgactt | AA109180 |
| 3464 | caaggtgagctgcctgtggctcc | W61537 | 46068 | aagcatctgcagataagctgcagg | AA023390 | 88672 | aggcctggtgcgtctgactttct | AA109180 |
| 3465 | ccaaagctgactgctgctggccag | AA020101 | 46069 | gcatctgcagataagctgcaggcc | AA023390 | 88673 | tggtgcgtctgacttctcttgat | AA109180 |
| 3466 | gctctgccagctgagtgccggaa | AA020101 | 46070 | atctgcagataagctgcaggccac | AA023390 | 88674 | caagccatgactacgactgggaacc | AA109196 |
| 3467 | accagttccagaatgtgattcgga | AA020101 | 46071 | acgataagctgcaggccacggcggg | AA023390 | 88675 | gccatgactacgactgggaacccg | AA109196 |
| 3468 | gttccgaatgtgattcgatgaa | AA020101 | 46072 | taagctgcaggccacggcggccaa | AA023390 | 88676 | ggtcaatcaaacgtgcctacctc | AA109196 |
| 3469 | tgcacctcgccgttattggcagc | AA020101 | 46073 | agctgcaggccacggcgggccaag | AA023390 | 88677 | gctaccttcccgacttgaatctg | AA109196 |
| 3470 | ccctcgccgttattggcagcaacac | AA020101 | 46074 | gccaatgatagcactcgtgttgg | AA023390 | 88678 | cttccgaactggaatctggtagca | AA109196 |
| 3471 | agaatcaggcgcactgcgactttgt | AA020101 | 46075 | caatgatagcactcgtgttggcg | AA023390 | 88679 | ccgacttgaatctggtagcaaca | AA109196 |
| 3472 | gaatcagggcgcactgcgactttgg | AA020101 | 46076 | cgagattcatcaccctcggaacta | AA023390 | 88680 | tctggtagcaacaatcccgtccgtg | AA109196 |
| 3473 | cgacttgtgaagctccgcaacatg | AA020101 | 46077 | agatcatcaccctcggaacttatt | AA023390 | 88681 | ggagttgcaacaatcccgtccgtgaag | AA109196 |
| 3474 | actttgtgaagctccgcaacatgt | AA020101 | 46078 | tcatcaccccggaacttattcaag | AA023390 | 88682 | gaagtgaccgtggcctgaaatatt | AA109196 |
| 3475 | ctttgtgaagctccgcaacactgtc | AA020101 | 46079 | atcaccctcggaacttattcaagca | AA023390 | 88683 | tatttaatgcagcgatggatagc | AA109196 |
| 3476 | ttgtgaagctccgcaacatgctcat | AA020101 | 46080 | caccctcggaacttattcaagcatc | AA023390 | 88684 | ttaatgcagcagatggattagcct | AA109196 |
| 3477 | tgggcccatggtgagatccggaagt | AA020101 | 46081 | cctcggaacttattcaagcatctg | AA023390 | 88685 | tactacactgtcgtcacagggt | AA109196 |
| 3478 | tgtgaagctccgcaacatgctcatg | AA020101 | 46082 | gaacttattcaagcatctgcacgat | AA023390 | 88686 | ataggcctcagtgttgtatactaca | AA109196 |
| 3479 | tgcccatggaatccggaagctgaa | AA020101 | 46083 | acttattcaagcatctgcacgataa | AA023390 | 88687 | gttgtatactacactgtcgtgtcac | AA109196 |
| 3480 | tgggatccacgtgtaccagttcca | AA020101 | 46084 | taccatgagcatctacacagaaag | AA023390 | 88688 | gtatactacactgtcgtgtcacagg | AA109196 |
| 3481 | ggatccacgtgtaccagtttccaga | AA020101 | 46085 | acgtcagcagcatggaggcacggt | X95685 | 88689 | tactacactgtcgtcacagggt | AA109196 |
| 3482 | tccacgtaccagtttccagaatg | AA020101 | 46086 | caatcatcagacagagagctgacaa | X95685 | 88690 | gtgctgcacagggctctcaattcg | AA109196 |
| 3483 | acgtgtaccagtttcagaatgtga | AA020101 | 46087 | caggtcacagacagacattgggataa | X95685 | 88691 | ctgtcacagggctctcaattcggtg | AA109196 |
| 3484 | cggttaccagttccagaatgtgat | AA020101 | 46088 | actatgccaggactacgtccatac | X95685 | 88692 | cagggtccaattcgattgccaatca | AA109196 |
| 3485 | gtaccagtttccagaatgtgattc | AA020101 | 46089 | gccaggactacgtccatacacagaa | X95685 | 88693 | tctcaattcggtgcaatcaaagttg | AA109196 |
| 3486 | ggcctggccattgctgttgaaggc | AA003323 | 46090 | cacagaagtcatcatcccgactt | X95685 | 88694 | ctgcatgagaccctggatcatctca | U66865 |
| 3487 | ctggccattgctgttgaaggccca | AA003323 | 46091 | ctgtgcttcggggatcatccagcatgc | X95685 | 88695 | gagaccctggatcatctcatcaag | U66865 |
| 3488 | gtagttcaggagccaggtgactag | AA003323 | 46092 | ttcgggatccagatcatgcggccc | X95685 | 88696 | ctggttccggctgcacagccgca | U66865 |
| 3489 | gtcttcaggcaggttcaacagagc | AA003323 | 46093 | acatccaggcagtcgccattc | X95685 | 88697 | gtcacgccgcagcaaggagagct | U66865 |
| 3490 | cacatactgatagcccttgtgg | AA003323 | 46094 | agcagtcatttgcaaggaaccc | X95685 | 88698 | gagagctgcaggccacctcaaggt | U66865 |
| 3491 | atacctgatagccccttctgttgc | AA003323 | 46095 | cttaccctgggtcgtttagcagc | X95685 | 88699 | tgcaggccacctcaaggtcagcaa | U66865 |
| 3492 | cctgatagccccctgctgtgggcctg | AA003323 | 46096 | gcacggttccacttcaaatgacact | X95685 | 88700 | gccacctcaaggtcagcaaacagaa | U66865 |
| 3493 | gtggttcccgtcgtggacgccg | AA003323 | 46097 | ttccacttcaaatgacatcagctta | X95685 | 88701 | tgtcaggcccttctacctgctct | U66865 |
| 3494 | gccccttactgctgctcagtctta | AA003323 | 46098 | cagcttagtcagcccacaaaggcagc | X95685 | 88702 | gccctgttgctctgactcact | U66865 |
| 3495 | ttactttctcagctgagctc | AA003323 | 46099 | atgcaggccacaaaggcagcctaac | X95685 | 88703 | taacccgatctctggactgctgga | U66865 |
| 3496 | ctgttctagtcttcagagatgcagg | AA003323 | 46100 | ccacaaaggcagctctaaccatgtt | X95685 | 88704 | cgatccggactgctggaacagc | U66865 |
| 3497 | tttctagtcttcagagatcagggtt | AA003323 | 46101 | aggcagctctaaccatgtttccaac | X95685 | 88705 | gactgcagcgacgatgagccac | U66865 |
| 3498 | gaaggcccccagcaaggctgcgatct | AA003323 | 46102 | ccatgtttccacaatcatcagaca | X95685 | 88706 | ctcatctatttaggcccccaga | U66865 |
| 3499 | ggcccccagcaaggctgagatcttt | AA003323 | 46103 | tctcaacaatcatcagacagaggagct | X95685 | 88707 | cctatttaggcccccagacacacta | U66865 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3500 | gctgagatctttcgaggaccgaa | AA003323 | 46104 | ccggccattcaacttctccggag | AA023491 | 88708 | ttaggcccagcacactccagagaca | U66865 |
| 3501 | gatggctccgtgtgtggccctag | AA003323 | 46105 | ggatccatccgcatctagagac | AA023491 | 88709 | agccctcagagatatcatcgtgtta | U66865 |
| 3502 | ggtctccgtgtgtgtggcctactag | AA003323 | 46106 | caatgggacctacaagcctgtgtga | AA023491 | 88710 | ctgacagtctataacctgaaccgca | U66865 |
| 3503 | tcctgtgtggcctacgtagttc | AA003323 | 46107 | tggaacctacacagctgtgatgg | AA023491 | 88711 | gtctataacctgaaccgcaccactc | U66865 |
| 3504 | gtggctacgtagtcaggaggccag | AA003323 | 46108 | ccagcctcgaagatatcccaga | AA023491 | 88712 | accactccggagtgaggatcgttc | U66865 |
| 3505 | tacgtagttcagaggccaggtgact | M95564 | 46109 | tctgaagcatatcccagatttcta | AA023491 | 88713 | cacaacacaaaaagttcctagagg | U66865 |
| 3506 | cacactccgttaacaacaga | M95564 | 46110 | gcatatcccagattctcacaaca | AA023491 | 88714 | tttctgcgtgctctccaagtct | L35236 |
| 3507 | ctgtttaacaacagcatgcttgt | M95564 | 46111 | tatccccagatctcacaacactg | AA023491 | 88715 | cgtgctctccaagatctgtatca | L35236 |
| 3508 | atgtctgagatatacactgaagct | M95564 | 46112 | cccagatctcacaacactggaa | AA023491 | 88716 | ctgtaactgccctcaaatgccatg | L35236 |
| 3509 | tctgagatatacactgaagctgaa | M95564 | 46113 | atctcacaacactggaaatcaa | AA023491 | 88717 | ctgcccttcaaatgcctgaggagg | L35236 |
| 3510 | tgagataccacctgaagctgaatc | M95564 | 46114 | ctctcgttctacctgcaggctgc | AA023491 | 88718 | agatccgcatgtcttgtatcaa | L35236 |
| 3511 | accaactgaagctgaattccactc | M95564 | 46115 | ctgttctacctgcaggctgttt | AA023491 | 88719 | tatttcaaacagcactagaggatgct | L35236 |
| 3512 | tgaagctgaatccaccttcatagta | M95564 | 46116 | tccatccgcatctagagacact | AA023491 | 88720 | acttagagatgctcctgtcagtgtc | L35236 |
| 3513 | ctctcctaccgtgtattactgc | M95564 | 46117 | ctaccgtcaggctgcttttagca | AA023491 | 88721 | agatgctcctgtcagtgtcctccag | L35236 |
| 3514 | ctgttacctgtatactacatgat | M95564 | 46118 | tgtgatagttgcccccaggaccaac | AA023491 | 88722 | ggctccaccaagacacacaccgggg | L35236 |
| 3515 | gttacctgtatactacatgat | M95564 | 46119 | gcccaggaccaacggtccaaccat | AA023491 | 88723 | catggccatttcatgatcatt | L35236 |
| 3516 | aggcttactttgttcttagaagat | M95564 | 46120 | tctcaacaatgttcagcgctggatc | AA023491 | 88724 | ccattcatgatcattatcctg | L35236 |
| 3517 | cttacttgttctttagagatagc | M95564 | 46121 | ctggatcccctgagaacaggactgc | AA023491 | 88725 | atctattactctgacataatccat | L35236 |
| 3518 | ttcctcatgagtcatgtgacagt | M95564 | 46122 | gaacaggactgttggtgtctcct | AA023491 | 88726 | aagttctgtatccaagctgagctga | L35236 |
| 3519 | atgttttgttctcatgagtcatg | M95564 | 46123 | ggtgtctccttttagctacaat | AA023491 | 88727 | aacttctagttgcgctgcttggt | L35236 |
| 3520 | ctttgttctcatgagtcatgtga | M95564 | 46124 | gtctccctttttagctacaatg | AA023491 | 88728 | tttcctccagcagtgcttactaca | L35236 |
| 3521 | ttcctcatgagtcatgtgacagt | M95564 | 46125 | aggctccttgtcactccaagtcag | AA023491 | 88729 | tccagagtgcttactacacaagac | L35236 |
| 3522 | aattatgacgccagttggaggagga | M95564 | 46126 | ctgttcactccaagtcaggagagg | AA023491 | 88730 | agtgcttactacacaagacacaaatca | L35236 |
| 3523 | tatggacgcagttggaggtatta | M95564 | 46127 | cattcaaatcagtccttcggggac | AA023491 | 88731 | ttaagtggctgcgaaccagcaccagaacc | L35236 |
| 3524 | tccagcagttgcgaggaaaacc | M95564 | 46128 | tcaaatcagtccttcggggacgt | AA023491 | 88732 | ggctacgcgaaccagcaacctgtaac | L35236 |
| 3525 | tcatatggccagctgctaaaga | M95564 | 46129 | cagtcttctggggacagttactg | AA023491 | 88733 | agcaacctgaactgccctcaaat | L35236 |
| 3526 | ctacatctcaaaactctagtgtc | D26352 | 46130 | cagtttactgctttggctggaaat | AA023506 | 88734 | tgggctcgaagctgctgagtctcg | AA124831 |
| 3527 | ataactcatgccaagccaactgttt | D26352 | 46131 | tttactgctttggcgtggaaatga | AA023506 | 88735 | cgaagctgcttgagtctgacttg | AA124831 |
| 3528 | aaccaactattgactccagctggc | D26352 | 46132 | actgtctttggctggaaatgaagcc | AA023506 | 88736 | tcctaatgcttgccctcatgcctggg | AA124831 |
| 3529 | actattgactccagctggttggta | D26352 | 46133 | tgaagctgcaggatcgcgggccccac | AA023506 | 88737 | tgcttgcctcatgcctggacaaac | AA124831 |
| 3530 | ccagatgacataactatgtctga | D26352 | 46134 | agttgcacgcagcgtcctcggctc | AA023506 | 88738 | cccagtggttgccatccagcatat | AA124831 |
| 3531 | taactatgtctgatctatgcctat | D26352 | 46135 | tcggctcacgttcctggcccctg | AA023506 | 88739 | ggtggttgccatccagcatatcaa | AA124831 |
| 3532 | tgtctgatctatgcctatattcc | D26352 | 46136 | ggctctggggccatctgaggaagca | AA023506 | 88740 | gttgccatccagcatatcaataa | AA124831 |
| 3533 | atctctatgcctatatttccaagaag | D26352 | 46137 | gctaggccggtcgcagttccccagg | AA023506 | 88741 | ataatgccaacctccaatgtaatgt | AA124831 |
| 3534 | tgccctatttccaagaagtctact | D26352 | 46138 | ccggctgcagttccccagggctact | AA023506 | 88742 | ccaacctccaatgtaatgttaat | AA124831 |
| 3535 | gtctactgccagagatgtgaccat | D26352 | 46139 | gctgcagttccaggctactgt | AA023506 | 88743 | acctccaatgtaatgttgaaatgca | AA124831 |
| 3536 | gtcatattctgtgtcctcga | D26352 | 46140 | tcccaggctactgttccaaggcgg | AA023506 | 88744 | gcttaaatatttcttcatacaag | AA124831 |
| 3537 | gtgtgtctgattaaactcaatg | D26352 | 46141 | caggctactgttccaaggggga | AA023506 | 88745 | ttcttcataaagtttgctaatgc | AA124831 |
| 3538 | accatagactgctcacccaagcac | D26352 | 46142 | ggggccagaccattcaaatcagt | AA023506 | 88746 | agctgttgagtctgactttgct | AA124831 |
| 3539 | aaagcaacctctgctgttctatc | D26352 | 46143 | agaccattcaaatcagtcctttcct | AA023506 | 88747 | agtctcgacttgtctcctgcgct | AA124831 |
| 3540 | cctggctgctctatctggcg | D26352 | 46144 | accattcaaatcagtcctttcggg | AA023506 | 88748 | gacttgtctcctgctgtctagg | AA124831 |
| 3541 | atggtcgcctctgaagcaccaa | D26352 | 46145 | aaattctgactgatccagtttga | AA023506 | 88749 | gtctcctgctaggactgt | AA124831 |
| 3542 | tctgcctgaagcaccaaatatca | D26352 | 46146 | tggactgatcagtttgaacctca | AA023506 | 88750 | tcctgctgctaggactgtcct | AA124831 |
| 3543 | gcaccaaatcaacagttaatat | D26352 | 46147 | aactcctgtccttttgtcttcag | AA023506 | 88751 | tgctgctgctaggactgtctcctaat | AA124831 |
| 3544 | tattctgaaagatctcctagaga | D26352 | 46148 | acactttacctgctcctctcctg | AA023506 | 88752 | taggactgcctaatgctgcctc | AA124831 |
| 3545 | actccctagagattagtgtactg | D26352 | 46149 | gcccaggtagccctgtgataatcc | AA023506 | 88753 | gactgctcaatgcctaatgtgcctcag | AA124831 |
| 3546 | gcttctaggtgtcatggaatggga | D26352 | 46150 | gtagcctgtgataatcccaagctt | AA023506 | 88754 | ctgcctatgctggagaaatgtcgt | AA124831 |
| 3547 | atattgctatttcaactataagc | X16133 | 46151 | ctgtatataaacccaagcttagggcg | AA023506 | 88755 | gtgccagtgtataccaggcctca | AA124831 |
| 3548 | aatgaaccgtctcaggataaagat | X16133 | 46152 | gtccttatatatcatccgcttaag | X66196 | 88756 | ttgaagcagatcctccttttaacct | Y07836 |
| 3549 | tgaatcctgttacccttcccat | X16133 | 46153 | aatatcattctcctgtcttaagctcct | X66196 | 88757 | ggaatctgctgcgcttttcct | Y07836 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3550 | tcctcattaactgtaaggaatat | X16133 | 46154 | atcctcgttaagctcctttgggat | X66196 | 88758 | cacgaaggttcctgatgcagag | Y07836 |
| 3551 | aatgtgttacctatctgttgtc | X16133 | 46155 | gcttaagctccttttgggatgctgg | X66196 | 88759 | ttcctgagtcgagagatcagcc | Y07836 |
| 3552 | tatcttgtgttctggaaaatgcct | X16133 | 46156 | gctccttttgggattgctgtaagac | X66196 | 88760 | ccctgcagaccccacagagaagattc | Y07836 |
| 3553 | gaacaattctacctccaagtgt | X16133 | 46157 | tgatccagtttgaacctcaaaagt | X66196 | 88761 | tgcagaaccccagagaagattcaga | Y07836 |
| 3554 | caatcttcatcctaagtgttca | X16133 | 46158 | agcattgcagcatcagcctgtgca | X66196 | 88762 | ttcctctgcacaaggagacacg | Y07836 |
| 3555 | tcttctacctaagtgttcagga | X16133 | 46159 | gcaagcatcagcctgcagcaca | X66196 | 88763 | gatagcctgacatcagatgacagac | Y07836 |
| 3556 | ttcaggaaccaactcgcattggaa | X16133 | 46160 | ctgtgcacgcacacccgagtctgg | X66196 | 88764 | gactgatgcacatctcgggcgtt | Y07836 |
| 3557 | aggaaccaactcgcattgtgaatt | X16133 | 46161 | cctgccaactgaaggtccttagcag | X66196 | 88765 | agcacatctgggcgttccctac | Y07836 |
| 3558 | tctatttcaactatagccttgta | X16133 | 46162 | aggtccttagcaggacacaactct | X66196 | 88766 | ttataccaggcctcaacaactcag | Y07836 |
| 3559 | attttcaactataagcctttgacag | X16133 | 46163 | ttagcaggacacaactctgcttcc | X66196 | 88767 | tccagcttcatgaaccagacaaga | Y07836 |
| 3560 | tcaactataagcctttgacaggat | X16133 | 46164 | ggacacaactctgcttccttttgt | X66196 | 88768 | agctcatgaaccagacacaagatac | Y07836 |
| 3561 | cttttgacacaggattcctgctgacga | X16133 | 46165 | gccaataacactgaccgagcgctgtt | X66196 | 88769 | atgaaccagacaagatccgactc | Y07836 |
| 3562 | acaggattctcactgacgaaaaca | X16133 | 46166 | caataactgaccgagcgctgtc | X66196 | 88770 | cctttgcacatctgccctgact | Y07836 |
| 3563 | ttctcactgagcaaaaccaagaaca | X16133 | 46167 | tacgtgttcacgatgccgaagcga | X66196 | 88771 | gactcttggcgctgtccaggctt | Y07836 |
| 3564 | ctgagcaaaaccaagaccaaaacaga | X16133 | 46168 | acgtgttcacgatgccgaagcgac | X66196 | 88772 | tgcttgtccaggttgaagcaga | Y07836 |
| 3565 | gaatgtgacgtctgtctcccca | X16133 | 46169 | tgttcacgatgccgaagcgaccga | X66196 | 88773 | ttgctcaggcttgaagcagatcc | Y07836 |
| 3566 | gggccaccacatatgactcgcttca | X16133 | 46170 | gttcacgatgccgaagcgaccgac | X66196 | 88774 | cgcaagtcgaacgaggagcttctacg | AA109508 |
| 3567 | caccacatatgactcgcttcagac | W48463 | 46171 | ttcacgatgccgaagcgaccgacg | X66196 | 88775 | cctctacgcctgaaggtgctgca | AA109508 |
| 3568 | tagattctaacagtcgaactcga | W48463 | 46172 | cacgatgccgaagcgaccgacgag | X66196 | 88776 | agaacgcaagtgctgttgaagaac | AA109508 |
| 3569 | gctcgaacttgtcatcagaattatga | W48463 | 46173 | acgatgccgaagcgaccgacgagg | X66196 | 88777 | tggcctgcggtaatctttccagaa | AA109508 |
| 3570 | gtcctgcttaaacgactgctga | W48463 | 46174 | cgatgccgaagcgaccgacgagga | X66196 | 88778 | tgcggtaatcctttccagaaccgaa | AA109508 |
| 3571 | ctgcttaaacgactgctgaaat | W48463 | 46175 | gatgccgaagcgaccgacgaggag | X66196 | 88779 | tcctttccagaaccgagaaactct | AA109508 |
| 3572 | gctttaaacgactgctgaaatga | W48463 | 46176 | atgccgaagcgaccgacgaggagc | X66196 | 88780 | tccagaaccagagaaactctaatt | AA109508 |
| 3573 | ttaaacgactggctgaaatgtagg | W48463 | 46177 | gccgaagcgaccgacgaggagcc | X66196 | 88781 | aaactctaatttgtgcttgactatg | AA109508 |
| 3574 | tgtactcatagctggatcctaat | W48463 | 46178 | gccgatctcaagcttcatcgggt | X66196 | 88782 | acctctaatttgtgcttgactatg | AA109508 |
| 3575 | actcatagctggatcctaattg | W48463 | 46179 | catctcgatcaagcttcatcgggtcg | AA023458 | 88783 | taatttgtgcttgactatgtcacg | AA109508 |
| 3576 | catagctggatcctaatttgaa | W48463 | 46180 | tctctgatcaagcttcatcgggtcg | AA023458 | 88784 | atttgtgcttgactatgtcacgg | AA109508 |
| 3577 | agctggatcctaatttggaaagt | W48463 | 46181 | atcaagcttatcgggtgccccgat | AA023458 | 88785 | ggagctcttccatcacgg | AA109508 |
| 3578 | cagttcctaagctggccagactag | W48463 | 46182 | caccatatgactgcctcagactta | AA023458 | 88786 | aagagcgaccacatcatgccaga | AA109508 |
| 3579 | ttcctaagctggccagactattg | W48463 | 46183 | caaagttatcgggtgccccgatag | AA023458 | 88787 | gctctcttcatccatcacgggaa | AA109508 |
| 3580 | cagttactctcagcattttgaagg | W48463 | 46184 | gatacgtgtcacgatgccccgaagc | AA023458 | 88788 | gagcaggaccacatcatgcgcagaac | AA109508 |
| 3581 | tagcgaatctctcagtcttttaga | W48463 | 46185 | ctgagaagccaaggcccaggagactcaa | AA023458 | 88789 | aggaccacacatcatggcagaacg | AA109508 |
| 3582 | ctgaatctctcagttcttagatc | W48463 | 46186 | cagagcccaaggcccgaggactcaactc | AA023458 | 88790 | aggaccacatcatggcagaagccaa | AA109508 |
| 3583 | aatctctcagttctttagatcaa | W48463 | 46187 | tacgttgtggcctggccagcaatg | AA023458 | 88791 | gaccacatcatggcagaacgcaacgtg | AA109508 |
| 3584 | ctctcagttcttagatctcaacag | W48463 | 46188 | ggcctgcagcaatgcgggtccaga | AA023458 | 88792 | ccacatcatggcagaagccaaacgtg | AA109508 |
| 3585 | ctttagatttcaacagctcgaactc | W48463 | 46189 | tttacatagctagccactcatcag | W13166 | 88793 | tccctaagaacgcaagcgcgtgaa | AA109508 |
| 3586 | cagttcctaagctggccagactag | W48463 | 46190 | atgtacagctaactgcagactac | W13166 | 88794 | gcagaaggcaagttgcgctgttgaaga | AA109508 |
| 3587 | ttcctaagctggccagactattg | W48463 | 46191 | tacagcaccatcatagagctacaag | W13166 | 88795 | cctttccaattgtgcacctct | AA109508 |
| 3588 | caggactcttgcactgacat | W48464 | 46192 | agcaccatcatatgagctacaagaga | W13166 | 88796 | aatccatcacaccttctggagag | D10215 |
| 3589 | tctgctcactgacatctgctgc | W48464 | 46193 | accatctagagctacaagaacag | W13166 | 88797 | tcactatacgaattctactaagg | D10215 |
| 3590 | gctcactggacatcgcctggc | W48464 | 46194 | aatagctacaaagtcaccctcatcc | W13166 | 88798 | attcctaaaatctgctactc | D10215 |
| 3591 | acatcgctggcacagctggagga | W48464 | 46195 | agctacaaagtcaactgccatcctctga | W13166 | 88799 | tactattaacattcctaagatgct | D10215 |
| 3592 | tctgcctgcacagctggaggagt | W48464 | 46196 | caggaccagggctgtgctactgga | W13166 | 88800 | taacattcctaagatgttcctga | D10215 |
| 3593 | aggagctggcaccctaatgtgtt | W48464 | 46197 | agcaagccaggactcaactcaga | W13166 | 88801 | tcctaagatgcttgaaaagc | D10215 |
| 3594 | agctgcaccctaatgtgttcca | W48464 | 46198 | agccaggcgtcgctactggat | W13166 | 88802 | gtgtgttccaactttggactgtgga | D10215 |
| 3595 | ccccttagtgttccagactgc | W48464 | 46199 | caggccaggcctcaactcaagaact | W13166 | 88803 | tccaactttgactggtggccgta | D10215 |
| 3596 | ttaatgttccagacagtgcacg | W48464 | 46200 | caggactcaactcaagaacttgatcc | W13166 | 88804 | tctttcagtactactctcgagata | D10215 |
| 3597 | atgttccagacagtgcacagaat | W48464 | 46201 | gactcaactcagaactgatccctg | W13166 | 88805 | cagtactactctcgagataagaacc | D10215 |
| 3598 | ctaagctggccacagtatggtgtgga | W48464 | 46202 | ctgcagcagacttccgagcgaat | W13166 | 88806 | atctctgcaagacattaagttt | D10215 |
| 3599 | ccagactatggtgtcctccag | W48464 | 46203 | cagcagacttccgagcgatcagt | W13166 | 88807 | tcagcacctcgtgtgaggaaatcct | D10215 |

| SEQ ID NO | sequence | DBAxnID | SEQ ID NO | sequence | DBAxnID | SEQ ID NO | sequence | DBAxnID |
|---|---|---|---|---|---|---|---|---|
| 3600 | gctgctccctcattgacttcctga | W48464 | 46204 | ccagacttccggagcgatcagttcc | W13166 | 88808 | agtacatccaatatcaacaggtcac | D10215 |
| 3601 | attgactccgagagtggtcagaa | W48464 | 46205 | gacttccggagcgatcagttccggg | W13166 | 88809 | tccaatatcaacaggtcaccatcc | D10215 |
| 3602 | cagcagagcaatgccgtacagcct | W48464 | 46206 | tagcggcttggtagtcaggcaaa | AA023595 | 88810 | ttcatcccagatacctgagcta | D10215 |
| 3603 | cacgctccaaaggcaagtgtcctga | W48464 | 46207 | cagtggatccccacaaggcgccaga | AA023595 | 88811 | tacctgcagctactggtacccag | D10215 |
| 3604 | ccaaaggcagtgtcctgagcgccac | W48464 | 46208 | ggtgcacctccaggcctgcttcgtc | AA023595 | 88812 | tgagctactggtacccagtaagga | D10215 |
| 3605 | agtgctcgagccacccattgtgg | W48464 | 46209 | cgtcctgcgtcatggttgaactg | AA023595 | 88813 | cctccaaatgctcactacgag | D10215 |
| 3606 | cactcgccaggaagagagcgtga | M91380 | 46210 | tcctgcgtcatggttgaactggt | AA023595 | 88814 | caaatgctcactacagattcta | D10215 |
| 3607 | cagctcttaggatggtacacat | M91380 | 46211 | cctgctgcatggttgaactgt | AA023595 | 88815 | gacagccaacatctgataacaagc | X97986 |
| 3608 | ctggtcatctgaacaagacaatt | M91380 | 46212 | tcatggttgaactggtgggcatgt | AA023595 | 88816 | tacaagcatgtcgtggactct | X97986 |
| 3609 | aatttgtctgcctagtgtctgtg | M91380 | 46213 | ttgaactggttgggcatgtgcgtca | AA023595 | 88817 | ttacacagactgcaaactttcact | X97986 |
| 3610 | ttgctcgcctagtgtctgtgcc | M91380 | 46214 | aactgtggttggcatgtgcgtcaggt | AA023595 | 88818 | cacagactggcaaactttcactcaa | X97986 |
| 3611 | cgctcatgcagtccagatttcatcc | M91380 | 46215 | atgtgcgcaggttgtagccgatgc | AA023595 | 88819 | gcaaacttcactcaacctcggctt | X97986 |
| 3612 | ggagagtcaagacagcaatgccat | M91380 | 46216 | tgtggtgcaggttgtagccgatgc | AA023595 | 88820 | tcaacctcggcttgggtgaagaatcc | X97986 |
| 3613 | gagctcaagacagcaatgccatcat | M91380 | 46217 | gtgcgtcaggttgtagccgatgcct | AA023595 | 88821 | acctggcttggtgaagaatccatt | X97986 |
| 3614 | ctcacgacagcaatgccatcatca | M91380 | 46218 | gtggatctccacaagcgccagaat | AA023595 | 88822 | gtgaagactaacgttcgcccatataa | X97986 |
| 3615 | acagcaatgccatcatcaaaagttt | M91380 | 46219 | tggatctccacagagcgccagaat | AA023595 | 88823 | actacgttcgcccatataactatga | X97986 |
| 3616 | gcaatgccatcatcaaaagttttgc | M91380 | 46220 | tccacaagcgccagaattggtgca | AA023595 | 88824 | ttcgccatataactatgaaggcaa | X97986 |
| 3617 | atgccatcatcaaaagttttgc | M91380 | 46221 | ccacaagcggccagaattggtgcac | AA023595 | 88825 | aaggctccatggctgatctgtggg | X97986 |
| 3618 | tgatctggagatcagagggtgcc | M91380 | 46222 | acaagcggccagaattggtgcacct | AA023595 | 88826 | ctgtgggctgcgatgatcggca | X97986 |
| 3619 | cccacacatgatgataaaaactt | M91380 | 46223 | agaattgtgcacctccaggcctgc | AA023595 | 88827 | tgtggggactctggtgtcaagga | X97986 |
| 3620 | ttgaaagtcaatccttctttgaga | M91380 | 46224 | aattgttgcacctccaggcctgct | AA023595 | 88828 | gactctgggtcaaggaatcaa | X97986 |
| 3621 | gtcaatccttttctttgacactcc | M91380 | 46225 | attggtgcacctccaggcctgttc | AA023595 | 88829 | aatcaaacacagcaaagtttgag | X97986 |
| 3622 | gagacactcgaataaactatggag | M91380 | 46226 | tctgctctagccttaaccacacca | AA023595 | 88830 | aaggccacactggagtccaacaag | X97986 |
| 3623 | ggagatttctgcatagaaagtg | M91380 | 46227 | tttaaccacaccacctggaggaa | U02554 | 88831 | gcctggccgatatgcttacacagac | X97986 |
| 3624 | gatttctgcatagaaagttgg | M91380 | 46228 | cctatcaatcatgccctcttcact | U02554 | 88832 | tggccgatatgcttacacagactgg | X97986 |
| 3625 | ttttctggtcatcgaaccag | M91380 | 46229 | tgccctcttcactactgccaggcct | U02554 | 88833 | ccgatatgcttacacagactggcaa | X97986 |
| 3626 | cagaccctgcgcagcaggcatacctgc | M91380 | 46230 | tgtcgaatgcctcatcttagcct | U02554 | 88834 | tgcttacacagactgcaaacttc | X97986 |
| 3627 | tacctgcccaggtgtctatgca | M27347 | 46231 | gaatgcctcatcttagcctggaa | U02554 | 88835 | gttgcctatgggatgacgaatatcg | AA109527 |
| 3628 | attgcctccaagtggagcttccg | M27347 | 46232 | ctcatcttagccttgaactcaa | U02554 | 88836 | ttcgccttgatgacgaataatcg | AA109527 |
| 3629 | tccaactggaggactccggagtcc | M27347 | 46233 | actggaactgactggaaccag | U02554 | 88837 | tcgaacaacgggtctccgcatgg | AA109527 |
| 3630 | caagatggcttagcttgcaatg | M27347 | 46234 | aaactgcactgggaaccaggagtat | U02554 | 88838 | gaacaacgggctcccggcatgtggc | AA109527 |
| 3631 | ggtctcttagcttgcaatgaactg | M27347 | 46235 | gtgctgctaagctgcatgcatag | U02554 | 88839 | acaacgggctcccggcatgtggcaa | AA109527 |
| 3632 | tatgtcgacgagcctgggctccat | M27347 | 46236 | ttctcagaactgcataaaactgttg | U02554 | 88840 | ctcccgcatgtgcaagccgggc | AA109527 |
| 3633 | cctggagctccatcccctaatactg | M27347 | 46237 | ctgtcccataaagtgtacacacac | U02554 | 88841 | gctttcggggcagaacgaatggct | AA109527 |
| 3634 | gctccatcccctaatactgcaacag | M27347 | 46238 | cacaccaactgctgtaacaggct | U02554 | 88842 | ctttcggggcagacagcctggggctg | AA109527 |
| 3635 | tccctaatactgcaacagcaggt | M27347 | 46239 | tagcaagcaatgcccacactgcag | U02554 | 88843 | ggaaggactctctagtgggtgaca | AA109527 |
| 3636 | atactgcaacagcaggaggaaatg | M27347 | 46240 | agcagtgccaccacagcaggggctt | U02554 | 88844 | ggaaggactctcatgtggggtgca | AA109527 |
| 3637 | gcaactgactactgaatcagata | M27347 | 46241 | tgctgagataagcctgggaacc | U02554 | 88845 | gaaggactcctatggggtgcaa | AA109527 |
| 3638 | gtgtctatagcatctgtcctccagt | M27347 | 46242 | gagataagcctgggaacctgccca | U02554 | 88846 | aaggacttcctatgtggtgacaag | AA109527 |
| 3639 | tccagetctcttactgggggctcct | M27347 | 46243 | agccctggaacctgccotcaact | U02554 | 88847 | atgacgaatatcggcctgcgctgg | AA109527 |
| 3640 | tcctcttactgggggctccttga | M27347 | 46244 | caccacctcttggtcaaccggtc | U02554 | 88848 | tgacgaatatcggcctgcgctgg | AA109527 |
| 3641 | tactgggggctcctcttgaagaata | M27347 | 46245 | gtcaacacctgtctgttttatg | U02554 | 88849 | acgaatatcggcctgcgcgtggtc | AA109527 |
| 3642 | cagtagctcgacgagtgaccactttg | M27347 | 46246 | ctgctgctcgggaggcttcattt | U02554 | 88850 | cgaatatcggcctgcgcgtggggtg | AA109527 |
| 3643 | gctgcgacgagtgaccagcttg | M27347 | 46247 | gagcttcatttcctctcgatct | X53802 | 88851 | gaatatcggcctgcgctgggtgcgt | AA109527 |
| 3644 | accgtctccaacagactctcgtt | M27347 | 46248 | ttcaacggctggactactagga | X53802 | 88852 | atatcggcctgcgctgggtgcgtcgt | AA109527 |
| 3645 | tctgcttcacattcctgatgaata | M27347 | 46249 | gaactgttgccgttcctccaaga | X53802 | 88853 | cgctcgaacaacgtctccggcatg | AA109527 |
| 3646 | agaaatagcaaagtcgcggcagagat | W54905 | 46250 | ctgttgctgttttctccaagac | X53802 | 88854 | gtcgaacaacgggctcccggcatgt | AA109527 |
| 3647 | tgctgcaggaactgcgagagaacac | W54905 | 46251 | gtttcctcaagagctctggaagagg | X53802 | 88855 | cttccacgetggacatccgcttag | AA109527 |
| 3648 | acggtgcaagtgccgacgagttccgca | W54905 | 46252 | tctccaagagtctggaagaggccg | X53802 | 88856 | acagctgggacatccgcttagcga | AA109531 |
| 3649 | atgcctccaagtgccgagcatgt | W54905 | 46253 | gccgtcactgcacactactgtat | X53802 | 88857 | ttctagaggtacccattcagggctg | AA109531 |

| SEQ ID NO | sequence | DBAxnID | SEQ ID NO | sequence | DBAxnID | SEQ ID NO | sequence | DBAxnID |
|---|---|---|---|---|---|---|---|---|
| 3650 | ccaagttgccgagcatgtcttccg | W54905 | 46254 | tgcacactactgtatgaacccteac | X53802 | 88858 | ctagagagtaccattcaggctgtc | AA109531 |
| 3651 | tgccgagcatgtcttccgcacttt | W54905 | 46255 | acactactgtgaacccteactgc | X53802 | 88859 | agaggtaccattcaggctgtcat | AA109531 |
| 3652 | ageatgtcttccgcacttitgacac | W54905 | 46256 | ctactgtatgaaccctcactgccca | X53802 | 88860 | aggtaccattcaggctgtcatca | AA109531 |
| 3653 | tcttccgcacttigaccaacacag | W54905 | 46257 | accctgcgaccaagtgcagtaac | X53802 | 88861 | accatcagggctgtcatcaggca | AA109531 |
| 3654 | gcacttigaccaacacagegacgg | W54905 | 46258 | tcatttcettcgatcctcaggac | X53802 | 88862 | ccattcagggctgtcatcaggatc | AA109531 |
| 3655 | ccaacagcgacggcaacactgcactt | W54905 | 46259 | tcctcttcgatctcaggacttcagg | X53802 | 88863 | ggctgtcatcaggcatcccgaggct | AA109531 |
| 3656 | gcgacggcaacactgcacttccggga | W54905 | 46260 | tcgatctcaggacttcaggcgaaaa | X53802 | 88864 | cgtcatcaggcatcccgaggctct | AA109531 |
| 3657 | tcgacttcgggagttcatcatcgc | W54905 | 46261 | atctcaggacttcaggcgaaaagcg | X53802 | 88865 | gtcatcaggcatcccgaggctctaa | AA109531 |
| 3658 | agaacacgagttctctgagctgca | W54905 | 46262 | ccacgtcctcatggtactgctgg | X53802 | 88866 | catcaggcatcccgaggctctaagg | AA109531 |
| 3659 | ccgagttctctgagctgagctacta | W54905 | 46263 | gccattgctgatttcaactggactg | X53802 | 88867 | ctgggacattgcttagcagatcca | AA109531 |
| 3660 | agctgggctacgagttgtgtacaa | W54905 | 46264 | tctgatttcaactggactggagcta | X53802 | 88868 | caggcatccggagtctctaaggta | AA109531 |
| 3661 | tcctgaaggactgcccgactggcat | W54905 | 46265 | gatttcaactggactggagctacta | X53802 | 88869 | gggacattgcttagcagatccagg | AA109531 |
| 3662 | aggactgcccgactggcatcctcaa | W54905 | 46266 | tcctccgccgacgagtaggccgc | X53802 | 88870 | catcgttagcagatccaggaggct | AA109531 |
| 3663 | gcccgactggcatcctcaagtgga | W54905 | 46267 | gactaacctaacatggccgcacaga | AA023589 | 88871 | ttcgcttagcagatccaggaggctt | AA109531 |
| 3664 | ctggcatcctcaacgtggatgagtt | W54905 | 46268 | aagtcctatcgaagctggccctga | AA023589 | 88872 | cgcttagcagatccaggaggctlcaa | AA109531 |
| 3665 | tcctcaacgtggatgagttcaagaa | W54905 | 46269 | tcctaacgaagctggcctgaagt | AA023589 | 88873 | cttagcagatccaggaggcttcaag | AA109531 |
| 3666 | gaaacgtgtcagcacagaatcat | W54905 | 46270 | tatcggaagctggcctcaagtac | AA023589 | 88874 | agatccaggaggcttcaaggagaa | AA109531 |
| 3667 | aaccgttccagcacagaatcatcc | W48477 | 46271 | aagctggcctgaagtatcacccig | AA023589 | 88875 | atccaggaggcttcaaggagcaacg | AA109531 |
| 3668 | atcctgacctgcctgacctgtcct | W48477 | 46272 | ctggcctgaagtatcacccigaca | AA023589 | 88876 | gtactgacgactgcagctatggc | AA109531 |
| 3669 | cctgtgacctggtctctctagtg | W48477 | 46273 | ctgaagtatcacccigacaagaacc | AA023589 | 88877 | ctgacgactgcagctatggctag | AA109531 |
| 3670 | tgctgacctggtctctctagta | W48477 | 46274 | aagtacccigacaagaaccctg | AA023589 | 88878 | cacgttctctgcgagtcegtca | AA109531 |
| 3671 | tggctctctagtgaccggtgg | W48477 | 46275 | tatcaccctgacaagaaccctgata | AA023589 | 88879 | gttcttgtcgagtcgtcaatt | AA109531 |
| 3672 | ttcaacctgcgaagcacaagttig | W48477 | 46276 | cctgacaagaaccctgataaccccag | AA023589 | 88880 | cttgcggagtcctgtcaattcca | AA109531 |
| 3673 | caacctgcgaagcacaagttigca | W48477 | 46277 | gacaagaaccctgataaccccagag | AA023589 | 88881 | agtcctgcaattccagcctgact | AA109531 |
| 3674 | gaagctctgtgcctgatgaacag | W48477 | 46278 | taacctaacatggccgccagtgagc | AA023589 | 88882 | cctctgataccagcggtgtaac | AA109531 |
| 3675 | aagtcttgcctgatgagcagaa | W48477 | 46279 | cctaacatggccgaccagagcagc | AA023589 | 88883 | ctgggataccatgcggtgtaacctgt | AA109531 |
| 3676 | gtcttgtccctgatgagcagaag | W48477 | 46280 | aacatggccgaccagagcagcgct | AA023589 | 88884 | ggatacatgcggtgtaacctgt | AA109531 |
| 3677 | ttgtcccctgatgagcagaagg | W48477 | 46281 | ctctcactcegggagaatcattat | AA023589 | 88885 | catggtgaacctgtagaaatgct | AA109531 |
| 3678 | ccgtgtccagcagaatcatcctt | W48477 | 46282 | gaatcattaccatgtcttggac | AA023589 | 88886 | gtgtaaccctgtagaaatgctg | AA109531 |
| 3679 | gtgtccagcacagaatcatccttg | W48477 | 46283 | taccatgtcttgactggacaaga | AA023589 | 88887 | tagaaatgctcgatcagcgctact | AA109531 |
| 3680 | ccagcacagaatcatccttggaaaa | W48477 | 46284 | gacaagaatgcaacctcagatgaca | AA023589 | 88888 | acagcactgcagctagcgctagttc | AA109531 |
| 3681 | cagcacagaatcatccttggaaaagg | W48477 | 46285 | aatgcaacctcagatgcattaaaa | AA023589 | 88889 | gaaatgctcgatcagcggctactac | AA109531 |
| 3682 | cacagaatcatcctggaaaaggag | W48477 | 46286 | catccaaatatgctgctcaggtg | X87671 | 88890 | ctgcagctagcgctagttcaccgtg | AA109531 |
| 3683 | cagaatcatcctggaaaaggagag | W48477 | 46287 | ctcaaatagcctgctcatcaggtg | X87671 | 88891 | cagctatgctagttcaccggta | AA109531 |
| 3684 | gacccaactgtggagattgatg | W48477 | 46288 | tcctcccagatgccctgtccag | X87671 | 88892 | gttcaccgtgacgcgggtcatgg | AA109531 |
| 3685 | ttcaatctgacctgcctactg | W48477 | 46289 | tccagatgcccttgtccaggc | X87671 | 88893 | cacgtgtaccgcggtcatggatc | AA109531 |
| 3686 | actaggaagcctcatccgaccaat | W48477 | 46290 | ggcccctgccagccttggcc | X87671 | 88894 | gglacgcggttcatggatcggatc | AA109531 |
| 3687 | tcatccgaccaatgtgtaaacgc | W48477 | 46291 | tttcctctccactigagctg | X87671 | 88895 | acgcggttcatggatcacg | AA109531 |
| 3688 | caccccagccgagtgcagccagta | W48477 | 46292 | tcctcttccactigagctgggt | X87671 | 88896 | cgggatcacgttctgctcgagtc | AA109531 |
| 3689 | catttaaggccagtccagttgact | L01695 | 46293 | tccggcaggttcaaggagagctac | X87671 | 88897 | tcaaggttgctcaccagggaagaga | AA109531 |
| 3690 | ctctctctttgtaaatacatgcatt | L01695 | 46294 | acagactigcegttccagaagaa | X87671 | 88898 | ttgtcaccaggagaaagcg | AA109531 |
| 3691 | ctctctctttgtaagtccatcc | L01695 | 46295 | gactigcegttccagaagact | X87671 | 88899 | ctgtttacagttctgaggtatac | X99104 |
| 3692 | tctgtgaagtccatccatgtc | L01695 | 46296 | ttgcctgttccagagagacttt | X87671 | 88900 | ttggggtctgtggactaggaatag | X99104 |
| 3693 | gaagtccatcccatggtcattaga | L01695 | 46297 | tctigccaatgtattitttgtaagc | X87671 | 88901 | tcctatttccagtcgactatctg | X99104 |
| 3694 | catccatggtcatttgaccgcc | L01695 | 46298 | gcctgcccagtggaccaggagta | X87671 | 88902 | ttctccagtcgacatatcgacact | X99104 |
| 3695 | cattagctgccatcctgaaccgc | L01695 | 46299 | tgctcaggggaccaggagact | X87671 | 88903 | agtgcactactgaccactcctca | X99104 |
| 3696 | acctgccactctgaaccgcatgta | L01695 | 46300 | cgccagggctcatttcagaga | X87671 | 88904 | agacaaccccagcgaccacctgca | X99104 |
| 3697 | aggcccctgctatgccagagatca | L01695 | 46301 | cctcattcagacgagtaagca | X87671 | 88905 | cacactttcggtccctgaccta | X99104 |
| 3698 | tctctgtaacgtctgaggctte | L01695 | 46302 | agaaggagcaggcctcctacctg | X87671 | 88906 | ctctccaggtattlgcatggacca | X99104 |
| 3699 | taaacgtctgaggtctccttctag | L01695 | 46303 | gtaagcaggccccctccctacctggag | X87671 | 88907 | gcatlgattcttggactigaggaac | X99104 |

TABLE 1-continued

| SEQ ID NO | sequence | DBAxnID | SEQ ID NO | sequence | DBAxnID |
|---|---|---|---|---|---|
| 3700 | ctctgaggtcttcctcaggatgta | L01695 | 46304 | tcctacctggcaggtcctcattgtc | X87671 | 88908 | ctcttaactgaattgctgttcagt | X99104 |
| 3701 | ggtcttcctcagatgatatcttat | L01695 | 46305 | gcaggtcctcattgtccttcct | X87671 | 88909 | atattgagtctccagttactg | X99104 |
| 3702 | agcagctagcccagtacaagcagg | L01695 | 46306 | agtatgactcatccagagacagaag | AA023559 | 88910 | tagtctccagttactgctaaca | X99104 |
| 3703 | gtattaccagttaatgtgacacag | L01695 | 46307 | atgactcatccagagacagaagat | AA023559 | 88911 | cctcagttactgctaacatctcca | X99104 |
| 3704 | agcaactiggcaccagagcgag | L01695 | 46308 | aactgatgcctgatgtcggctac | AA023559 | 88912 | ttacttgtcaacatctcattcct | X99104 |
| 3705 | ttgagcaccccagagcgagtgcagc | L01695 | 46309 | actgcatgcctgatgtcggctatcg | AA023559 | 88913 | gctaacatccattcctaggta | X99104 |
| 3706 | gaaggctcagtactacctgccgat | W48490 | 46310 | atgcctgatgtcggctatcgagcta | AA023559 | 88914 | atcctcattccttaggatagatggg | X99104 |
| 3707 | tcagtactacctgccgatggccagc | W48490 | 46311 | cctgatgtcggctatcgagcctaccg | AA023559 | 88915 | gtctctcctggctgttacagtgt | X99104 |
| 3708 | gcgtcaggcctgactgattggc | W48490 | 46312 | ctgatgtcggctatcgagctaccgg | AA023559 | 88916 | cctggcgttcagtgtctgtg | X99104 |
| 3709 | gtcaggcctgactgattggcgag | W48490 | 46313 | atgtcggctatcgagctaccggca | AA023559 | 88917 | tatcagtgtcgtttgctgcaga | AA110543 |
| 3710 | gcctgacttgattggcgaggagagt | W48490 | 46314 | gtcggctatcgagctaccggccaac | AA023559 | 88918 | agtgtgtctttgctgcagagataa | AA110543 |
| 3711 | tatcatgagggtgtggtcgct | W48490 | 46315 | tcggctatcgagctaccggcaacc | AA023559 | 88919 | tggaacatcacttataagagaggag | AA110543 |
| 3712 | ccatgagggtgtggtcgct | W48490 | 46316 | ggctatcgagctaccgccaacg | AA023559 | 88920 | aggagaatcctatctcaagatagg | AA110543 |
| 3713 | tgagggtgcgtttgtgctaccag | W48490 | 46317 | gctatcgagctaccggccaaccgg | AA023559 | 88921 | gagaatcctctcaagatagataagg | AA110543 |
| 3714 | ggtgtctatcacagaagtcagac | W48490 | 46318 | ttagataatgcactgccagatgag | AA023559 | 88922 | atccttcatcaagatagatgaag | AA110543 |
| 3715 | gtcgctatccagaagtcagacatg | W48490 | 46319 | agataatgcactggcagatgagct | AA023559 | 88923 | tgccctgggttctgtgccattaac | AA110543 |
| 3716 | cgctatccagaagtcagacatggat | W48490 | 46320 | gataaatgcactggcagatgagt | AA023559 | 88924 | ccctggggtctgtgcagtaacga | AA110543 |
| 3717 | tatccagaagtcagacatggatta | W48490 | 46321 | taatgcactgcagatgagagctgg | AA023559 | 88925 | ggtgttcgtgccattaagatagt | AA110543 |
| 3718 | gtactactgccccgatggcagacc | W48490 | 46322 | aatgcactgcgatgagagctgg | AA023559 | 88926 | tgttctgtgccattaacgatagtga | AA110543 |
| 3719 | ctactgccgatggcagcaccatt | W48490 | 46323 | tgcactgccagatagagctgggg | AA023559 | 88927 | ttctgccattaacgatagtgaa | AA110543 |
| 3720 | tggcagcaccattgcagtggccct | W48490 | 46324 | actgcgcagatgagcttggggaga | AA023559 | 88928 | ggctaacctatgacacactgaac | AA110543 |
| 3721 | caccattgcagttgcccttccag | W48490 | 46325 | tgaactgcatgcctgatgtcggcta | AA023559 | 88929 | tgtgctttgtctgcagagtaaaa | AA110543 |
| 3722 | tgagattggccctccagttccgg | W48490 | 46326 | aacatgaccggcgcagctagccc | AA023669 | 88930 | ctatacctatgacacatctgactg | AA110543 |
| 3723 | ggccccctgagctctgtcaggtccgg | W48490 | 46327 | accatgaccggcgcgacgtagcct | AA023669 | 88931 | tgtgtttgtcagatgaaaaac | AA110543 |
| 3724 | tgagctgtgctcaggctgtcaggct | W48490 | 46328 | gtagccctcgagctgtcagcct | AA023669 | 88932 | gaaagctgaacctcatcgtgac | AA110543 |
| 3725 | gctgcgttcaggctgactgatt | W48490 | 46329 | agccctctcactgctgggagaccgg | AA023669 | 88933 | aagctgaaccctcatcgtgact | AA110543 |
| 3726 | cattccgcagttgcagaaccagg | W48490 | 46330 | gccttctcactgtggagaccga | AA023669 | 88934 | aacctcatcgtgacgtgtccggg | AA110543 |
| 3727 | ttgcaagaccagggaccgcgttattac | M29464 | 46331 | ttctcactgctgggagaccgatctg | AA023669 | 88935 | cctcatcgtgacgtgccgggaa | AA110543 |
| 3728 | ttgcaaggtggccaaagtgagtat | M29464 | 46332 | tctccactgctgggagaccgatctgg | AA023669 | 88936 | atgcattgaacactcatttaataga | AA110543 |
| 3729 | acaccctggggtgtcatgtcgcgacc | M29464 | 46333 | tcactgctgggagaccgatctggaa | AA023669 | 88937 | attggacatcacttaataggaga | AA110543 |
| 3730 | tgcatgtgcgacctccaactgaac | M29464 | 46334 | actgctgggagaccgatctgggaac | AA023669 | 88938 | tgtaggccctcaagaatgacgtcc | AA110543 |
| 3731 | tgacatcctgaacatactgatgt | M29464 | 46335 | tgctgggagaccgatctgggaacca | AA023669 | 88939 | ccagtatcatccactccactcgcag | Y07941 |
| 3732 | tcctgaactcatacttagtggct | M29464 | 46336 | aagggtagtaccctagggctgcacga | AA023669 | 88940 | atttgcctcagttccatatctaa | Y07941 |
| 3733 | tggttgctcaatgcaatgtgctg | M29464 | 46337 | acgagcctcagtcggcgtcatg | AA023669 | 88941 | ctcctagttccatatctaaaacag | Y07941 |
| 3734 | ttcattgccaatgtgcgtgccgt | M29464 | 46338 | catgaccgtgcgcagctagccctt | AA023669 | 88942 | tttggactgtcgcagcgtcggga | Y07941 |
| 3735 | gccaatgtgcgtgccgttttgttc | M29464 | 46339 | gtgccgcagctagccttccactg | AA023669 | 88943 | ctgcgcagctgcagggaccctcc | Y07941 |
| 3736 | cagtgtcgtgctttcagtgtgaca | M29464 | 46340 | tgccgcagctagcccttctcactg | AA023669 | 88944 | actgcctgtccactgtgatga | Y07941 |
| 3737 | ctccttgtcacagaagtgcagaaac | M29464 | 46341 | cgcagctagcccttctcactgc | AA023669 | 88945 | cttgctcatcgtgatgagaacct | Y07941 |
| 3738 | cattagagatacctgagcaggccag | M29464 | 46342 | gcagctagcccttctcactgctg | AA023669 | 88946 | ttgtgctgaacggccccagttcct | Y07941 |
| 3739 | cgagatacctgagcaggttgac | M29464 | 46343 | cagcgtagccttctcactgctgg | AA023669 | 88947 | gaaacgggccagttcctcttgtatg | Y07941 |
| 3740 | atggccaactccgatctggccc | M29464 | 46344 | ggcgtacgccttctcactgcgggag | AA023669 | 88948 | gatacaacatgtatttgcttgtca | Y07941 |
| 3741 | caacttcgatctgcccccatgt | M29464 | 46345 | cgtagccctcctcactgctgggaga | AA023669 | 88949 | ccatgtattgcttgtcaaaatat | Y07941 |
| 3742 | gggctgactgctgcgtgtaacaac | M29464 | 46346 | ttgcatgggtgatcgcgccgcca | AA023669 | 88950 | taggttcaccattgctttgggat | Y07941 |
| 3743 | ctgtgtaaccacagcgtgaact | M29464 | 46347 | taatccgaccttcatatcggaact | AA023665 | 88951 | aggcttaagatacccagaggtcag | Y07941 |
| 3744 | cagagggtcacggccagccttca | M29464 | 46348 | tgtattacggcagcaggttcctca | AA023665 | 88952 | taagatccagaggtcaggctcaa | Y07941 |
| 3745 | cgtcaagtcgcagcgcttccaggc | M29464 | 46349 | tattagccgagcaggttcctcaggc | AA023665 | 88953 | ggaactcctcatgatcccaagct | Y07941 |
| 3746 | cctcacactggtataatgtcttcctg | J05185 | 46350 | ccgagcaggttcctcaggtcactc | AA023665 | 88954 | atgatctcaagctggccatggcc | Y07941 |
| 3747 | accaattcgcatcatcgtgagg | J05185 | 46351 | aggttcctcaggtcactcgaact | AA023665 | 88955 | tgtgcctcattccaggaaaaat | Y07941 |
| 3748 | ggatcatgcatcctgtcaagggg | J05185 | 46352 | ctcaggtccaggtcactactgat | AA023665 | 88956 | cttggacttctgtatccgacactt | Y07941 |
| 3749 | tcaagctgaggtactgtcaaggccg | J05185 | 46353 | aggctcactcatcggaactactgatctt | AA023665 | 88957 | gtatccagactatatctcattggtt | Y07941 |

| SEQ ID NO | sequence | DBAxnID | SEQ ID NO | sequence | DBAxnID | SEQ ID NO | sequence | DBAxnID |
|---|---|---|---|---|---|---|---|---|
| 3750 | caggactaccgaccagccggctatg | J05185 | 46354 | cggaactactgatcttggacattgg | AA023665 | 88958 | actlgactgaagcctgtcgctcta | Y09419 |
| 3751 | taccgacagccggctaggccaca | J05185 | 46355 | aactactgatcttggacattggctt | AA023665 | 88959 | tgactgaagccgtcgctctatga | Y09419 |
| 3752 | ctgtggctgcgattccttccag | J05185 | 46356 | tactgatcttggacattggcttgc | AA023665 | 88960 | ccatagccgtatagccatcaaat | Y09419 |
| 3753 | gatctcttccagcatgcctgtggc | J05185 | 46357 | tcttggacattggcttgctgtgt | AA023665 | 88961 | tatgccgtatagccatcaaatgt | Y09419 |
| 3754 | tttccagcatgcctggcctgtgt | J05185 | 46358 | ggacttcatatgcgaactgcaggt | AA023665 | 88962 | tatgccatcaaatgtcaggcaac | Y09419 |
| 3755 | aatgaaatgcccattctcaggcat | J05185 | 46359 | tatcggaactgcaggtacgcgcgga | AA023665 | 88963 | gtcaggcaactgctcatgaattcct | Y09419 |
| 3756 | atgccattctcaggcattctac | J05185 | 46360 | tgcaggtacgcgggatgcgccagt | AA023665 | 88964 | caactgctcatgaattccttcagt | Y09419 |
| 3757 | attcttcaggcattctaccataat | J05185 | 46361 | aggtacgcgggatgtgccgcagt | AA023665 | 88965 | ctgctcatgaattcctttcagtgt | Y09419 |
| 3758 | ttcatctgaaggcattcatcttt | J05185 | 46362 | tacgcgggatgatgccgcagtcg | AA023665 | 88966 | caattagacagcccagcaaagactg | Y09419 |
| 3759 | atgctcatgccagctactgtt | J05185 | 46363 | cagccagacatctgctgagtgtct | AA023665 | 88967 | gacagcccagcaaagactgcagaat | Y09419 |
| 3760 | actgttcaccatggcagaacctcc | J05185 | 46364 | gtcaaagagccgcgtctggt | AA023665 | 88968 | gcagaatgcactgaccctagaat | Y09419 |
| 3761 | ttcaacatggcagaacctccgagt | J05185 | 46365 | taagagcagcccgcgttctggtt | AA023665 | 88969 | tcaagaccttaattggacatg | Y09419 |
| 3762 | tctgcctggtaggaagttggc | J05185 | 46366 | ttgaccgcaagacattgctgaact | AA023665 | 88970 | ctgaagcctgtcgctagaaga | Y09419 |
| 3763 | ctctgggtctgtggcactctccac | J05185 | 46367 | cattgctgaactgccacatcgg | AA023665 | 88971 | aacagctgggggctgtatgtcc | Y09419 |
| 3764 | tctccacctgtcctagtgtgcca | J05185 | 46368 | ccgatgacatgccgtatagagagtt | AA023665 | 88972 | gggctgtatgtctgtggaatt | Y09419 |
| 3765 | catttaacctggggatctatgcatc | J05185 | 46369 | gtggttctgccttcacaaatgca | AA023665 | 88973 | attgtcctgggaattcctcaaaga | Y09419 |
| 3766 | aggcgttgccagttccaacgccag | AA071689 | 46370 | aatgtcatgtctcactagaaga | AA023665 | 88974 | tctgtgccctcatacttggaatt | Y09419 |
| 3767 | gcggttgcccagttccaacgccagt | AA071689 | 46371 | atgtctacttcatagaagaaccaaa | AA023665 | 88975 | gtgtgtcgggcaacttcctgac | Y09419 |
| 3768 | ttcgtcaccttccctgactgt | AA071689 | 46372 | tgtgttgctagtgtactctg | AA023665 | 88976 | tcctgacctccatatgccgtatag | Y09419 |
| 3769 | tcacctttccctgacttgctctcat | AA071689 | 46373 | tcggtactgactatctgtaaata | AA023665 | 88977 | cctcatatgccgtatatgccatca | Y09419 |
| 3770 | tccctgacttcctctcatcttga | AA071689 | 46374 | ctttcgccactgacgacaaagcca | AA023665 | 88978 | actccgattccattcatggcctt | Y09419 |
| 3771 | cctgactgcttcattcatcttttgagt | AA071689 | 46375 | gcactgacgacaaagccagtgtag | AA023665 | 88979 | ttcccgatccatttcattggcctct | Y09419 |
| 3772 | catcttgagtttatcttggaggc | AA071689 | 46376 | acagacaaagccagtgtaggttgt | AA023665 | 88980 | ttatccgatgatgatttaggact | AA110549 |
| 3773 | tttgagttatcttggaggcctgg | AA071689 | 46377 | tagcttcagttatgcacagtgta | AA023665 | 88981 | atgaactcacagcaggcggaaaca | AA110549 |
| 3774 | agttatcttggaggcctgctgtg | AA071689 | 46378 | ctgaatccgcacattcggaccaa | AA023665 | 88982 | agaactcacagcaggcggaaaca | AA110549 |
| 3775 | tttatcttggaggcctgctgtga | AA071689 | 46379 | tcggcacattcggaccaatatatt | AA023665 | 88983 | acttcacagcaggcggaaacaaa | AA110549 |
| 3776 | tctgtgtctgcttcctgccaca | AA071689 | 46380 | tccatcaagtcccctgacaaaaca | AA023665 | 88984 | agaattcactgtagcacaggcatc | AA110549 |
| 3777 | tgtgtctgcttctgccaccactc | AA071689 | 46381 | aagtcccctgacaaaacgaggggcag | AA023665 | 88985 | aatccatgctagacacaggcatctc | AA110549 |
| 3778 | gtgtccagtccaagccagctcg | AA071689 | 46382 | ttttctagaaactcatgcttgac | AA023665 | 88986 | ttcactgacacaggcatctcag | AA110549 |
| 3779 | cccggcgagcagttcgggtggcag | AA071689 | 46383 | tagaaacttcatgcttgacacacc | AA023665 | 88987 | ctgtagacacaggcatctcagtgta | AA110549 |
| 3780 | gggcagcagttcgggttggcagcagcacc | AA071689 | 46384 | caccagtattaaccattcccgatga | AA023665 | 88988 | gtagacacaggcatctcagtgtaaa | AA110549 |
| 3781 | cagcagttcgggttggcagcacct | AA071689 | 46385 | tattaaccattcccgatgacatgcg | AA023665 | 88989 | agacacaggcatctcagtgtaatt | AA110549 |
| 3782 | tgcccagttcgctcccgtcttgt | AA071689 | 46386 | atgcagccctagatcgtcttggcc | AA023665 | 88990 | ccggattccactcatggccttctta | AA110549 |
| 3783 | cccagttcgctcccgtcttcgtca | AA071689 | 46387 | atctgtcttggcagcccaccgaa | AA023665 | 88991 | ggattccattcatggccttcttaac | AA110549 |
| 3784 | cagtggcttctcccgtcttcgtcacc | AA071689 | 46388 | tggtcatgcagccccagccatctgg | AA023665 | 88992 | attccattcatggccttcttaactt | AA110549 |
| 3785 | gtggcttctccgtcttcgtcacct | AA071689 | 46389 | aggcctgccaaggtcattgtgcagt | AA023665 | 88993 | tccatcatggccttcttaacttag | AA110549 |
| 3786 | ataccgctaggcaagaaatacaa | AA071689 | 46390 | tgcctgccatctctgggcaagat | AA023665 | 88994 | cattcatggccttcttaactagtc | AA110549 |
| 3787 | acctgtcatcgcaagattggatgc | AA071689 | 46391 | ccatctctggggcaagattaaagg | AA023665 | 88995 | ttcatggccttcttaacttagtcct | AA110549 |
| 3788 | aacatgccacaagaggagcaggagc | J05186 | 46392 | aagactctgtctcggtatga | AA023665 | 88996 | catggccttcttaacttagtcctg | AA110549 |
| 3789 | aggcaccagcactagtggacagca | J05186 | 46393 | tgtgctcagggttatgatatcaa | AA023665 | 88997 | tcttaactagtccttgaacaactg | AA110549 |
| 3790 | gacaggcattgccaccaaggcacgtg | J05186 | 46394 | atatcaacagccaaggtagagaagtc | X76652 | 88998 | ggcagatccagacctcgtcccaca | AA109774 |
| 3791 | caccaagcaagtggccaaggtga | J05186 | 46395 | aagtgaactcccaagaaatacacat | X76652 | 88999 | cagcagaccgacctcgtcacaaa | AA109774 |
| 3792 | tttgttaatgccacctaggtct | J05186 | 46396 | actcccaaggaaatacacatgctcc | X76652 | 89000 | gctctcggaatatcccagcatcat | AA109774 |
| 3793 | taatgccacctatgcgtgaatac | J05186 | 46397 | aggaaataacacatgcttccaattaa | X76652 | 89001 | tcgaatatcccagcatcatcctt | AA109774 |
| 3794 | cacctatgcgtgaatactgaata | J05186 | 46398 | ctttgcaccagcaacatgtataaa | X76652 | 89002 | cccagcatctctgagcttatgcc | AA109774 |
| 3795 | actattactcagtatctctcag | J05186 | 46399 | aggctcctccagagacattgtataa | X76652 | 89003 | gcatcatcctcctgagcttatgcc | AA109774 |
| 3796 | tactcagtatctctcagacaat | J05186 | 46400 | cagcagacatccagggtcaccaccat | X76652 | 89004 | atcatcctcctgagcttatgccac | AA109774 |
| 3797 | agtatctctcagacaaataagttt | J05186 | 46401 | acatccaggtcaccactatcgga | X76652 | 89005 | tccttcctgagcttatgccacgaag | AA109774 |
| 3798 | tggatctactgccaagacatcac | J05186 | 46402 | aggtcaccactactggagaaact | X76652 | 89006 | cttcctgagcttatgccagaagct | AA109774 |
| 3799 | ctactgccaacgcatcaccaacga | J05186 | 46403 | agtgttcgaacgtcaacgagctga | X76652 | 89007 | tccgagcttatgccacgaagctga | AA109774 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3800 | ccaacgatcaccaacgaccaata | J05186 | 46404 | gccacgcagcagcaacgcaacggcac | X76652 | 89008 | gcttatgccagaagctgagatcaa | AA109774 |
| 3801 | acatcaccacgaccaatataagt | J05186 | 46405 | acagcaacggcactgagatggtcag | X76652 | 89009 | ttatgccacgaagctgagatcaatg | AA109774 |
| 3802 | gttccctaccactcattgtctc | J05186 | 46406 | aattcaccaagaagttgcacatgtc | AA023740 | 89010 | agacctcgtccacaaactcaactc | AA109774 |
| 3803 | ctaccatctattttgctcccagtg | J05186 | 46407 | tcaccaagaagttgcacatgtccca | AA023740 | 89011 | tttaaacagcagtgcctttgatatc | AA109774 |
| 3804 | tctattttgctcccagtggggacaa | J05186 | 46408 | agatgttgccaaaatccttgactac | AA023740 | 89012 | taaacagcaggcgcttgatatcgt | AA109774 |
| 3805 | tagatgaacatgccacaagaggag | J05186 | 46409 | tgttgccaaaatccttgactacaag | AA023740 | 89013 | ccacgctcgatgagacctggcaaa | AA109774 |
| 3806 | aggcgtcctcactgcggaagcaag | W48504 | 46410 | tgccaaaatccttgactacaagtgt | AA023740 | 89014 | accgtcgatgagacctggcaaagt | AA109774 |
| 3807 | ggcgtcctcactgcggaagcaaga | W48504 | 46411 | gtgtgtctcagatctaaggctgcc | AA023740 | 89015 | ctcgatgagacctgcaaagtactg | AA109774 |
| 3808 | gaagcaacggcctggtgaagaaggag | W48504 | 46412 | cagatctaaggctgccgggatccca | AA023740 | 89016 | atgaccgtctcggaatatccaga | AA109774 |
| 3809 | agcaacggcctggtgaagaaggag | W48504 | 46413 | atctaaggctgccgggatcccagca | AA023740 | 89017 | gaccgctcgcgaatatccagca | AA109774 |
| 3810 | gaggagttccacagacctgaagcc | W48504 | 46414 | taaggctgcgggatcccagaga | AA023740 | 89018 | tccaggcctcaaggaagctagagc | AA109774 |
| 3811 | ggagttccacagacctgaagccaa | W48504 | 46415 | tgccaggacccagcacagttgcag | AA023740 | 89019 | ctagagctgcagcagtcaacca | AA109799 |
| 3812 | gagttccacagacctgaagccaga | W48504 | 46416 | cgggatcccagcacagcacatggga | AA023740 | 89020 | ctcatttcattggtgctcttct | AA109799 |
| 3813 | gttcccacagacctgaagccagagg | W48504 | 46417 | agcagcacatggagccctagaagattg | AA023740 | 89021 | gtcattgtggtcctcttcctgt | AA109799 |
| 3814 | ttcccacagacctgaagccagagga | W48504 | 46418 | gcctcgaacatagggtgtgag | AA023740 | 89022 | gtgggtcctcttcctcctgtcctgtgga | AA109799 |
| 3815 | cccagacctgaagccaggaaggag | W48504 | 46419 | tggcccccgaacgcattagtgcctc | AA023740 | 89023 | ctcttcttcctgtcctgatgcca | AA109799 |
| 3816 | ccacagacctgaagccagccaaag | W48504 | 46420 | aacgcattagtgcctcaaggtgcag | AA023740 | 89024 | ttcctggcatgccccatcttca | AA109799 |
| 3817 | gagttccacagacctgaagccaga | W48504 | 46421 | gcattagtgcctcaggaaatctccg | AA023740 | 89025 | atgccaatctcagtgccaatgcct | AA109799 |
| 3818 | gttcccacagaccctgaagccagagg | W48504 | 46422 | ttagtgcctcaggaaatctccgctt | AA023740 | 89026 | agtgccaatgcctgcgggcatatg | AA109799 |
| 3819 | cagactgaagccagaggaagttggc | W48504 | 46423 | cctcaggaaatctccgcttaagttg | AA023740 | 89027 | aatgcctggcatatgacacgg | AA109799 |
| 3820 | ctctcacgtcggaagcagaaccaag | W48504 | 46424 | caggaaatctccgcttaagttgcag | AA023740 | 89028 | gcatatgacacggttctgccgaga | AA109799 |
| 3821 | gaacattgcagcagcaccggctg | W48504 | 46425 | tccgcttaagttgcaggcgaatgaa | AA023740 | 89029 | gtttctgccagaaacactctcag | AA109799 |
| 3822 | aacattgcagcagcaccggcctgg | W48504 | 46426 | gctcgcagtcgttcaggccgcgtg | AA023740 | 89030 | ctgcacagtctcaaccagcagcag | AA109799 |
| 3823 | cattgcagcagcaccggcctggtg | W48504 | 46427 | acgtgcagtccggtcacatcagcct | AA023740 | 89031 | tcaaccagcagcaggggtgcagaa | AA109799 |
| 3824 | attgcagcagcaccggcctggtga | W48504 | 46428 | gccgcgtgcctgcttacgttaagtac | AA023740 | 89032 | atccaagcatcagagcagtgt | AA109799 |
| 3825 | tgcagcagcaccggccctggtgaag | W48504 | 46429 | cgttaagtactcgcttcggagcat | AA023740 | 89033 | agtggtcgtcgcaacctgatcg | AA109799 |
| 3826 | agcagcaccggcctggtgaagaag | W48504 | 46430 | taagtactcgcttcgggagcatcaa | AA023740 | 89034 | tctgcgtccaacctgatcgccaga | AA109799 |
| 3827 | gtctgcaccattgggatgctgctat | M97900 | 46431 | gtactcgcttcgggagcatcaacac | AA023740 | 89035 | gtgatccgcatgccattgcattg | AA109799 |
| 3828 | gtctgcaccattgggatgctgctat | M97900 | 46432 | ctcgcttcggagcatcaacacg | AA023740 | 89036 | gtgaacctgtcgtccaagaagtcg | AA109799 |
| 3829 | acatggcaaccaatcttgtcagg | M97900 | 46433 | cgctcggagcatcaacacgtgaag | AA023740 | 89037 | cgcatgcatgtcattgcatggtgtcc | AA109799 |
| 3830 | caaccaatcttgtcaggtggatg | M97900 | 46434 | ttcggagcatcaacacgtgaagacc | AA023740 | 89038 | cctgacctttgcagtcgtgtgc | AA109799 |
| 3831 | atcttgttcaggtggatggatggga | M97900 | 46435 | atcaacacgtgaagaccaaggaa | AA023740 | 89039 | cttatgagaccactalgggcata | AA109799 |
| 3832 | aaactacatctccctgtgaca | M97900 | 46436 | atcaacacgtgaagaccaaggaaggaa | AA023740 | 89040 | ctacaggcttcagaagctgaggcct | U46463 |
| 3833 | calcttccctgtagacacaaaagt | M97900 | 46437 | tcaacacgtgaagaccaaggaagg | AA023740 | 89041 | actacaactcatggcgcctgg | U46463 |
| 3834 | aaatggtgcaatccaccaaacag | M97900 | 46438 | tgacctggtcatcagcctga | AA023740 | 89042 | actctcatggtcctgtgacatgg | U46463 |
| 3835 | ttttctcaatgtaatcaccctact | M97900 | 46439 | accctgtcacatcagccttgaggc | AA023740 | 89043 | atggtgcctgacatgagagtc | U46463 |
| 3836 | caatgtaatcacctacatgtggaa | M97900 | 46440 | ctgtcacatcagccttgaggcgt | AA023740 | 89044 | catgcttactgagtctctgct | U46463 |
| 3837 | aatcaccctacatgtggaaatagca | M97900 | 46441 | tcggaatccgacatagagcgtgat | AA023740 | 89045 | tacttaggatcttcgtctgtgta | U46463 |
| 3838 | atgtcttttttgggaagagacaga | M97900 | 46442 | gagatccgacatacgagctgattgc | AA023740 | 89046 | ggatcttgtctgtcgtaggaccgg | U46463 |
| 3839 | gtgtatctcctgattgctcacatt | M97900 | 46443 | atccgacatacgagctgattgctcg | AA023740 | 89047 | ataatactcacagcagctcacagt | U46463 |
| 3840 | tctcctgattgctcacattgtggtg | M97900 | 46444 | catacgagctgattgctcgcgcgtg | AA023740 | 89048 | ctcagctccagtcacatgtgtagt | U46463 |
| 3841 | gaattaacagccagccagccatcat | M97900 | 46445 | agctgatctgctgcgcgtctg | AA023740 | 89049 | gcagctcacatggtagtggtttc | U46463 |
| 3842 | acagccagccatcattgcagaccag | M97900 | 46446 | gacctgaagccctcaaacatgacagt | AA023740 | 89050 | gggcatatcttctagctgcatatt | U46463 |
| 3843 | agccagccatcattgcagaccaag | M97900 | 46447 | cctgaagctcaacatgacagtgga | U25708 | 89051 | atcttcctagctgcatatccalga | U46463 |
| 3844 | cagatcagccatcagcatcagtgg | M97900 | 46448 | cagtccctttggcctgatcct | U25708 | 89052 | aacactgcacctttgccatgtc | U46463 |
| 3845 | atgcatccacatgatatacatgc | M97900 | 46449 | tccccttggcctgatcctcct | U25708 | 89053 | tccaaacgcaaccaatcgctaatg | U46463 |
| 3846 | tgtatacatggcaaccaatcttg | M97900 | 46450 | ccctttggcctgatcctcctat | U25708 | 89054 | agcaaccaatgctaatgcacacc | U46463 |
| 3847 | ctcagttcatcaacttccatcta | M97900 | 46451 | ccttttgcctgatcctcctag | U25708 | 89055 | gctaatgcacaccacacgcctig | U46463 |
| 3848 | cagttcatcaacttccatctg | W48519 | 46452 | ttgtggcctgatcctcctatgcag | U25708 | 89056 | cctgatgcctgatgcctgaagcaaaaaa | U46463 |
| 3849 | tgaatgcatcaaccaatatggca | W48519 | 46453 | gtgggccatcaaccatgcagaa | U25708 | 89057 | caagtctacagggtccagaagagctg | U46463 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 3850 | aatgacatcaaccaatatggcaga | W48519 | 46454 | cctgatccttcctatgcagaacta | U25708 | 89058 | ataagcaacaaggcttcaggagaga | AA117787 |
| 3851 | atgacatcaaccaatatggcagag | W48519 | 46455 | tgatccttcctatgcagaacctacc | U25708 | 89059 | agcaacaaggcttcaggagagatca | AA117787 |
| 3852 | gacatcaaccaatatggcagaggc | W48519 | 46456 | attacatagaattcttatactggg | U25708 | 89060 | agcataatgaactcctggttaattg | AA117787 |
| 3853 | atcaaaccaatatggcagaggccgt | W48519 | 46457 | acaatacgaattctatatcgggtgt | U25708 | 89061 | gttatgtcctctctctatctggaa | AA117787 |
| 3854 | tcaaaccaatatggcagaggccgc | W48519 | 46458 | ctgtaagcctcacatgacagtgaa | U25708 | 89062 | attgtcctcttctatctggaatgg | AA117787 |
| 3855 | aaccaatatggcagaggccgtccaa | W48519 | 46459 | taagcctcaacatgacagtgaagg | U25708 | 89063 | gtcctctcttatctggaatggtag | AA117787 |
| 3856 | atatggcagaggccgtccaaagaag | W48519 | 46460 | ctcaacatgacagtgaaggccgaga | U25708 | 89064 | ctcttctatctgaatgtagcta | AA117787 |
| 3857 | tatggcagaggccgtccaaagaagt | W48519 | 46461 | tagggcctcaacctcctgctgg | U25708 | 89065 | atgttacgcacgctacataagata | AA117787 |
| 3858 | cagaggccgtccaaagaagaagag | W48519 | 46462 | cctcccgaagctgaaaactgag | U25708 | 89066 | ttacgcacgtacataaagatatg | AA117787 |
| 3859 | ttcatcaacttcccatctgtgt | W48519 | 46463 | tgagcctgaatccttatgagggct | U25708 | 89067 | aaccagatgagacttcacgaagatg | AA117787 |
| 3860 | tcatcaacttcccatctatgtg | W48519 | 46464 | tgttacagttcccctttggccctg | U25708 | 89068 | gacctcacggaagatgccaggaag | AA117787 |
| 3861 | tcaacttcccatctatgtggagag | W48519 | 46465 | tacagtcccctttgggcctgatc | U25708 | 89069 | tctacgaagatgccaggaagaat | AA117787 |
| 3862 | aacttccccatctatgtgtggagta | W48519 | 46466 | cgttagtccatctcctatccaaaa | U25708 | 89070 | tattctatagttttgaggaagaga | AA117787 |
| 3863 | acttcccatctatgtgtggagtag | W48519 | 46467 | agtccatctcctatgccaaaatcaa | AA023764 | 89071 | atcagatgggcgctcaggtggact | AA117787 |
| 3864 | tttcccatctatgtggagtagca | W48519 | 46468 | actgtgggcgctcagtggatgtca | AA023764 | 89072 | agatggggcgctcaggtggactata | AA117787 |
| 3865 | ttcccatctatgtggagtagcaa | W48519 | 46469 | ggcttgtcagtggagtcagagtc | AA023764 | 89073 | ctgagtctatgcctcacaccata | AA117787 |
| 3866 | cccatctatgtggagtagcaaga | W48519 | 46470 | ctgctcagtggagtcagagttcat | AA023764 | 89074 | gagtctatgcctcacaccatatc | AA117787 |
| 3867 | gtgctccgtcctacatgggtgatgg | W48519 | 46471 | agagaagacactacacatagaatta | AA023764 | 89075 | tctatgcctcacaccatatcagt | AA117787 |
| 3868 | ctgtcctagggtgatgggaacaa | W48519 | 46472 | agaagacactacacatagaattatg | AA023764 | 89076 | cacaccatattcagtggtttagca | AA117787 |
| 3869 | tggatgcgtgtcagatgtgtca | M32484 | 46473 | aagactactacacatagaattatggg | AA023764 | 89077 | accatatcagtggtttagcataa | AA117787 |
| 3870 | gggcaaccagtccctgaacatt | M32484 | 46474 | cctactacaagaatatgggagt | AA023764 | 89078 | tcatgaatcgttcagtggtgtat | AA117787 |
| 3871 | gaacattgagtgtcctgctgtcg | M32484 | 46475 | tggcagttgccagcagtgtgaaag | AA023764 | 89079 | tgaatctgttcagtggtttatgac | AA117787 |
| 3872 | tcgagttgtcctgctgtcgctggagt | M32484 | 46476 | cagttgccagcagcgtgaaaagcaca | AA023764 | 89080 | acgcagtccagctatcaagaattatg | AA162233 |
| 3873 | gcccttttgtccaccgagatttg | M32484 | 46477 | tatctcaacctcgtaaatgtat | AA023764 | 89081 | tttgcctgtcgaagtactgatttc | AA162233 |
| 3874 | ttgcgaccgagatttgattga | M32484 | 46478 | tccatctctatgccaaaatcaagt | AA023764 | 89082 | gcctgtcgaagtactgatttcaca | AA162233 |
| 3875 | atcacatatgccggctatgacagcc | M32484 | 46479 | catcctatgccaaaatcaagtcgtg | AA023764 | 89083 | tactgatttcacaagcaggactat | AA162233 |
| 3876 | tatgcggctatgacagcctact | M32484 | 46480 | tctcctatgccaaaatcaagtcgtg | AA023764 | 89084 | tgatttcacaagcaggactatat | AA162233 |
| 3877 | ggctatgacagccctactcttcaa | M32484 | 46481 | atgccaaaatcaagtcagctgggaaat | AA023764 | 89085 | agataacaggggtccagttgcat | AA162233 |
| 3878 | ccttacttttcagaatcagcaat | M32484 | 46482 | gggaaatccatcatgactgctggg | AA023764 | 89086 | gttgcatccctactgctgcttgat | AA162233 |
| 3879 | atgaccagttgctgaggcactga | M32484 | 46483 | tccatcatgactgtgggctgtcca | AA023764 | 89087 | gcatccctactgctgtgatcaag | AA162233 |
| 3880 | cagtttgcgaggcactgagagccca | M32484 | 46484 | tcatggactgtggggctgtcagtgg | AA023764 | 89088 | tcccctactgctgtgatcacaag | AA162233 |
| 3881 | ggtcgcccagactgactgagagga | M32484 | 46485 | atggactgtggggtcgtcagtgat | AA023764 | 89089 | tactgtgtttgatcacaagcctgaa | AA162233 |
| 3882 | cccagcatcgactgagaaagaactgga | M32484 | 46486 | agatttctaccacatctactgg | AA023764 | 89090 | ttatgcaacttcattaactaccgg | AA162233 |
| 3883 | agtccattttgcagggcactaattc | M32484 | 46487 | cttacaccatctactgacctgtgg | X94908 | 89091 | tcacaagctgaatggtggtcttat | AA162233 |
| 3884 | ttttgcaggcactaattccttga | M32484 | 46488 | cacagtttacacagtctgctgag | X94908 | 89092 | cattaactaccggtccctgatgtct | AA162233 |
| 3885 | agccgcactaatttcttgatgtccc | M32484 | 46489 | agagccacacacacagttggctc | X94908 | 89093 | taactaccggtccctgatgtctgca | AA162233 |
| 3886 | atgtcccaaggggatcttgatag | W48530 | 46490 | aaatcaagctgctgatagcatcct | X94908 | 89094 | ctaccggtccctgatgtctgcgac | AA162233 |
| 3887 | acactgctgaacctgcaacaactg | W48530 | 46491 | ctgtagatcgtgaacgaagcac | X94908 | 89095 | gtccctgatgtctgcagacaatgta | AA162233 |
| 3888 | tctgaacctgcaacaacattgcaa | W48530 | 46492 | gcatcctagaaacgcaagaggatctc | X94908 | 89096 | cctgatgtctgcagacaatgtacgc | AA162233 |
| 3889 | gatctgtcatcgaccagctcata | W48530 | 46493 | gcatcatttcggggctttatcat | X94908 | 89097 | agacaatgtacgccagcagtactca | AA162233 |
| 3890 | gtattgaatgcctcggctcagcgc | W48530 | 46494 | gggctttatcatctgctggttgtc | X94908 | 89098 | caatgtacgccagcagtatcaaga | AA162233 |
| 3891 | tagcatgctgtggttaagggaa | W48530 | 46495 | tctgcaggagctctttggaccca | X94908 | 89099 | tgtcttcgcatcaagcacaga | AA162233 |
| 3892 | tggacatgctcaacctacgtctc | W48530 | 46496 | actctcattaacccgtcatcta | X94908 | 89100 | cttctcagatcaagcacaaagattg | AA109831 |
| 3893 | gacatgctcaacctactgtcttcct | W48530 | 46497 | tcatcacactgtgttcaacgaaga | X94908 | 89101 | tactcttcagagaccttacgtcgg | AA109831 |
| 3894 | tgctcaacctacgtctctcccag | W48530 | 46498 | ccaatactactgtgtgcggccctt | X94908 | 89102 | ttctcagagaccttaagtcggggcg | AA109831 |
| 3895 | tccaggctgcgcaggaggactct | W48530 | 46499 | cctgtgcctctatatccatc | X94908 | 89103 | tctcagagacctttacgtcgggcga | AA109831 |
| 3896 | gcaggactcctgacatccttatac | W48530 | 46500 | tctatatccatccatctgctcat | X94908 | 89104 | cctgatcagtctaccagaggggt | AA109831 |
| 3897 | aggactcctgacatcctttataccg | W48530 | 46501 | tcccatccatctgctcattatcct | X94908 | 89105 | atcagctctaccagagggcgtgtcc | AA109831 |
| 3898 | tgaactgcaacatgtacgg | W48530 | 46502 | tgctcattatccgtatggcgcat | X94908 | 89106 | cagcctgaccatgagggcgtgccat | AA109831 |
| 3899 | tgaactgcaacatgtcaaca | W48530 | 46503 | tgtatggccgcatatacgggccgc | X94908 | 89107 | agctctaccacatgaggcggtgccata | AA109831 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 3900 | W48530 | cctgacatccttatacc ggctcag | 46504 | X94908 | ggaag gcttcaccacggcacagct | 89108 | AA109831 | taggacgacactgctgatgaagaggt |
| 3901 | W48530 | aactg caacaacattgtcaacatg | 46505 | X94908 | gcttcacacaggcacagcttatcac | 89109 | AA109831 | ggacgacactgctgatgaagaggct |
| 3902 | W48530 | cctg caacaacattgtcaacatgac | 46506 | AA023769 | ctgattacccgcgaaatatcctga | 89110 | AA109831 | agacacagctgatgaagcagc gattctg |
| 3903 | W48530 | caacaacatgtcaacatgactga | 46507 | AA023769 | gattacccg caaatatcctgacg | 89111 | AA109831 | ttctccagcatcaagcaccagattga |
| 3904 | W48530 | acaacatgtcaacatgactgaat | 46508 | AA023769 | agtaccagttccagcaaccagccag | 89112 | AA109831 | tcagcatcaagcacacaggattgagat |
| 3905 | W48530 | aacattgtcaacatgactgaatc | 46509 | AA023769 | agttccagcaccagccagtcagga | 89113 | AA109831 | agcatcaagcacacaggattgagattg |
| 3906 | W48530 | cattgcaacatgactgaatcaag | 46510 | AA023769 | ccagcaccagccagtcaggaggag | 89114 | AA109831 | gcatcaagcacacaggattgagattga |
| 3907 | W48530 | gcgatctgctcatcgaccagctca | 46511 | AA023769 | ccagcaccagccagtcaggaggatg | 89115 | AA109831 | agattggctccttctgtatgata |
| 3908 | W48876 | gtctcgaggacacgacgggatccgcag | 46512 | AA023769 | agctccctgcggctgtgttgaac | 89116 | AA109831 | attgagtccttctgtatgataat |
| 3909 | W48876 | tcgaggacacgacgggatccgcag | 46513 | AA023769 | ctccctgcggctgtgttgaaca | 89117 | AA109831 | gagtccttctgtatgataatact |
| 3910 | W48876 | agagcttccacggctaagccatt | 46514 | AA023769 | tgtttgaacacttgtcatgatgca | 89118 | AA109831 | agtccttctgtatgataatactt |
| 3911 | W48876 | cacggctaagccattgcctct | 46515 | AA023769 | tttgaacacttg ccatgatgcagc | 89119 | U57324 | atctgcaggaggccaggcgaggtcc |
| 3912 | W48876 | caggctaagccattgcctctccat | 46516 | AA023769 | tgaacacttgcatgatgcagcgg | 89120 | U57324 | agtttacactctagccatatat |
| 3913 | W48876 | cggctaagccattgcctctccatt | 46517 | AA023769 | aacacttgccatgatgcagcggga | 89121 | U57324 | aaggctcttcaggg atgaggctcg |
| 3914 | W48876 | taagccattgcctctccatttggt | 46518 | AA023769 | tctgacggttgatggcatccgg | 89122 | U57324 | tccacgtctgtaagtctccaggat |
| 3915 | W48876 | agccattgcctctccatttggtgc | 46519 | AA023769 | cttcgagtgcatccggacaactg | 89123 | U57324 | tctgtaagctccaggagatcag |
| 3916 | W48876 | attgcctctccatttggtgccgct | 46520 | AA023769 | tcgatgcatccggacaacgtga | 89124 | U57324 | cccgttgcagtcatgaatgtccc |
| 3917 | W48876 | tgcctctccatttcggtcgcgttc | 46521 | AA023769 | gatgcatccggacaacgtggatg | 89125 | U57324 | catgaatgtcccagtgctgtgtt |
| 3918 | W48876 | cctctccatttcggtcgcgttct | 46522 | AA023769 | gcatccggacaacgtggatgcagc | 89126 | U57324 | ttagaagccaagtcctgtctcttctattt |
| 3919 | W48876 | tccatttcggtcgcgttctttat | 46523 | AA023769 | ccggaacaacgtgatgcagccctg | 89127 | U57324 | gccaagtctgtccttatt ctgcag |
| 3920 | W48876 | cgacggatccgcagccattaggga | 46524 | AA023769 | caagc gatgcagcctgccctc | 89128 | U57324 | tcctgttctatttcgcagtgact |
| 3921 | W48876 | gggatccgcagccattagggaatgg | 46525 | AA023769 | gccattagtacagtggccgggagc | 89129 | U57324 | tcttattcttcgagtgactgctggg |
| 3922 | W48876 | gatccgcagccattagggaatgct | 46526 | AA023769 | ccaaagtcataccattggccgtag | 89130 | U57324 | ttctg cagttgactgctgggaagttgg |
| 3923 | W48876 | ggtaaccttaag cagcattg cctt | 46527 | AA023769 | gtcatacattggagcgggaacgtt | 89131 | U57324 | tgtcgtgttactctgatgagga |
| 3924 | W48876 | taaccttaag cagcattg cctcc | 46528 | AA023769 | gttccagctgtgctctgtgtgca | 89132 | U57324 | accaataaacag atgctccgctgg |
| 3925 | W48876 | ctttaagcagcattgcctccagt | 46529 | AA023769 | tctcctatccctatccatcaga | 89133 | U57324 | ccctggctaccgctctgtca |
| 3926 | W48876 | cttcagctgcttagttttcaca | 46530 | X69867 | ctatccttatccatcagagagt | 89134 | U57324 | acctgctg tcaccagactgcagc |
| 3927 | W48876 | gcttgtttagttttcacaagaaga | 46531 | X69867 | ctatccatcagagagtgttccctt | 89135 | U57324 | ctgt caccagactgcagctgcct |
| 3928 | W48876 | gcttgcgcttcaaaatgccggat | 46532 | X69867 | ttcttagcctctataccaaccca | 89136 | U57324 | accagactgcagctg ccgctcga |
| 3929 | W48902 | aaggacgacaagccatccgagctc | 46533 | X69867 | accccacagagacaatgattctcag | 89137 | U57324 | cttggatgctcagcaagcaaggc |
| 3930 | W48902 | atgacatcagcaactttgcaatt | 46534 | X69867 | ttctcagcttgaagcgggccctcac | 89138 | U57324 | tgctcagcaagcaaggtctcttca |
| 3931 | W48902 | aaattaatgagctcactg gatcaa | 46535 | X69867 | gcctcacctgaagcttgataaaac | 89139 | U57324 | gcaagcaaggtctctcaggg atg |
| 3932 | W48902 | attaatgagctcactgtgatcaag | 46536 | X69867 | cgtgttccagcaggtgtcttcaag | 89140 | M32502 | tctagggctgctaatgctggctg |
| 3933 | W48902 | atgagctcactgtgatcaaagagt | 46537 | X69867 | tgglggcttgtttgatggag acat | 89141 | M32502 | tcagccactttcctgttgtgca |
| 3934 | W48902 | gagctcactgtgatcaaagagtcg | 46538 | X69867 | ttggcaaacacaccatgccttcta | 89142 | M32502 | ctggataagctgtgtgtgagacact |
| 3935 | W48902 | atcaaagtcgacactgggctgg | 46539 | X69867 | ccttctacagaaggacg tgacagac | 89143 | M32502 | agacactgagcagaacggatacaa |
| 3936 | W48902 | caaagagtcgacactgggctggcc | 46540 | X69867 | attggctccattctgcactagcc | 89144 | M32502 | attacagctcttcatatctatg |
| 3937 | W48902 | ctccagccctcggattggctgc | 46541 | X69867 | ctccattctgcactagcagcagaaa | 89145 | M32502 | tacaagtctcttcatatctatg |
| 3938 | W48902 | ccagccctcggatttgctgcgcag | 46542 | X69867 | tctgcactggcagcagaaacctgcc | 89146 | M32502 | gtcatgttccggggctgtattcaag |
| 3939 | W48902 | agccctcggatttgctgcgcagac | 46543 | X69867 | cattgttagacctcacatg gaca | 89147 | M32502 | cattgtaattatctc gccatagtc |
| 3940 | W48902 | ggagacaagccatccgagctctg | 46544 | X69867 | ttagactcacatgtgacaagttg | 89148 | M32502 | tatcctgccatatgcaggtaatag |
| 3941 | W48902 | cccctggattggctgcgagacaa | 46545 | X69867 | ttagtactgtcctcctcaggag | 89149 | M32502 | cctaccatagtcaggtaatagcat |
| 3942 | W48902 | acgacaagccatccgagctctgga | 46546 | X69867 | caacatcccagatgtgttcacgg | 89150 | M32502 | tccctaccaacctgctatcccaaa |
| 3943 | W48902 | catccgagctctgg atgaagggat | 46547 | X69867 | caaaggcagccctcatggtggca | 89151 | M32502 | ccaacctctgtatccaaagttg |
| 3944 | W48902 | tccg agtcctggataagaacttatg | 46548 | Z18278 | ttcaacaggactacacagtcgtt | 89152 | M32502 | gccactcttccctgttgcagt |
| 3945 | W48902 | gatatcgcttgcaaacttatg | 46549 | Z18278 | aggagctacacagtgcttcaagg | 89153 | M32502 | ctgttgcagtgcttgcagtgccaagc |
| 3946 | W48902 | acttatgccagatcaagcaggt | 46550 | Z18278 | agtgctttcaaggtcttctcca | 89154 | M32502 | tttgcagttggcttgccaagcagg |
| 3947 | W48902 | agtacttattgcagatcaagcaac | 46551 | Z18278 | ttcaaggtcttctccaagcaac | 89155 | M32502 | cctgctgccactcttccaccatg |
| 3948 | W48902 | cttattcgaggacatgcaggt | 46552 | Z18278 | ttcttcaagcaacaatgagagacca | 89156 | M32502 | catgtgaccaatgagcactgctta |
| 3949 | W48905 | cagtgcgaccatggcctcg | 46553 | Z18278 | gagtgcttcccatagctgta | 89157 | M32502 | tgtgacatgagcactgctctagg |

| SEQ ID NO | sequence | DBAxnID | SEQ ID NO | sequence | DBAxnID | SEQ ID NO | sequence | DBAxnID |
|---|---|---|---|---|---|---|---|---|
| 3950 | tgaaaacttctgcgatcaacag | W48905 | 46554 | gcttgtagctcagtgggtatatg | Z18278 | 89158 | gaccatgagcactgctctaggaca | M32502 |
| 3951 | gtcatcgcacagtctcagtcggca | W48905 | 46555 | gtccatgaaccttgcaggctgcc | Z18278 | 89159 | tctccttccgaagttgaaatcaa | M32502 |
| 3952 | catcgcacagtctcagctgtgga | W48905 | 46556 | tgaaccttgcaggctgccagctg | Z18278 | 89160 | tactctaccaagctcttcagtgt | AA109782 |
| 3953 | gcaagacggccacctcagtatttc | W48905 | 46557 | tttgcaggctgccagctgtcttg | Z18278 | 89161 | cctcaccatagctctttcagtgtaa | AA109782 |
| 3954 | aagaggccacctcagtatttcag | W48905 | 46558 | gtgttgtgctctgtcggttccctt | Z18278 | 89162 | ggaccactctgtctccttcatg | AA109782 |
| 3955 | gacggccacctcagtatttcagtc | W48905 | 46559 | tgctggttccctttcttcgtcacag | Z18278 | 89163 | cactctggtctccttcatgaagaa | AA109782 |
| 3956 | cggccacctcagtatttcagtcct | W48905 | 46560 | ttccttctgtcacagagctca | Z18278 | 89164 | gaatttcaggcgattggaagaatca | AA109782 |
| 3957 | cacctcagtatttcagtccttcag | W48905 | 46561 | ttcttctgcacagagctcatcagtc | Z18278 | 89165 | agaatcagttcactgtagcccagta | AA109782 |
| 3958 | cctttcagtatatttcagtccttcagt | W48905 | 46562 | ttcctgggttgtatttctaatt | Z18278 | 89166 | aatcagttcactgtagcccagtag | AA109782 |
| 3959 | ttcagtatttcagtccttcagtgt | W48905 | 46563 | tctaattcctttcttcaacccactca | Z18278 | 89167 | tcagttcactgtagccagtatgag | AA109782 |
| 3960 | cagtatttcagtccttcagtgtctg | W48905 | 46564 | atctacacagcatcaacaggagct | Z18278 | 89168 | agttcactgtagcccagtatgagaa | AA109782 |
| 3961 | accttctgcgatcaacagcgtgct | W48905 | 46565 | acagcattcaacagagactacggca | Z18278 | 89169 | ttcactgcccagtatgagaaatt | AA109782 |
| 3962 | tacccaggagcagaccaacaggatgg | W48905 | 46566 | aatttgatgtggggcacgtgccaa | Z18278 | 89170 | cactgtagcccagtatgagaaatt | AA109782 |
| 3963 | ctctcggatcaacagcgtgctat | W48905 | 46567 | ttttgatgtggggcacgtgccaata | Z18278 | 89171 | ctgtagcccagtatgagaatttga | AA109782 |
| 3964 | tctcggatcaacagcgtgctatca | W48905 | 46568 | tgtgactttgggcattgtagatccat | Z18278 | 89172 | ctaccatagctctttcagtgtaatg | AA109782 |
| 3965 | tgcgatcaacagcgtgctatcaag | W48905 | 56569 | caccacgctgtgacattaaagggtc | Z18278 | 89173 | gatcaacactgaagtttagatcag | AA109782 |
| 3966 | atccaacagcgtgctatcaagcaga | W48905 | 46570 | gtcatatacacagtttgaacacac | Z18278 | 89174 | accatagctctttcagtgtaatgaa | AA109782 |
| 3967 | ccaacagcgtgctatcaagcagata | W48905 | 46571 | catatacagcacagtttgaacacac | Z18278 | 89175 | tagctctttcagtgtaatgaaggag | AA109782 |
| 3968 | aacagcgtgctatcaagcagataat | W48905 | 46572 | tttgaacacactatcgtttgctgc | Z18278 | 89176 | gtgcaaattacactactatgatgaa | AA109782 |
| 3969 | atgtcatcgcacagtctcagtctgg | W48905 | 46573 | tgaacactatactgttgctgctcca | Z18278 | 89177 | gcaaattacactactatgtctcct | AA109782 |
| 3970 | taccacaggcagcaaccaacaggatggg | W48905 | 46574 | aacacactaactgttgctgtctcac | Z18278 | 89178 | agagatgaccactctgtgtcctct | AA109782 |
| 3971 | acaccaggagcatggcagggaagatc | U35312 | 46575 | ctatactgttcgtccaactgtaa | Z18278 | 89179 | agatgaccactctgtgtcctctt | AA109782 |
| 3972 | tatgagacactgtgtatgtgcgactgg | U35312 | 46576 | atacgttcgctccaactgtaaag | AA023796 | 89180 | atggaccactctgtgtcctctca | AA109782 |
| 3973 | acactgctgtatgtgcgactgg | U35312 | 46577 | tgttgctccaactgtaaagaagt | AA023796 | 89181 | ttcaaggctagcctgagctactta | AA109782 |
| 3974 | ccatgattgtgcgcagactctct | U35312 | 46578 | gtacccttgctccgaagtag | AA023796 | 89182 | cttctcccagaagagcagagagcc | U18119 |
| 3975 | tttgtccagagacttctcaggg | U35312 | 46579 | cctttcctctgccgaagtagcgtc | AA023796 | 89183 | agtcatctaccagctcaggctgggag | U18119 |
| 3976 | tcaggagagccaggccatggattgag | U35312 | 46580 | ttgcctctgccgaagtaggctga | AA023796 | 89184 | catctaccagctcaggctgggaag | U18119 |
| 3977 | agccaggccatggatgatgaagaaga | U35312 | 46581 | tgccgaagtaggctggatcgtt | AA023796 | 89185 | caggagcctcgcgagaatctcct | U18119 |
| 3978 | aaactgccctctaatacaggcactc | U35312 | 46582 | agtaggccgatcgtgggagaaat | AA023796 | 89186 | tcgcctgaatctctcattgcaac | U18119 |
| 3979 | cctctaatacagccactcaatgga | U35312 | 46583 | taggcgatcgctggagagaagtaa | AA023796 | 89187 | tcattgcaccaggtcgacctctc | U18119 |
| 3980 | atacaggcacctcaatggattataa | U35312 | 46584 | ggcgatcgctgggagagaagataat | AA023796 | 89188 | gggtgcaacagtgccaacaagagatg | U18119 |
| 3981 | ggacaatctgttcttcactcgtt | U35312 | 46585 | tctgtgactggcattgtagat | AA023796 | 89189 | gtgcaacagtgccaacaagatgtca | U18119 |
| 3982 | tcttcaacaggttctactcagttcc | U35312 | 46586 | gggagtcaatccctatctacaagg | X15830 | 89190 | caccagtcaacaaagattactactg | U18119 |
| 3983 | atacgatgtctgcagtcagataccacac | U35312 | 46587 | tcaatcctatctacaaggaaagag | X15830 | 89191 | tgccacaaagatcatcactggttaag | U18119 |
| 3984 | acaccactacacagatcgcatgcg | U35312 | 46588 | taccaatgctgtgctttctgctac | X15830 | 89192 | tagaagcctttggtctgtaagact | U18119 |
| 3985 | caaggcatcaacaagacaaccgcatct | U35312 | 46589 | ctgtgcttctgctacattagaata | X15830 | 89193 | gcccagaaagtagcagagagcccca | U18119 |
| 3986 | gctcaacaagaaccgcatctggaga | U35312 | 46590 | tgctttcgtacattgaataaaa | X15830 | 89194 | gcagccccagagccgatccagccta | AA109597 |
| 3987 | catcaacaagaaccgcatctggaga | W48921 | 46591 | atacatggttctctgcagttt | X15830 | 89195 | gagagcccaggatccagccatacc | AA109597 |
| 3988 | ccgctctcgcgcagtatgagga | W48921 | 46592 | ctcagattctcagttttgggt | X15830 | 89196 | cctgtcacctctatcctgtcagg | AA109597 |
| 3989 | ctctcagcagtatgagacactgt | W48921 | 46593 | ttgggttatgctgtttgggccaagt | X15830 | 89197 | tgtacccctatccgtcaggatg | AA109597 |
| 3990 | taagctgccgtactctggtattgtta | W48921 | 46594 | tatgcgttggccaagtctcgtaa | X15830 | 89198 | tgtctgactggggaaccaagtcaa | AA109597 |
| 3991 | gccgtactcctggtatttgagata | W48921 | 46595 | ggtgacacatctactctgcgtt | X15830 | 89199 | gaaccaagtcatctaccccaggtcag | AA109597 |
| 3992 | aaatctgattggctgaagctgga | W48921 | 46596 | gacacatctcactctgctctt | X15830 | 89200 | ccaagtcatctaccccaggtcaggt | AA109597 |
| 3993 | aatctgattggctgaagctgaa | W48921 | 46597 | acatctcactcgtcgtttcttaat | X15830 | 89201 | tagattccatcaatactattaccca | AA109597 |
| 3994 | atctgattggctgaagctgaagg | W48921 | 46598 | gtatgtagaaaacccatccaatgctt | X15830 | 89202 | attccatcaatactattaccatg | AA109597 |
| 3995 | tctgattggctgaaagctgaagg | W48921 | 46599 | aaccacatccaatgcttatgtcag | X15830 | 89203 | ttagtatccaatcatatgctaat | AA109597 |
| 3996 | ctgattggctgaaagctgaaggt | W48921 | 46600 | ccatccaatgcttatgtcatgct | X15830 | 89204 | gtatcaaactcataatgctaattca | AA109597 |
| 3997 | tgattggctgaaagctgaaaggtg | W48921 | 46601 | gtcatagagcccgtgagttgacacag | X15830 | 89205 | tcaaactcataatgctaattcacac | AA109597 |
| 3998 | attggctgaaagctgaaggtgt | W48921 | 46602 | catagagcccgtgagttgacacatg | X15830 | 89206 | aactcataatgctaattcacacagc | AA109597 |
| 3999 | ttggcctgaaagctgaaggtgtgc | W48921 | 46603 | aagcagtctctgccctccataccc | X15830 | 89207 | tcataatgctaattcacacagatc | AA109597 |

| SEQ ID NO | sequence | DBAxnID | SEQ ID NO | sequence | DBAxnID | SEQ ID NO | sequence | DBAxnID |
|---|---|---|---|---|---|---|---|---|
| 4000 | gtactcggtattgttagagatacag | W48921 | 46604 | tccttgctccatccaatgcctgt | X15830 | 89208 | taatgctaattcacacgcatcagg | AA109597 |
| 4001 | tcacaggtcaccagattcgccaaa | W48921 | 46605 | ttgcctccataccaatgcctgtgct | X15830 | 89209 | tgctaattcacacagcatcaggacg | AA109597 |
| 4002 | cacaggtcaccagattcgccaaa | W48921 | 46606 | ctgttccgtatacaatggatagaa | X67348 | 89210 | taattcacacagcatcaggacgaac | AA109597 |
| 4003 | acaggtcaccagattcgccaaaat | W48921 | 46607 | cactaccacctgagggtcacagt | X67348 | 89211 | ttcacacagcatcaggacgaacatg | AA109597 |
| 4004 | cctaaatctgattggcctgaaagc | W48921 | 46608 | taattcagtagacacgggcagttaa | X67348 | 89212 | acacagcatcaggacgaacatgaac | AA109597 |
| 4005 | cttaaatctgattggcctgaaagct | W48921 | 46609 | ctctaccaggagccctcctctcaat | X67348 | 89213 | tccatcaatactataccatcgctc | AA109597 |
| 4006 | ttaaatctgattggcctgaaagctg | W48921 | 46610 | caggaggcctctcaatgttact | X67348 | 89214 | aatactataccatcgctcaatag | AA109597 |
| 4007 | taaatctgattggcctgaaagctgg | W48921 | 46611 | gaggcctctcaatgttacctac | X67348 | 89215 | aatactataccatcgctcaatacg | AA109597 |
| 4008 | gctcagtaccacctggtgcctcac | W48921 | 46612 | caatgttactcaccctaaaggctg | X67348 | 89216 | ataccatcgctcaatacgcctaat | AA109597 |
| 4009 | cagttaccacctggtgcctcactgt | M77174 | 46613 | tgttactcaccctaaaggctgaca | X67348 | 89217 | cccatcgctcaatacgcctaatcaa | AA109597 |
| 4010 | agagtccccatgtcctggcagtgt | M77174 | 46614 | cagtaattcgtctcaaacatagt | X67348 | 89218 | atcgctcaatacgcctaatcaacaa | AA109597 |
| 4011 | gctcgccctcagagctgcaaggga | M77174 | 46615 | ttctgctctaaacatagtgggtaag | X67348 | 89219 | acaatcgtctcgagaacttaccaata | AA109597 |
| 4012 | agaccaactcttcccagaatcgct | M77174 | 46616 | taagctacagcaaatcgtacagt | X67348 | 89220 | gtctcgagacttaccaaatactgact | AA109597 |
| 4013 | ccaactcttcccagaatcgctaga | M77174 | 46617 | aatcgttacatgtatctattaag | X67348 | 89221 | tgactlacttagaggcctccaccaaa | AA109641 |
| 4014 | cagtcgagacctcagtcttggaagg | M77174 | 46618 | cacactgcagggtcacagtgtcact | X67348 | 89222 | cttacttagaggcctcaccaaactg | AA109641 |
| 4015 | ccatcgggagcctgaggacctgac | M77174 | 46619 | ctcctcagccagaaagcaaggactg | X67348 | 89223 | tagcccatcctggtcccaggaag | AA109641 |
| 4016 | ggttaagcaggccgacgtggtggctc | M77174 | 46620 | aaactgcttagactccgacactgt | X67348 | 89224 | tagtgtcccaggaagaaggatgga | AA109641 |
| 4017 | cagactgtgggtctgggtcctaga | M77174 | 46621 | ctggctagactctgcacagctata | X67348 | 89225 | aggagtcctgtcatgcgtagc | AA109641 |
| 4018 | actgtggtcctgggtcagaagg | M77174 | 46622 | tagaactcctgacagttataaccaca | X67348 | 89226 | tcctgctcatgtcgtagcaatag | AA109641 |
| 4019 | gaaccccctggcgtctttcctgat | M77174 | 46623 | cctgacagtctataaccacagaacag | X67348 | 89227 | gtgaccgacaagttctggacagt | AA109641 |
| 4020 | ccacctggtcctcactgtcaaact | M77174 | 46624 | gactctactaattcagtagacacg | X67348 | 89228 | accgacaagttctggacagttcgat | AA109641 |
| 4021 | ggccatggtgagccactgttctgg | M77174 | 46625 | tctacctaattcagtagacacgggc | X67348 | 89229 | agacaagttctcggacagttgctca | AA109641 |
| 4022 | catggtgagccactgttctggggag | M77174 | 46626 | cggaccagaattgctgtggtctca | AA023087 | 89230 | caagttctcgacagttgctcacac | AA109641 |
| 4023 | tgagccactgttctggggagcagag | M77174 | 46627 | agaattgctgtgttcagtagcc | AA023087 | 89231 | gttctggacagttgtcacactac | AA109641 |
| 4024 | gccacctgttctggggagcagagga | M77174 | 46628 | agagcagctgcttcagtagacg | AA023087 | 89232 | ctcggacagttgctcactactg | AA109641 |
| 4025 | acccacctagccagaggttccatgt | M77174 | 46629 | gacgcagctgcttcagatgaacga | AA023087 | 89233 | acttagagggcctcaccaaaaactcgt | AA109641 |
| 4026 | ctagccagaggttccatgtcctgg | M77174 | 46630 | acgcagctgcttcagatgaacgag | AA023087 | 89234 | aggcctcaccaaactgcgtctcaat | AA109641 |
| 4027 | ggccagaggttccatgtccttggag | M77174 | 46631 | cgcagctgcttcagatgaacgagc | AA023087 | 89235 | cctcaccaaactgcgtctcaatgtc | AA109641 |
| 4028 | gtcctggtcaatgatctatatacat | M34141 | 46632 | agctgcttcagatgaacgacgag | AA023087 | 89236 | caccaaactgcgtctcaatgtcgat | AA109641 |
| 4029 | aactcccaactgaatgtctagaa | M34141 | 46633 | gctgcttcagatgaacgacgaac | AA023087 | 89237 | caaactgcgtctcaatgtcgatgag | AA109641 |
| 4030 | ttggagccacactagatctctcaa | M34141 | 46634 | gaattgctcgggtctcagtagcct | AA023087 | 89238 | gcgtcaatgtcgatgaggcatt | AA109641 |
| 4031 | ggagccacactagactcttccaa | M34141 | 46635 | aattggtcgggtctcagtagcctc | AA023087 | 89239 | atttgatcagctggtcgcgcgtc | AA109641 |
| 4032 | acactagactcttccaaagatgt | M34141 | 46636 | attggtcgggtctcagtagcctcc | AA023087 | 89240 | ataagaactctctagcccatct | AA109641 |
| 4033 | atggactcatctatgatctggttg | M34141 | 46637 | ttggtcgggtctcagtagcctccg | AA023087 | 89241 | tccagggcaactttcagatct | AA109641 |
| 4034 | gactcatctatgatctggttggaa | M34141 | 46638 | cgtgaagacgcagctgctttcagat | AA023087 | 89242 | tcaagacaactccattgtctggg | U69599 |
| 4035 | tcatctatgatctggttggaaacc | M34141 | 46639 | gaagacgcagctgctttcagatga | AA023087 | 89243 | gcatctgcattgctgctggct | U69599 |
| 4036 | atccagatcttttgctggcagt | M34141 | 46640 | gaagacgcagctgcttcagatgaa | AA023087 | 89244 | tgcattgctctggcctgacgg | U69599 |
| 4037 | cagatcttgctgtggcagctgt | M34141 | 46641 | aagacgcagctgcttcagatgaac | AA023087 | 89245 | gcttcacctgttcctcaaataca | U69599 |
| 4038 | tgtgggcagctgttctcatgaagct | M34141 | 46642 | cagtagcggggcgggcctggtctccc | AA023087 | 89246 | aatccaaagcgagtgaagtactg | U69599 |
| 4039 | ggcagctgtttcatgaagctaat | M34141 | 46643 | tgactgagggcggcctggtccgta | AA023107 | 89247 | atctaaagaaccaagaccaattcat | U69599 |
| 4040 | ttcccaactgaagtcatagaa | M34141 | 46644 | gtcaggtgaagcaactcttcgaaa | AA023107 | 89248 | cagaccaattcatctagaggtctt | U69599 |
| 4041 | aattggtcatttcgtctcagt | M34141 | 46645 | agcaactctcgaaagtgaatgaga | AA023107 | 89249 | cagcaatccaattagaggtctt | U69599 |
| 4042 | ttcctgttcagtgaatgaccacag | M34141 | 46646 | aactcttcgaaagtgaaatgagca | AA023107 | 89250 | aattcatcttagaggtctggacaa | AA109641 |
| 4043 | aaccagtgtccagcaagaattgctg | M34141 | 46647 | ctaccgatgtacctggaagcagg | AA023107 | 89251 | tgtcaattatttcttccagaaaa | U69599 |
| 4044 | ccagtgtccagcaagaatgcctg | M34141 | 46648 | ccgagtacctggaagcagggagc | AA023107 | 89252 | ttatttcttccagaaaaggagcg | U69599 |
| 4045 | agcaagaattgctgcccaaact | M34141 | 46649 | gagccatgactttcactacattat | AA023107 | 89253 | gcaactccattgctgggcaact | U69599 |
| 4046 | tgcctgcccaaactactgctacg | M34141 | 46650 | ccatgactttcactacattatga | AA023107 | 89254 | ccattgctgggcaatctgaagcc | U69599 |
| 4047 | tacgtctacgccaaaggtcaaggca | M34141 | 46651 | tgactttcactacattattgaca | AA023107 | 89255 | aaatccgaccacatggcctctgag | U69599 |
| 4048 | tggtctgcagcaacttccagatag | W48951 | 46652 | ctttttcactacattatgcacgg | AA023107 | 89256 | ccgcaggctgcagcaagtcatcct | U69599 |
| 4049 | tggctgcagcaacttccagatagc | W48951 | 46653 | ttcactacattatgcacgggggt | AA023107 | 89257 | ggctgcagcaagtcatcctgattcc | U69599 |

| SEQ ID NO | sequence | DBAxnID | SEQ ID NO | sequence | DBAxnID | SEQ ID NO | sequence | DBAxnID |
|---|---|---|---|---|---|---|---|---|
| 4050 | tgtgtaccggtatgccaaggcaag | W48951 | 46654 | cctggtctccgtagccaggagat | AA023107 | 89258 | agcaagtcatccgattccgttggg | U69599 |
| 4051 | gtgtaccggtatgccaacggcaagt | W48951 | 46655 | ctccgtagccaggaagatggtgct | AA023107 | 89259 | tcatcctgattccgttgggcatct | U69599 |
| 4052 | taccggtatgccaacggcaagtt | W48951 | 46656 | agatggtgctgacgatgatcgc | AA023107 | 89260 | cgttgggcatctccgattgctgct | U69599 |
| 4053 | taccggatgccaacggcaagttg | W48951 | 46657 | tgacgatgatcgccgtgacgatcggga | AA023107 | 89261 | cccagtctgtgagatgcgagaaat | U76716 |
| 4054 | cggtatgccaacggcaagttgtat | W48951 | 46658 | cctcgtcaggaggacgagcagc | AA023107 | 89262 | gtactgalgctactcagcagcga | U76716 |
| 4055 | ggtatgccaacggcaagttgtat | W48951 | 46659 | gccggaacttcaacagtatcagag | AA023107 | 89263 | ccaagccggcgactggatgacta | U76716 |
| 4056 | tatgccaacggcaagttgtatcc | W48951 | 46660 | gggaccttcaacgtatcagagtca | AA023107 | 89264 | aagccccggcactggatgactactc | U76716 |
| 4057 | tatgccaacggcaagttgtatcc | W48951 | 46661 | ttcaacagtatcagagctaa | AA023107 | 89265 | tggatgactactcagagccggt | U76716 |
| 4058 | atgccaacggcaagttgtatccc | W48951 | 46662 | atctgalccgtcgtgtcaccg | AA023107 | 89266 | gcacctctgagcgctctctgggccg | U76716 |
| 4059 | ggctgcagccaacttccagatagcg | W48951 | 46663 | gctgtgtccacggtggagtccaaa | U08110 | 89267 | ccctcgggcgatacactgatgtgga | U76716 |
| 4060 | ctgcagccaacttccagatagcgg | W48951 | 46664 | gctgaaccacatgttgggcctact | U08110 | 89268 | tgggccgatacactgatgtggacac | U76716 |
| 4061 | tgcagccaacttccagatagccga | W48951 | 46665 | accacagttgggcctactctga | U08110 | 89269 | gcatgcaccccaatcggtgacct | U76716 |
| 4062 | gcagccaactccagatagcggag | W48951 | 46666 | acatgttgggcctactctgaggg | U08110 | 89270 | cgggtgacctgccctccaagatcg | U76716 |
| 4063 | gcagccaactccagatagcggagt | W48951 | 46667 | tgttgggcctactctgagggttt | U08110 | 89271 | ggagcaacagacaacagacagta | U76716 |
| 4064 | cagccaactccagatagccgggagtg | W48951 | 46668 | ctgtgactcccgaatgggctgctt | U08110 | 89272 | gctactcagacagcgaacactacct | U76716 |
| 4065 | agccaactccagatagccgagtgg | W48951 | 46669 | cttcccgaatgggctgctggccac | U08110 | 89273 | ggagcacagcaacagacagtag | U76716 |
| 4066 | ttgtaccggaagttccaacggcaa | W48951 | 46670 | ctgcctgccggagctcactctga | U08110 | 89274 | gaaatgacctcagtaccatctga | U76716 |
| 4067 | gcttcaggcctgctagctcggt | W48951 | 46671 | ctgtgcccggagcttcaaaataa | U08110 | 89275 | atgacctcagtaccatctctgatac | U76716 |
| 4068 | aggcctgctagctcctggtcactgg | X74937 | 46672 | gcttcaaaataaacgtcatctgtg | U08110 | 89276 | acctcagtaccatctctgataccag | U76716 |
| 4069 | agalgggccacgtgctctgtcatt | X74937 | 46673 | caaataaacgtcatctgtgtagttg | U08110 | 89277 | tgaagcctcagcctgctctgrgga | U76716 |
| 4070 | tgggccacgtgatctgtcattca | X74937 | 46674 | accctgcctaaccatgtgact | U08110 | 89278 | agggctcagcctctgtgctgggacc | U76716 |
| 4071 | acagtgatcgtcattctaaatagg | X74937 | 46675 | tctgccttaaccatgtgactgga | U08110 | 89279 | cctctgtcgcggacccaaagcccg | U76716 |
| 4072 | agccttgtctccttatgtagac | X74937 | 46676 | cttaacatgtgactgaggagca | U08110 | 89280 | tgctgtgcagaccccaaagccccgact | U76716 |
| 4073 | cctctatgtagactactgcttctca | X74937 | 46677 | aacagtgactgaggagcagcagc | U08110 | 89281 | gccctgcacagagagggagatgc | U76716 |
| 4074 | tgtagactactgcttctcaagacat | X74937 | 46678 | ggcagtccccgcagctgaacca | U08110 | 89282 | tgcatttcgtgatacgttgccca | U12283 |
| 4075 | ctatgtctgttgtcagaaagtc | X74937 | 46679 | aggccctcaatgcctgaaccacat | U08110 | 89283 | tcacttatagtgggctcatcaggag | U12283 |
| 4076 | acatcccatcctgacatggtgaaa | X74937 | 46680 | cctaatgctgaaccacatgttggg | U08110 | 89284 | ttatagtggctcatcaggagc | U12283 |
| 4077 | gaaatccaggtctcgggtctgatt | X74937 | 46681 | aatgctgaaccacatgtggggct | U08110 | 89285 | tgcctcctggtctctagaggtatt | U12283 |
| 4078 | atccaggtctgtattaat | X74937 | 46682 | ttctttgacaggttcatcgctgga | X65582 | 89286 | tcctcctggtctctagaggtatt | U12283 |
| 4079 | ccctgctagtctggtcactggggg | X74937 | 46683 | ttcatccgtgatcttgtagcacc | X65582 | 89287 | cttggctctagaggtatlgagaga | U12283 |
| 4080 | tgctagtctggtcactgggacaa | X74937 | 46684 | atctacctataccttgccctcaag | X65582 | 89288 | ctggtctctagaggtatlgagaca | U12283 |
| 4081 | tggcactggggacaagggaaata | X74937 | 46685 | cccagtcttcccactgctgtt | X65582 | 89289 | ctggaccttgcaggaggccat | U12283 |
| 4082 | accaactttcaggcctcaagggagc | X74937 | 46686 | catccactgcccttctgaaagct | X65582 | 89290 | tattaacgcaataaactggccag | U12283 |
| 4083 | cttcaggcctcaggccagagctc | X74937 | 46687 | cctcttgaaagtctgtctggcct | X65582 | 89291 | actgcaataaactggccaatgtggc | U12283 |
| 4084 | tctcacctgtctgtgtccaata | X74937 | 46688 | gaaagctgtctgctggctgcacca | X65582 | 89292 | tgcaataaactggccagtgtgccc | U12283 |
| 4085 | cacctgtctgtccctaaatagat | X74937 | 46689 | tgtctgtgcctgcaaccagtccctg | X65582 | 89293 | caataaactggccagtgtggcccg | U12283 |
| 4086 | tctgttccctaaatagatgggcca | X74937 | 46690 | ctgtatctctatccaggggatc | X65582 | 89294 | catttctgatacgttgcccact | U12283 |
| 4087 | ttccatcatlcgcatggccatlt | M83344 | 46691 | ttcctatccatccaggggacct | X65582 | 89295 | tctgttgatacgttgcccactacc | U12283 |
| 4088 | ccatlcatlcgcatggccatligg | M83344 | 46692 | atctcaggagatcagagaccgtagagc | X65582 | 89296 | tgttatacgttgccactacc | U12283 |
| 4089 | aacctlgttacctcactcaggatga | M83344 | 46693 | tgagaccgccatatcatgcccaa | X65582 | 89297 | ctcctccagtcgaaaacgatgccca | U12283 |
| 4090 | ctgttacctcactcaggatgatac | M83344 | 46694 | atcgtlaccgccatgctcggc | X65582 | 89298 | caccgccatcacttatagtgggc | U12283 |
| 4091 | gttacctcactcaggatgatact | M83344 | 46695 | ctccacccatcgggtctaata | X65582 | 89299 | agccatcacttatagtgggctcat | U12283 |
| 4092 | atgatactctcaagttctalccaaa | M83344 | 46696 | cccatcgtgtgctaataggacc | X65582 | 89300 | cccatcacttatagtgggctcatca | U12283 |
| 4093 | atactctcaagttctatccaaata | M83344 | 46697 | gctaataggacctgcctagccgccgt | X65582 | 89301 | catcacttatagtgggctcatcagg | U12283 |
| 4094 | ctctcaagttctatccaaattaatg | M83344 | 46698 | tcaaggagatcagacctgcgccgt | X65582 | 89302 | acttgcggagctcagaccagctgct | U79163 |
| 4095 | tcaagttctatccaaattaatg | M83344 | 46699 | tgcagctagaccagctagtacac | X65582 | 89303 | tctccggcttggcccaaggcaa | U79163 |
| 4096 | agttctatccaaattaatgatgct | M83344 | 46700 | gccctccccaaatcaggacaga | X65582 | 89304 | tttggccacgctacgtgaaggtggg | U79163 |
| 4097 | gtctatccaaattaatgatgcct | M83344 | 46701 | ctcccaaaatcaggacagaaggact | X65582 | 89305 | gcagctgcttcagcaagcgctcctg | U79163 |
| 4098 | ttctatccaaattaatgatgctc | M83344 | 46702 | gacttacctactlcgctctct | Z22923 | 89306 | gcttcagcaagcgtcctctc | U79163 |
| 4099 | tlcattcgcatggccattggccat | M83344 | 46703 | gcatgcgccgatgccgtgggggctt | Z22923 | 89307 | gcttcagcaagcgtcctgcttgt | U79163 |

TABLE 1-continued

| SEQ ID NO | sequence | DBAxnID | SEQ ID NO | sequence | DBAxnID |
|---|---|---|---|---|---|
| 4100 | cagttccattcctccatcgcttt | M83344 | 46704 | tttctcaggatctctggaaaccca | Z22923 | 89308 | gcaagcgtcctgctctgtgccga | U79163 |
| 4101 | ttcccttctacagatgatcaagc | M83344 | 46705 | aagatccaggggttctgaagacaag | Z22923 | 89309 | agccatccaagtctgtgcacctcac | U79163 |
| 4102 | cccttctcacagatgattcaagcat | M83344 | 46706 | aggccaacagagccaagtattggag | Z22923 | 89310 | catccaagtctgtgcacctcaagt | U79163 |
| 4103 | tatataccatgcagccattttgga | M83344 | 46707 | ggtagcttcctcctggagtacca | Z22923 | 89311 | ggattcctccatccagtaccccatcat | U79163 |
| 4104 | ataccatgcatgccattttgaaac | M83344 | 46708 | ttacccctatttattctcctggact | Z22923 | 89312 | acccatcatttcgagtgaaggc | U79163 |
| 4105 | tgcatgccattttggaacctggtta | M83344 | 46709 | ccctatctattctctggacttat | Z22923 | 89313 | tcatttcgagtgtaagtgtcctg | U79163 |
| 4106 | tggaacctggtacctcactccagga | M83344 | 46710 | atacctggagtggcagttcttagg | Z22923 | 89314 | gcttggccaaggcaagaaacagcg | U79163 |
| 4107 | tgtgagctacctgatggccatggag | W48962 | 46711 | tcttagccacgcctgctattgcct | Z22923 | 89315 | aacagcgcgtgagcaagaagctgag | U79163 |
| 4108 | gtgggctacctgatggccatggaga | W48962 | 46712 | taggccagccctgctattgcctgc | Z22923 | 89316 | agatggctgtgggcacagacctt | U79163 |
| 4109 | cagatccgcagcgtcatgcagaag | W48962 | 46713 | cagtattaaacatccatcttcct | Z22923 | 89317 | agacctctgccggtgctgtacgc | U79163 |
| 4110 | agcatccgcagcgtcatgcagaagt | W48962 | 46714 | ctcacagagcctgggtccatcaagg | Z22923 | 89318 | cggtcgtagcgggtggaatgacct | U79163 |
| 4111 | catccgcagcgtcatgcagaagtat | W48962 | 46715 | gggtccatcaagggggccatgagcaa | Z22923 | 89319 | tgcgtacgcgtggaatgacctagg | U79163 |
| 4112 | atccgcagcgtcatgcagaagtatc | W48962 | 46716 | gggccatgacaacaccaggacaca | Z22923 | 89320 | taggcagccgtttgccacgcta | U79163 |
| 4113 | ccgcagggtcatgcagaagtatcta | W48962 | 46717 | tgtctagggtcacttctgggtggac | Z22923 | 89321 | gccgctttggccacgctagcgtaa | U79163 |
| 4114 | cgcagcgtcatgcagaagtatctag | W48962 | 46718 | tcactttgggtgacatgtactcc | Z22923 | 89322 | acagtctgccatcacgactctgtc | AA109760 |
| 4115 | aagatctctcagagagttaggat | W48962 | 46719 | ggacatgtactccagaccagagg | Z22923 | 89323 | catcacgactctgctcggcagatc | AA109760 |
| 4116 | gatcttctcacagaagttaggatac | W48962 | 46720 | catgtactccagaccaggaggta | Z22923 | 89324 | catgactgcatatgcacagactg | AA109760 |
| 4117 | atctcttcacagaagttaggataga | W48962 | 46721 | gtactccagaccagaggaggctagat | Z22923 | 89325 | atatggcacagactcgatggataag | AA109760 |
| 4118 | ctctcacagaagttaggataccgtg | W48962 | 46722 | accaatggttcctcagctgtagt | Z22923 | 89326 | tggacagactcgatggataaggc | AA109760 |
| 4119 | gagctacctgatggccatggagaag | W48962 | 46723 | agctagtgctctgccctgggca | Z22923 | 89327 | cacagactctgctcgagacgat | AA109760 |
| 4120 | agctacctgatggccatggagaaga | W48962 | 46724 | aactagtcgacactggaatcatgg | Z22923 | 89328 | agtcaacacagtaagaagacact | AA109760 |
| 4121 | ctacctgatggccatggagaagagc | W48962 | 46725 | ctagtcgacacctggaatcatgggc | Z22923 | 89329 | gtaagacactggacagctgacaac | AA109760 |
| 4122 | gcgcgcccagcaagaagatcctgc | W48962 | 46726 | agtcgacacctgaatcatgggctg | Z22923 | 89330 | tcgagcagctgacaccgctctgtcag | AA109760 |
| 4123 | caagagatcctgctgccagagccc | W48962 | 46727 | tcgacacctggaatcatgggctga | Z22923 | 89331 | gctcgtgacacctctgcaggtc | AA109760 |
| 4124 | gaaagatcctgctgccagagcccagc | W48962 | 46728 | gacacctggaatcatgggctgaac | Z22923 | 89332 | cgctcaggtcgctcgggaactcg | AA109760 |
| 4125 | agagccagatccgcagcgtcatgc | W48962 | 46729 | cacctggaatcatgggctgaccgc | Z22923 | 89333 | ggactcgtcggtgacactgctcca | AA109760 |
| 4126 | gccagatccgcagcgtcatgcag | W48962 | 46730 | tggaatcatgggctgcaccgcagcg | Z22923 | 89334 | cacgactctgctgcgacgatcgca | AA109760 |
| 4127 | tgagtccctcacctgctctctcagt | W48962 | 46731 | gaatcatgggctgcaccgcagcg | Z22923 | 89335 | tgacactctccaggaagctgctga | AA109760 |
| 4128 | ctcagctgacactggaattctac | M83348 | 46732 | ggctgcaccgcagcgaggatgaaaa | Z22923 | 89336 | gacgatcgcactgctggccacatc | AA109760 |
| 4129 | tacagccacattggagtcatgtc | M83348 | 46733 | ctgaccgcagcgaggatgaaaac | Z22923 | 89337 | gctggccaccatcgcagcccaggca | AA109760 |
| 4130 | tcatgtctgaatgctggatatt | M83348 | 46734 | ctgtagtgcctdgccctggggcag | Z22923 | 89338 | catctgagccaggcaggaggctccg | AA109760 |
| 4131 | atgagaccaggacctaaaatgagac | M83348 | 46735 | tgcaccgcagtgaggatgaaaaca | Z22923 | 89339 | gtgtcactcggtactccgag | AA109760 |
| 4132 | atgagactctgtctccaaaggaaaa | M83348 | 46736 | actgccgcccagccagttgcga | Z22923 | 89340 | gctgttcactcgtactccgaagc | AA109760 |
| 4133 | ctctgtctccaaaggaaacagaca | M83348 | 46737 | gcaagtcgcacaactagtcgcaaac | Z22923 | 89341 | tcggtactgccagatgcatgactga | AA109760 |
| 4134 | atatatagccagtcatgcagaatacca | M83348 | 46738 | aagtgcgcacaactagtcgcacact | Z22923 | 89342 | gtactgcagagcatgactgcatat | AA109760 |
| 4135 | tacatggccaatccatttgagagc | M83348 | 46739 | gtgccacaacaactagtcgacacctgg | Z22923 | 89343 | actgaattcacctaacgcaagatg | AA109760 |
| 4136 | gagccccaaacttgagtctgctg | M83348 | 46740 | gccacaactagctgggcgctgaa | Z22923 | 89344 | gtcttaaagccaggtcacttgctgg | AA109760 |
| 4137 | tttgagtcgtcgttaaatgttgc | M83348 | 46741 | gcacaactagtcgacacctggaat | Z22923 | 89345 | agcattcagtgattcctgcctgtc | U79776 |
| 4138 | atgttgcaggtgtttgaatagaaata | M83348 | 46742 | acaactagtgcgaccctggaatcat | Z22923 | 89346 | ttcctgcctgtctcaagagagtag | U79776 |
| 4139 | agcgaccagtgaattccatccgt | M83348 | 46743 | agcacatcgaaccacaaaacaggt | AA023145 | 89347 | tattagcatcattcaact | U79776 |
| 4140 | gaaataatgtctctgtccatatcc | M83348 | 46744 | ggtgacactcgtgaaccatcggcaatg | X75926 | 89348 | acatttattcaacttctgctt | U79776 |
| 4141 | tggaatctcatccgttggatctc | M83348 | 46745 | catgcccgtcattggctggcata | X75926 | 89349 | atcaactttgcactttgtgata | U79776 |
| 4142 | aatctcatccgttggatcttcaat | M83348 | 46746 | cctgtcatgtcttgccatagcatct | X75926 | 89350 | tttgtggcactttgtgatacaaatg | U79776 |
| 4143 | gtgacactccttcatcctataaa | M83348 | 46747 | atggcttgccatagcattcgta | X75926 | 89351 | ttgggtgctctactatgccat | U79776 |
| 4144 | tgtcagttaccactccaggtacagc | M83348 | 46748 | ctcctaagcagcaaagattgacagc | X75926 | 89352 | ctactaagcttcatatttctgaca | U79776 |
| 4145 | ttaccactccagtgaccgccaccatt | M83348 | 46749 | tagcaagccaaactgggctgccaccatt | X75926 | 89353 | tgccatatttctgacacttaag | U79776 |
| 4146 | ctcaggtacagccaccattgtgagt | M83348 | 46750 | ggctcaaagcgctcagttcaggt | X75926 | 89354 | tatttctgacacttaagaaagaa | U79776 |
| 4147 | aggtacagccaccattgtgagtcat | M83348 | 46751 | gtgcatttacacggcaggtctgg | X75926 | 89355 | aagccaggtcaactgctgctgctggaa | U79776 |
| 4148 | ttcggatccattgtaacactcct | AA110197 | 46752 | tttggctgactgtctcctaacaca | X75926 | 89356 | attcattttgatgcaccagttgcaaa | U79776 |
| 4149 | atgctaacatctaccatgcctgaaga | AA110197 | 46753 | gtcctcaacaagatgggtacac | X75926 | 89357 | accaagctgcaagagtccgtccc | U79776 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4150 | ttaacagatcacaaagtgtcagc | AA110197 | 46754 | ggtacactacacctgagatcctc | X75926 | 89358 | ttgccaagatgtcctgtccctactg | U79776 |
| 4151 | tcacaaagtgtcagccatcatcaa | AA110197 | 46755 | gtactagtgccaagttgctcagaa | X75926 | 89359 | aagtcctgtccctactgatgtgt | U79776 |
| 4152 | caaacgtgtcagccatcatcaagcc | AA110197 | 46756 | agtgccaagttgctcagaaagtctg | X75926 | 89360 | ttcttatagctgctacatgtttg | U79776 |
| 4153 | gtctgcagctgtctgaagtgaa | AA110197 | 46757 | ccgcctacgttgctcagatctat | X75926 | 89361 | gttctttcattgcactgagcattc | U79776 |
| 4154 | tgtcagctcgtctgaaggaggt | AA110197 | 46758 | tactgtcggttgacatcattaaata | X75926 | 89362 | ttcattgcactgagcattcagtgat | U79776 |
| 4155 | aggtgcagccgctgctgacctgcc | AA110197 | 46759 | tctctcttgatgagctgctgtgt | X75926 | 89363 | cctaggaaggctgcacctgacctg | U03421 |
| 4156 | tgcagccgctgctgacctgccag | AA110197 | 46760 | gagctgctgtgtggctgctcgta | X75926 | 89364 | gaacctgaccttgactgggccgtg | U03421 |
| 4157 | tgccagcaacctgaagcaatcgt | AA110197 | 46761 | ctgtgtggctgctgttgacaaat | X75926 | 89365 | gtgcatcgagaacctgaagagcag | U03421 |
| 4158 | ccagcaacctgaagcaatcgtat | AA110197 | 46762 | tgtgcatcctctaaccaggtact | X75926 | 89366 | caictgagaccctgaagaggacgt | U03421 |
| 4159 | gcaaacctgaagcaatcgtgctaga | AA110197 | 46763 | ctgatgagccagaggacctgacac | X75926 | 89367 | agaccctgaagagcaggaactgag | U03421 |
| 4160 | ctaacactacctgatgaagaagg | AA110197 | 46764 | atgaagcctcatcagctcgagga | X75926 | 89368 | tgagatcctgggtctgggggtcct | U03421 |
| 4161 | gggcaagaaagacctgactactgg | AA110197 | 46765 | caagagccacatcagggatgcagt | X75926 | 89369 | gggtctgggtctcatgagaaatct | U03421 |
| 4162 | accagaaagacccctgactactggga | AA110197 | 46766 | tagtcacactgccaggccctggga | X75926 | 89370 | tatgaaatcgttcacagtgctctc | U03421 |
| 4163 | aagaccctgactctggtgactcct | AA110197 | 46767 | cgaattgtgccaaggctggcctgg | X75926 | 89371 | gaaatcgttcacagtgtctctctc | U03421 |
| 4164 | gtgacctctgagacgttagtaga | AA110197 | 46768 | atgtggccaaaggctggcctggcc | X75926 | 89372 | atctgttcacagtgtctcctcact | U03421 |
| 4165 | ggtctctataggcccgccaaaga | AA110197 | 46769 | acctcccaggtgacatgggctgc | X75926 | 89373 | tgttcacgtgttcctccacttcc | U03421 |
| 4166 | ctctcatcaggcccgccaaagatt | AA110197 | 46770 | tgacatggctgccccaagtatct | X75926 | 89374 | cagtgtctcctcactcctacatt | U03421 |
| 4167 | caggccccagccaaagatttctcatca | AA110197 | 46771 | caagatcctgtgactctctcgc | X75926 | 89375 | gactcgactgtgactcgggactgaa | U03421 |
| 4168 | gtgaaagccactctagggggtgca | M15668 | 46772 | gtatccctgactctttctgcagc | X75926 | 89376 | tcgactgtgaactggggactgaaac | U03421 |
| 4169 | gccacttctaggggttgcatcacta | M15668 | 46773 | tgtgactttctctgcagcgccgc | X75926 | 89377 | gactgaaaccaccacatcgatacgc | U03421 |
| 4170 | accaatgtcattgtagaggcgtc | M15668 | 46774 | gactctctgcaggcgcggccaag | X75926 | 89378 | acaccagcagacagtctttccag | U03421 |
| 4171 | atattcgctctagaaggaagtga | M15668 | 46775 | tcatcagcttgaggaaagagcgggc | X75926 | 89379 | cccagtagacgtctttccagtag | U03421 |
| 4172 | aaaggctgagctctctctgacgt | M15668 | 46776 | tgcagccgccgccaagtcaccagg | X75926 | 89380 | agtagacagtctttccagtagacc | U03421 |
| 4173 | ctctctgacgtatgtacctctg | M15668 | 46777 | tccgcttcggggaagaggggccca | X75926 | 89381 | tagacagtcttccagtaggactgg | U03421 |
| 4174 | tatgagcctgactaggcttctgtc | M15668 | 46778 | ctctcaacactgatacgcctgctg | X75926 | 89382 | tgggcatctgagaacccgaagag | U03421 |
| 4175 | gcctcgttagctttcgtcactcac | M15668 | 46779 | acactgatacgtctgctgaccatc | X75926 | 89383 | tgactattcctgggggattgatta | U03421 |
| 4176 | cactcacttggtgcatcagcatg | M15668 | 46780 | atacgctctgaccatcaagagc | X75926 | 89384 | attacgccagttgacattggta | U03421 |
| 4177 | ttgactgcattgcaatctgatga | M15668 | 46781 | cgctcctgaccatcaagagccac | X75926 | 89385 | cccatcataaatgggccgggtat | U03421 |
| 4178 | ctgatgaaattccccagctgaagtc | M15668 | 46782 | tctgctgaccatcaaagagccacatc | X75926 | 89386 | gcagcatccatagctgctgcga | U03421 |
| 4179 | aaaattccccagctgaagtctgaaga | M15668 | 46783 | catcaagagccacatcaaggatgca | X75926 | 89387 | gcatcctaagctgtctgcgatga | U78103 |
| 4180 | tgctcctaagctaacctgctgtttt | M15668 | 46784 | catcagcagcctgaaccgaacacac | AA023919 | 89388 | tcatagctgctgcgatgatgccag | U78103 |
| 4181 | taagctaacctgctgtttctccacat | M15668 | 46785 | tccagcctgaaccgaacacacct | AA023919 | 89389 | cgtctgcgatgatgccagcattg | U78103 |
| 4182 | tgtgccacagacttaacagtgcaa | M15668 | 46786 | aaggccctacctggaaccggaatgca | AA023919 | 89390 | gcgatgatgccagcattggggatg | U78103 |
| 4183 | aggccaagcatctcagctgtctta | M15668 | 46787 | ccgtggaccagatgcaggtgtca | AA023919 | 89391 | aattagctgtgtctgtaaaatag | U78103 |
| 4184 | agcatctcagctgctctactgcat | M15668 | 46788 | gtggacccagatgcaggtgtcaga | AA023919 | 89392 | atgtatcttgctagtaagggcacat | U78103 |
| 4185 | tcagctcgctactgcatcgatcat | M15668 | 46789 | accaaggcaggtgtcagaggcc | AA023919 | 89393 | ttttcagtcattggatcagtggc | U78103 |
| 4186 | cgtcttactgcatcagatgctgtt | M15668 | 46790 | tcagaggccgaggcagcgatgtgccac | AA023919 | 89394 | gtactgtctctgctcggacttta | U78103 |
| 4187 | gctggttctcagatccatttaa | M15668 | 46791 | gcagcaggccaacgatgtgccga | AA023919 | 89395 | acagccagtgacattggtacat | U78103 |
| 4188 | cagacccctgagactgcacttga | W48999 | 46792 | agcagggccaacgatgtgccgacc | AA023919 | 89396 | agatgctcattggcaatcaggt | U78103 |
| 4189 | ccatggaacagtcctgacaaggc | W48999 | 46793 | caggattacactctctacctggagct | AA023919 | 89397 | aagatcctcataaagccaaatgcaac | U78103 |
| 4190 | agtacacatccaactaacatgacaac | W48999 | 46794 | ggattacactctcctactctgggagct | AA023919 | 89398 | atcctaagccaacactgcacaac | U78103 |
| 4191 | caactatgacaacatgacaaggccat | W48999 | 46795 | tactatctctacctggagctgaga | AA023919 | 89399 | aagccaaatgcacaacactgaccca | U78103 |
| 4192 | ctatgacaaagtgcccaggcaatctc | W48999 | 46796 | tggaaccgaacacctgtatgt | AA023919 | 89400 | ccaaatgcaacaactgaccatca | U78103 |
| 4193 | caagctcccaggcaatcatgcc | W48999 | 46797 | cacgtatgtgtgggaccggtg | AA023919 | 89401 | caacactgacccatcataaatgtgg | U78103 |
| 4194 | cccagggcaatcatgccagctg | W48999 | 46798 | acgggtcctaacaaccatgtgca | AA023919 | 89402 | cactgacccatcataaatgtggc | U78103 |
| 4195 | caatcatgctcagccggctggcc | W48999 | 46799 | gtgcctacaaccccatgtgcacta | AA023919 | 89403 | acctttgctgagtcgctaga | U78103 |
| 4196 | tctcatgctcagccggctgcctg | W48999 | 46800 | gcctacaaccccatgtgcgacctag | AA023919 | 89404 | ttttgtctgagtcgctagaggc | U78103 |
| 4197 | cctgcgttcctcagaggccagagtgctc | W48999 | 46801 | acacaccccatgtgcacctatgaa | AA023919 | 89405 | agctggcttcaaccagcctgagg | AA109998 |
| 4198 | agaccgagtgctctgcgatgccag | W48999 | 46802 | acaccccatgcacctatgtgaacc | AA023919 | 89406 | ggcttcaaccagccctgaggtgacg | AA109998 |
| 4199 | cctgcgatgcagaagagacgggcacg | W48999 | 46803 | ccccatgcgcacctatggaacgt | AA023919 | 89407 | aaccagcctgatggtgacggcagag | AA109998 |

| SEQ ID NO | sequence | DBAxnID | SEQ ID NO | sequence | DBAxnID | SEQ ID NO | sequence | DBAxnID |
|---|---|---|---|---|---|---|---|---|
| 4200 | tggacatgtccctgacaaggcaga | W48999 | 46804 | gagatcgtcagtcggtcctctggag | AA023922 | 89408 | cagctcgaggtggacggcagagtc | AA109998 |
| 4201 | acatgtccctgacaaggcagaggc | W48999 | 46805 | tcgtcagtcggtcctctggagacag | AA023922 | 89409 | aagtcggctactctgctttgga | AA109998 |
| 4202 | aggcagccctggtggccaaggaact | W48999 | 46806 | acatgtcgtctgcgagtagtag | AA023922 | 89410 | tctgggtacttctgctttggaaag | AA109998 |
| 4203 | cagccctggtggccaaggaactgcg | W48999 | 46807 | attgtcgtctgcgagtagtagcc | AA023922 | 89411 | gggctactctgctttggaaagctg | AA109998 |
| 4204 | ccaaggaactgcggtccgctgctaga | W48999 | 46808 | tgtcgtctgcgagtagtagcat | AA023922 | 89412 | ctactctgctttggaaagctgct | AA109998 |
| 4205 | aactgcggaccgctgctgaagaggc | W48999 | 46809 | tcgtctgcgagtagtagccatca | AA023922 | 89413 | cttctgctttgaaagctgcgcgg | AA109998 |
| 4206 | ctgaccctccaaagtcacaca | W48999 | 46810 | gtagtagccatcaagtcagattg | AA023922 | 89414 | aaagctgcgggaacacgagggg | AA109998 |
| 4207 | taaagtcacactaccaactatgac | W48999 | 46811 | tagccatcaagtcagattgtgga | AA023922 | 89415 | gagtcgctgaggccaccagtc | AA109998 |
| 4208 | actgctttccaagtctcgaatat | W49003 | 46812 | gccatcaagtcagattgtggaga | AA023922 | 89416 | gctgcggggaacactgaggggtc | AA109998 |
| 4209 | tttccaagtctctgaatatcttgg | W49003 | 46813 | catcaagtcagattgtggagag | AA023922 | 89417 | aggccaccagttcctcacagtcag | AA109998 |
| 4210 | ctgtcctccagtcgaaccagctat | W49003 | 46814 | tggctccgatcgagagcgactct | AA023922 | 89418 | cagttctccacgctcagcagagc | AA109998 |
| 4211 | tccagtcgaaccagctatccctg | W49003 | 46815 | gcgacttctacaagatgatgtagtg | AA023922 | 89419 | gttcctccagctcagcagctgg | AA109998 |
| 4212 | tgaaccagctatccctggagtct | W49003 | 46816 | cagtacgcgttgcgacatttgtg | AA023922 | 89420 | cacagtcagaggtgcaagaaa | AA109998 |
| 4213 | acccagctatcccctggagtcttgg | W49003 | 46817 | gctaccgcggttgcgacatttgcgtc | AA023922 | 89421 | gaaagtcagtcaacactgaggaacc | AA109998 |
| 4214 | cagtatcccctggagtcttggtgg | W49003 | 46818 | taccgcgttgcgacatttgcgtctg | AA023922 | 89422 | agtcagtcaacactgaggaaccaca | AA109998 |
| 4215 | ttggtggccctaccccattggcat | W49003 | 46819 | ccgcgttgcgacatttgctgctgt | AA023922 | 89423 | gagacgcggtcgtcctgaagaggct | AA109998 |
| 4216 | ggaacatcgcaaccaactagctgac | W49003 | 46820 | gcgttgcgacatttgctctgct | AA023922 | 89424 | tacacacaggtcacttctgcc | AA109998 |
| 4217 | acaagctgacctctcaactcctt | W49003 | 46821 | gttcgacatgtcgtctgctgagg | AA023922 | 89425 | accacaggtcacttcttcgcctga | AA109998 |
| 4218 | ttgggatcatcacatgctctcgg | W49003 | 46822 | tgcgacatgtcgtctgctgaggta | AA023922 | 89426 | acgtgactgggcttcagatggag | AA109998 |
| 4219 | ggatcatccacatgctgttcgggt | W49003 | 46823 | cgacatttgcgtctgctgagggt | AA023922 | 89427 | gtgactgggcttcagatgaggcg | AA109998 |
| 4220 | ccaagtctgaatatcttggtc | W49003 | 46824 | catgatatctttgaccttctcat | AA023922 | 89428 | actgggctccagatgagccgccc | AA109998 |
| 4221 | gggtcgcctgagcctttccacca | W49003 | 46825 | atgtatctttgaccttctcagtg | | 89429 | cccacaggcactgagtacgagactc | AA109998 |
| 4222 | atatcttggctcatcatgagcgt | W49003 | 46826 | ttgaaactctcgtttggatgtag | | 89430 | gagtacgagacctctcactgctaagt | AA109998 |
| 4223 | tcttttggtcatcatggagcgtacg | W49003 | 46827 | tgatatctttgacctctcagta | | 89431 | gagactctcacgtctaagtttcact | AA109998 |
| 4224 | tacggcaagttcaccatagagaa | W49003 | 46828 | gatatctttgacctctcagat | | 89432 | actctcactgctaagtttcactcg | AA109998 |
| 4225 | caagttcaccatagagaactggaa | W49003 | 46829 | atatctttgacctctcagatg | | 89433 | gctaagttcacttcgtggactg | AA109998 |
| 4226 | tgttcaccatagagaactgacggaa | W49003 | 46830 | tatctttgacctctcagtgatga | | 89434 | aagttcacttcgtggactggctg | AA109998 |
| 4227 | tcaccatagagaactgacggagga | W49003 | 46831 | acctctcagtgatgagctggact | | 89435 | tttcacttcacttcgtggactggct | AA109998 |
| 4228 | cgctcctggaagttctgctctcca | W49003 | 46832 | cctctcagtgatgagctggactg | | 89436 | ggtgcacttctgccctgatcaact | AA109998 |
| 4229 | gaaccaagtctcatgatgaagt | W49003 | 46833 | ctctcagtgatgagctggactga | | 89437 | tcgggactggctctcagagc | AA109998 |
| 4230 | cctccaatgcgtgtcaccatat | M17299 | 46834 | gactgaaactctcgttgatg | | 89438 | actctcgccgatcaactcccagg | AA109998 |
| 4231 | ccgtatgctgcgtgtcgtcatca | M17299 | 46835 | ctttattaccactactgatgtct | | 89439 | atccagtccctgaagcaggcgcc | AA109998 |
| 4232 | gccatcaatatcacattcagcaagt | M17299 | 46836 | tattaccactacttgatgcctcat | AA166524 | 89440 | gtacagagctcccgatccccatgcca | AA109999 |
| 4233 | aatatcacattcagcaagtctat | M17299 | 46837 | gctaccctcgagtagctgctggg | AA166524 | 89441 | accatccacctgaccttgcagatcgcg | AA109999 |
| 4234 | acattcagcaagtctaattctgtc | M17299 | 46838 | accctctcgagtagctggggtcc | AA166524 | 89442 | gccgcgtcgacctggtgaatgaga | AA109999 |
| 4235 | catcacattgttagtctctcaa | M17299 | 46839 | ctctcgagtagctgcggtcctga | AA166524 | 89443 | cagcctgaccctggtgaatgagacg | AA109999 |
| 4236 | tcttcaagatctcatcaggatttc | M17299 | 46840 | ctgagtagctgctggtgctga | AA166524 | 89444 | aatgagacgtgactgggtccag | AA109999 |
| 4237 | agatctcatcaggatttcccacgt | M17299 | 46841 | acagctgcacactgtctcaaaagt | AA166524 | 89445 | gtacacacttagttacttcattg | AA109999 |
| 4238 | catcaggatttcccacgtcctc | M17299 | 46842 | gctgcacacgtgcttcaaaaggtacg | AA166524 | 89446 | gttacttcattgctccgttggt | AA109999 |
| 4239 | aggaaacattccatgctcaactatt | M17299 | 46843 | gacactgctttcaaaagggtaccggaa | AA166524 | 89447 | ttgaacacgtatttcccagtcca | AA109999 |
| 4240 | cattctgtcaactattaaagaa | M17299 | 46844 | aactgaggagctgcagtgctgcagt | AA166524 | 89448 | atgcagttcttctttggcctt | AA109999 |
| 4241 | ctactgtcgccaaatgggggac | M17299 | 46845 | agctatgcagttcgagttgggatt | AA166524 | 89449 | tcttggccttttcctgctcagca | AA109999 |
| 4242 | tagaggcctcagcaacatgtaatt | M17299 | 46846 | tatgcagttcgagttggggattatc | AA166524 | 89450 | gtgccttcctgctcgttcagca | AA109999 |
| 4243 | aatgtactgctctcgttttcctgc | M17299 | 46847 | atgctccactcgatgtggactga | AA166524 | 89451 | tcagcattccagcctgtggcagt | AA109999 |
| 4244 | cttctccgttcctgcacag | M17299 | 46848 | ctgaccgcgggcagaaaaggaatac | AA166524 | 89452 | attctcagctcgtcagtaaagag | AA109999 |
| 4245 | cgcacagcagaaccaactcac | M17299 | 46849 | caccgtcggaaaacgggatcattg | AA166524 | 89453 | ctctccagtcgtgttcctggat | AA109999 |
| 4246 | ctatatctcaacattgttaacctc | M17299 | 46850 | caggtctccagctcgagggtcgg | AA166524 | 89454 | ttacactgttagacactatttta | AA109999 |
| 4247 | tgaatcaagacgcctatgctgctg | M17299 | 46851 | gacggcaggcgctgttggagacta | U79523 | 89455 | tgttagaacactattttcagaact | U79523 |
| 4248 | aagccgactatgtcgtgtg | M17299 | 46852 | aggcgtgtttgtggagctcacctcc | U79523 | 89456 | acactattttcagaatctgaatgt | U79523 |
| 4249 | gaccgctgctgtaccagtagctact | W49039 | 46853 | ctgctttgtggaagctcagcactct | U79523 | 89457 | tcatttggccgttggcgtttggt | U79523 |

| SEQ ID NO | sequence | DBAxnID | SEQ ID NO | sequence | DBAxnID | SEQ ID NO | sequence | DBAxnID |
|---|---|---|---|---|---|---|---|---|
| 4250 | cctgctgtaccagtagctactcag | W49039 | 46854 | tgtgggagctaccctctgagtagt | AA166524 | 89458 | ctaccagttcactccagtgccatg | U79523 |
| 4251 | ttttctgacacaagaacttgtaagc | W49039 | 46855 | aactacaccacgagagaggatct | X56518 | 89459 | gttcactccagtgccatgtcttta | U79523 |
| 4252 | cagcggtacctagtagctgataaac | W49039 | 46856 | tacacaaggaggaggaggatcttg | X56518 | 89460 | tccaggccattgtctttatatgaa | U79523 |
| 4253 | ggatctatactctgctacactgtgaa | W49039 | 46857 | aatcgcttctcccaaattgctca | X56518 | 89461 | ctcttccagttagcgtcaaagcc | U79523 |
| 4254 | tctatactctgtacactggaaag | W49039 | 46858 | ttttctcccaaattgtcaggcca | X56518 | 89462 | agcgctcaaagccctaatggaagtt | U79523 |
| 4255 | atactctgctacactggaaatgaag | W49039 | 46859 | cccaaattgtcagcgccacgata | X56518 | 89463 | aatagcctattctgcttgaaca | U79523 |
| 4256 | ctctgctacactggaaatgaagggg | W49039 | 46860 | ttgctcagccgaccgatactctgg | X56518 | 89464 | cctattctgcttgaacacacgtat | U79523 |
| 4257 | gacatgtctggttttgtaataata | W49039 | 46861 | ctcagcgccacgatactctgacg | X56518 | 89465 | cctttgacatcgcatgccatggatc | AA110022 |
| 4258 | atgctggtgtctggagcatcgat | W49039 | 46862 | acgatactctggacgagggcagcg | X56518 | 89466 | ctttgacatcgatgccatcggatc | AA110022 |
| 4259 | gtgctgctggagcatcgatacgagg | W49039 | 46863 | gcccgagccctagctgtatataca | X56518 | 89467 | atgccatcgatgcgcttaagctcac | AA110022 |
| 4260 | tctgctggagcatcgatacgagggga | W49039 | 46864 | gccctagctagtatatacactatt | X56518 | 89468 | tgccatcgatcgttaacgtcact | AA110022 |
| 4261 | gctgtaccagtagctactcagttc | W49039 | 46865 | catcttctgcatgtctgggctaag | X56518 | 89469 | ccatcgatcgcttaacgtcacgc | AA110022 |
| 4262 | gtaccagtagctactcagttcatt | W49039 | 46866 | cttctgcatgtctgggctaagctc | X56518 | 89470 | catcgatcgcttaacgtcactgct | AA110022 |
| 4263 | cccagtagctactcagttcattact | W49039 | 46867 | tactgaccaatttgcccgcacag | X56518 | 89471 | atcggatcgttaacgtcactgctg | AA110022 |
| 4264 | agtagctactcagttcattacttcc | W49039 | 46868 | tggaccaatttgcccgcacaggg | X56518 | 89472 | tcggatcgttaacgtcactgctgc | AA110022 |
| 4265 | tactcagttcattacttccaacaga | W49039 | 46869 | cccaatgacccctcgagactccaaat | X56518 | 89473 | ggatcgcttaacgtcactgctgccg | AA110022 |
| 4266 | tcagttcattacttccaacagaag | W49039 | 46870 | cctcgagactccaaatctccaaga | X56518 | 89474 | atcgcttaacgtcactgctgccgac | AA110022 |
| 4267 | gttcattacttccaacagaaggttg | W49039 | 46871 | cgagactccaaatctccacagtgc | X56518 | 89475 | gtataagatcaccattgccaacgac | AA110022 |
| 4268 | tacttccaacagaaggttgaaccat | W49039 | 46872 | tccaaatctccacagtggccacgt | X56518 | 89476 | tataagatcaccattgccaacgaca | AA110022 |
| 4269 | gagctataagcctctggctctct | W49039 | 46873 | acctgcgcttctgaatcgctttc | X56518 | 89477 | tttgacatcgatcgcatcggatcgc | AA110022 |
| 4270 | taagcctctggcttctctactgtg | W49039 | 46874 | tggaatcgctttctcccaaatgc | X56518 | 89478 | ttgacatcgatcgcatcggatcgc | AA110022 |
| 4271 | gggcatcagaaaccctgaaactgggg | W49039 | 46875 | ttttctgctggccatacccgtcctg | X56518 | 89479 | gacatcgatgccatcgatgcatcgctta | AA110022 |
| 4272 | tagatagctgagcccacctgtggg | J03293 | 46876 | ctgctggccatacccgtcctgtgt | AA028322 | 89480 | acatcgatcccatcgatgcgcttaa | AA110022 |
| 4273 | agcaagaacaggcgtcataactgt | J03293 | 46877 | cataaagtcttccatctgctcctcg | AA028322 | 89481 | catcgatgccatcgatgcttaac | AA110022 |
| 4274 | aacagcgctataactgctagct | J03293 | 46878 | aaagtcttccatctgctcttcgaag | AA028322 | 89482 | atcgatcgcccgatcgctaacg | AA110022 |
| 4275 | cgctcataactgtctagctaget | J03293 | 46879 | gtcttccatctgctcttcgaagca | AA028322 | 89483 | cgatgccatcggatcgcttaacgtc | AA110022 |
| 4276 | taactgtctagctaagttatgat | J03293 | 46880 | catctgctcttgaagccatcacag | AA028322 | 89484 | gatgccatcggatcgctaacgtca | AA110022 |
| 4277 | ttcaaggtcattgtggctacacaa | J03293 | 46881 | ctgtcttgaagccatcacgggt | AA028322 | 89485 | tgacctgactgacctgatgatga | AA110022 |
| 4278 | gtcattgtggctacacaaggagct | J03293 | 46882 | ctcttcaagccatcacgggctcc | AA028322 | 89486 | aaatcatcagctgccccactgag | AA110022 |
| 4279 | attgtggctacacaaggagctga | J03293 | 46883 | acgggtctctgcgcctcctag | AA028322 | 89487 | acatgaccggcaaatgcaagtcctag | AA110022 |
| 4280 | gtgctcctgatatacatagaatt | J03293 | 46884 | gtggccagtactctgacatcgggc | AA028322 | 89488 | ccggcaaatgcaagtcctgatgac | AA110022 |
| 4281 | ttctggctctctactgtgcactt | J03293 | 46885 | gtggtgctcatatctggcctcg | AA028322 | 89489 | gcaaatgcaagtcctggatgactcc | AA110022 |
| 4282 | tactgtgcaccttgttgatgtcta | J03293 | 46886 | gtgctcattatctggcctctcg | AA028322 | 89490 | aatgcaagtcctgatgactccatg | AA109910 |
| 4283 | gcaccttgttgatgtctatagtt | J03293 | 46887 | aacaggactctgatctggctccga | AA028322 | 89491 | agtcctgatgactccatgtccgga | AA109910 |
| 4284 | tttagctgcatgcattttatgtaac | J03293 | 46888 | aggactctgatctggctccgaact | AA028322 | 89492 | cctggatgactccatgtccggagag | AA109910 |
| 4285 | atgtaaccacatgcatgcagtacc | J03293 | 46889 | actcgatcgtgctccgaactac | AA028322 | 89493 | ggatgactccatgtccggagagaag | AA109910 |
| 4286 | taaccacatgcagtacactgt | J03293 | 46890 | ctgatcgtgctccgaactac | AA028322 | 89494 | gtatgtaacttctccagaggca | AA109910 |
| 4287 | cccacatgcatgcagtacctgga | J03293 | 46891 | atctgcgtcgaactatcccaca | AA028322 | 89495 | tgtactaactctccagaggcaagt | AA109910 |
| 4288 | tgcatgcagtaccgtagagtcac | J03293 | 46892 | tggctccgaactatcccaacaag | AA028322 | 89496 | ttctccagaggcaagttcaaggtt | AA109910 |
| 4289 | ctcgaggccaggtccgcagagat | J03293 | 46893 | ccgaactatcccaacaagagcata | AA028322 | 89497 | tggctcccacctgaggataacaga | AA109910 |
| 4290 | ccaggtctccgcagagatcctagctg | W48975 | 46894 | tatcccaacaagagcataaagtct | AA028322 | 89498 | ctgccccacctgaggataacagatgt | AA109910 |
| 4291 | gctgaactgtggcagctcctcg | W48975 | 46895 | ccaagtccccagaaatgtccctgct | AA028322 | 89499 | cagatgtcactccggactgctagg | AA109910 |
| 4292 | tgaactgctggcgatggtctcgat | W48975 | 46896 | agtcccagaaatgtccctgctgag | W75353 | 89500 | agtcacttccgactgctaggggg | AA109910 |
| 4293 | aactgctgcgatggtctcgatgc | W48975 | 46897 | tgtcttggtcagctttgtagcac | W75353 | 89501 | atggcatgtataccaccttagttga | AA109910 |
| 4294 | ctgttggcgatggtcgatgcc | W48975 | 46898 | tcagctttgtcatgcatgctac | W75353 | 89502 | tgtataccacttaggtgacatgac | AA109910 |
| 4295 | cgttggcgatggtcgatgccc | W48975 | 46899 | tagcatccagtctacagaaagct | W75353 | 89503 | ataccacttaggtgacatgaccagg | AA109910 |
| 4296 | cggccccgtgccactgcaatgtagc | W48975 | 46900 | catccatgtctacagaaagctgt | W75353 | 89504 | ccactagttgacatgaccggcaa | AA109910 |
| 4297 | gcccgtgccactgcaatgtagcag | W48975 | 46901 | ccatgtctacagaaagcctgagccc | W75353 | 89505 | tcagagtctcacaaactgtcccct | AA109910 |
| 4298 | cgtgccactgcaatgtagcagct | W48975 | 46902 | agagcagcgcctgagcctggtaag | W75353 | 89506 | gagcctccacaatctgcctctagg | AA109912 |
| 4299 | tgcactgcaatgtagcagctgc | W48975 | 46903 | tggagccactggtgaccagaaccag | W75353 | 89507 | ggaccactggcccctcaagagtgacta | AA109912 |

TABLE 1-continued

| SEQ ID NO | sequence | DBAxnID | SEQ ID NO | sequence | DBAxnID |
|---|---|---|---|---|---|
| 4300 | actgcaatgtagcagctctgcgagc | W48975 | 46904 | agcccactgtgaccagaaccaggga | W75353 | 89508 | cactggcctcaagagtgactacat | AA109912 |
| 4301 | gctccagagatctagctgagt | W48975 | 46905 | tgcacagaaccaggacagatggca | W75353 | 89509 | ccctcaagagtgactacattagtct | AA109912 |
| 4302 | tgcaattgtagcagctctgcgagcc | W48975 | 46906 | acagatggcagttctggggcc | W75353 | 89510 | actacattagtctgctgcctcaag | AA109912 |
| 4303 | tcgcagagatcctagctgaggtgg | W48975 | 46907 | ccccagaaatgtccctgctaggtg | W75353 | 89511 | acattagtctgctgcctcaagcac | AA109912 |
| 4304 | ggtcgccgatgtcacggttccta | W48975 | 46908 | cagaaatgtccctgctgaggtgg | W75353 | 89512 | ttagtctgctgcctcaagcacta | AA109912 |
| 4305 | tcgccggatgcacggttctctaa | W48975 | 46909 | tgtccctgctgaggtgcaggccag | W75353 | 89513 | tggcctcaagcacttactagccac | AA109912 |
| 4306 | ttacggggtgcagctgctgctgaac | W48975 | 46910 | tgtgaggtgcaggccacgggacct | W75353 | 89514 | gcacttactagccacggcctacat | AA109912 |
| 4307 | tgcagcggcgcgaactcgtggc | W48975 | 46911 | catcagtctccctttcgtcgtgt | W75353 | 89515 | cttacctagccacggcctcatctt | AA109912 |
| 4308 | gggtcgctgaactcgtggcgatg | W48975 | 46912 | cagctccctttctgtcgtgctt | W75353 | 89516 | acctagccacggcctcacatctagt | AA109912 |
| 4309 | tcgctgaactcgtggcgatggtct | W48975 | 46913 | ctgtcgctgtctggtcagttgt | W75353 | 89517 | tcctcaaactgtccctaggggtg | AA109912 |
| 4310 | gctatctgcctgcctgatctgga | W48975 | 46914 | tgctgtctctgttcagcttgtagc | W75353 | 89518 | actgtccctaggggtgcctgagt | AA109912 |
| 4311 | tgcctgcctgatctggaatcctc | J02980 | 46915 | cgcagccaggtcaaggtgagagc | AA023975 | 89519 | ggcctagctctgtccatatctgg | AA109912 |
| 4312 | tatattccagaccctgcaactc | J02980 | 46916 | gagatgtccaagagctgatgcagc | AA023975 | 89520 | agctctgccatatctgggaacgg | AA109912 |
| 4313 | caacctccatggacaattccagatc | J02980 | 46917 | catcacatgatgcagcgctgga | AA023975 | 89521 | tctctgcatatctgggaaccggta | AA109912 |
| 4314 | aacattccagatctgacctctc | J02980 | 46918 | cacatgattgcagcgctgggacatg | AA023975 | 89522 | ctgcatatctggaacgggaatga | AA109912 |
| 4315 | gaaacactgcgcccatagtcacggc | J02980 | 46919 | gcttctgccacagatgttgttg | AA023975 | 89523 | tatctggaaggtgagtgagtggcc | AA109912 |
| 4316 | ccatagtcacgccagtctccaagc | J02980 | 46920 | gcgcacacgcgatgttgtcactca | AA023975 | 89524 | tctggaacctggcctcaagtgta | AA109912 |
| 4317 | cagglctgctcaggatgagactccc | J02980 | 46921 | gatgttgttgcactcaggcgcagc | AA023975 | 89525 | agaagtcagaagccatgtgtca | AA109912 |
| 4318 | ggaagaactcagccgagcagga | J02980 | 46922 | gcactcaggcgcatgccggtactac | AA023975 | 89526 | aagtcagaagccatgttgtcaga | AA109912 |
| 4319 | attgcagagactgccaaccttta | J02980 | 46923 | ctcaggcgcatgccggtactacagg | AA023975 | 89527 | atggcaaggtcgtctgccagcggc | AA109912 |
| 4320 | cgccaaccttctgccaagtggctc | J02980 | 46924 | aggccatgccgactacagctg | AA023975 | 89528 | gtcagccagccgcggtgaact | AA109912 |
| 4321 | ccctcactgaagtgctctctgt | J02980 | 46925 | atgccggtactacaggctgcgcgg | AA023975 | 89529 | cgctcggcagccgcgttgaactg | AA109912 |
| 4322 | gcctgtatctgaatcctcaatggg | J02980 | 46926 | gtactacaggctgcgcgctgcgga | AA023975 | 89530 | ctctggcagccgcgttgaactgag | AA109912 |
| 4323 | aatcctcatgggccagattcctgg | J02980 | 46927 | atgctcaagagctgatgcagctta | AA023975 | 89531 | ctggaccgcagcaagcaagggaaa | AA109912 |
| 4324 | ccatggccagattcctgctgc | J02980 | 46928 | ctgatcagcttatcgttcctgcc | AA023975 | 89532 | gggcacggcccctcaagtga | AA109912 |
| 4325 | ttccctgctcgcctttattccta | J02980 | 46929 | atgcagttatcgttctaggcgcgac | AA023975 | 89533 | gcatgttcagcgactgagggacacgg | AA109912 |
| 4326 | agttatgctgccctttgccagcagt | J02980 | 46930 | atcgttctaggccgacaactccaca | AA023975 | 89534 | atgcttcagcgactgcacgaget | AA109912 |
| 4327 | agcaggttctctctggggcaggga | J02980 | 46931 | gtctaggccgacaactccacagc | AA023975 | 89535 | gcttcagcgactgcacacgagcttt | AA109912 |
| 4328 | tttctctctgggcgcaggaca | J02980 | 46932 | ggccgacaactccacaagctgtgc | AA023975 | 89536 | ttcagcgactgacacgagcttc | AA109912 |
| 4329 | gcacagattcccaaagcacctatt | J02980 | 46933 | caactccacaagcttctgctgatc | AA023975 | 89537 | gtccgaagccatgtgtcagag | AA109912 |
| 4330 | ccgagcctgcgtctactgatgc | J02980 | 46934 | aagcttctgctgcatcacatgatg | AA023975 | 89538 | ctcagaagccatgttgtcagaagct | AA109912 |
| 4331 | ctcgtgctctactgatggccagctg | W49034 | 46935 | gctgaactcatcctgcttggaaag | AA108035 | 89539 | ggaagtgcatcctccatggagaaca | AA109721 |
| 4332 | caacttcatcaaggtgttaggcaaa | W49034 | 46936 | acctatctgcttggaaagtcctgg | AA108035 | 89540 | aagtgcatcctccatggagaacacg | AA109721 |
| 4333 | cttcatcaaggtgttaggcaagtta | W49034 | 46937 | ccctgctgtggttcaaacttg | AA108035 | 89541 | ggtcatcctcatggagaacacgt | AA109721 |
| 4334 | catgggctgcaggctcaaggttaag | W49034 | 46938 | gaaagtgcatcaattctgaaatgt | AA108035 | 89542 | tcatcctcatggagaaacgctg | AA109721 |
| 4335 | gctggctgcaggctcaaggtaaggat | W49034 | 46939 | tgcatcaattctgaatgtcaaaca | AA108035 | 89543 | atctccatggagaaacgctgtgg | AA109721 |
| 4336 | tgaagtctatgctgaaggtctta | W49034 | 46940 | ctgtcagatcctgtgatcacaca | AA108035 | 89544 | cctccatggagaaacgctgtggtc | AA109721 |
| 4337 | agtctatgctgtgaaggtcctaaag | W49034 | 46941 | agatccctgtgatcatcataa | AA108035 | 89545 | agttactcctttaaagtatgatg | AA109721 |
| 4338 | catcctgcaggagtacgactggac | W49034 | 46942 | atttaagaatgcctccagegagct | AA108035 | 89546 | ttacttccttaaaagtatgatgcct | U79550 |
| 4339 | cctgacgagctgaagtcatcaat | W49034 | 46943 | ccttcaggagctgaagtcatcaat | AA108035 | 89547 | acattccctggtgtgtcccatgtc | U79550 |
| 4340 | tgacgagctgactgaagtcgacgaga | W49034 | 46944 | catcaatattctgcttgataaatg | AA108035 | 89548 | ccctcaagtcgccttcaatgact | U79550 |
| 4341 | cagacgactgaactgacgagag | W49034 | 46945 | caaccatctcgaggtcactacatt | AA108035 | 89549 | tgtcttaatgactgtgtagttgaa | U79550 |
| 4342 | gtcgtctacgtcgagccagctggca | W49034 | 46946 | attccagctgagactggaaca | AA108035 | 89550 | cggttaataagccacgcctatatca | U79550 |
| 4343 | gtcatctctgccagctggcaagc | W49034 | 46947 | tgtgaaagtctgggccaataatgtg | AA108035 | 89551 | ttaatagccacgcctatattcaacc | U79550 |
| 4344 | tactgaggccagctggcaagcct | W49034 | 46948 | ccttgccaataaagtcgcattg | AA108035 | 89552 | gcaagcctatattcaaccagaata | U79550 |
| 4345 | tgatgccagctggcaaggcctgc | W49034 | 46949 | gccaataatgctgccattgagtcaa | AA108035 | 89553 | acgcctatattcaaccagaatactt | U79550 |
| 4346 | ccagctggcaaggccctgcgagaac | W49034 | 46950 | aatgctccattgagtcaactcaa | AA108035 | 89554 | cctatattcaaccagaatacttgtg | U79550 |
| 4347 | gcgctgggcctggatgagtttcaac | W49034 | 46951 | gccattgagtcaacctcactctg | AA108035 | 89555 | atatttcaaccagaatacttgtgaaa | U79550 |
| 4348 | tgagttcaactcatcaaggttta | W49034 | 46952 | gagtcaacctcactctgggcactc | AA108035 | 89556 | ttcaaccagaaatacttgtgaaatca | U79550 |
| 4349 | gtcaacttcatcaaggtgttaggc | W49034 | 46953 | acctcactctgggcactcctgctg | AA108035 | 89557 | atgtatgatgcctggtgtcatcag | U79550 |

| SEQ ID NO | sequence | DBAxnID | SEQ ID NO | sequence | DBAxnID | SEQ ID NO | sequence | DBAxnID |
|---|---|---|---|---|---|---|---|---|
| 4350 | tgtctggtggtacctggctgcagaa | W49037 | 46954 | cttctgggcactcctgctgctggtg | AA108035 | 89558 | gatgcctggtgtcatcagtgaatg | U79550 |
| 4351 | ctggtggtacctggctgcagaaggt | W49037 | 46955 | gccacagtcatcattagaagaagcag | AA039136 | 89559 | gtgaatgacagcctttctggatta | U79550 |
| 4352 | ctaccatggcttccaggcctga | W49037 | 46956 | attgtgattgacacctcaggtgggac | AA039136 | 89560 | gacagcctttctggattacctaca | U79550 |
| 4353 | ccctcatgctggacagtggtgcatct | W49037 | 46957 | gcagtgctcatagtcaggccctac | AA039136 | 89561 | agcctttctggattacctacaatg | U79550 |
| 4354 | tcatgctggcagtggtgcatctga | W49037 | 46958 | atagctcaggcctacacaactatta | AA039136 | 89562 | gacaaacttcaaacattcctggtgc | U79550 |
| 4355 | tgcatctgaagagtccctccacct | W49037 | 46959 | gctcaggcctacacaaactattaact | AA039136 | 89563 | cttcaacattcctggtgcgtgtcc | U79550 |
| 4356 | tgaagagtccctccacctttgcag | W49037 | 46960 | actattaactacgcgagacgatg | AA039136 | 89564 | caaacattcctggtgcgtgtgcccat | U79550 |
| 4357 | tccacctttgcagcaacccgcgaag | W49037 | 46961 | tgagccacacagctcgaaggta | AA039136 | 89565 | ttctctgcggaatcacacatggcggc | AA110046 |
| 4358 | ttgggctagtiggctgctgactgat | W49037 | 46962 | gccacacagtcgaaggctaaaa | AA039136 | 89566 | gcggaatcacacatggcggctgggac | AA110046 |
| 4359 | ggctagttggctgctgactgatcct | W49037 | 46963 | aacgcagcagcaacctgggaaagg | AA039136 | 89567 | ctcaatcggctgctcagtaaagcgg | AA110046 |
| 4360 | ttggctgctgactgatcctcatccc | W49037 | 46964 | gcagcagcaacctgggaaagagctg | AA039136 | 89568 | tcaatcggctgctcagtaaagcggg | AA110046 |
| 4361 | tcatcctgcatggcgcgctgttac | W49037 | 46965 | ccagagcagtctaccatgtctctcc | AA039136 | 89569 | caatcggctgctcagtaaagcgggg | AA110046 |
| 4362 | gtgggtactggctgcagaaggttat | W49037 | 46966 | ggacagtctaccatgtctctccctg | AA039136 | 89570 | aatcggctgctcagtaaagcggggg | AA110046 |
| 4363 | ctgcatggccgctgtacctatcc | W49037 | 46967 | attgacacctcaggtggaccctg | AA039136 | 89571 | tagagcaatgcaatgccatttt | AA110046 |
| 4364 | aggttatccagctcggcgctgactgaa | W49037 | 46968 | gacctcatgtcgcagactgtag | AA039136 | 89572 | aggaaatactccaaggcagctcac | AA110046 |
| 4365 | aagggaattctgccctgtcgaga | W49037 | 46969 | atgtgtgccagatgtagctgctg | AA039136 | 89573 | ggaaatactccaaggcagctcaca | AA110046 |
| 4366 | attcttgccctgtcgagaatcttg | W49037 | 46970 | tcgtgcagagtcgtagctgctgca | AA039136 | 89574 | gaaatactccaaggcagctcacag | AA110046 |
| 4367 | gccctgtcgagaatcttgaacct | W49037 | 46971 | tgcagagtcgtagctgctggcacca | AA039136 | 89575 | cggaatccaccatgcgggctgggacc | AA110046 |
| 4368 | cttgaacctccatgcagcagaatgg | W49037 | 46972 | gtagctgtggccaccagagatgg | AA039136 | 89576 | gaatcaccatgcggctgggaacct | AA110046 |
| 4369 | tgcaagctacccatggccttccagg | W49037 | 46973 | gctgctggcaccagagagatggcag | AA039136 | 89577 | aatcaccatgggggctgggaccctg | AA110046 |
| 4370 | aagctaccccatggcctccaggcct | W49037 | 46974 | atggcagtcatagtcagtcagcc | AA039136 | 89578 | caaggctcaatcgctgctcagtaa | AA110046 |
| 4371 | ttatttgttgccttcctgtccaag | W49037 | 46975 | ccccgtcgtcagaggtgctgcagaga | AA024005 | 89579 | aaggctcaatcggctgctcagtaaa | AA110046 |
| 4372 | attuggtgcctccctgtccaagct | M13945 | 46976 | ccccggtcagagtgctgcagaga | AA024005 | 89580 | aggctcaatcgctgctcagtaaag | AA110046 |
| 4373 | tgttgcccccgtttatttgtcatg | M13945 | 46977 | gttgcagtcagaggagccggaagaa | AA024005 | 89581 | gctcaatcggctgctcagtaaagc | AA110046 |
| 4374 | tgcccccggttatttgtcatgt | M13945 | 46978 | tgcagtcagaggagccggaagaag | AA024005 | 89582 | gtcaatcggctgctcagtaaagcg | AA110046 |
| 4375 | agtgggtcctaggggtctgctgactgt | M13945 | 46979 | gaaggaggacccagagctgacaag | AA024005 | 89583 | tgcatagcaagctgctgtgatcca | AA110046 |
| 4376 | gtctagggtctgctgactgactata | M13945 | 46980 | aagcagaccaggaaggtgacaagc | AA024005 | 89584 | atgtgaagccatccaatgcctcat | D87115 |
| 4377 | ctagggtctgctgactgactataa | M13945 | 46981 | cagaccagaaggtgtcaagctcc | AA024005 | 89585 | cagcggaccagtctccccgagt | D87115 |
| 4378 | ggtctgctgactgtactataagacag | M13945 | 46982 | aagcgctgacaagctccacagagc | AA024005 | 89586 | tgtgacttcactagccagtgcct | D87115 |
| 4379 | gctgctgactgactgtactaagacagt | M13945 | 46983 | ggctgacaagctccacgagagcac | AA024005 | 89587 | acttcactacaagcctaaggaa | D87115 |
| 4380 | ggatcctctcggggctgtgtttg | M13945 | 46984 | tgacaagctccagggagcacgag | AA024005 | 89588 | taaggaagaaccccgcagagagcgat | D87115 |
| 4381 | ctctgggctgtgtgttgagcagg | M13945 | 46985 | dacaagctccagggagcagcacgaga | AA024005 | 89589 | agaacccgagagcgatgagcta | D87115 |
| 4382 | tttgagcaggtgctgccccgctggt | M13945 | 46986 | gctccagaggctgcagagcctg | AA024005 | 89590 | tgagctcgagctgatgagaaca | D87115 |
| 4383 | tttggtgcctcctgtccaagt | M13945 | 46987 | ccgggtcagtgctgcagaagcc | AA024005 | 89591 | tggaaccaccatcctcacctgca | D87115 |
| 4384 | tggttgcctcctgtccaagttcc | M13945 | 46988 | ctccacgggagcacgagagcctg | AA024005 | 89592 | tcttcacttgcacaaaactaagaa | D87115 |
| 4385 | tgcctcctgtccaagttcactg | M13945 | 46989 | aaccaggcgcagccccaaggac | AA024005 | 89593 | agacagaccattgcccttgtgaa | D87115 |
| 4386 | cttcctgtccaagttcactgact | M13945 | 46990 | aacaggcgcagccccaaggacag | AA024005 | 89594 | gggtaccttttagagcacaatgga | D87115 |
| 4387 | tgtccaagttcactgactgtact | M13945 | 46991 | cagcgcccaaggacgatgacagga | AA024005 | 89595 | tcctcatcaacaaggaagggcatgt | D87115 |
| 4388 | gtccaagttcactgactgtactgc | M13945 | 46992 | gagcccccaaggacgacgacaggaaa | AA024005 | 89596 | caatgatgctggctgcaagccta | D87115 |
| 4389 | agcttcacctgactgttgccccgg | M13945 | 46993 | agccccaaggacgatgacagaaag | AA024005 | 89597 | actgcccaagcttacagcccctga | D87115 |
| 4390 | gcttcacctgactgttgccccggt | M13945 | 46994 | aaacggttgcagtcagaggagc | AA024005 | 89598 | acatgccccgagagatcaaccc | D87115 |
| 4391 | ccacaatcaaccatactttctac | W49072 | 46995 | aacgagttgcagtcagaggagcc | AA024005 | 89599 | agatggccattcgcgatctccctta | D87115 |
| 4392 | caatacaacccatatttctcaccaa | W49072 | 46996 | gcatccacgaaacccacctataacag | AA024005 | 89600 | tcccttatgctgtctgggggcacacc | D87115 |
| 4393 | tacaaatctccacacaactaatca | W49072 | 46997 | atccacgaaaccaccataacgca | X13297 | 89601 | atgagtcttgggggcaccgttcca | D87115 |
| 4394 | aaatctcacacaactaaatcaaca | W49072 | 46998 | tggatcaggcgcctccagtccttc | X13297 | 89602 | gcacaccgttccagccagctgaagca | D87115 |
| 4395 | caatcaacaactaaaatccaatc | W49072 | 46999 | gatcaggcctccagttcctcca | X13297 | 89603 | gagcggccaccatccaccaaggg | D87115 |
| 4396 | ctaatcaacaaatcccaatcct | W49072 | 47000 | tcagggcctccagttctttccaaa | X13297 | 89604 | catccatccaaggtgaacaaa | AA154742 |
| 4397 | aattccaatcctctgtataact | W49072 | 47001 | cgcctcagttccttccaaatcat | X13297 | 89605 | gaaatcggccaagtccaagacata | AA154742 |
| 4398 | ctcttgctataacttctacacaat | W49072 | 47002 | tccagttcctttccaaatcattcct | X13297 | 89606 | atcggccaagtcccaagacatactt | AA154742 |
| 4399 | ttgctataaccttctacacaattac | W49072 | 47003 | tccttccaaatcattcctgcccaa | X13297 | 89607 | caaagacatattctgtgaagaa | AA154742 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4400 | taaccttctacacaattacacacatta | W49072 | 47004 | ctttccaaatcattcctgcccaaag | X13297 | 89608 | agacatactttctgctgaagaagta | AA154742 |
| 4401 | cctctacacaattacacattactc | W49072 | 47005 | tgcccaaagcttgatttgttactc | X13297 | 89609 | gtggtctcagtctctgaaaaactc | AA154742 |
| 4402 | cacacaacaattcaaaaccttca | W49072 | 47006 | tcagacatgtctaccttaactg | X13297 | 89610 | gtctcagtctctgaaaaactcctt | AA154742 |
| 4403 | catacttctccaccaaacacattat | W49072 | 47007 | agacatgtctaccttaactgta | X13297 | 89611 | tctgaaaactcctgccaaccag | AA154742 |
| 4404 | actttctcaccaaacacattalcct | W49072 | 47008 | gtccaccgtaaatgtlctaagtcc | X13297 | 89612 | cctgccaaccagacagtcaaaat | AA154742 |
| 4405 | ttctcaccaaacacattatcctaca | W49072 | 47009 | ctgctcgcctctagcacacaactg | X13297 | 89613 | tgccaaccagacagtcaaaatgc | AA154742 |
| 4406 | ceaaacattalcctatcatcacaa | W49072 | 47010 | gctctgcctctagcacacaactgtg | X13297 | 89614 | caaccagacagtcaaaatgtctt | AA154742 |
| 4407 | aacacattatcctacatcacaaact | W49072 | 47011 | tctagcacaacadtgtgaacgttt | X13297 | 89615 | gttcttttctgctagccaaaggat | AA154742 |
| 4408 | acattatcctacatcacaaatct | W49072 | 47012 | gcacacaacadtgtgaacgttttgtg | X13297 | 89616 | tctgtctagccaaaggattcgaaa | AA154742 |
| 4409 | tacatcacaaactttctaccalca | W49072 | 47013 | aactgtgaacgttttgtggatcagc | X13297 | 89617 | cagccattcctctagacgacaaa | AA154742 |
| 4410 | atcacaaaactttctaccatacaat | W49072 | 47014 | ttttggatcagcgcctccagttcc | X13297 | 89618 | ttctctagacgacaaaaagcag | AA154742 |
| 4411 | agatcttgaatctcagggtcgaact | W49072 | 47015 | tgtggatcagcgcctccagttcct | X13297 | 89619 | aacatactgagatcgatgatccca | AA154742 |
| 4412 | tctgaatctcagggtcgaactctc | W49072 | 47016 | taccatccactgatcacacaga | X13297 | 89620 | gagatcgatgatcccacactcggaa | AA154742 |
| 4413 | tcaaatctgcgcagagtgaagtgg | M59821 | 47017 | acctcaacctagaccacactgcaatg | AA024009 | 89621 | acatctgaatctgggatgaaatcg | D30785 |
| 4414 | cccggacttgtcaaactagatgat | M59821 | 47018 | ccgagctgctcacaggtcgcagca | AA024009 | 89622 | tacaacaacagcaaccagaagatc | D30785 |
| 4415 | caacctagatgatcgcctgctggcgtgg | M59821 | 47019 | cagagctcacagtgcgcagcatc | AA024009 | 89623 | aaccaagaatcacagtccagata | D30785 |
| 4416 | cctagatgatcgcctgctggacc | M59821 | 47020 | ccgagccatacgaacacctgtgg | AA024009 | 89624 | aacaccctcaactgtcggaagtga | D30785 |
| 4417 | ccgctggtcgtagttgctgcgtag | M59821 | 47021 | cagcccatagagaatctgtgcagt | AA024009 | 89625 | tatccagaacaagtgtagagag | D30785 |
| 4418 | gttgctcgtagacacagctctct | M59821 | 47022 | tagaagctgatccactagatgg | AA024009 | 89626 | ggcatggtctgtcggcagcagca | D30785 |
| 4419 | ggtgcgtagacacagctctctcgg | M59821 | 47023 | agctcgatccactagatggcgac | AA024009 | 89627 | gctgcagtgccaggtgctgactcag | D30785 |
| 4420 | gcgtagacacagctctctcgggca | M59821 | 47024 | ctctgatccactagatgggact | AA024009 | 89628 | caggatcacctcatgggctcag | D30785 |
| 4421 | actaccggagtttacaatgtcag | M59821 | 47025 | ctgatccactagatgggactgt | AA024009 | 89629 | atcacctcagggctcagaccct | D30785 |
| 4422 | tttacaatgtcagctaggaaaataa | M59821 | 47026 | gatccactagatgggactgtct | AA024009 | 89630 | tcatgggctcagaccctgcggaa | D30785 |
| 4423 | tcgaactctctaggggccaggctgc | M59821 | 47027 | atgccgacagcagctcgtgac | AA024009 | 89631 | cctggctacaccaaaatctgcc | D30785 |
| 4424 | tcgccctcacagtccgcagctt | M59821 | 47028 | ctcaactagccaccctgccatgtg | AA024009 | 89632 | accaaatctgccgtactacacct | D30785 |
| 4425 | gccccctacagtgggcacctgtg | M59821 | 47029 | acctagaccacctgccaatgtggga | AA024009 | 89633 | accatgacaacagggactgatct | D30785 |
| 4426 | agtgggcacgctgtcaagcggtc | M59821 | 47030 | ctagaccacctgccaatgtgggatg | AA024009 | 89634 | gaagtcacagtcacgatalaatgc | D30785 |
| 4427 | ggtgtggcaagcggtcagagtgcg | M59821 | 47031 | agaccacctgccaatgtggaatgaa | AA024009 | 89635 | tcaataaacaccaattgttggcc | D30785 |
| 4428 | ggtcagagttgctcatggagacaga | M59821 | 47032 | accacctgccaatgtgggatgaact | AA024009 | 89636 | cgactgcagaactcagcaaacctg | D30785 |
| 4429 | gtcatgagagacgcggggtgtlc | M59821 | 47033 | ctacgtgcagagctcgcgagcgtgct | AA024009 | 89637 | cagaactcagcaaacctggggaca | D30785 |
| 4430 | cctgactgaaccaatcaaatctgc | M59821 | 47034 | acgtgcagagctcgcgagcgtctca | AA024009 | 89638 | tcagcaaacctcggggacaaggtga | D30785 |
| 4431 | acctcccaaaatcaatgtgtgac | AA067362 | 47035 | agctctggggtttggtctgctgcc | AA024009 | 89639 | aagcggtccaacgccaatctga | D30785 |
| 4432 | tgtggtgacgtgaactgggaaaag | AA067362 | 47036 | agctctcggggtttggtctgctgct | AA024009 | 89640 | gtccaggtccaatctgtgccca | D30785 |
| 4433 | gttcctgactgcattgctgccct | AA067362 | 47037 | ggtttggtctgctctctggacaa | X14971 | 89641 | tgtcccaaagttggccagaagtgca | D30785 |
| 4434 | gtactgcattgctgccctctgtc | AA067362 | 47038 | tgcccagcagttctgagccctgga | X14971 | 89642 | actgcaccagcctcaagagaact | D30785 |
| 4435 | cattgctgccctcttgctctatgt | AA067362 | 47039 | agcagttctgagccctggacttgcc | X14971 | 89643 | caggccaactgccacgccgcggag | AA154337 |
| 4436 | tgccctctgctcatgttggttac | AA067362 | 47040 | tctgagccctggacttgcccgtgta | X14971 | 89644 | gccgttcctggactgtacgaaaacag | AA154337 |
| 4437 | ccttctgctctatgttggttacacg | AA067362 | 47041 | gagcctggacttgcctggtlat | X14971 | 89645 | altcatttgacagtccattgagt | AA154337 |
| 4438 | cctctaccggatagtgcaaactg | AA067362 | 47042 | ccctgactgcctgccctgtatggc | X14971 | 89646 | ttcatttgacagtccattgagtt | AA154337 |
| 4439 | tagtatgcaaactgcccatgatc | AA067362 | 47043 | ccagttgccagcgagccgggaga | X14971 | 89647 | tcatttgacagtccattgagttg | AA154337 |
| 4440 | caaactgcccatgatcgcgaact | AA067362 | 47044 | cctcagtgcggcagccaaaagagc | X14971 | 89648 | catttgacagtccattgagttgc | AA154337 |
| 4441 | gcccatgcccatgactttat | AA067362 | 47045 | gtcactcgtcgtgttacattcc | X14971 | 89649 | atttgacagtccattgagttg | AA154337 |
| 4442 | gccatgatgacttatttgtact | AA067362 | 47046 | ctgctgctgtttacattcaatttaagggg | X14971 | 89650 | atttgacagtccattgagttgg | AA154337 |
| 4443 | gcatgtccatagttgattactcc | AA067362 | 47047 | tccaggggccgtgtatattgtgag | X14971 | 89651 | tttgacagtccattgagttgc | AA154337 |
| 4444 | tgtcctataggtgttactccct | AA067362 | 47048 | actttggggtctggaatcatcca | X14971 | 89652 | ttgacagtccattgagtttggt | AA154337 |
| 4445 | tgattactcctcttctgccacagtc | AA067362 | 47049 | gaatcatcgacgaaggccctgca | X14971 | 89653 | ttgacagtccattgagttggct | AA154337 |
| 4446 | ctctctcgcagtctacgttc | AA067362 | 47050 | ccaatgccaccagcccaaatgtaccg | X14971 | 89654 | tgacagtccattgagttggctc | AA154337 |
| 4447 | ctacgttacgttcagtcttgtg | AA067362 | 47051 | cctcgcaccacaagaagagccgt | X14971 | 89655 | gacagtccattgagttggctica | AA154337 |
| 4448 | tacgttgcagtcttgtccg | AA067362 | 47052 | tgcgcaccagagactgctgcct | X14971 | 89656 | gtgtccggtatcgaaaacaggga | AA154337 |
| 4449 | gttgcagtctttgtccgtac | AA067362 | 47053 | aagagcctgtcccgtcactgtg | X14971 | 89657 | tgtccggtatcgaaacaggac | AA154337 |

| SEQ ID NO | sequence | DBAxnID | SEQ ID NO | sequence | DBAxnID | SEQ ID NO | sequence | DBAxnID |
|---|---|---|---|---|---|---|---|---|
| 4450 | tgtgttcctgtactgcattgctgcc | AA067362 | 47054 | gtcactgtgtgagctgctggccca | X14971 | 89658 | gtcctcggtatcgcgaaaacaggcact | AA154337 |
| 4451 | gtcgagattgccattgccataagg | J02935 | 47055 | agctgctggccagccagttctgagc | X14971 | 89659 | tcctcggtatcgaaaacaggcactt | AA154337 |
| 4452 | attgcccattgccataagggcagt | J02935 | 47056 | aaagcaaagcatccgatggaacacag | X14971 | 89660 | ggacatctacgacaaatatggcaaa | AA154337 |
| 4453 | atctgagccttcctcagtgtata | J02935 | 47057 | gaagttgaccccgaatcctgcaaatt | X14971 | 89661 | gaccctctagcacaaatatggcaaag | AA154337 |
| 4454 | accttccagtcagcccacagaaccac | J02935 | 47058 | acgcgtctccaaggactatgtgaat | X14971 | 89662 | acatctacgacaaatatgccaaga | AA154337 |
| 4455 | gacagaaccgctctgctgctgtct | J02935 | 47059 | cagttctagtccgcagaccagaaga | X14971 | 89663 | aattcatttgacgtccattgag | AA154337 |
| 4456 | ttgcttcgaacgccgtcattagac | J02935 | 47060 | tagtccgagaccagagatcagc | X14971 | 89664 | acactgccaattcatcatggggc | AA110098 |
| 4457 | ctgaacgccgtcattagaccactta | J02935 | 47061 | atcaggctcttgttgtcgcgctc | X14971 | 89665 | gccaattcatcatgggagcactgat | AA110098 |
| 4458 | attagaccaactatgtcatgagtac | J02935 | 47062 | tcgttgctttgtaccacactga | X14971 | 89666 | agtgaatgtcccgcaagtgtcctc | AA110098 |
| 4459 | atgtcatgagtactccaacccaggt | J02935 | 47063 | gtctttgtaccacactgcagataaa | X14971 | 89667 | gaatgtcccgcaagtgtcctccatg | AA110098 |
| 4460 | tgagtactccaaccaggttcaca | J02935 | 47064 | ataccacctgcagataaaacaccccc | X14971 | 89668 | tgcccgcaagtgtcctccatgcag | AA110098 |
| 4461 | ttcagaatgtctccagcaatta | J02935 | 47065 | acacccttgctgaaaactgccat | X14971 | 89669 | gcaagtgtcctcatgcagatggga | AA110098 |
| 4462 | atgtctccagcaatttaagtgcc | J02935 | 47066 | tgaaaactgccattcacggcgacctc | X14971 | 89670 | agtgtcctccatgcagatgggagcg | AA110098 |
| 4463 | tactctcggagaactgccctgctca | J02935 | 47067 | aaatcagggcagtcctgtggttcaa | X14971 | 89671 | aggactgatagcctgctggcagt | AA110098 |
| 4464 | aaaccccaggctgcttccgcttacg | J02935 | 47068 | gaccgaatctgcaaatttcgtgg | X14971 | 89672 | actgatagcctgctgtggcagtgac | AA110098 |
| 4465 | aggctctcggcccctgcaggaca | J02935 | 47069 | ttcgtggtcgtcggcataaatacaca | X14971 | 89673 | ggatagcctgctgcagtgacctt | AA110098 |
| 4466 | aagaggaactcacattacgaag | J02935 | 47070 | ggctcgtgttgcctggaacca | X14971 | 89674 | tagcctgcttggcagtgacctgc | AA110098 |
| 4467 | ttttggctcaactggatctgatgg | J02935 | 47071 | cgcctggagccaaacctgcaagctc | X14971 | 89675 | cttcatcccgtcatcagtgcctcg | AA110098 |
| 4468 | tccaacttgatctgatggaccccg | J02935 | 47072 | gagccaaacctgcaagctcagatgt | X14971 | 89676 | aattcatcatgggagcactgatgca | AA110098 |
| 4469 | ttggatctgatgaccccggccaagt | J02935 | 47073 | aacctgccaagctcagatgtatagac | X14971 | 89677 | tcgagggatagcccccggttggcacc | AA110098 |
| 4470 | ctgatgaccccggccagtagatgt | J02935 | 47074 | ctcacctgccagcaaagaca | X14971 | 89678 | tgatagcccgttggccaccacact | AA110098 |
| 4471 | ggccatgccaaatgcagccatgaag | J02935 | 47075 | tgcgtaccagcaaagacaccgtct | X14971 | 89679 | cactacaaccaacctggagcagcct | AA110098 |
| 4472 | caatgccaaatgcagccatgaagaa | W49091 | 47076 | gatctctcgatcaagctctcgagag | AA024092 | 89680 | tacaaccaacctggagcagcctcag | AA110098 |
| 4473 | atactagacgtatacatagtcttc | W49091 | 47077 | tccttgatcaagctctcgagagt | AA024092 | 89681 | caacctggagcagcctcaggtcatt | AA110098 |
| 4474 | gcagttgagcacctactctctcgt | W49091 | 47078 | ctcgagctcgaggtgcgcagtgctc | AA024092 | 89682 | tgaccttcggggatcttttgaat | AA110098 |
| 4475 | agtttgagcacctactctctcgtag | W49091 | 47079 | cgatcgagtcgcgcagtgcttcag | AA024092 | 89683 | cccaggtgaatgtcccgcaagtgtcc | AA110098 |
| 4476 | tgagcacctactctctcgtagactc | W49091 | 47080 | atcgagtcgtcgcagtgcttcagcg | AA024092 | 89684 | tccttcaaggtacgagccagtccaa | AA110098 |
| 4477 | ctctgtagactctgttggaaatac | W49091 | 47081 | ccagtcgtcgcagtgcttcagcgt | AA024092 | 89685 | caacagtccaaaatgtacagaca | AA110098 |
| 4478 | ctcgtagactctgttggaaatacaa | W49091 | 47082 | cggatactccgctcgctgcccc | AA024092 | 89686 | gcttagtgcaagccctgttgccccc | AA110098 |
| 4479 | gtagaacattctcatgtcgattc | W49091 | 47083 | cgctgctcagccgcgcgatcgtagagg | AA024092 | 89687 | tagtgcaagccctggttgcccaga | AA110098 |
| 4480 | agaacattctcatgtcgattctg | W49091 | 47084 | gctcagccgcgatcgtagagggcta | AA024092 | 89688 | tggttgcccagaaccaagtgat | U69488 |
| 4481 | aacattctcatgttcgatttctggg | W49091 | 47085 | tcagccgcgatcgtagagggctacg | AA024092 | 89689 | cccagaaccaagtatgttatg | U69488 |
| 4482 | catttctcatgttcgattctgggaa | W49091 | 47086 | agcccgatcgtagagggctacgcg | AA024092 | 89690 | tgttatgtaccctgacctaagtt | U69488 |
| 4483 | attatattgccagatacacactcg | W49091 | 47087 | agatgacgttggccaccagctt | AA024092 | 89691 | tactttcggttggataaagatg | U69488 |
| 4484 | tatattgccagatacacactgtc | W49091 | 47088 | cttcgatcaagctctcgagaggta | AA024092 | 89692 | agtcgatagctgggcaggagagaacc | U69488 |
| 4485 | tattgccagatacacactgtctt | W49091 | 47089 | cttgccacacgtctcgagctgat | AA024092 | 89693 | ttaagagcagcccagatggaaacat | U69488 |
| 4486 | gccaggaacacgtcgtctggtg | W49091 | 47090 | tcaagctcgagaggtgatccgtg | AA024092 | 89694 | atctgcccagctcttgctgatta | U69488 |
| 4487 | cagagaacacgtcgtctggtgca | W49091 | 47091 | gctccgagaggtgatcctgcgagt | AA024092 | 89695 | gctcttgctgattaaggctgtt | U69488 |
| 4488 | gacacacgtcgtctggtgcaacaa | W49091 | 47092 | ggtgatccgtgttgctcgatcgagt | AA024092 | 89696 | cctcactatgaacaacaacatcct | U69488 |
| 4489 | cacgtcgtctggtgcaacaatact | W49091 | 47093 | atccgtgttgctcgatcgagtcgtc | AA024092 | 89697 | cactatgaaccacaacaatccggt | U69488 |
| 4490 | cgtcgtctggtgcaacaatact | W49091 | 47094 | ccgtgtttgctcgatcgagtcgtgc | AA024092 | 89698 | gaaccaaacctcggttcggtaaat | U69488 |
| 4491 | atcatctaggggcttgctcaaaca | M25811 | 47095 | gtgtttgctcgatcgagtcgtgcag | AA024092 | 89699 | aagagagccgcgtcttgttgtg | U69488 |
| 4492 | ctttgctaaacagcatatgaaatc | M25811 | 47096 | gttgctcgatcgagtcgcgcagtg | AA024092 | 89700 | tatattgagcttggtcgttatgc | U69488 |
| 4493 | cccacatccactagagatgaaaaa | M25811 | 47097 | gatgagtcatcccattatggtcgca | U08215 | 89701 | cttggtctgtatgcttggaatg | U69488 |
| 4494 | ccattctcagttctcattgaacgc | M25811 | 47098 | gaggtcatcccattatggtcgcca | U08215 | 89702 | tggtcgttgtatgcttggaatgtt | U69488 |
| 4495 | tcagttctattgaacggcacatgt | M25811 | 47099 | ggatcttacaggtgacgtgcacag | U08215 | 89703 | aatgcttaggcaagcccgttggtgc | U69488 |
| 4496 | cctattgaacggacatgtggaact | M25811 | 47100 | gtgacgtgacagaccaagaaccg | U08215 | 89704 | gtgaaggtctgtcaggctctgatta | AA110113 |
| 4497 | atacttatgtcgacatcaactct | M25811 | 47101 | tgcacagacaagacacgccaagt | U08215 | 89705 | gtccaggcctctcagatccactcg | AA110113 |
| 4498 | tatgctgacatcaactctttgatgt | M25811 | 47102 | tgcacattactgtgagtgcat | U08215 | 89706 | actcaggctctgatctcggaccgctc | AA110113 |
| 4499 | gacatcaactctttgatgtctt | M25811 | 47103 | gaggtcatcctcgactcctcagat | U08215 | 89707 | gcgacatatctcgacggccttgca | AA110113 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4500 | aacttctttgtagttgtctgctaga | M25811 | 47104 | tcctgactcttcagataaaccaaga | U08215 | 89708 | acatatctcgacggctcagcaaca | AA110113 |
| 4501 | atgtgtcttgctcagaaggatttta | M25811 | 47105 | tgactcttcagataaaccaagatgg | U08215 | 89709 | tctcggacggctcagcaacaactga | AA110113 |
| 4502 | ttttgcgagtgcatcatgctgaatgga | M25811 | 47106 | ataatatcaacataaatttgtttg | U08215 | 89710 | ctcggaggctcagcaacaactga | AA110113 |
| 4503 | gtcattctaatctctggagatga | M25811 | 47107 | taataaactgcttttcaatgaagg | U08215 | 89711 | ctacgcattattcagcttattcaa | AA110113 |
| 4504 | tctaatctctgggatgatgactctc | M25811 | 47108 | taaactgcttttcaatgaaggtat | U08215 | 89712 | atttcagcttattcagtcatcgt | AA110113 |
| 4505 | gagatgactctcaatccagggtgc | M25811 | 47109 | gtcatcctattgggtcagccatag | U08215 | 89713 | cagcttattcaagtcatcgctggcc | AA110113 |
| 4506 | actcttcaatccaggggccatcag | M25811 | 47110 | ttcacagtacgttcctcctcggga | U08215 | 89714 | aacagacattttccagctgttctgc | AA110113 |
| 4507 | ccatcagtaatcatgccactgtca | M25811 | 47111 | cgaagacgcacacactgcaggccc | U08215 | 89715 | acagacattttccagctgttctga | AA110113 |
| 4508 | gtaalcatgccactgttcacgagtg | M25811 | 47112 | ctgaactctatgagtctgagggga | U08215 | 89716 | ctcaggctgtcagatcactgcg | AA110113 |
| 4509 | atgcactgttcacgagtgtgtta | M25811 | 47113 | gaacttcatatggtctgaggggaaga | U08215 | 89717 | tcaggctctgtcagatcactgcga | AA110113 |
| 4510 | atgactagcctcagtccctctaga | M25811 | 47114 | caggttgtactcaggacttagata | U08215 | 89718 | tctgtcagatcactcggcacatat | AA110113 |
| 4511 | tggcctctgcattggctccataat | W49135 | 47115 | atattagcgttcttactatgaaaa | U08215 | 89719 | tctgtcagatcactcggcacatat | AA110113 |
| 4512 | cctcttgcattggctccataatgat | W49135 | 47116 | ttagctgttctacttatgaaaagg | U08215 | 89720 | gtcatcactcggacatatctcg | AA110113 |
| 4513 | gagtacacgcattcaacacatgac | W49135 | 47117 | cttttccacgcctctctcaatg | U08215 | 89721 | cagatcactcggacatatctcgga | AA110113 |
| 4514 | ttcaacacatgacgatgagatta | W49135 | 47118 | ttcaatgacatcgtccaggccatcc | X54424 | 89722 | agatcactcggcgacatatctcggac | AA110113 |
| 4515 | taatgtgaatccaagccacaaagg | W49135 | 47119 | acagggccatcacacaagtcatta | X54424 | 89723 | tcactcgcgacatatctcggacgc | AA110113 |
| 4516 | gaatcacagccacaaaaggacgaat | W49135 | 47120 | accatcaacaacatcattaaagtc | X54424 | 89724 | gcatccggccccacacagctgg | AA110113 |
| 4517 | gacgaatctgagcctaatgatgt | W49135 | 47121 | aaagttctgaatccacagaagcaac | X54424 | 89725 | ggccacacagcgggtcattccca | AA110117 |
| 4518 | gaatctgagcctaatgatttgtgat | W49135 | 47122 | ctgaatccacagaagcaacagctgc | X54424 | 89726 | ttgatcaagtcaccatactactcta | AA110117 |
| 4519 | tctgagcctaatgatgtgatcct | W49135 | 47123 | cggatcaagctcacatataatcaca | X54424 | 89727 | atcactccatactcatatctcataa | AA110117 |
| 4520 | taatgatgttcgttggctcaagaa | W49135 | 47124 | aagctcacatataatcacaaggct | X54424 | 89728 | tcaccatactatctcataagtcag | AA110117 |
| 4521 | tgttcgttggctcaagaagctct | W49135 | 47125 | aatcacaaaggctcggcaatgcaag | X54424 | 89729 | ccatactatctcataatgtcagtga | AA110117 |
| 4522 | agaagctctcaggcatcttaggag | W49135 | 47126 | tgcagcaccatctcattcttacc | X54424 | 89730 | tactatctcataatgtcagtgagctcac | AA110117 |
| 4523 | gcatttggctccataatgatagtgct | W49135 | 47127 | ctatcccactcaatcaaaggaatt | X54424 | 89731 | tatctcataatgtcagtgagctcac | AA110117 |
| 4524 | ttggctccataatgatagtgctgca | W49135 | 47128 | taccagtccgcagaagagctgagag | X54424 | 89732 | agctcactgcagaaatgcacagat | AA110117 |
| 4525 | catcaatctgttccatagatctaa | W49135 | 47129 | ccctcatcacagcacagagctaaga | X54424 | 89733 | tcactgcagaaatgcacaggatat | AA110117 |
| 4526 | ttcgttccatgatctcaaccgcgt | W49135 | 47130 | gcctcaacagcacagagctagaca | X54424 | 89734 | gatataaacagcaggtggttctc | AA110117 |
| 4527 | tgttccatgatctcaaacgcgtagt | W49135 | 47131 | gcagtaccaaagacattccagctgc | X54424 | 89735 | aaccaggcaggggttcttcgacag | AA110117 |
| 4528 | tcccatgatctaaacgctagtcag | W49135 | 47132 | ccaaagacattccagctgcagttc | X54424 | 89736 | ctttcaaccctgcttccagg | AA110117 |
| 4529 | ctaaacgctagtcagcaacggagt | W49135 | 47133 | acatccagctgcagttctgctc | X54424 | 89737 | ggttctcgacagatacctactgc | AA110117 |
| 4530 | aacgcgtagtcagcaacggagtaca | W49135 | 47134 | cctagcagcagcgtgtcccagcct | X54424 | 89738 | tgagtcaacctgcttctcagggac | AA110117 |
| 4531 | tagtcaacttctcagtggtgt | L11332 | 47135 | agcagcgtgcccagcctttaata | X54424 | 89739 | tcctctgtgggaagaagtggcccc | AA110117 |
| 4532 | aactttctcagtggtgctctgta | L11332 | 47136 | ccagcttaatacaggagcatca | X54424 | 89740 | tgatgctgtggcatcaaact | AA110117 |
| 4533 | aatggccatcaaactcccattagaag | L11332 | 47137 | gagcagcgtacaagccctcagg | X54424 | 89741 | agatgtcatatagactgcttgatca | AA110117 |
| 4534 | caatcaaactcccattagacaaag | L11332 | 47138 | gcgctaacagccctcaggcagtt | X14206 | 89742 | tgtccatatagactgcttgatca | AA110117 |
| 4535 | ttcattctccacagatattcaca | L11332 | 47139 | ctactgccacactcaggggagac | X14206 | 89743 | ccatatagactgcttgatcacgt | AA110117 |
| 4536 | cttcccacagatattcacatggtaa | L11332 | 47140 | atctcaggagaccgattgctta | X14206 | 89744 | tgcttgatcacgtcaccatactac | AA110117 |
| 4537 | atcacatgtaaacctcacatggtcat | L11332 | 47141 | atctgctgcaacgacacatgccctg | X14206 | 89745 | cttgatcacgtcaccatactactac | AA110117 |
| 4538 | cccacgtgccctgcctttaatctt | L11332 | 47142 | tgtcaacgacactgccctgctgat | X14206 | 89746 | cttctgcagcttttggaaacaggt | AA110117 |
| 4539 | tgccctgctttaatcttaactc | L11332 | 47143 | cgacactgccctgctgtataatgag | X14206 | 89747 | aacaggtgtccgtcgctgctgagg | AA110117 |
| 4540 | ttaactcaacagctccgtgataact | L11332 | 47144 | gtacactgtcgcacatttgcag | X14206 | 89748 | atgttgaacggttgtaccagtgcc | AA110117 |
| 4541 | caacagtccgtgataacttgagc | L11332 | 47145 | tgtcatgacatttgcagttgat | X14206 | 89749 | gtggttctatttatgtgacctg | U79738 |
| 4542 | gtccctgataactttgagcattctt | L11332 | 47146 | tctcaaaatcctgcgaaactcaag | X14206 | 89750 | ttatgtgaccgttctctcctggac | U79738 |
| 4543 | ctctcctcaatgagctgagaatc | L11332 | 47147 | ataacctgctgaaactcaagtcaat | X14206 | 89751 | tgtgaccctgttcctctgaccaa | U79738 |
| 4544 | gagaatcccacctgagaactttcat | L11332 | 47148 | ttttaagacatcctcggtaatg | X14206 | 89752 | gttcctcctgaccaatctccctgt | U79738 |
| 4545 | ccaactcgagaacttcatacatgg | L11332 | 47149 | caagcctcaggcagcttcacac | X14206 | 89753 | ccaatcctcggtgtgcaagcga | U79738 |
| 4546 | ctttcatcaatgtgtgataagccta | L11332 | 47150 | caccgtgcgtgtgtatgaattc | X14206 | 89754 | atctcccgtgttgcaagtcgaaag | U79738 |
| 4547 | aagcctataccactgcagctaaat | L11332 | 47151 | ctcaggcagcttcacaaccgagg | X14206 | 89755 | ccagcctcatttctgttcct | U79738 |
| 4548 | atatacactgcagctaaatcctag | L11332 | 47152 | tgtctttctttactgaccagtc | X14206 | 89756 | tcaaccactgcagcgctgtgggac | U79738 |
| 4549 | gctaaatcctgccacagctgataa | L11332 | 47153 | caggacaccaacttgctgataa | X14206 | 89757 | agttgtccgtctgtcgcagatt | U79738 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4550 | tcctcagcacagctgataacatcat | L11332 | 47154 | caccaacttgctgcatcctgtcg | X14206 | 89758 | ttgtccgtctgctgcaggattcaa | U79738 |
| 4551 | acctcaagctctggggtatcgaccg | M20473 | 47155 | gacaggctacatgttggaaaggg | X14206 | 89759 | gttctgtgcaggattcaagtgagg | U79738 |
| 4552 | tcgaccgtgacagttactacaggcgcat | M20473 | 47156 | gatctacttgcgacatggtgtcc | X14206 | 89760 | aggcctagaactcagtgcttaggg | U79738 |
| 4553 | atgacttctacatcatccacagagg | M20473 | 47157 | tgcaaactgccaacacatccag | Z33637 | 89761 | cagtgcctaggggtaaggcgtca | U79738 |
| 4554 | tctacatcatcacagaggcactgc | M20473 | 47158 | cctcactctggttctgctccaag | Z33637 | 89762 | aaggctgcagttggaccggcggt | U79738 |
| 4555 | gcactgcttcagtcctccagcgag | M20473 | 47159 | ctctgggttctgctccaggaactct | Z33637 | 89763 | gctgtcagcttgacggctggtacc | U79738 |
| 4556 | cctcgactacttgggagggatgc | M20473 | 47160 | tcctggcattgttttgatccatcc | Z33637 | 89764 | gtcagctggacggctggataccagt | U79738 |
| 4557 | agattgcctgctgaatcggcc | M20473 | 47161 | ttttgatccatcccttgtccat | Z33637 | 89765 | caagactgctgactattgttgac | U79738 |
| 4558 | atcggccccgtgcagccactgtggt | M20473 | 47162 | tgtgtgaccagccaatgccctgtc | Z33637 | 89766 | tgacttagtcccagcgaaggctat | U79738 |
| 4559 | tagaccggcctgttttgagcgtgt | M20473 | 47163 | tagacagggcccaaagtgtgccctt | Z33637 | 89767 | tgtcccttatgaatcagatacaag | Z11997 |
| 4560 | gctctggatcctgaagaggaacat | M20473 | 47164 | agagtcctccgagccatgaagag | Z33637 | 89768 | ttagtaccaattgtccaatacatt | Z11997 |
| 4561 | tccaagctacaacagcttcatctc | M20473 | 47165 | cctcctgccaagaagaaatata | Z33637 | 89769 | ccattgtccaatacattgcttttt | Z11997 |
| 4562 | tcatctcctaactgtctgagcctg | M20473 | 47166 | tggactccagtttatagttgct | Z33637 | 89770 | ttttataagacccaaactcatcat | Z11997 |
| 4563 | gctacaggccatccatccatggaaag | M20473 | 47167 | atgagtaccctgccagcacagagg | Z33637 | 89771 | ataagacccaaactcatcattcattaat | Z11997 |
| 4564 | agttcctcagcaaagtctccatcct | M20473 | 47168 | tcccttcaatctaccacagctctgg | Z33637 | 89772 | tccatlcaattaatcaggtttaatct | Z11997 |
| 4565 | tcgcaaagttctcatcctagaatc | M20473 | 47169 | caatctaccccagtcctggtgccaa | Z33637 | 89773 | gattatcgttcttaaagtgccag | Z11997 |
| 4566 | aagtctccatcctagaatccctga | M20473 | 47170 | gttctgtccaagaatctgcctg | Z33637 | 89774 | taattttcacgcgttttgtgatgga | Z11997 |
| 4567 | tagaatccctggagaagtgggaacg | M20473 | 47171 | gttcaggcacgtgtctttactt | Z33637 | 89775 | tttcacgcgttttgtgatggagtg | Z11997 |
| 4568 | ctgtagctgatgccctggagcctgt | M20473 | 47172 | ttggaagtcccagctctgactcta | Z33637 | 89776 | tgaacatgagtctgatgatacta | Z11997 |
| 4569 | ctgatgcctgagcctgtgcagtt | M20473 | 47173 | gtcccagtcctgactctataccag | Z33637 | 89777 | ccttagtccagggaaggctatcac | Z11997 |
| 4570 | ccctgagccctgcagttgaaga | M20473 | 47174 | agtcctgactctataccagtattgc | Z33637 | 89778 | tcccagccgaggctatcacaagaac | Z11997 |
| 4571 | cggttttgcacattgggctttat | M20473 | 47175 | gactctataccagtatgctgagc | Z33637 | 89779 | tcacaagacgctgcgtaaagct | Z11997 |
| 4572 | ttttgcacattgggctttatatg | W49158 | 47176 | tcccttactgccagcagccagaatg | Z33637 | 89780 | caagaacgctggcgtaaagcttg | Z11997 |
| 4573 | ctttgcacgaggaaatttcaat | W49158 | 47177 | cccaaatcttcattgttttgat | Z33637 | 89781 | ctgtaaagcttgcccttctatcta | Z11997 |
| 4574 | gaaatttcaatggtcccctgcgg | W49158 | 47178 | tgccacttgcaccagaagaatt | Z33637 | 89782 | agcttgcccttctatctagatatg | Z11997 |
| 4575 | atttcaatgtgccctgtgggtc | W49158 | 47179 | ttgcaccccagaaaatttccaatgag | Z33637 | 89783 | tttgcccttctactctagatatgat | Z11997 |
| 4576 | tcaatgtgccctgtgggatcaag | W49158 | 47180 | ctactaaccagagctgaactaaggc | Z33637 | 89784 | tataactgtgtttgtccccttatga | Z11997 |
| 4577 | caatgtgccctgtgggatcaagc | W49158 | 47181 | ctaaccagagctgaactaaggctgc | Y00516 | 89785 | gagtcctgacactcattagcactg | Y00516 |
| 4578 | tgtgccctgtgggatcaagcc | W49158 | 47182 | gaactaaggctgctccatcaacact | Y00516 | 89786 | catgctccaacagacagaagatt | D49730 |
| 4579 | tgtcccctggggatcaagccgagag | W49158 | 47183 | ctgccacccactgtcatgtgaaga | Y00516 | 89787 | tcctagataactccagacataagat | D49730 |
| 4580 | gtccctggggatcaagccgagagt | W49158 | 47184 | cctaccccacttgctatgaagaggg | Y00516 | 89788 | ataactccagacataagatactcaa | D49730 |
| 4581 | ccctggggatcaagccgagagtct | W49158 | 47185 | ggtcttcaggctctttccccalcact | Y00516 | 89789 | ttctlcacatttccatccacacag | D49730 |
| 4582 | agaggtctaaatttctgagggaaga | W49158 | 47186 | cttcaggtcttttccccalcactctt | Y00516 | 89790 | cacacagcagggccagaacacagag | D49730 |
| 4583 | ttgacattgtgggctttatatgaa | W49158 | 47187 | atgtaaaatgccatccctttccag | Y00516 | 89791 | tctgagcctgtgtcgtccttca | D49730 |
| 4584 | cacattgtgggctttatatgaaaaa | W49158 | 47188 | cgggactgccaataaacaactattt | Y00516 | 89792 | gtctgttccttcatgaatgtatgat | D49730 |
| 4585 | aagccattggaaagccgagagat | W49158 | 47189 | cactgccaataaacaactattaag | Y00516 | 89793 | cctttgttctggctgtacaatg | D49730 |
| 4586 | agatctatgccaaagccgaagaga | M19960 | 47190 | caccccagaaatttccaatggag | Y00516 | 89794 | gttcttggctgtacaatgggctg | D49730 |
| 4587 | atctatgccaaagcgaagaagaag | M19960 | 47191 | agccctgcaggccctgctctaaact | Y00516 | 89795 | ggtaacactccacacagggttgt | D49730 |
| 4588 | tatgccaaagcgaaagaagaagtt | M19960 | 47192 | cctgcaggcctctgctctaaggcc | Y00516 | 89796 | actcacctcagagtgttgtgaa | D49730 |
| 4589 | gaagccgatcttgcagcacggaga | M19960 | 47193 | agccagtgaatctctctcatct | Y00516 | 89797 | atttcagacatttctggata | D49730 |
| 4590 | tctttgcacgcaggaaatttcaa | M19960 | 47194 | atctctcatctctaaccagcc | Y00516 | 89798 | attttaaacatccatggaccagac | D49730 |
| 4591 | gactgtacagaggcctgctgcca | M19960 | 47195 | tctctlcatctaaccatgcctac | Y00516 | 89799 | catggaccagccacataagtagtc | D49730 |
| 4592 | tccctaaatcaattctgatgacc | M19960 | 47196 | cttcatctaaccatgcctactaa | Y00516 | 89800 | ggtagtctgtcaccagatgtt | D49730 |
| 4593 | cagctgccatccacctctgccgtg | M19960 | 47197 | ccatgccaaccagagctgaac | Y00516 | 89801 | ctgtgctaccacagtgttaacact | D49730 |
| 4594 | actgcaacccaagtcgatgtggc | M19960 | 47198 | tcatatgggcacagctgtgctc | Y00516 | 89802 | ttagtaccctgcggtgaatccaga | D49730 |
| 4595 | gcaaccaagtctgatgtgttt | M19960 | 47199 | ggtacaccgctgatgctgactg | AA024180 | 89803 | agatctaagctcctagataactc | D49730 |
| 4596 | agtctgaattgtctttctctcaa | M19960 | 47200 | tagacattcttttccaagaagtc | AA024180 | 89804 | taagtcctagataactccagaca | D49730 |
| 4597 | gtgctttttcctccaatagaaagt | M19960 | 47201 | tattctttccaagaagtctgagtc | AA024180 | 89805 | ggaccaccccaatctcgaggctgagg | L47335 |
| 4598 | tgcgtcaacctgtgtgtctcaaagg | M19960 | 47202 | ctgagtcctgcatatagctcatc | AA024180 | 89806 | cccaatctcgaggctgggcagtac | L47335 |
| 4599 | gatgagactctcctgcaacgtgt | M19960 | 47203 | agtcctcgcatatagctcatctcc | AA024180 | 89807 | gtggcattccaggggtgactttgct | L47335 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4600 | acttcctcttgaacagtgtgctgtt | M19960 | 47204 | ccttcgcatatagctcatctcctg | AA024180 | 89808 | gcattccaggttgacttttgctcct | L47335 |
| 4601 | tcctcttgaacagtgtgctgtgta | M19960 | 47205 | atagctcatctcctggagaagatg | AA024180 | 89809 | ggtgactttgtccgttccgct | L47335 |
| 4602 | tcttgaacagtgtgctgtaaac | M19960 | 47206 | gctcatctccttggagaagtgat | AA024180 | 89810 | gactttgttcctgttcctgtccc | L47335 |
| 4603 | caattcgatgagaccgtggtgaac | M19960 | 47207 | ttattgtcagccatgtctcagtac | AA024180 | 89811 | aagcctactcactgggcaccatgt | L47335 |
| 4604 | agccaaactgaccgtcaaggacgcc | M19960 | 47208 | tcagccatgtctcagtacttctga | AA024180 | 89812 | cttcactgggcaccatgttcag | L47335 |
| 4605 | agccaaactgaccgtcaaggaaagg | M19960 | 47209 | atgctcagttacttctgatgagtc | AA024180 | 89813 | accagttttgcagccattgctgcgg | L47335 |
| 4606 | ctgaccgtcaaggaaggaactgg | M19960 | 47210 | cgtgctgatgctgacgaataagt | AA024180 | 89814 | atgtttgcagccattgctgcggta | L47335 |
| 4607 | cagtggtccatgccaattgctcct | M19960 | 47211 | cagtgacttcgatgagtcgatccg | AA024180 | 89815 | tttgcagccattgctgggctactt | L47335 |
| 4608 | tggtcatgccaattgctctgtg | M19960 | 47212 | atatttgtacacataggactgtg | AA024180 | 89816 | gccattgctgggctacttcactcc | L47335 |
| 4609 | catgccaattgtctctgtcatcag | M19960 | 47213 | tttctgtacacataggggactggat | AA024180 | 89817 | aatctggggctgaggcagtacctg | L47335 |
| 4610 | ttctagcttagctgtcagctgtcca | M19960 | 47214 | cgtacacataggggactgtggatcac | AA024180 | 89818 | taagtaaaccacaggtcgccttg | L47335 |
| 4611 | cctagctgcagctgtccatcact | M19960 | 47215 | taaggacttttgcctgcctccacgat | AA024180 | 89819 | gcagtacctgctgaaccaggggtg | L47335 |
| 4612 | ccttgctgggtgactgcgggcaccgg | W49163 | 47216 | ctgcctcacgattgcttcagtctg | AA024180 | 89820 | agccttgagcaggcgaggagagtg | L47335 |
| 4613 | ttgactggcgggcaccggtacacaa | W49163 | 47217 | cctttcacgattgctttcagtctgtt | AA024180 | 89821 | gctccgcaggcaggcagagagtcgtg | L47335 |
| 4614 | cacagttcattatccgtcatgtat | W49163 | 47218 | cgattgcttcagtcgttgtcagt | AA024180 | 89822 | tagtcagctgtggaacatgctgag | L47335 |
| 4615 | agttcattatccgtcatgtatgc | W49163 | 47219 | ctcagagccaccatcacgccaggt | AA024180 | 89823 | tcagctggcgaacatgctgagcag | L47335 |
| 4616 | ttattccgtcatgtatgccatccg | W49163 | 47220 | agcagcaccatcacgccaggtga | AA024180 | 89824 | acatgctggcgaggtgcaggggcat | L47335 |
| 4617 | ttccgtcatgtatgccatccgagtc | W49163 | 47221 | ttcaaaagctgtacacagcgagat | AA024180 | 89825 | tgagcagccaggtggcattccagg | L47335 |
| 4618 | cgtcatgtatgccatccgagagtc | W49163 | 47222 | tcgtacacagcgagatcaagtcctg | AA024180 | 89826 | tagccacaggtgacagtcaggaca | L47335 |
| 4619 | catgtattgccatccgagtcgcc | W49163 | 47223 | gcgaatcaagtcctgctgaaggaa | AA024180 | 89827 | gaccaaggatcaatggggatgaac | L47335 |
| 4620 | ttgatgaccttgactttcatagg | W49163 | 47224 | agatcaagtcctgctgaaggaatga | AA024180 | 89828 | gggcttcaggaacttcacctccaaag | L47335 |
| 4621 | atgaccttgacttcatatggga | W49163 | 47225 | tcaatgcctgctaaggaatgatgc | AA024180 | 89829 | accaagccacttgagggtctct | U57344 |
| 4622 | acttgacttcttcataggggatga | W49163 | 47226 | atcttctggcacaaccgtataatc | AA024180 | 89830 | aagagccacttgagggtctctcaa | U57344 |
| 4623 | ttgacttcttcataggggatgaagc | W49163 | 47227 | ttctttggcacaaccgtataatccg | AA024180 | 89831 | ccacttgagggtctctcaaggcaa | U57344 |
| 4624 | acaacaagctcggactcacgcaggcaa | W49163 | 47228 | gccacaacgtatatccggaagtatt | AA024180 | 89832 | aagacaaagcctccagttcctgcac | U57344 |
| 4625 | agctcggactcacgcaggccactga | W49163 | 47229 | ccgtatatccggaagtattgtccag | AA024180 | 89833 | tgccccaggaaccttaagcagaaaactg | U57344 |
| 4626 | gctacgcaggccaaccagtgagccaca | W49163 | 47230 | tgtccagtttttggctacagctagcc | AA024180 | 89834 | actggccaaggctgaagaagatg | U57344 |
| 4627 | acgcaggccaaccagtgagccacagtt | W49163 | 47231 | accatcacgccaggttgaccgagt | AA024180 | 89835 | gggtccaccggatccaatgttggaa | U57344 |
| 4628 | caggccaaccagtgagccacagttcat | W49163 | 47232 | atcacgccaggtttgaccgagtctt | AA024180 | 89836 | tcacctgatccaatgtttgaaga | U57344 |
| 4629 | gcaacactgagccacagttcattat | W49163 | 47233 | ttgaccgagtctttggcaaagtat | AA024180 | 89837 | tggaagaatcccatctccctgg | U57344 |
| 4630 | ctggccacagttcattaccgtc | W49163 | 47234 | gcaagttatcagccaataagact | AA024180 | 89838 | ttacctatagaggctggggtlcaaag | U57344 |
| 4631 | agccacagttcattattccgtcatg | W49163 | 47235 | ttatccgccaataagacttcaaaa | AA024180 | 89839 | ctgactgtgaccaccccaggcctgcac | U57344 |
| 4632 | ctaaggctcgaactctccaaggtgg | W48965 | 47236 | tccagccaataagacttcaaaagct | AA024180 | 89840 | actgtaccaccgcctgcaccta | U57344 |
| 4633 | ggtgatcctacgtggaaagacta | W48965 | 47237 | taagacttcaaaagctctacacg | AA024180 | 89841 | cttgacctaattggtccctgcctg | U57344 |
| 4634 | gaaatgagcggttgagatcgtag | W48965 | 47238 | gactttcaaaagctctacacagcga | AA024180 | 89842 | cctaattggtccctgctggtcttg | U57344 |
| 4635 | gagatgcaggattcctacagccc | W48965 | 47239 | cacatccgcacagactgttttgagt | L48015 | 89843 | ctgcttccttggggttcaggact | U57344 |
| 4636 | atcgcaggattccctactagcctcc | W48965 | 47240 | cgcacagactgttttgagtcgtaca | L48015 | 89844 | ctggctctttgggttcaggatcca | U57344 |
| 4637 | gggattcctactagcctccagatcl | W48965 | 47241 | cggtgctcgagatccgggtct | L48015 | 89845 | gtccttgggtcaggactltcact | U57344 |
| 4638 | ccctacagcctccagatctgggaca | W48965 | 47242 | gctgcagatccgtcctccgggc | L48015 | 89846 | tgcagcaacaggggccactgcgca | U57344 |
| 4639 | gacacacgcggacacgggaaaagttca | W48965 | 47243 | tccgggctgccccagatgatgagag | L48015 | 89847 | aacaggggccactgcgcaagctgc | U57344 |
| 4640 | gctactaccgcgggtgccccagggtg | W48965 | 47244 | ctcactccatccagagaagcca | L48015 | 89848 | ttccactccacgagctctgcagct | U57344 |
| 4641 | taccgggtgccccagggtgagcagg | W48965 | 47245 | aagccaagtgaatttcactaccca | L48015 | 89849 | ttcacctccacgagctctttgga | U57344 |
| 4642 | gaggcagcgaatgagcggaactc | W48965 | 47246 | attcactcagtccccagggccaccagc | L48015 | 89850 | atgaagtcctgcaccatgccat | U57344 |
| 4643 | aatggagcggaactctcaaccat | W48965 | 47247 | accagggtcctgcctaaagtgt | L48015 | 89851 | cgcccaaccgttttgactcagatcl | U57344 |
| 4644 | gatcctacgggagaactagcc | W48965 | 47248 | ctgctaaagttgtgtggggcag | L48015 | 89852 | cgcccaaccatttcaggatggtg | U57344 |
| 4645 | ccaccgggtlgaatactact | W48965 | 47249 | aaagttgctggggtcaggaagaca | L48015 | 89853 | tctttctcaaaggggttgagagatg | U79748 |
| 4645 | ggaaagctagccatccatccaggt | W48965 | 47250 | atccagccaaaatacagctgtgct | L48015 | 89854 | gtgtttgctcgtcttagcag | U79748 |
| 4646 | actagcctcattcacagttatgca | W48965 | 47251 | acagacatcgggccttggcctag | L48015 | 89855 | gctgccttgctctcttagcagagagaa | U79748 |
| 4647 | agcctcattcacagttatgcaaga | W48965 | 47252 | atccaggcctttggcctagtctat | L48015 | 89856 | ttgctggcgagctcttgga | U79748 |
| 4648 | ctcattcacagttatgcaagaatg | W48965 | 47253 | atccgccgggaccatcaatg | L48015 | 89857 | cagtttgctgctgagtctccctgct | U79748 |
| 4649 | gattacaaggccacgattgcgtag | | | | | | | |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 4650 | W48965 | aaggccacgattgcgtagacttig | 47254 | L48015 | atcaatggcattgtggaggattaca | 89858 | U79748 |
| 4651 | W48965 | gccacgattgcgtagacttgaaa | 47255 | L48015 | aggccaccttctatgacatggtac | 89859 | U79748 |
| 4652 | L28035 | gccaccctttgatggggaagatgag | 47256 | L48015 | cctttctatgacatgtgaccaatg | 89860 | U79748 |
| 4653 | L28035 | tcaagccatcatggaacaacgtgtc | 47257 | L48015 | tatgacatgtgaccaatgaccca | 89861 | U79748 |
| 4654 | L28035 | gccagaccgttggttctagccagc | 47258 | L48015 | cctaaccggctggctgcagatccgg | 89862 | U79748 |
| 4655 | L28035 | ccgcttgtctctagccagcatcgac | 47259 | AA024231 | actgggctactcgctgacagtgacg | 89863 | U79748 |
| 4656 | L28035 | agccagcatcgaccaagctgattc | 47260 | AA024231 | tgggctacctgctgacagtgacgg | 89864 | U79748 |
| 4657 | L28035 | catccaccaagctgattcaggge | 47261 | AA024231 | tgaatgcagcacctctagacttta | 89865 | U79748 |
| 4658 | L28035 | ccaagctgattccaggccttacc | 47262 | AA024231 | aatgtcagcacctctagacttaca | 89866 | U79748 |
| 4659 | L28035 | gaaccggactgctgtgcaccagat | 47263 | AA024231 | tcagcacctctagacttacaggt | 89867 | U80036 |
| 4660 | L28035 | gccgtgcctgtcatgtaatcctat | 47264 | AA024231 | cgactggcccagcgtcatgctcctg | 89868 | U80036 |
| 4661 | L28035 | gcctgtcatgtaatctcatctgtg | 47265 | AA024231 | actgggcccagcgtcatgctctgag | 89869 | U80036 |
| 4662 | L28035 | catgtaatctcatctgccgcgcta | 47266 | AA024231 | tggcccagcgtcatgctctgcagtg | 89870 | U80036 |
| 4663 | L28035 | gctgtaaccaccatcactacccctag | 47267 | AA024231 | gcccagcgtcatgctgtgagagtt | 89871 | U80036 |
| 4664 | L28035 | ggaacaaactgtcacctatcccaag | 47268 | AA024231 | caggtcatgctgagagttggag | 89872 | U80036 |
| 4665 | L28035 | aactgtcacctatcccaagtcactt | 47269 | AA024231 | catgctcgagagttgagggcaag | 89873 | U80036 |
| 4666 | L28035 | ttcccggaagctgtggccatctgc | 47270 | AA024231 | aaggcagacgcgccagatactaccat | 89874 | U80036 |
| 4667 | L28035 | tgtgggccatcgcaaaggttcctg | 47271 | AA024231 | ggctacctgctgacagtgacggtct | 89875 | U80036 |
| 4668 | L28035 | catgcaaaggttctgaccaag | 47272 | AA024231 | ctacctgctgacagtgacggtctct | 89876 | U80036 |
| 4669 | L28035 | gcaccaggaaaagcctgggtca | 47273 | AA024231 | gctgacagtgacggtctctgcagat | 89877 | U80036 |
| 4670 | L28035 | tcatgctttccgttcgatcgat | 47274 | AA024231 | tgacagtgacggtctctgcagatgg | 89878 | U80036 |
| 4671 | L28035 | actggaaatgtcacctccttcaga | 47275 | AA024231 | cttctggagccacgatgcccggac | 89879 | U80036 |
| 4672 | W48968 | ccaagccagacacgcgaacaggagac | 47276 | AA024231 | gatgcccgggactatgctgatggat | 89880 | U80036 |
| 4673 | W48968 | aagccagacacgcgaacaggagacta | 47277 | AA024231 | tgcccggactatgctgatgggatca | 89881 | U80036 |
| 4674 | W48968 | gctagttcagcggaacaggagccg | 47278 | AA024231 | aatgaatgtcagcacctctagatc | 89882 | U80036 |
| 4675 | W48968 | ctgagttctgtcatggaagccgt | 47279 | AA024231 | agctccctatcacgacctgtgcc | 89883 | U80036 |
| 4676 | W48968 | tgagttctgtctcatggaagccgtg | 47280 | AA024231 | accettctatgaggactagagaga | 89884 | U80036 |
| 4677 | W48968 | agttcgtctcatggaagccgtgg | 47281 | Z23143 | tctgacagtgatactgtgggacag | 89885 | U80036 |
| 4678 | W48968 | gttctgtctcatggaagccgtgagt | 47282 | Z23143 | gaattcacagaagcatcgttagcc | 89886 | U80036 |
| 4679 | W48968 | ttctgtctcatggaagccgtgagta | 47283 | Z23143 | agcatcgttagccccaagcctgaac | 89887 | AA110061 |
| 4680 | W48968 | tcgtctcatggaagccgtgagtacc | 47284 | Z23143 | ccaagccttgaacgttagcctactg | 89888 | AA110061 |
| 4681 | W48968 | cgtctcatggaagccgtgagtacca | 47285 | Z23143 | cttgaacgttagcctactgcccagt | 89889 | AA110061 |
| 4682 | W48968 | agccgtgagtaccatgccgagacta | 47286 | Z23143 | tgagttcagactttctgcgaagaga | 89890 | AA110061 |
| 4683 | W48968 | gccgtgagtaccatgccgagactat | 47287 | Z23143 | cagacttctggaagagacgcagg | 89891 | AA110061 |
| 4684 | W48968 | agccagacgcgaacagagactgc | 47288 | Z23143 | accagaaacacgattcatcatgg | 89892 | AA110061 |
| 4685 | W48968 | aacaggagacgcctcattcagac | 47289 | Z23143 | ggattcatcaaggtctctgaggag | 89893 | AA110061 |
| 4686 | W48968 | acaggagacgcctcattcagacc | 47290 | Z23143 | tgctttctaagaaagccctgatt | 89894 | AA110061 |
| 4687 | W48968 | aatggcgtcggtctgagttgtcct | 47291 | Z23143 | cattccccaatcgatggacagttga | 89895 | AA110061 |
| 4688 | W48968 | tggctgctgagttcgtctcatg | 47292 | Z23143 | atgagtgtctcaggcagatggggaa | 89896 | AA110061 |
| 4689 | W48968 | ggctggctgagttcgtctctcatgg | 47293 | Z23143 | gtctcaggcagatgggaagttat | 89897 | AA110061 |
| 4690 | W48968 | ctcggcagttgtctcatggaa | 47294 | Z23143 | tgacagagtgctggggcgcagaatcc | 89898 | AA110061 |
| 4691 | W48968 | cggctgagttgtctcatggaagc | 47295 | Z23143 | ccettgccaaaatgtcggaagttcca | 89899 | AA110061 |
| 4692 | W48968 | cgagcagttggttctcatggaagc | 47296 | Z23143 | ccaaaatgtcagatgtcccaggacat | 89900 | AA110061 |
| 4693 | W49178 | agtaccaagatgctatgccggacga | 47297 | Z23143 | tgtcagagtcccaggacaattaaact | 89901 | AA110061 |
| 4694 | W49178 | ctcagttctccatcgcccgtg | 47298 | Z23143 | ttaaactctgacgtcgatactgt | 89902 | AA110061 |
| 4695 | W49178 | cagttctcatcgcccgtgta | 47299 | AA024290 | ggctccaggctccaaacagccatg | 89903 | AA110061 |
| 4696 | W49178 | tccatctgcccgtgactccagtg | 47300 | AA024290 | tgccaggtccaaacagccatgtt | 89904 | AA110061 |
| 4697 | W49178 | ccatctgcccgtgactccagtgt | 47301 | AA024290 | tcaagctctcaagaaccaagttcac | 89905 | AA110061 |
| 4698 | W49178 | catctgcccgtgactccagtgc | 47302 | AA024290 | tctctaagaccaagttcacagttcc | 89906 | AA110061 |
| 4699 | W49178 | gtgtactccagtgtctttctgctgg | 47303 | AA024290 | ctaagaaccaagttcacagttccctg | 89907 | AA110277 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4700 | gtgtgtctgtttgcaatggga | W49178 | 47304 | agaccaagtlcacagttccctggct | AA024290 | 89908 | cgaactgtggcagtcatgcgcgat | AA110277 |
| 4701 | tgtgtctgtttgccaatggag | W49178 | 47305 | agttcacagttccctgctgccaga | AA024290 | 89909 | gatcataatccctgtcgtcttgag | AA110277 |
| 4702 | gtgtctgtttgccaatggagt | W49178 | 47306 | tcacagttccctggctgccagaaga | AA024290 | 89910 | ataatccctgtcgtctgagact | AA110277 |
| 4703 | tgttctgtttgcaatgggag | W49178 | 47307 | ttcaccacgtttaatgcagataac | AA024290 | 89911 | aatccctgtcggttctgagcactic | AA110277 |
| 4704 | taccaagtcgtatcgcaatgg | W49178 | 47308 | aagccgtcattcctgatgactatt | AA024290 | 89912 | tccctgtcggttctgagcacttcg | AA110277 |
| 4705 | ccaagatgctatcgcggacgaggg | W49178 | 47309 | ccgctcattcctgatgactattgtg | AA024290 | 89913 | tcggttcgagcacttctgcagagt | AA110277 |
| 4706 | aagatgctatcgcggacgaggaaga | W49178 | 47310 | ctcattcctgatgactatgtgtca | AA024290 | 89914 | ggtctgagcactctgcagagtca | AA110277 |
| 4707 | agatgctatcgcggacgaggaagag | W49178 | 47311 | caggctccaaacagccatgcttaga | AA024290 | 89915 | tcttgagcacttctgcagagtcatg | AA110277 |
| 4708 | gattagatccctcagcttcctcat | W49178 | 47312 | ccaaacagccatgcttagcgcat | AA024290 | 89916 | ttgagcacttctgcagagtcatgaa | AA110277 |
| 4709 | attagatccctcagcttcccatc | W49178 | 47313 | agccatgctgagccattgggaat | AA024290 | 89917 | gcacttctgcagagtcatgaatcctc | AA110277 |
| 4710 | ttagatccctcagcttccatct | W49178 | 47314 | agccattgggaatcccacggcaca | AA024290 | 89918 | actctgcagagtcatgaatctcaa | AA110277 |
| 4711 | agatccctcagcttctccatctgc | W49178 | 47315 | tgggaatcccacggcacaggtgcc | AA024290 | 89919 | acgtcagacagcatttgggatat | AA110277 |
| 4712 | taggaactcgacctgagtctgagt | W49178 | 47316 | gaatccccacggcacagtggcagg | AA024290 | 89920 | gtactggactcagggcaccgatca | AA110277 |
| 4713 | ctcgacctgagtctgtagttacaga | M63554 | 47317 | tcccacggcacagtggccaggttt | AA024290 | 89921 | tggactcagggcaccgatcataaat | AA110277 |
| 4714 | ttgaaacaaatctacctatgtaga | M63554 | 47318 | gatcaagctctcaagaccaagtt | AA024290 | 89922 | gactcagggcaccgatcataatcct | AA110277 |
| 4715 | tgaactatggcctattgagacaa | M63554 | 47319 | tggccacagtcctcattcacgg | AA024290 | 89923 | ctcagggcacgatcataatcctgcgt | AA110277 |
| 4716 | atctcgataatcctattacaacat | M63554 | 47320 | ccagctcctattcacagtgagc | AA024290 | 89924 | ggcaccgcataatccctgtcggt | AA110277 |
| 4717 | ctattacaacatccaacagttca | M63554 | 47321 | tgtlatcacagatgctcagtggacc | X61172 | 89925 | caccgatcataatccctgtcggtct | AA110277 |
| 4718 | acaacatccaacagttcaagtcc | M63554 | 47322 | cacagatgctcagtggaccaagact | X61172 | 89926 | ccgatcataatccctgtcggttctg | AA110277 |
| 4719 | aatctcctgttaactatgctgat | M63554 | 47323 | tgctcagtggaccaagacgtctcg | X61172 | 89927 | aagtcctggagactggtcgagact | AA110277 |
| 4720 | cactgtlcacatgcattttgtaa | M63554 | 47324 | cattgaattatcatcccgtgtctt | X61172 | 89928 | gcaacgttgctgatgcctcca | AA110277 |
| 4721 | tgaaccagtgctaagactgtgtga | M63554 | 47325 | aattatcatcccgttcgtgtgt | X61172 | 89929 | ggagcatcacactgactgcagtac | AA110277 |
| 4722 | atacccagagacatatactatattac | M63554 | 47326 | gtgtcttgctgtactcgtgctgaa | X61172 | 89930 | cttatgaggtcactcactcaccaacc | D85845 |
| 4723 | ctattactaatgcatgcgggccat | M63554 | 47327 | ttgctgctgtgtcgaagtgtt | X61172 | 89931 | cctacaatttcatgccacattatac | D85845 |
| 4724 | aggaagctgctcatatctccat | M63554 | 47328 | tactcgtgctgtcgaagttt | X61172 | 89932 | tgccacaattatacctgcaagtct | D85845 |
| 4725 | tatatctccataagagtgctttca | M63554 | 47329 | agtgttcacagtcctttgtctag | X61172 | 89933 | atgtgcattcaactccctttcagc | D85845 |
| 4726 | atgaatctcatttagcccccactg | M63554 | 47330 | ttcacagtccttgctcagaagaa | X61172 | 89934 | atgttcctgtagacctgagctatga | D85845 |
| 4727 | dcattagcccccaactgatgtt | M63554 | 47331 | ccttattccacaggtgaagcaagaac | X61172 | 89935 | ctgtagacctgtgatcactcccta | D85845 |
| 4728 | tgttaagtacgttcttctggatata | M63554 | 47332 | cagaaactctatgtaaccagcaagc | X61172 | 89936 | acctgactgattcctactccca | D85845 |
| 4729 | gtatgccttctggatataagaacag | M63554 | 47333 | ctctatgtaaccagcaagcttcgc | X61172 | 89937 | gcattggaactcagtcaatacgat | D85845 |
| 4730 | agaggcctgtcttgatctaagtca | M63554 | 47334 | gtaaccagcaagctctgcttttta | X61172 | 89938 | gaactcagctcaatagatctctc | D85845 |
| 4731 | ttgatctaagctcattgagggctagc | M63554 | 47335 | acattacaacactgggaaatgaag | X61172 | 89939 | tggttcgtggatgcctccaactggg | D85845 |
| 4732 | tgtatcagttgaactactltaagtag | M63554 | 47336 | ctgggttcttctggcacaggggca | X61172 | 89940 | gctcaatagatctctctgattag | D85845 |
| 4733 | atatttcatttcatgatgaatctcc | X61434 | 47337 | tcctctggcacacagtgggcagtcagc | X61172 | 89941 | aatcttcaattgtgactctactact | D85845 |
| 4734 | gcaatggccaatgtcccacagtaacaa | X61434 | 47338 | agtcagccacactcagaccgaca | AA024320 | 89942 | caatttgtgactctactatctgt | D85845 |
| 4735 | caatgtccccacagtaacaaataaatg | X61434 | 47339 | ataagtatgcctgggccgaaagat | AA024320 | 89943 | tctctgtccacagcttcaactatca | D85845 |
| 4736 | gatttcagttgtccacctgtattt | X61434 | 47340 | tccgcagttgcctggcgccgaaagat | AA024320 | 89944 | gctcaactacgtgtccagggct | D85845 |
| 4737 | ctgaatactctgtgctagcaagtt | X61434 | 47341 | ceatcagtcctctgtgaggaagt | AA024320 | 89945 | gccctcttatggccatatggaaac | D85845 |
| 4738 | tactctgtgctagcaagttctggt | X61434 | 47342 | aagtagccatcaagctcgaatgt | AA024320 | 89946 | tgaaacattctctccatccaa | D85845 |
| 4739 | ttaaatccaagaacatgctaatact | X61434 | 47343 | tgaagacgaaacatcccagtcca | AA024320 | 89947 | ctttggagccatccactcgactg | D85845 |
| 4740 | ccaagaacatgctaatcatgtgttc | X61434 | 47344 | agaagaaacatcccagcccacat | AA024320 | 89948 | gcaagacgcaatcaaaccactgg | U65418 |
| 4741 | taatcatgttctagtatgctca | X61434 | 47345 | cccagctccacagagcaagtt | AA024320 | 89949 | cctgaatcaacactgccaatg | U65418 |
| 4742 | tgctacaaattctctggtagttg | X61434 | 47346 | tcatgagctgctgtggcccaacct | AA024320 | 89950 | aggactatcgtccagatccacat | U65418 |
| 4743 | aaattctgtgtggtgtat | X61434 | 47347 | tgtggccaacctggatgaccttt | AA024320 | 89951 | atgctgcagatccacatccactgt | U65418 |
| 4744 | ttaagtccagaaccctgtata | X61434 | 47348 | ggccaaccttggatgcactictcaa | AA024320 | 89952 | tccatccgaaggccgaacaaagc | U65418 |
| 4745 | tactgccctcctacgtgcaagt | X61434 | 47349 | atgacctctcaactctgttccg | AA024320 | 89953 | tcaccgtgaacactcatctccgtg | U65418 |
| 4746 | attgacagcagtcctagtcatage | X61434 | 47350 | tcttcaacttcgttccgacagt | AA024320 | 89954 | tgtggatccgctcacgagacatgc | U65418 |
| 4747 | agcagtcctagtcatatgcacacac | X61434 | 47351 | gtgctcctttgagacatctacct | AA024320 | 89955 | acacgaacatgccctgcaagtgtcc | U65418 |
| 4748 | attgaaatctatctgagaccttc | X61434 | 47352 | tcaactcctgtcccggacagttag | AA024320 | 89956 | acatcgctcaagtgtcccaaaat | U65418 |
| 4749 | aatcctatcgaagaccttctctcca | X61434 | 47353 | gctccttgagacatctaccggg | AA024320 | 89957 | tcaagccccctcaagaagtactgct | U65418 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 4750 | X61434 | atctgagacctctctccactatc | 47354 | AA024320 | cctttggagacatctacctgggtgc | 89958 | U65418 |
| 4751 | X61434 | ctctccactatctgcatgtgttt | 47355 | AA024320 | gagacatctacctgggtgccatcat | 89959 | U65418 |
| 4752 | J04847 | atttccaatgtgaaacagtcatca | 47356 | AA024320 | acactacctgggtgccatcatgc | 89960 | U65418 |
| 4753 | J04847 | aacaatgtcatcaattcgactgcc | 47357 | AA024320 | tctacctgggtgccatcatgcctc | 89961 | U65418 |
| 4754 | J04847 | tcattctcaacgagaggaacataa | 47358 | AA024320 | tggggtgccatcatgcctctgtga | 89962 | U65418 |
| 4755 | J04847 | cattctcaacgagaggaacataa | 47359 | AA024320 | gtgccatcatgcctctgtgagga | 89963 | U65418 |
| 4756 | J04847 | gtgccatcttggctagaaacatgg | 47360 | X63240 | cggcagcccagagctgcgggacct | 89964 | U65418 |
| 4757 | J04847 | agtggtgacggtccaagagcagat | 47361 | X63240 | cctcagcgctggggaccccgg | 89965 | U65418 |
| 4758 | J04847 | ttcagcagtggccgtgctagcaac | 47362 | X63240 | tgctcatccggagacctaccaag | 89966 | U65418 |
| 4759 | J04847 | tcagcagtggccgtgctagcaacag | 47363 | X63240 | agacctaccaagccaacactgcca | 89967 | U65418 |
| 4760 | J04847 | agtggccgtgctagcaacagtcgca | 47364 | X63240 | gctacgggaaccacgtgggtcgt | 89968 | U65418 |
| 4761 | J04847 | ggccgtgctagcaacagtcgcagcg | 47365 | X63240 | accagtggtgctgctgctaaaaat | 89969 | U73915 |
| 4762 | J04847 | gagccatggcagcagcagagaggggtt | 47366 | X63240 | tggtgctgctaaaaatgcaggc | 89970 | U73915 |
| 4763 | J04847 | agcaggtggcagcagcagagaggggttg | 47367 | X63240 | cctacgcgggcaagctgctcatcag | 89971 | U73915 |
| 4764 | J04847 | catgtcatcaatttcgactggcta | 47368 | X63240 | agtcgctcatcagcctgtccgagga | 89972 | U73915 |
| 4765 | J04847 | atgtcatcaatttcgactggcta | 47369 | X63240 | tgctcatcagcctgtccgagagc | 89973 | U73915 |
| 4766 | J04847 | gtcatcaatttcgactggcctagtg | 47370 | X63240 | tgtccgaggaggcatcagccgcga | 89974 | U73915 |
| 4767 | J04847 | tcatcaattcgactgcctagtga | 47371 | X63240 | acatggtagccaccgagtgcggctg | 89975 | U73915 |
| 4768 | J04847 | atcaattcgactgcctagtgaca | 47372 | X63240 | cggcctctagcgctgctccaa | 89976 | U73915 |
| 4769 | J04847 | tcaattcgactgcctagtgacat | 47373 | X63240 | tgcatgcctgtgtcccaacgactc | 89977 | U73915 |
| 4770 | J04847 | accctcattcaacgagaggacta | 47374 | X63240 | tagcgctgtgtcccaacgactccg | 89978 | U73915 |
| 4771 | J04847 | cctcattctcaacgagaggaacat | 47375 | X63240 | tgctgtctaaaggcgctgcaggg | 89979 | U73915 |
| 4772 | M57958 | ttaacgaaacaatcagtccgtcctg | 47376 | X63240 | tgctaaaggcgctgcagggcttacg | 89980 | U73915 |
| 4773 | M57958 | tcagtcgctccttttcgagtact | 47377 | X63240 | taaaggcgctgcagggcttacgggc | 89981 | U73915 |
| 4774 | M57958 | atctcgtccgaaatcgaagaaaca | 47378 | X63240 | agcgtcagtgctcatccgcagca | 89982 | U73915 |
| 4775 | M57958 | ttttcatacagggcatagtctcg | 47379 | X63240 | gtcagtgctcatcccgagaccta | 89983 | U73915 |
| 4776 | M57958 | ggcatagtctcgctcggatttcactc | 47380 | AA027404 | gccatcatgacgaagacgagacgagaag | 89984 | U73915 |
| 4777 | M57958 | atagtctcggtcgatttcactcact | 47381 | AA027404 | ccatcatgacgaagacgagaga | 89985 | U73915 |
| 4778 | M57958 | gtctcggtcgattcactcact | 47382 | AA027404 | agcgtcatcacaaccgagcag | 89986 | U73915 |
| 4779 | M57958 | gtcgattcactcactacgacatc | 47383 | AA027404 | ctgtcatctacaaccgagcagc | 89987 | U73915 |
| 4780 | M57958 | gatttcactcactacgacatctga | 47384 | AA027404 | gtcatctacaaccgagcagcgga | 89988 | X14805 |
| 4781 | M57958 | ttcactcactacgacatctgaaca | 47385 | AA027404 | tcatctacaaccgagcagcgggaga | 89989 | X14805 |
| 4782 | M57958 | cacttacgatcatctgaacagaatgt | 47386 | AA027404 | atctacaaccgagcagcgggagagt | 89990 | X14805 |
| 4783 | M57958 | ttacgacatctgaacagaatgtaaa | 47387 | AA027404 | ctacaaccgagcagcgggagagtt | 89991 | X14805 |
| 4784 | M57958 | gagtactacagggtcctcctcagtga | 47388 | AA027404 | acaaccgagcagcgggagagttctt | 89992 | X14805 |
| 4785 | M57958 | aggggtcctcagtcactactcagtgt | 47389 | AA027404 | aacccgagccagcgggagagttctgg | 89993 | X14805 |
| 4786 | M57958 | ttaggccctcattatctgtaagt | 47390 | AA027404 | agtttctgggggcacctccaagag | 89994 | X14805 |
| 4787 | M57958 | cctcattatctgtaagtataacg | 47391 | AA027404 | tttctgggggcacctccaagag | 89995 | X14805 |
| 4788 | M57958 | accttcaacacgtctggatcctcg | 47392 | AA027404 | agaagaaalcttccaccagagcct | 89996 | X14805 |
| 4789 | M57958 | ttcaacacgtctggatcctggtg | 47393 | AA027404 | tccttccaccagactgcggcgagt | 89997 | X14805 |
| 4790 | M57958 | aacacgtctgatctggggcaa | 47394 | AA027404 | cttccaccagacctgccggcgagtgg | 89998 | X14805 |
| 4791 | M57958 | tggatctggggcaaatctgagga | 47395 | AA027404 | caccagacctgccgagtggaagc | 89999 | X14805 |
| 4792 | W49194 | agcagtcgcctgaactggtgtgg | 47396 | AA027404 | ccagagcctgccgagtggaagctg | 90000 | X14805 |
| 4793 | W49194 | gccttgaactggtgttctgatgt | 47397 | AA027404 | agagcctgccgagtggaagctgtt | 90001 | X14805 |
| 4794 | W49194 | ctctgccccagtatagaccccaa | 47398 | AA027404 | agcctgccgagtggaagctgttca | 90002 | X14805 |
| 4795 | W49194 | ctgttgctccaatttgaccac | 47399 | AA027404 | cctggccagtggaagctgttcat | 90003 | X14805 |
| 4796 | W49194 | ttgtgctcaatttgaccactg | 47400 | AA027420 | ggtcctggacgaagccacagcccga | 90004 | X14805 |
| 4797 | W49194 | tctcaattgaccactctctt | 47401 | AA027420 | cacagccgagtggattgatagacg | 90005 | X14805 |
| 4798 | W49194 | ttcccatcacgccttgagggaaa | 47402 | AA027420 | cgcacaggccgtgcaccatcatg | 90006 | X14805 |
| 4799 | W49194 | cccatcacagccttgggaaatca | 47403 | AA027420 | gctgcaccatcatggacgagtgac | 90007 | X14805 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4800 | atcacgcctlgagggaaatcaaga | W49194 | 47404 | gcaccaccatggacagtgacaag | AA027420 | 90008 | ctgttccaagctcagcactgccat | Z47352 |
| 4801 | atcaagatlctacagctcctaaaac | W49194 | 47405 | caccatcatggacagtgacaagata | AA027420 | 90009 | caagctcagcactgccatgaaccag | Z47352 |
| 4802 | aagatlctacagtctcctaaacatg | W49194 | 47406 | cctagacacggcaagatlgttgaa | AA027420 | 90010 | aatcccggtgaagggcaagctgctg | Z47352 |
| 4803 | cagtcctaaaacatgcagaatgtgg | W49194 | 47407 | cagtcctgaagaactgctgccaat | AA027420 | 90011 | gcagacaactcctgagccacaagg | Z47352 |
| 4804 | gttctgatgtctctgctcctgata | W49194 | 47408 | caatatggglccctlctacttgatg | AA027420 | 90012 | cacaaggcgcctgccatgggg | Z47352 |
| 4805 | ctgatgtctctgctcctgatacga | W49194 | 47409 | tatgglgtccctlctacttgalggcc | AA027420 | 90013 | gctgcctgcaatggglgccatt | Z47352 |
| 4806 | ctgtcctgatacagagaattggat | W49194 | 47410 | tccctlctacttgatggccaaggaa | AA027420 | 90014 | tctccatggaactctctgtctcc | Z47352 |
| 4807 | tctcctgatacgagaattggatlcc | W49194 | 47411 | gaaccacacaggagctctagacagt | AA027420 | 90015 | tggaactctctgtctccctcttt | Z47352 |
| 4808 | ggaaccatcacacaggaacgatlct | W49194 | 47412 | agcgccagtggatctagacagaga | AA027420 | 90016 | cctcttlccctlatgtcaacgtg | Z47352 |
| 4809 | accatcacacacaggaacgatlctctc | W49194 | 47413 | gacggatgcctcatlcagacgcacc | AA027420 | 90017 | gctgtccaaggctgtgatatgttttg | Z47352 |
| 4810 | caggaacgatlctctgcctgct | W49194 | 47414 | ggatagccatlcagacgaccatc | AA027420 | 90018 | tgtttgattcaggctctatgtagc | Z47352 |
| 4811 | ttccaacctgtccctcagtataga | W49194 | 47415 | catccggaacagttctcccagtgc | AA027420 | 90019 | gatlcagctctatgtagcatcctc | Z47352 |
| 4812 | cactgtggtlgcgcgtggccctlg | W49194 | 47416 | gaacgagtlcccagtlccacgcacggtc | AA027420 | 90020 | cagcaggccatgaacagccagcc | Z47352 |
| 4813 | tgaacgcgcctggccatgctca | W49194 | 47417 | ccagtgcacggtcatcactactcga | AA027420 | 90021 | altcaggctctatgtagcatcctct | Z47352 |
| 4814 | cagtctatgtcttcactcacgcagac | W49194 | 47418 | cacggtcatcactalcgcacacagg | X56007 | 90022 | ccagaacactgtcacaacgtggcc | Z47352 |
| 4815 | tctatgtcttcactcacgcagactgc | W49194 | 47419 | catcactatcgcacacagggtcgcac | X56007 | 90023 | cactggtcacaacgtggccacgag | Z47352 |
| 4816 | tctcctcagcgccaagtggccactg | W49194 | 47420 | cactlgttgcacagagaagatgaa | X56007 | 90024 | ccacgagctccatgaagaagctc | Z47352 |
| 4817 | ctgagccgccaagtggccactggt | W49194 | 47421 | tgagaacctggccacttlgtcatg | X56007 | 90025 | gtccctcatgaagaagctgtggcc | Z47352 |
| 4818 | cgccaagtlgggcactggcttcacag | W49194 | 47422 | cgctgccaatatlgccacagacgat | X56007 | 90026 | agacaacttlcctgtcatcagag | Z47352 |
| 4819 | actggctcacagcttlctgtctct | W49194 | 47423 | ggacaagttgctgccgtggccgcc | X56007 | 90027 | ctttlcctgtcatcagagggcgag | Z47352 |
| 4820 | ggcttcacagcttlctgtctgta | W49194 | 47424 | ccacactcctgtggatgctctg | X56007 | 90028 | ggagcaaatcccgtgaaggggcaag | Z47352 |
| 4821 | gcttctcttctgtatactaaagg | W49194 | 47425 | tctctgtgalgcttctcggaatgt | X56007 | 90029 | cagacctgctcagagaggacaaag | Z47352 |
| 4822 | tctlgtctgtatactaaaggttg | W49194 | 47426 | caacttctcacctagcctgatgcc | X56007 | 90030 | aagctgatccacgaagglgtgcc | Z47352 |
| 4823 | tgtctgtatactaaaggttgctt | W49194 | 47427 | ctagcctgatgccacacaatttcc | X56007 | 90031 | cagagctcggtccatlgtaccagc | Z47352 |
| 4824 | acgcgctctggccatgctcagat | W49194 | 47428 | tgatgccacacaatltccaacatc | X56007 | 90032 | ctggccatlgtaccaggccagcta | Z47352 |
| 4825 | gttgcttlattgtcaccatltcaat | W49194 | 47429 | caacatcttccaacttagcttage | X56007 | 90033 | catlgtaccaggcagcctagccag | Z47352 |
| 4826 | gctccttlggccatgctcagatatc | W49194 | 47430 | ctccaacttagcttagccagaga | X56007 | 90034 | tgcctlaggccccagccagctgac | Z47352 |
| 4827 | tggccatgctcagatatcctcaag | W49194 | 47431 | acctlagtlagccagacagagaga | X56007 | 90035 | aggtccccagccagctgacacagaagg | Z47352 |
| 4828 | cccatgctcagatatcctcagcga | W49194 | 47432 | ccttggccactlgtcatgtcct | X56007 | 90036 | cagcagctgacagaagggggctct | Z47352 |
| 4829 | atgctcagatatcctcaagcgaaac | W49194 | 47433 | ccactgctlcatgtcatgttcgct | X56007 | 90037 | ttctccacagagctgggglgcag | Z47352 |
| 4830 | tatcctcaagcgaaacatccagcag | W49194 | 47434 | tgtcatgttlccctgctaatlggcagc | X56007 | 90038 | ccacagagctggggtgcagccccaa | Z47352 |
| 4831 | cctcaagcgaaacatccagcagtac | W49194 | 47435 | tcctactatggcaaaagtlccat | X56007 | 90039 | ggtcagcccaacatgtgatllg | Z47352 |
| 4832 | gtacaacagcttlgtgcatgctgcc | W49194 | 47436 | ctatactcagcctltggcggctgta | X56007 | 90040 | gcccaacatgtgatlltgaatgag | Z47352 |
| 4833 | aagatggatgccacacgccaatgatg | M73329 | 47437 | tgttgaatgccgatcaagcggtgta | X56007 | 90041 | atccacgaaggtggtgccacactct | Z47352 |
| 4834 | gatgccacacgccaatgatgtgctt | M73329 | 47438 | atgccgtcatcaagcgtgccaatat | X56007 | 90042 | cacatctgtcgcgggatgatgtc | Z47352 |
| 4835 | tttatlagtctactcaacgaagaag | M73329 | 47439 | catcaacgctgccaatatlgccaca | X56007 | 90043 | tatgtcgggatgctcgaaata | Z47352 |
| 4836 | gaggacctctaaagcaacgcccaaa | M73329 | 47440 | gaatltcaacgcacaacatlccg | X56007 | 90044 | aacacattctatgacatlgggccg | D17571 |
| 4837 | gacctctaaagcaacagcccaatgc | M73329 | 47441 | cgcaacatcgatcccatgagc | X74216 | 90045 | gacatcggccgagtlgggccca | D17571 |
| 4838 | ctctaaagcaacagcccaatgcacc | M73329 | 47442 | cagagtlcgttlgacccactlcaacc | X74216 | 90046 | gggccctgccgagtttlgggccgtg | D17571 |
| 4839 | aacagcccaaatgcacccactlatata | M73329 | 47443 | tgcttlgacccacttlcaacctact | X74216 | 90047 | tggccctlaggccgagccgctgtcc | D17571 |
| 4840 | ggactctlaccagaagagcaa | M73329 | 47444 | gccctlcaaggctgtgtgacaaagt | X74216 | 90048 | ctlaggcagccgctlccatlgta | D17571 |
| 4841 | ggataaactgttlctlagctgtaaat | M73329 | 47445 | aacagcacagcacacagcagtgaca | X74216 | 90049 | gtggaaacctgtccatlgagc | D17571 |
| 4842 | tctctaaacttgttctltagctgcac | M73329 | 47446 | gacaacagcgccaaaagcagtgaca | X74216 | 90050 | cctgtccatlgaggccagatgacaa | D17571 |
| 4843 | tgttlctlagctgcactgttgaaa | M73329 | 47447 | gggaacagccacctcactgctgct | X74216 | 90051 | ctggcatccatlgctcaggatcacc | D17571 |
| 4844 | ttagctgcactgttlgaaaataaacaa | M73329 | 47448 | agccactcctactgctgctact | X74216 | 90052 | ggatcaccatlgaggtcc | D17571 |
| 4845 | gccatgccaatgatgtgcttctc | M73329 | 47449 | tctactgctgctactcgcgt | X74216 | 90053 | atcaccatcattcgaggtcccca | D17571 |
| 4846 | acagccaatgatgtgcttctccat | M73329 | 47450 | tgctgctactcgctgtlgcgc | X74216 | 90054 | aaccaaggtlcacatatagtctg | D17571 |
| 4847 | gtgccttctccatgaagtcaagg | M73329 | 47451 | tcccgagtlcctccgatlgctctc | X74216 | 90055 | agtgctgctllcactgctgcac | D17571 |
| 4848 | tcccatatgaagtcaagggttttc | M73329 | 47452 | cattcagtlgaccctlcaatggagacaagtg | X74216 | 90056 | gctgctlgttlcactgctgcaccaa | Y07711 |
| 4849 | tttccaaccagccaacagaagctaa | M73329 | 47453 | gatccaatgagcaagtlgggcaagaa | X74216 | 90057 | ttcactgctgccaccatlgcccttg | Y07711 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4850 | tcaccagccaacaagaagctaactc | M73329 | 47454 | atgtcctggccacaaaacagatct | X74216 | 90058 | gtgcttgctgaggtagaagccta | Y07711 |
| 4851 | ccagccaacaagaagctaactccaa | M73329 | 47455 | ctggccacaaaacagatcgcaaag | X74216 | 90059 | cctgctctgctgctaggttgtg | Y07711 |
| 4852 | aagctaacctccagaatgtatgaa | M73329 | 47456 | actgacctgctgctccaggacgat | X74216 | 90060 | cgtctaggttggccacagctaag | Y07711 |
| 4853 | gcaatccttactccagaaaacagcg | M14647 | 47457 | aactcgcgccaatctactctgg | X74216 | 90061 | ctctcgatggccacgtccttgcg | Y07711 |
| 4854 | ctaactccagaaaacaggcggcaag | M14647 | 47458 | aatcctatccggacctggcatcc | X74216 | 90062 | atggccacgtccttgtcggaagg | Y07711 |
| 4855 | ttctggtcgtcatggtcagattgc | M14647 | 47459 | gagcctggcatccagagttgcttga | X74216 | 90063 | cactgaggccagtccttgcctcac | Y07711 |
| 4856 | aacaggtgtctctagaaccttatgc | M14647 | 47460 | gaaggcaccagctgaaggaacatcc | X74216 | 90064 | tgaggccagtcctgcctcacct | Y07711 |
| 4857 | agaacctgtagaacgcgtgcgca | M14647 | 47461 | tgaaggaacatccactttaagag | AA027445 | 90065 | tgccctgaccaggcctcagcatg | Y07711 |
| 4858 | tacctcaggtcctgaagttgtctg | M14647 | 47462 | cgaaccaatgagctgttcatgacg | AA027445 | 90066 | cctcagcatggcctacaagtattga | Y07711 |
| 4859 | gatgttcataacaactgctgaa | M14647 | 47463 | aaccaatgagctgttcatgacgtt | AA027445 | 90067 | catggcctacaagtattgaggctcc | Y07711 |
| 4860 | tgctgaacatctatccctctct | M14647 | 47464 | gttcatgacgttatactgagtc | AA027445 | 90068 | tgggctcaaccctgcctctg | Y07711 |
| 4861 | atccctctctgtctcttagaag | M14647 | 47465 | ttcttgaaaagctccacactcgg | AA027445 | 90069 | tgggccagtatcgtgctgtctcca | Y07711 |
| 4862 | tgtctctagaaggtccctggtgat | M14647 | 47466 | ttgaaaagctccacactcggtgag | AA027445 | 90070 | cccagatcgcgctgctgctccagg | Y07711 |
| 4863 | tcgtgatctagacctttcaaagcacc | M14647 | 47467 | aaagtccacactcggtgagtcat | AA027445 | 90071 | gcatctacgaccggggcctcgcg | U78109 |
| 4864 | ttggtgcctttctagatgagttgt | M14647 | 47468 | agctccacactcggtgagtcatga | AA027445 | 90072 | tctacgacctgggcctcggcgcct | U78109 |
| 4865 | aacgcggagcaagtccaccagaca | M14647 | 47469 | ccacactctggtgagtcatgaggtt | AA027445 | 90073 | gccgaccggcctatgaggagacgaggt | U78109 |
| 4866 | actgatctttgcaaatgctaaatt | M14647 | 47470 | acactctggtgagtcatgaggtgt | AA027445 | 90074 | cgacggcctatgaggacgaggtgtc | U78109 |
| 4867 | gtccaccagacacatcggaagacc | M14647 | 47471 | actctgggtgagtcatgaggttgtc | AA027445 | 90075 | cctctcggagtgcacgccgcta | U78109 |
| 4868 | tccatcactatttcaagcctggg | M14647 | 47472 | ggaacatccactttaagagctgt | AA027445 | 90076 | gccgctaccacgcgcaagagct | U78109 |
| 4869 | gctcttccacatgtacctgatatc | M14647 | 47473 | catcactttaagagctgtatat | AA027445 | 90077 | gacccgtcgagaactgactcac | U78109 |
| 4870 | ccacagtacctgatactctgtgt | M14647 | 47474 | tccacttttaagacgctgtatatac | AA027445 | 90078 | cctcgctagaactgactcacata | U78109 |
| 4871 | gtacctgatactctgtgtcaagaa | M14647 | 47475 | gctgtatatacatccatccacctt | AA027445 | 90079 | gaactgacttcacataaagtgtggg | U78109 |
| 4872 | taccagagctgttgcaagtgact | M14647 | 47476 | catccaactgcatcacaaataag | AA027445 | 90080 | ctgactcacataaagtgtggaac | U78109 |
| 4873 | tatactttcgtcgtcatgtcag | M14647 | 47477 | tctccactgcatcacaaataagtt | AA027445 | 90081 | agtatcgctctgctccagggcc | U78109 |
| 4874 | agctacggcattcgtacagact | W49285 | 47478 | tccactgcatcacaaataagtag | AA027445 | 90082 | ttcgaaacttctccggctgc | U78109 |
| 4875 | cctacagaaatccggcattcgtaca | W49285 | 47479 | cactgcatcacaaataagttagac | AA027445 | 90083 | gagagacttttctccctgggtccg | U78109 |
| 4876 | taagacaatggctgcttagccaag | W49285 | 47480 | tgcctctgcagcctacactggcat | AA027445 | 90084 | tgggctacacgtcggatgagaccgt | U78109 |
| 4877 | acaatggctgcttagccaaggcca | W49285 | 47481 | tagataaccataccctcttct | AA027445 | 90085 | tctaacagtcggatgagaccgtgt | U78109 |
| 4878 | gctgcttagccaaggccatcgaaa | W49285 | 47482 | tattttctaacgcdggactgagc | D16141 | 90086 | acacgtcggagaacggtcgtgtt | U78109 |
| 4879 | tgcttagccaaggccatcgaaaag | W49285 | 47483 | tctaacgctgaactgagcdggcca | D16141 | 90087 | cggcatcacgaccdggccttcg | U78109 |
| 4880 | ttagccaaggccatcgaaaagacg | W49285 | 47484 | gcctgactgacgctggccagtcatt | D16141 | 90088 | tccgatcacgacctgggccttcg | U78109 |
| 4881 | gtgtattttcacacctgatgaca | W49285 | 47485 | actgagctgccagtcatttctaaag | D16141 | 90089 | cgtcgcgtcatggtggagcatcatc | U78109 |
| 4882 | gttattttcacacctgaccttgat | W49285 | 47486 | ctggccagtcatttctaaagcagttt | D16141 | 90090 | cgtctgcatgttcctttccttcact | U78109 |
| 4883 | tttttcacacctgatgacaat | W49285 | 47487 | tggtacttgctccggccgttgg | D16141 | 90091 | caactctcacaaactctccctgagg | D50096 |
| 4884 | cacacctgatgacaatgagaaga | W49285 | 47488 | gtatgtggtcctgactagag | D16141 | 90092 | caactctgctgtccaggagccaa | D50096 |
| 4885 | atgcaatgttccagtctcttat | W49285 | 47489 | tgtggctcctgactagagactgt | D16141 | 90093 | tctgtccaggagccaaagccga | D50096 |
| 4886 | caagaaatccggcattcgtacagact | W49285 | 47490 | atgggcttccctgagatgccacct | D16141 | 90094 | tgatgctgagaccggttgtggagca | D50096 |
| 4887 | gaaatccggcattcgtacagactg | W49285 | 47491 | gtagagtccacctcggcttctcg | D16141 | 90095 | atttacagaaatcatctccatcc | D50096 |
| 4888 | aatccggcattcgtacagactgaa | W49285 | 47492 | gcaggcatgacctcggttgctccc | D16141 | 90096 | cagaaatcatctcatctccctag | D50096 |
| 4889 | gggtctatcgcgctgaggtta | W49285 | 47493 | tcgtccacctcggtcttgcct | D16141 | 90097 | atcatcctttaggtagaccatta | D50096 |
| 4890 | ggtgtatcgcgctgaggttaca | W49285 | 47494 | cttaacgaccgaaccdgtgactagt | D16141 | 90098 | agatctaccaagatccacgagct | D50096 |
| 4891 | ctatcagcgctgaggttacactga | W49285 | 47495 | acgagcccgctgactgatgctgggc | D16141 | 90099 | taccaagatccacggaggaagctggacag | D50096 |
| 4892 | atcagcgctgaggttacactgagg | W49285 | 47496 | cactccataccgtactctccttttc | D16141 | 90100 | gatccacgagagcttgacagaatgt | D50096 |
| 4893 | atgctgctccaggtgagaagt | W49285 | 47497 | atacctacttcctctccttccag | D16141 | 90101 | tgcctcgtttaccgcggactgaga | D50096 |
| 4894 | actcagttatcactgtcagttcg | W49285 | 47498 | tacttcctttcctccaagcagagt | D16141 | 90102 | cgtctaggttggggtttatgccaat | D50096 |
| 4895 | tcagttatcactgtcagttctgca | W49290 | 47499 | cttctcctcaagcagagtatttt | D16141 | 90103 | cagaagcttccatgcgtaccaa | D50096 |
| 4896 | tgcagtttcccaaagtgcctggaa | W49290 | 47500 | cacgccatgggcctctgagagat | D16141 | 90104 | cttccgatggcgtaccaacagctc | D50096 |
| 4897 | tcccaaagtgcctgaagaacgcgag | W49290 | 47501 | atgggcctctgagagatcccttaga |  | 90105 | acagtcttcactgcaagctgca | D50096 |
| 4898 | gaaacatggcgcgttgatgctcaa | W49290 | 47502 | agatcctagaatcccagtgggtccc |  | 90106 | cttccgcaagttgcaagccac | D50096 |
| 4899 | acatggcgcgttgatgctcaacac | W49290 | 47503 | gatcctagatcgaggcgggtccct |  | 90107 | ctgcaagctgcaagcgcaacactct | D50096 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4900 | tggatgtcaacaccgtgttcaagga | W49290 | 47504 | atcctagatccagcggtgccctc | | 90108 | gcttgcaagccacaacctccacaa | D50096 |
| 4901 | ggatgtcaacaccgtgttcaaggag | W49290 | 47505 | tgggcctccgagagatccttagat | | 90109 | gctaggtatcgcagcaggaaccg | AA119868 |
| 4902 | gatgtcaacaccgtgttcaaggagt | W49290 | 47506 | gggcctccgagagatccttagatc | | 90110 | ctctaggtatcgcagcaggaaccga | AA119868 |
| 4903 | tgtcaacaccgtgttcaaggagtta | W49290 | 47507 | ggcctccgagagatccttggaga | | 90111 | gggcctggcttccgatcttggaga | AA119868 |
| 4904 | gtcaacaccgtgttcaaggagttag | W49290 | 47508 | gcctccgagagatccttagatcc | | 90112 | ggcctggcttccgatcttggaagaa | AA119868 |
| 4905 | tcaacaccgtgttcaaggagttagt | W49290 | 47509 | cctcctgagagatccttagatccag | | 90113 | gctggcttccgatcttggagaat | AA119868 |
| 4906 | agtttataccttcgagttcgcagt | W49290 | 47510 | ctccgagagatccttagatccagc | | 90114 | cctggcttccgatcttggagaatg | AA119868 |
| 4907 | tactctgagttcgcagttttcc | W49290 | 47511 | agagatccttagatccagcggtgcc | | 90115 | ctggcttccgatcttggagaatgt | AA119868 |
| 4908 | actctgagttcgcagttttccca | W49290 | 47512 | gagatccttagatccagcggtgcc | | 90116 | tggcttccgatcttggagaatgtg | AA119868 |
| 4909 | ctctgagttcgcagttttcccaa | W49290 | 47513 | tgggcctccgagagatccttagat | | 90117 | ggcttccgatcttggagaatgtga | AA119868 |
| 4910 | tctgagttctgcagttttcccaaag | W49290 | 47514 | gggcctccgagagatccttagatc | | 90118 | gcttccgatcttggagaatgtgaa | AA119868 |
| 4911 | ctgagttctgcagttttcccaaagt | W49290 | 47515 | atcctagatccagcggtgccctc | | 90119 | ttccgatcttggagaatgtgaagg | AA119868 |
| 4912 | tgagttctgcagttttcccaaagtg | W49290 | 47516 | tcctagatccagcggtgccctcc | | 90120 | taagtctgaattgatgtggcctcgg | AA119868 |
| 4913 | ctgcagttttcccaaagtgctgga | W49290 | 47517 | ccttagatccagcggtgccctcca | | 90121 | aggtatcgcagcaggaaccgaagta | AA119868 |
| 4914 | tgtagagcagatccttggtatg | M98502 | 47518 | cttagatccagcggtgccctccaa | | 90122 | ggatcgcagcaggaaccgaagtac | AA119868 |
| 4915 | gcagattccttgcgtattggtcaac | M98502 | 47519 | ttagatccagcggtgccctccaac | | 90123 | gtatcgcagcaggaaccgaagtacg | AA119868 |
| 4916 | tcttttacattatgctgtgcaggt | M98502 | 47520 | tagatccagcggtgccctccaacc | | 90124 | tatcgcagcaggaaccgaagtacgc | AA119868 |
| 4917 | tgctgtgcaggtgtacagttagt | M98502 | 47521 | agatccagcggtgccctccaacca | | 90125 | atcgcagcaggaaccgaagtacgcc | AA119868 |
| 4918 | tgaggcacactgtctgaactctg | M98502 | 47522 | gatccagcggtgccctccaaccag | | 90126 | accattgggctgcttccgatctt | AA119868 |
| 4919 | gaatatgctacatctgtccggtca | M98502 | 47523 | atccagcggtgccctccaaccagg | | 90127 | cattgggctgcttccgatcttg | AA119868 |
| 4920 | gctacactggtccgtcagtgtga | M98502 | 47524 | tccagcggtgccctccaaccagga | | 90128 | tgggcctggcttccgatcttggag | AA119868 |
| 4921 | gtcatgccgttgcaaagcaacat | M98502 | 47525 | ggcctccgagagatccttagatc | | 90129 | tcccgtctgcaaccagcaggcagg | AA119868 |
| 4922 | ttattagcttgcagaagaagaga | M98502 | 47526 | gcctccgagagatccttagatcc | | 90130 | tctgcaaccagccaggcaacta | AA110440 |
| 4923 | aaacagcaggaaccagtgctaggc | M98502 | 47527 | cctccgagagatccttagatcca | | 90131 | tgaacaaacttgtgtcaagcaggg | AA110440 |
| 4924 | ggtatacacatatatccgactct | M98502 | 47528 | ctccgagagatccttagatccag | | 90132 | gtccgagacactctggtctcc | AA110440 |
| 4925 | agcagcctagtctacgtgtaggaa | M98502 | 47529 | agagatccttagatccagcggtgc | | 90133 | aggcacttcggtcttccgtgatg | AA110440 |
| 4926 | tccctgtattggtcaaccatcct | M98502 | 47530 | gagatccttagatccagcggtgcc | | 90134 | ttctggttccgtgatggtctg | AA110440 |
| 4927 | ccatcctagttcgtctatagct | M98502 | 47531 | agatccttagatccagcggtgccc | | 90135 | tgggtcccgtgatggggtcgtca | AA110440 |
| 4928 | tagtctgtctatagctctatta | M98502 | 47532 | gatcctggttcgactttgctg | | 90136 | gggtctcaggcatccagcagga | AA110440 |
| 4929 | taaactcaaaaccactgagtact | M98502 | 47533 | cctgaagctgacttggtgtt | | 90137 | agggcatccagcaggaaccgggcaa | AA110440 |
| 4930 | ttggtaatctcaaactcatgatag | M98502 | 47534 | tgaagctgacttggtgtcac | | 90138 | aagaaccggggcaatggctgcatgc | AA110440 |
| 4931 | atctcaaactcattgatagtagagc | M98502 | 47535 | ttcagcgtgttctacctgatgct | | 90139 | accgggcaatggctgcatgtcaca | AA110440 |
| 4932 | cctctcgattttcatgaagattcat | M98502 | 47536 | agcgcgttctacctgatgatctgga | | 90140 | atggctgcatgtcacagaagataag | AA110440 |
| 4933 | cggtcatgatcatcttacattat | M98502 | 47537 | gcgttctacctgatgatctgagc | | 90141 | gcaaccaggcaggcaactacttctt | AA110440 |
| 4934 | tatagaaaacaccctgggtgaagg | M98502 | 47538 | ttctacctgatgatctggagcgtt | | 90142 | aggcaggcaactacctctggctg | AA110440 |
| 4935 | gccaggcagtcatcaggagagacc | L29503 | 47539 | ctgatgatctggagcgttgcacag | | 90143 | caggcaactacctctggtctgtca | AA110440 |
| 4936 | tattctccaagaccacagcctg | L29503 | 47540 | atctggagcgttgcacagttgac | | 90144 | gcaactacctctggtctgcagg | AA110440 |
| 4937 | ttccaagcaacagcctaagttgg | L29503 | 47541 | acagattgactaatcctaatcgac | | 90145 | ttctggctggggagtacagt | AA110440 |
| 4938 | gaccacagccttgactgggaagaat | L29503 | 47542 | gattgactaatcctatacagag | | 90146 | atgttgccaataatcgcgctgcca | AA110440 |
| 4939 | gaagagccccaaatacggggaaag | L29503 | 47543 | ctaatcctatacagcaggattgtc | | 90147 | ttgccaatcgctcgctgcatct | AA110440 |
| 4940 | tgagcacctgaaccaaaacctggag | L29503 | 47544 | atacagcaggatgttgttgcgggcg | | 90148 | aaggctcctggaacaatgggcatga | AA110440 |
| 4941 | atctcgtttggccgctggggga | L29503 | 47545 | ctggtctggctgcaggaagaac | | 90149 | tctgagcctcgacagacccttca | AA110440 |
| 4942 | tatgttccacacctcgtgccctc | L29503 | 47546 | gtcctggtctgcagaaggaacaag | | 90150 | ctgcagtcctgacgacccttcat | AA110440 |
| 4943 | tatttctcgagaaccaatgtgtt | L29503 | 47547 | gatgctcctgaagactgtcgg | | 90151 | ctgttttcactccaagtagctga | AA110440 |
| 4944 | tactactggtgctgtaccgacac | L29503 | 47548 | gcttcctgaagactgttcggt | | 90152 | ctgttcactccaagtagttgaa | AA110440 |
| 4945 | cagacacaaacagcctaggtgctaa | L29503 | 47549 | tgcaagcttgtttgccgttcaga | | 90153 | tgtttcaccccaagtagctgaaa | AA110440 |
| 4946 | cagtcatcgaccaaccactgca | L29503 | 47550 | cctgtttggcgctcagagaataat | | 90154 | ttcactccaagtagctgaaaaag | AA110440 |
| 4947 | ctatgcaccagagtaataccagagt | L29503 | 47551 | gctcaatgattcagcgccgttctacc | | 90155 | tcactcccaagtagctgacaccttcat | AA110440 |
| 4948 | tgccaccaggatacgcgcacttc | L29503 | 47552 | caattgattcaggccgttcactga | | 90156 | tgcagtcgagacccttcatc | AA110440 |
| 4949 | ccaggatacgcaacttccatcatt | L29503 | 47553 | gcctgcaagccctcgcgatct | AA027491 | 90157 | cctgacgacccttcatccagggt | AA110440 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 4950 | gcacttcatcatgtgaactataga | L29503 | 47554 | ttgaagaagccttgcgatatcct | AA027491 | 90158 | tgacagacccttcatcccaggttt | |
| 4951 | ctatagaacatcaactctgcaaatg | L29503 | 47555 | gtcaccatgccgttgactgaatg | AA027491 | 90159 | cttcatcccaggglttcagtcctg | |
| 4952 | aacatcaaactctgcaaatgtggat | L29503 | 47556 | gatgatcatgcctctcagctccgg | AA027491 | 90160 | ttcatcccagggttctagtcctgt | |
| 4953 | aactctgcaaatgtggatatttct | L29503 | 47557 | gatcatgcctctctagctccgta | AA027491 | 90161 | tcatcccaggglttcagtcctgt | |
| 4954 | gatttgctgtcattcccaaagt | M37335 | 47558 | gcctctagctccggctacgcggag | AA027491 | 90162 | gtcccgttcactcccaagtagctt | |
| 4955 | ttgctgtcattcccaaagtgct | M37335 | 47559 | gtttgagcagcccaagatccggcga | AA027491 | 90163 | tcctgttcactcccaagtagctg | |
| 4956 | cattccttaaaatctcacatgca | M37335 | 47560 | tgagcccaagatccggcgaacgc | AA027491 | 90164 | tagtcagggactcctcccctctgca | |
| 4957 | tccctaaaatctcacatgcacac | M37335 | 47561 | gcagcccaagatccggcgaacagc | AA027491 | 90165 | agtcaggactcctcccctctgca | |
| 4958 | cttaaaatctcacatgcacaca | M37335 | 47562 | caagatccggcgaacgacgagagc | AA027491 | 90166 | gtccctgacagaccctcatcccag | |
| 4959 | agttaatcaactgcaagtgttcct | M37335 | 47563 | tcagctgagcgtcagcagtgttt | AA027491 | 90167 | cctgacagaccctcatcccaggt | |
| 4960 | taatcaactgcaagtgttccttca | M37335 | 47564 | gctgagtcgcagcagtgttcct | AA027491 | 90168 | cctatcccaggglttcagtcctg | |
| 4961 | tcaactgcaagtgttccttcattt | M37335 | 47565 | acgaagcttcgagatactcctgct | AA027491 | 90169 | ttcatcccaggglttcagtcctgt | |
| 4962 | actgcaagtgttccttcattctg | M37335 | 47566 | aagccttcgatactcctgtctc | AA027491 | 90170 | tcatcccaggglttcagtcctgt | |
| 4963 | gcaagtgttccttcattctgata | M37335 | 47567 | tccgatactcctgctctcctgtat | AA027491 | 90171 | tcctgttcactcccaagtagctg | |
| 4964 | tccttcattctgataagaagaattt | M37335 | 47568 | tgcctatctgccacttcgggtaga | AA027491 | 90172 | cctgttcactcccaagtagcttga | |
| 4965 | tttagaaactctcattactacaaatg | M37335 | 47569 | ctatctgccacttcggttagagaa | AA027491 | 90173 | ctgtttcactcccaagtagcttga | |
| 4966 | tgctgtcatcccaaagtgcttc | M37335 | 47570 | tctgccacttcggtagaggatct | AA027491 | 90174 | ttcactcccaagtagctgaaaag | |
| 4967 | cattccccaaagtgcttctgctg | M37335 | 47571 | gtagtgtcaccatgcccgttgaac | AA027491 | 90175 | tcactcccaagtagctgaaaaggt | |
| 4968 | ccaaagtcttctgctgttgaa | M37335 | 47572 | gttgtcaccatgcccgttgactgg | AA027491 | 90176 | ccctctgcagtcccctgcacgaccc | |
| 4969 | aagtgcttctgtcgttgaaga | M37335 | 47573 | aagctcgggccatgagcacttac | AA027491 | 90177 | ccctctgcagtcctgcacgaccct | |
| 4970 | tgcttctgcgttgaaagagat | M37335 | 47574 | ggcctagcacttaccaggcatt | AA027491 | 90178 | cctctgcagtcctgcacgaccct | |
| 4971 | acttgagacttgtctgggcaat | M37335 | 47575 | caccagacaggatgctctacaac | AA027491 | 90179 | tctgcagtccctgacagacctca | |
| 4972 | tgagacttgtggccaatata | M37335 | 47576 | tcctgctccaactagagccagag | AA027491 | 90180 | ctgcagtccctgacagacccttat | |
| 4973 | gaaaccatcaagatcaaggaaggt | M37335 | 47577 | caactagagccagagtctcaga | Z22216 | 90181 | tgcagtccctgacagacccttcatcc | |
| 4974 | caagaagaacctctagcacagatct | W49298 | 47578 | ctagagcccagagtcttcagaa | Z22216 | 90182 | cagtccctgacagaccctcatccc | |
| 4975 | agaagaacctctagcacagatctag | W49298 | 47579 | gagcccagagtcttcagaagaaga | Z22216 | 90183 | agtccctgacagacccttcatcca | |
| 4976 | gctgactgcgaggttgcagattgg | W49298 | 47580 | tggcgctgctggctctttttcaga | Z22216 | 90184 | cacatcaacatcttcctaatcgcaa | |
| 4977 | ctgactgcgaggttgcagatttgt | W49298 | 47581 | cgcgctgtgggtcttttcagaggt | Z22216 | 90185 | catcaacatcttcctaatcgcaac | |
| 4978 | actgtctcctcaactggatgct | W49298 | 47582 | gctctttcagaggttccagcca | Z22216 | 90186 | cgcaaccggtcaactgatgtagag | |
| 4979 | taacctgatgctgtgtctgtgct | W49298 | 47583 | tcttttcagaggttccaggcaagg | Z22216 | 90187 | aaccggtcaactgatgatgagatgt | |
| 4980 | aacctgatgctgctgttgtgctg | W49298 | 47584 | aggttccagccaagggcatgacaag | Z22216 | 90188 | gctgcttcgattgcctgtgctt | |
| 4981 | ctggatgctgtctgttgtctgtat | W49298 | 47585 | catgagcactaccaggcattt | Z22216 | 90189 | cttcgatttgcctgtgctttagag | |
| 4982 | ttgctgtctgtatccggaaag | W49298 | 47586 | ttcccaggccaagggcatgcaagctt | Z22216 | 90190 | tcgaatgtgcctgctcttaagaa | |
| 4983 | tgtctgtctgtatccggaaag | W49298 | 47587 | cacttaggccaggcattttacagac | Z22216 | 90191 | gtgcctgctgttagagaagctggaa | |
| 4984 | agtctatcaacagttggagattt | W49298 | 47588 | ttacgcaggcattttacagaccac | Z22216 | 90192 | agactatgctgacgatcagtgagtg | |
| 4985 | gtctatcaacagttgggagattt | W49298 | 47589 | gtagctgcgcaagccccaagtta | Z22216 | 90193 | tatgctgacgatcagtgagtggc | |
| 4986 | gaagaacctctagcacagatcagc | W49298 | 47590 | gctgcaggccccaagccccaagttagg | Z22216 | 90194 | tatgctgacgatcagtgagtggccc | |
| 4987 | gaacctctagcacagatctgaa | W49298 | 47591 | aacctcagcacagacacccgctc | Z22216 | 90195 | tgctgacgatcagtgagtggccca | |
| 4988 | acctctagcacagatctgact | W49298 | 47592 | tgctgcatcaccagacaggatgg | Z22216 | 90196 | catcttccaatcgcaaacgtagat | |
| 4989 | tctagcacagatctagctgactcg | W49298 | 47593 | cataaccaggaccagggatgctccac | Z22216 | 90197 | tcctaaatcgcaaacgtagattg | |
| 4990 | ctagcacagatctagctgactgcg | W49298 | 47594 | ataacctgaagtgctgacatcac | X15267 | 90198 | ttcctaaatcgcaaacgtagattg | |
| 4991 | gatctagctgaggttgcag | W49298 | 47595 | aaacctgaagtgctgacatcacag | X15267 | 90199 | atcgaaactagatgtgcaagt | |
| 4992 | ctagctgactgcgaggttgcagatt | W49298 | 47596 | ctgacatcacagagcaggccctgc | X15267 | 90200 | ggcaagtgcagcaaccggtcaac | |
| 4993 | tagctgactgcgaggttgcagatt | W49298 | 47597 | tcgaatcacagagcaggccctgca | X15267 | 90201 | caagtgcacagcaaccggtcaactg | |
| 4994 | caaggcgggctcgccaatacttg | L28835 | 47598 | cgaatcacagagcaggccctgcac | X15267 | 90202 | agtgcaagacaaccggtcaactgat | |
| 4995 | agccgctcgccaatacttctc | L28835 | 47599 | catccagagcagcaggccctgcactct | X15267 | 90203 | tgcacgaccaaccggtcaactgatgt | |
| 4996 | tctgctgcttcttctgcatg | L28835 | 47600 | cagagcaggccctgcactctcgtt | X15267 | 90204 | agattccatgctcaaacactgaa | |
| 4997 | cagtgctttgtgtccagatgagg | L28835 | 47601 | agcaggccctgcactctgctttct | X15267 | 90205 | attctccatgctcaaacactgaaaa | |
| 4998 | gggcctctgcaatgaactgacgggg | L28835 | 47602 | gcccctgcactctcgtttctggag | X15267 | 90206 | taacaaccttcatgcacttaggct | |
| 4999 | gatgtgacccttcagtcatc | L28835 | 47603 | gactgagtacaccttcccactact | X15267 | 90207 | cttatgctgtggttctggcttac | |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5000 | gacaccttgcagttcatcaacatc | L28835 | 47604 | actgagtacaccttccacttactg | X15267 | 90208 | tatggctggttctggcttaacag | AA110466 |
| 5001 | ttgcagttcatcaacatcaactat | L28835 | 47605 | ctgagtacaccttccacttactga | X15267 | 90209 | gtttcggcttacagagtgcgccga | AA110466 |
| 5002 | caacatcaactatgtgccccgcag | L28835 | 47606 | acccgaagtgctgacatcacaga | X15267 | 90210 | ggcttacagagtgcgccgatttca | AA110466 |
| 5003 | ggtgctctttgccaacatggcagt | L28835 | 47607 | ccctgaagtgctgacatcacacag | X15267 | 90211 | cttacagagtgcgccgatttcaga | AA110466 |
| 5004 | ctttgcaacatggcagtctgtc | L28835 | 47608 | ctgaagtgtcgacatcacagaca | X15267 | 90212 | tacagagtgcgccgatttcaggtt | AA110466 |
| 5005 | caacatggcagctctgttctgtat | L28835 | 47609 | tgaagtgctgacatcacagagcag | X15267 | 90213 | cagagtgcgccgatttcaggttga | AA110466 |
| 5006 | atactgtctgctctaaagctctac | L28835 | 47610 | gaagtgctgacatcacagagcagg | X15267 | 90214 | gtgcgccgatttcaggttgactaa | AA110466 |
| 5007 | gctcaccccggtgctcaccaagca | L28835 | 47611 | agtgctgacatcacagagcaggcc | X15267 | 90215 | cgattttcaggttgactaagacgtg | AA110466 |
| 5008 | gctcaccaaagcagtcagcagggc | L28835 | 47612 | gtgctgacatcacagagcaggccc | X15267 | 90216 | tccatgctcaaacactgaaaataag | AA110466 |
| 5009 | caaagcagtcagcagggcatttg | L28835 | 47613 | tgctcgacatcacagagcaggccct | X15267 | 90217 | catgctcaaacactgaaaataagag | AA110466 |
| 5010 | agtcagcagggcatttgtcagc | L28835 | 47614 | gatcagccgatgcaaattgtgagc | X15267 | 90218 | tgctcaaacactgaaaataagagca | AA110466 |
| 5011 | tctggccaacgcgattgagaagaag | L28835 | 47615 | agagaagccgatgcaaattgtgag | X15267 | 90219 | gttttggccactatattaagactg | AA110466 |
| 5012 | tgtcaaggtccactggtcactac | L28835 | 47616 | gtgttgactgctgcaacgatgaaa | X15267 | 90220 | ttgagccactatattaagactgt | AA110466 |
| 5013 | tgccccaactttctgctgctgtc | L28835 | 47617 | tgttgactgctgcaacgatgaaag | X15267 | 90221 | tatatgaacttaacaaccttcacgc | AA110466 |
| 5014 | tgcctctgcctgaaagacactcagg | W49108 | 47618 | gttgactgctgcaacgatgaaagc | AA027544 | 90222 | gaacttaacaaccttcacgcact | AA110466 |
| 5015 | ctctgcctgaaagacactcaggaca | W49108 | 47619 | ttgactgctgcaacgatgaaagcg | AA027544 | 90223 | cttaacaaccttcagcacttatgg | AA110466 |
| 5016 | agccttacgctcaacatgaacggggg | W49108 | 47620 | tgactgctgcaacgatgaaagcgc | AA027544 | 90224 | atctgcctcaggcagcctagccgtt | AA110471 |
| 5017 | gggccaacgagagggcctgccttct | W49108 | 47621 | actgtctgcaacgatgaaagcggc | AA027544 | 90225 | tctgcctcaggcagcctagccgttg | AA110471 |
| 5018 | ccaacgagagggcctgcctgctgcc | W49108 | 47622 | aaagctgccgccatgtgccgcactg | AA027544 | 90226 | tggtgatccaaggcagctcaagcatg | AA110471 |
| 5019 | agtcctcgaacctgtgatcctcga | W49108 | 47623 | tggccgccatgtcgcgcactgtgt | AA027544 | 90227 | gtgagatccacaggcagtcaagcag | AA110471 |
| 5020 | gctgatccggacactggagctagca | W49108 | 47624 | ggccccatcgcgcactgtggt | AA027544 | 90228 | tgagatccacaggcagtgcatgagg | AA110471 |
| 5021 | gatctcggaacaccgtagcacgc | W49108 | 47625 | cgccatgtcgcactgtgtgact | AA027544 | 90229 | gagatccacaggcagtgcatgaggt | AA110471 |
| 5022 | acacacgtagcacgcgccaacagt | W49108 | 47626 | gccatgtcgcactgtgttgactg | AA027544 | 90230 | atacggggttctcgcaggagcag | AA110471 |
| 5023 | cacacgtagcacgcgccaacagtaac | W49108 | 47627 | catgtcgcactgtgttgactgc | AA027544 | 90231 | ataggttctcgcaggagcagtatg | AA110471 |
| 5024 | agcacgccaacagtaacgtgtgt | W49108 | 47628 | atgtgcgcactgtgttgactgtct | AA027544 | 90232 | gggttcgccaacagtaatg | AA110471 |
| 5025 | acgcccacagtaacgtgtgtgcg | W49108 | 47629 | tgtgcgcactgtgttgactgtctg | AA027544 | 90233 | ggtttcctgcaggagcagtattgt | AA110471 |
| 5026 | tgcctgaaagacactcaggacacaa | W49108 | 47630 | tcatagcagatcgctctcgtacaa | AA027544 | 90234 | ttcctgcaggagcagtattgtggc | AA110471 |
| 5027 | cgccacagtaagtggtgcgcc | W49108 | 47631 | tagcagatctgctctcgtacaa | AA027544 | 90235 | ttcctgcaggagcagtattgtggct | AA110471 |
| 5028 | gacaactgagacaagcctgagaa | W49108 | 47632 | ttagttaatttccatgctctcag | X66091 | 90236 | tgcctcagccagctagccgttgg | AA110471 |
| 5029 | actcaggacacaagcctgagaatgg | W49108 | 47633 | aatttccatgctcttcagactggaa | X66091 | 90237 | gcctcaggccagcctagccgtttgga | AA110471 |
| 5030 | tcgtctccgccagtttgatga | W49108 | 47634 | ttccatgctctcagactgtgatat | X66091 | 90238 | cctcaggccagcctagccgtttggag | AA110471 |
| 5031 | ttctccgccagtttgatgagag | W49108 | 47635 | ctatcttccagactgtgatatgt | X66091 | 90239 | tcaggccagcctagccgtttggagct | AA110471 |
| 5032 | tccgcccagtttgatgagagaca | W49108 | 47636 | ctatctgctctgttttgtgtgaaa | X66091 | 90240 | caggccagcctagccgttggagctt | AA110471 |
| 5033 | agagacagcctacgctcacatgaa | W49108 | 47637 | acatttcaatcattttaggattgtc | X66091 | 90241 | ggcagcctagccgtttggagctg | AA110471 |
| 5034 | gacagcctacgctcacatgaacgg | W49330 | 47638 | tatgactccaagtctattgtcaca | X66091 | 90242 | agttggggcagcgctgagatatg | AA110471 |
| 5035 | acgaagtcgcgtgactgttagga | W49330 | 47639 | tccaagtctattgtcacagatgaa | X66091 | 90243 | gcagcctcgagatatgtgtggaga | AA110471 |
| 5036 | agtcgcgtgactcttagcaaata | W49330 | 47640 | cagtatgacctatactagaaggc | X66091 | 90244 | tcctgacacgtcatcaagtacct | AA110471 |
| 5037 | cgatcatcacacattctggtgta | W49330 | 47641 | tattgacctatactagaagatgagg | X66091 | 90245 | tggaactgtcatcaagtaccgcc | AA110471 |
| 5038 | atcatcacacattctagtgcgtaat | W49330 | 47642 | tcgctctcgtacataagagtatgg | X66091 | 90246 | ggctacagtcagggcctaaactca | AA110471 |
| 5039 | catcacacattctagtggctaatg | W49330 | 47643 | tgtatacgttccttattcacttag | X66091 | 90247 | tcaggcctaaactcaggagcacag | D38614 |
| 5040 | tcacacattctagtgcgtaatgg | W49330 | 47644 | ctttaactcagtacaatctttcatt | X66091 | 90248 | cctaaactcaggagcacagccatag | D38614 |
| 5041 | atgtcgctcgtttgtcagacga | W49330 | 47645 | tttaattcaagctgtttgttcaga | X66091 | 90249 | ctcaaggacagccataagtgggg | D38614 |
| 5042 | ttgttgcagacgcatgactacata | W49330 | 47646 | tgtaatatcctttctcctaacatc | X66091 | 90250 | agtcattgcccagtttctggact | D38614 |
| 5043 | gcagagcgactgactacatagacga | W49330 | 47647 | atccctttctcctaacactactact | X66091 | 90251 | ccattgcccagtttctggactgt | D38614 |
| 5044 | gacgcatgactacatagacatgatga | W49330 | 47648 | tcctaacatctacattccctcag | X66091 | 90252 | gactgtggacctgctgaccatt | D38614 |
| 5045 | gactacatagcacgaaggtgcta | W49330 | 47649 | tcccctcatgtcttgtaacttta | X66091 | 90253 | ttgttgacctgctggaccaattgcc | D38614 |
| 5046 | ctacatagcacatgacaaggtgctaag | W49330 | 47650 | ggtctaccgcatgaggatgatgag | X66091 | 90254 | ctgctcgaccattcgtctgcttc | D38614 |
| 5047 | ctgcgtgacttcttaggagaaata | W49330 | 47651 | tgatgagcaactccagaccttc | X66091 | 90255 | tgtctctgctctgtgagctaccac | D38614 |
| 5048 | ggtcagtgctatacctctag | W49330 | 47652 | tatcacctgaggcaaagttcttgg | Z14252 | 90256 | acactgtcaagtacctgcctgg | D38614 |
| 5049 | aagtcgtatctcgctgagacatgg | W49330 | 47653 | ctctcagagctgtttgtacact | Z14252 | 90257 | tcatcaagtacctggcctgggccact | D38614 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5050 | gtcgctacccttgtagacatggcg | W49330 | 47654 | gtcctactattgcccaggatctga | Z14252 | 90258 | agtacctgcctggccactgcagga | D38614 |
| 5051 | catggcggcacagatgctgcacag | W49330 | 47655 | atctggattacccctggcgggctgatg | Z14252 | 90259 | gatatgggtcagcaccaggagccc | D38614 |
| 5052 | cacaggtcgctgcacgaaatggctt | W49330 | 47656 | attacccgggctgcgatgctgac | Z14252 | 90260 | aagccatagtcctagatctatccg | D38614 |
| 5053 | ggtcgctgcacagatggcttagat | W49330 | 47657 | gtctgacgcgggcttgtcgaggc | Z14252 | 90261 | ccatagtctagatcatccgccc | D38614 |
| 5054 | tcgctgcacgaaatggcttagatcg | W49330 | 47658 | ggagctattgcccagcctgggta | Z14252 | 90262 | gtgtgacccctcaggccctgtctg | D38614 |
| 5055 | gatctggaaccacgtctgattg | L28836 | 47659 | aatggacctcgaacctgactgt | Z14252 | 90263 | cccacagagcctgccaaggtcagg | D38614 |
| 5056 | tgattgtggtccaaacgctgtgg | L28836 | 47660 | gtactgtacctgatcctgcaagc | Z14252 | 90264 | cttctgaagtccttggccatgtat | X92352 |
| 5057 | agtttgccattttgatgaatgcac | L28836 | 47661 | ttacctgatcctgcaaggcgttaa | Z14252 | 90265 | ctgaagtcctgtgccatgtatcta | X92352 |
| 5058 | aatgcacaagtcggtcagtgtgga | L28836 | 47662 | ggccactctgtgccagcctctca | Z14252 | 90266 | cctgtcatttgcagtaaatatg | X92352 |
| 5059 | aggactacattacagccactgctg | L28836 | 47663 | tctgtgtgccagctctcagccga | Z14252 | 90267 | atgcctaagaggcctgcatatgatt | X92352 |
| 5060 | acagccactgctggaaggttggcat | L28836 | 47664 | cagcctgcttgtgcgccactg | Z14252 | 90268 | cctaagaggcctgcatatgattgag | X92352 |
| 5061 | tctttaccgttctcacagaaatg | L28836 | 47665 | tgctttggcgccacttgatgccc | Z14252 | 90269 | aggcttcgattgtatgtgactgtg | X92352 |
| 5062 | ccgtttctcacagaaatgccttg | L28836 | 47666 | gatgccaatagggaggcctccagat | Z14252 | 90270 | cttcgatttgatgtgactgtgata | X92352 |
| 5063 | ctcacagaaatgccttggaagca | L28836 | 47667 | gtatccatgttccagactgggaa | Z14252 | 90271 | tttatcattgacatgtgagttacag | X92352 |
| 5064 | gccttttgaagcaccacagctacta | L28836 | 47668 | catgttccagactggggaaagttca | Z14252 | 90272 | aatatgtcctgtgaattgtaa | X92352 |
| 5065 | ggaagcaccagagtcgagagacta | L28836 | 47669 | acatlccgatgcgctgctattac | Z14252 | 90273 | tggaacttactaagagtgctttg | X92352 |
| 5066 | accacagagtactacctgcatatgga | L28836 | 47670 | agaatcttaagcgcgtggccaagga | Z14252 | 90274 | atttcatatctgtcattcactga | X92352 |
| 5067 | agttatggcctctttttggaggcag | L28836 | 47671 | aatcttaagcgcgtggccaaggagc | AA153569 | 90275 | tcatatctgtcattcactgaaaa | X92352 |
| 5068 | tttatgtctccgaccctatat | L28836 | 47672 | tttttctactgcaagcacatgtgac | AA153569 | 90276 | attaatctggcgtgaatatat | X92352 |
| 5069 | ttcctcgcgaccctatatgaccct | L28836 | 47673 | tttctactgcaagcacatgtgacta | AA153569 | 90277 | tggaaacttactaagagtgctttg | X92352 |
| 5070 | tgacccctggaacactgagagacca | L28836 | 47674 | tactgcaagcacatgtgactagat | AA153569 | 90278 | cctcctaagaagtgctttgctattt | X92352 |
| 5071 | ggatctgaccagtgtcgtgaagga | L28836 | 47675 | ctgcaacgacatgtgactagatta | AA153569 | 90279 | cttatcctctagtgctttggccaa | X92352 |
| 5072 | ctgaccagtgctgaagagtactt | L28836 | 47676 | atttagtgccgcatttgtgaaa | AA153569 | 90280 | atcctctagtgctttggccaattg | X92352 |
| 5073 | atgacagttgggccaatcctga | L28836 | 47677 | ttagtgccgcattttgtgaaata | AA153569 | 90281 | ctctaggcttggccaatgact | X92352 |
| 5074 | agttggccactttgaatccgaga | L28836 | 47678 | agtgcctgcattttgaaatatg | AA153569 | 90282 | gtgcttgcaatgactgacttattg | X92352 |
| 5075 | tcgggccactgctgagcgcagaga | L28836 | 47679 | gtaactttagccatgacctgaatc | AA153569 | 90283 | ctttggccaatgacttattgtgc | X92352 |
| 5076 | cgggccactgctgagcgcagcacaca | W57339 | 47680 | aacttagccatgacctgaatctat | AA153569 | 90284 | agctgtaccaggcgtctctgt | AA110453 |
| 5077 | cagacaccatgctgagcgcccgcgaaag | W57339 | 47681 | ctttagccatgacctgaatctatt | AA153569 | 90285 | ctgtaccaggcgtctctgtctgga | AA110453 |
| 5078 | cagacaccatgctgagcgcccgcgaaaca | W57339 | 47682 | caagagttccgcatcatgaaaa | AA153569 | 90286 | tcctgatcaactccaggaagag | AA110453 |
| 5079 | caccatgctgagcgcccggaaagcca | W57339 | 47683 | ttagccatgacctgaatctattt | AA153569 | 90287 | tcctgatcaactccaggaagaga | AA110453 |
| 5080 | catggccgcggaaaagccaaggag | W57339 | 47684 | agagttccgcgcatcatgaaaaag | AA153569 | 90288 | ctgatcaacttcaggaagagaag | AA110453 |
| 5081 | caaatcatctggaactcggaaag | W57339 | 47685 | agtccgcgccatcatgaaaaagac | AA153569 | 90289 | aaggtcttgacgatggtgatga | AA110453 |
| 5082 | aaatlcatctggaactcggaaga | W57339 | 47686 | ttcctgcgcatcatgaaaagacca | AA153569 | 90290 | tcttlgacgatggtgaagtgaacag | AA110453 |
| 5083 | aaatlcatctggaactcggaagaa | W57339 | 47687 | aagaccagcctcattaagatcagt | AA153569 | 90291 | aacagatttgccagggatgccca | AA110453 |
| 5084 | tcatctggaactcggaagaagga | W57339 | 47688 | gaccagcctcattaagatcagtgt | AA153569 | 90292 | acagatttgccagggatgccat | AA110453 |
| 5085 | catctggaactcggaagaagaagag | W57339 | 47689 | acggtctattaagatcagtgttct | AA153569 | 90293 | agatttgccagggagatgccattg | AA110453 |
| 5086 | gtttaagtcctctgttcactgtg | W57339 | 47690 | tctttttcactgcaagcacagtg | AA153569 | 90294 | tttttgccagggagatgccattgt | AA110453 |
| 5087 | gggccactgcctgagcagcaccat | W57339 | 47691 | taagctattgccgcaacatact | AA153569 | 90295 | aggaggcccatccactcatgcctgg | AA110453 |
| 5088 | cactgctgagcgcagcacccc | W57339 | 47692 | cagcaagcgtggcctgagagatcaga | X56007 | 90296 | tgtactaccaggctgtgctctgat | AA110453 |
| 5089 | actgctgagcgcagcaccatgccg | W57339 | 47693 | gagtacgtatcaccgtgctcttcag | X56007 | 90297 | tactaccaggctgtctctgatca | AA110453 |
| 5090 | ctgctgagcgcagcaccatgccccgc | W57339 | 47694 | gtatcagtcagctgcgctctc | X56007 | 90298 | actaccaggctgtctctgatcaa | AA110453 |
| 5091 | ctgctgagcgcagcaccatgcccgcga | W57339 | 47695 | gctcgttcagtttgagcctctc | X56007 | 90299 | taccaggctctctctgatcaact | AA110453 |
| 5092 | tgagcgcagcaccatgccccgcgga | W57339 | 47696 | ctttcagttgagcctctcaggagg | X56007 | 90300 | caggctgtctctgtcgatcaactca | AA110453 |
| 5093 | agagcaccatggccccgcggaaaa | W57339 | 47697 | gttgagcctcagagggttcct | X56007 | 90301 | aggctgtctctgatcaacttcag | AA110453 |
| 5094 | caccaccatggcccgcggaaag | W57339 | 47698 | tcttcttaggtctaccgagactct | X56007 | 90302 | ctgtctctgatcaacttcagga | AA110453 |
| 5095 | ctaccaccttcaagccagtccaccg | W49346 | 47699 | ttaggtctaccagaccctcaccct | X56007 | 90303 | gtctctgatcaactccaggaaga | AA110453 |
| 5096 | cctcaaggccgtcagatgactggg | W49346 | 47700 | tcaccctctgtcttttccaat | X56007 | 90304 | ccgagggccaccatggttacaca | AA110506 |
| 5097 | cactcagtcagatgactgggc | W49346 | 47701 | ttccaatctgttcagtcagtac | X56007 | 90305 | agccgcccatggttacacagag | AA110506 |
| 5098 | tcgtcagtgactgggcagac | W49346 | 47702 | tctgtttcagtactgacctgggg | X56007 | 90306 | ggaagcctgccatctcaatact | AA110506 |
| 5099 | gtcagatgactctggggacgcgc | W49346 | 47703 | gacccatgcagacctggctgtagat | X56007 | 90307 | cttcattcattcatttcaatactgggc | AA110506 |

| SEQ ID NO | sequence | DBAxnID | SEQ ID NO | sequence | DBAxnID | SEQ ID NO | sequence | DBAxnID |
|---|---|---|---|---|---|---|---|---|
| 5100 | agatgactcgggacgacgacgaa | W49346 | 47704 | tgcagacctgctgtagatccagga | X56007 | 90308 | gtcatcttcaatactctgggccat | AA110506 |
| 5101 | tgactcgggacgacgacgaagagct | W49346 | 47705 | gcgctctgctgggcttctatccc | X56007 | 90309 | atcttcaatactctgggccatggt | AA110506 |
| 5102 | ctctggggacgacgaagagagcct | W49346 | 47706 | ctatccctctatgtctagttc | X56007 | 90310 | tttcaatactctgggccatgtggg | AA110506 |
| 5103 | cgagagcctgctgccctgctgac | W49346 | 47707 | ctaggctcttctgtgtctgag | X56007 | 90311 | ctccactttcatctgcttcgtt | AA110506 |
| 5104 | agagcctgctgccctgctgacaac | W49346 | 47708 | ttatcctcacattcagccctct | X56007 | 90312 | cacctttcatctgcttcgttggt | AA110506 |
| 5105 | tgctgccctgctgacaacagtgat | W49346 | 47709 | cattcagccctgtccgagget | X56007 | 90313 | cttttcatctgcttcgttggtgc | AA110506 |
| 5106 | gctgccctgctgacaacagtatc | W49346 | 47710 | tttcgaagtaacctatctagtct | X56007 | 90314 | tggctctggcagtcaggtcaag | AA110506 |
| 5107 | caaggctgcagatgggaccgt | W49346 | 47711 | ttttctcgtgacccaatggcctga | X56007 | 90315 | taaagtgactcaaagcgaatcatt | AA110506 |
| 5108 | ctgccctgctgacaacagtgatct | W49346 | 47712 | tctcgtgacccaatggcctgagcc | X56007 | 90316 | ttacacagactccctcgggca | AA110506 |
| 5109 | ccgtcagcaatgatcaccgttctg | W49346 | 47713 | caggccctccagaaacagttgtag | AA049662 | 90317 | cacagagtcctcctcgggcattt | AA110506 |
| 5110 | gcaatgatcaccgttctgagttg | W49346 | 47714 | gccctccagaaacagttgtagcca | AA049662 | 90318 | tggtgagttccagctcatgga | AA110506 |
| 5111 | atgagcctgctgagttgcc | W49346 | 47715 | gtagcaagctgtagatgatgaagtt | AA049662 | 90319 | gttccagctcatgagaagcctg | AA110506 |
| 5112 | gatcaccgttctgagttggccaa | W49346 | 47716 | attcgattagcttcatccggtc | AA049662 | 90320 | cccagcctcatggaagcctgca | AA110506 |
| 5113 | caaggctacgtgatgaacaact | W49346 | 47717 | gattagcttcatccggtcttcatc | AA049662 | 90321 | agcctctcatggaagcctgtcatct | AA110506 |
| 5114 | gatgaacactcagtcagatgactct | W49346 | 47718 | tagcttcatccggtcttcatctct | AA049662 | 90322 | cttcatggaagcctgtcatcttc | AA110506 |
| 5115 | gaacactcagtcagatgactctgg | W49346 | 47719 | cttcatccggtcttcatctcaat | AA049662 | 90323 | catggaagcctgtcatcttcaat | AA110506 |
| 5116 | gagccagtccaccagcatt | W49346 | 47720 | cttcatcttattctactagaagt | AA049662 | 90324 | ctgctgctgcaactagtaagacct | AA110506 |
| 5117 | cactggcagtcccaccagcagc | M88299 | 47721 | ctctctaggtggacattaaaccat | AA049662 | 90325 | gctgctcgcaactagtaagacctgg | AA110514 |
| 5118 | ggacgatgctactgcaggtggt | M88299 | 47722 | attaaacatcgtccaaagtacatg | AA049662 | 90326 | atgtctaccgagctacgcgccgct | AA110514 |
| 5119 | cgatgtctactgcaggtgggtacc | M88299 | 47723 | gacccaaatggctgctgagcccagaga | AA049662 | 90327 | cgcctgctgctgctaggatactaga | AA110514 |
| 5120 | ctactgccaggtgggtaccagcagc | M88299 | 47724 | aaaccatcgtccaaagtacatga | AA049662 | 90328 | cctgctgctaggatactagaa | AA110514 |
| 5121 | ctgcaggttgggtaccgtgagcgt | M88299 | 47725 | cccaaatgggctgagcccagaacac | AA049662 | 90329 | tgctgctgctaggatactagagt | AA110514 |
| 5122 | taccgttgagcgctgacacacgca | M88299 | 47726 | aatgggctgagcccagagacacga | AA049662 | 90330 | cgaatagaactcgcagctggcaagg | AA110514 |
| 5123 | caaggttcagacagcgtcagtga | M88299 | 47727 | ctgagcccagagacacgaggggtg | AA049662 | 90331 | tagactgcagctgcaaggaacg | AA110514 |
| 5124 | gcttcagacagcgtgcagtga | M88299 | 47728 | gagctgcgtagaagggcagctg | AA049662 | 90332 | ggaactgcagctgcaaggaacgac | AA110514 |
| 5125 | tcagaccacgcgtgcagtgatgcg | M88299 | 47729 | ttactgtcaaagcagccctccaga | AA049662 | 90333 | actcagctgctgcaaggaacgacat | AA110514 |
| 5126 | gagaaccaccgctgctgctgcc | M88299 | 47730 | ctgcaaagcagccctccagaaac | AA049662 | 90334 | gccactgcagtgcaggtgcgtcgta | AA110514 |
| 5127 | gacctggccaggtgccgagccattcag | M88299 | 47731 | aagcagcccctccagaaacagttg | AA049662 | 90335 | tgctcgcaactagtaagacctgtaag | AA110514 |
| 5128 | tagctgcaaaggcgccgaggccattag | M88299 | 47732 | cttcaatcctctatctactgcgg | X15643 | 90336 | tcctgcaactagtaagacctgtaag | AA110514 |
| 5129 | cgccaaagacaggcggccacgtc | M88299 | 47733 | tatctactgcgggatccagattc | X15643 | 90337 | tagtaagaccgagacagcggcaac | AA110514 |
| 5130 | gcaggaaatcaccaactggccgac | M88299 | 47734 | ctgtcaaggtactgtccagttt | X15643 | 90338 | atcgtgaatcagctcgagaaggagc | AA110514 |
| 5131 | aatcaccaactggccgacagc | M88299 | 47735 | aggtactgtgcctagctagcgt | X15643 | 90339 | cgtgaatcagctcgagaaggagcagca | AA110514 |
| 5132 | caactggccgacagctacagcgccta | M88299 | 47736 | tgtgcctagcctttagcgttgactcc | X15643 | 90340 | tgaatcagctcgagaaggagcagca | AA110514 |
| 5133 | ctgccgacagctacagctgaa | M88299 | 47737 | tagcttaggtttgactccaagga | X15643 | 90341 | gggcagcatgtctaccgagctacg | AA110514 |
| 5134 | catccagacagcgacgccgacgat | M88299 | 47738 | tacaaatgactgcactgtaatac | X15643 | 90342 | agcagcatgtctaccgagctacgcg | AA110514 |
| 5135 | ccagcagcagacgccgacgtc | M88299 | 47739 | tagctgccactgtaatacaggctt | X15643 | 90343 | cagcatgtctaccgagctacgcgc | AA110514 |
| 5136 | atcatgaagactccaatcgga | W49353 | 47740 | gtaatacaggctttctactctta | X15643 | 90344 | aggaaccaagtatccgccatag | AA110514 |
| 5137 | catgaagactctcaaatgtgaaga | W49353 | 47741 | ctcctgacagacactaaccagta | X15643 | 90345 | ctgaaccgagtctgatgcacatt | U73460 |
| 5138 | catgaagactctcaaatgtggaag | W49353 | 47742 | attttttagctgcaacaagaagag | X15643 | 90346 | agtgtcggaagaccctggagtct | U73460 |
| 5139 | atatgattgagcccattgtgagta | W49353 | 47743 | tatagttcagttctctgtaga | X15643 | 90347 | agaactcaccatttctttgccagc | U73460 |
| 5140 | tatgattgagcccattgtgagtat | W49353 | 47744 | tgcttttcaagagtctctgcct | X15643 | 90348 | caccatgtcttgccagccctgaa | U73460 |
| 5141 | tgattgagcccattgtgagtatg | W49353 | 47745 | ttaagagtctctgcctgccagg | X15643 | 90349 | aagatagacagccccagtacctc | U73460 |
| 5142 | gattgagcccattgtgagtagt | W49353 | 47746 | tcgcaggtctcctttgaaactat | X15643 | 90350 | tgcccagacctcctgtctccgt | U73460 |
| 5143 | attgagcccattgtgagtagtg | W49353 | 47747 | ctctagcaatagcaacgcgaagag | X15643 | 90351 | cctgtctccgtgtatactagcta | U73460 |
| 5144 | ttgagcccattgtgagtagtgt | W49353 | 47748 | caatagcaacggcagaaccgagactac | X15643 | 90352 | tctccgtgatactagctatccta | U73460 |
| 5145 | gagcccattgtgagtatgttc | W49353 | 47749 | cagaacggactacacaagggagagctac | X15643 | 90353 | tgtatactagctatcctactacc | U73460 |
| 5146 | agcccattgtgagtatgtttcca | W49353 | 47750 | gggagcaaaacctgtcagtgggg | X15643 | 90354 | cctactgctgtcggcagctg | U73460 |
| 5147 | gccccattgagtatgtcttaa | W49353 | 47751 | acaggaactgctgtgagatccc | X15643 | 90355 | tgtactgctgggcagctgcatcc | U73460 |
| 5148 | agtattgtgtccacgctgaaga | W49353 | 47752 | acgatgactagaccagggggtta | X72862 | 90356 | aacataatccaggaggacttagcaag | U73460 |
| 5149 | tgaagactccaaatcgaagaag | W49353 | 47753 | ctctcttccgagagaagtgtcta | X72862 | 90357 | cagctgcatccatgcttctggtag | U73460 |

| SEQ ID NO | sequence | DBAxnID | SEQ ID NO | sequence | DBAxnID | SEQ ID NO | DBAxnID |
|---|---|---|---|---|---|---|---|
| 5150 | gtatgtcgttccacagctgaagaa | W49353 | 47754 | catgttcctccacaaatcactctgt | X72862 | 90358 | U73460 |
| 5151 | aagactctcaaaatcggaagaagtt | W49353 | 47755 | actctgtctccaggctcgtgtctc | X72862 | 90359 | U73460 |
| 5152 | agactctcaaaatcggaagaagtt | W49353 | 47756 | ggctcgtgtctcggttagtttga | X72862 | 90360 | U73460 |
| 5153 | agaagttcagagctgtgagaga | W49353 | 47757 | gtgtctcgattagttgagagcag | X72862 | 90361 | U73460 |
| 5154 | aagttcagagctgtgagatact | W49353 | 47758 | tgaggttcatccctggctcctcac | X72862 | 90362 | U73460 |
| 5155 | agcttcagagctgtgagatacta | W49353 | 47759 | ctatggctctcaagcaccatcttg | X72862 | 90363 | U73460 |
| 5156 | tatatgattgagcccatgtgagt | W49353 | 47760 | ctctcaagcaccatctggaccat | X72862 | 90364 | U73460 |
| 5157 | tgtgcaagctgaagccttgttgaa | W49353 | 47761 | aagcaccacatctggaccatctcta | X72862 | 90365 | AA111635 |
| 5158 | gcaagctgaagccttgttgaacaa | W49353 | 47762 | calcttgaccatctcacaatag | X72862 | 90366 | AA111635 |
| 5159 | ctctgcgggtgccgaggatgtgta | W49353 | 47763 | tctacctcacagttagacttcaag | X72862 | 90367 | AA111635 |
| 5160 | agtagggacaacggcaccacacacg | X66602 | 47764 | gaacttactcactactactccta | X72862 | 90368 | AA111635 |
| 5161 | gtgcagcgccgtccagtgaactc | X66602 | 47765 | cactactactccagcagttcagcagt | X72862 | 90369 | AA111635 |
| 5162 | tgcagacgcccgtccagtgaacta | X66602 | 47766 | ccaactgctgacgccctggga | X72862 | 90370 | AA111635 |
| 5163 | agagcccgtccagtgaactcaagc | X66602 | 47767 | cctatggcctggaggccgccagt | X72862 | 90371 | AA111635 |
| 5164 | gcccgtccagtgaactcaagcggg | X66602 | 47768 | tgccagtccctgcctatgttgtgc | X72862 | 90372 | AA111635 |
| 5165 | tggtccacagtcttcctggagact | X66602 | 47769 | tccctgcctatgttgtctgtag | X72862 | 90373 | AA111635 |
| 5166 | gtccacagtcttcctggaccct | X66602 | 47770 | tgctttctaacctgatgatgac | X72862 | 90374 | AA111635 |
| 5167 | ccacagttcctggaccctgt | X66602 | 47771 | ccgtagctgcctcacacgaatgga | AA027667 | 90375 | AA111635 |
| 5168 | ctgttccctccactctgattg | X66602 | 47772 | ctgcctcaacagaatgagataagtt | AA027667 | 90376 | AA111635 |
| 5169 | caagctgaagccttgttgaacag | X66602 | 47773 | tgattgtccaaccgcgaacaattgcc | AA027667 | 90377 | AA111635 |
| 5170 | aagagcagactcatctcgggccag | X66602 | 47774 | tgtccaccgcgaacaattgccatg | AA027667 | 90378 | AA111635 |
| 5171 | cgtcaaggggctcgagagccat | X66602 | 47775 | acggcaacaatgccatgccacgt | AA027667 | 90379 | AA111635 |
| 5172 | gtcaaggggctcgagagccatt | X66602 | 47776 | gcggacaattgccatgcacgtgac | AA027667 | 90380 | AA111635 |
| 5173 | ctaagccctcggccaggagatcac | X66602 | 47777 | caccactcctaagctgcg | AA027667 | 90381 | AA111635 |
| 5174 | tccctggacagctacagctgg | X66602 | 47778 | ctcctagattacgctgtctc | AA027667 | 90382 | AA111635 |
| 5175 | tcgcggacagttacagctggagaa | X66602 | 47779 | ctctagattacgctgtctctga | AA027667 | 90383 | AA111635 |
| 5176 | cgggacagttacagctgagaa | X66602 | 47780 | acgtcttctctgacttaaagac | AA027667 | 90384 | AA111635 |
| 5177 | ccacaggccgccgttagtcgg | X66602 | 47781 | ctgctctcgacttaagagcgt | AA027667 | 90385 | U75680 |
| 5178 | ggcgccagttagtcgggtgaca | X66602 | 47783 | ttctctgacttaaagacggtt | AA027667 | 90386 | U75680 |
| 5179 | gtaggcalcttcagctgtgtcgga | X66602 | 47784 | agttctaggggctgaacgaccacgt | AA027667 | 90387 | U75680 |
| 5180 | agctcctctgtgagagacaataaaaa | X66603 | 47785 | tctaggcctgaacgaccacgtgat | AA027667 | 90388 | U75680 |
| 5181 | ctccctctgtacataccaaggtct | X66603 | 47786 | cgctgaacgaccacgtgatcaacgt | AA027667 | 90389 | U75680 |
| 5182 | ctgtacatacaaggtctgagtaa | X66603 | 47787 | acgaccacgtgatcaacgtcaacgt | AA027667 | 90390 | U75680 |
| 5183 | agctcttagggagccctcttcagtg | X66603 | 47788 | tgatcaacgtacctgggcgaaaatgc | AA027667 | 90391 | U75680 |
| 5184 | gtcttgacaagcacagctgtgga | X66603 | 47789 | gcgaaaaatgctaccctccatgacgac | AA027667 | 90392 | U75680 |
| 5185 | gacaagcagctggtgagaagcggg | X66603 | 47790 | tttccagcatcatgatgtccacg | AA027667 | 90393 | U75680 |
| 5186 | aagccaagcgcgatcgaggcgag | X66603 | 47791 | tcatgattgccacgcggacaat | AA027667 | 90394 | U75680 |
| 5187 | agalagctgtgtgtacgtattact | X66603 | 47792 | agtctccttgctgataactgcaga | AA027667 | 90395 | U75680 |
| 5188 | ctgtgtgtacgtattactgtatac | X66603 | 47793 | atatcaatggcttactatggacat | AA027667 | 90396 | U75680 |
| 5189 | gttgacaacctgctgctaccctatgt | X66603 | 47794 | tgctgcacgacggagcgatacacac | AA027667 | 90397 | U75680 |
| 5190 | aactgctaccctactagtacatc | X66603 | 47795 | tacacacaactcggaagaccaaactt | AA027678 | 90398 | U75680 |
| 5191 | tacactctctagatgaagactg | X66603 | 47796 | gaagaccaaaatctcggctatcatga | AA027678 | 90399 | U75680 |
| 5192 | agactgctcaacaatggtgc | X66603 | 47797 | caaactcgctatcatgagatct | AA027678 | 90400 | U75680 |
| 5193 | accaaagactctggcctatg | X66603 | 47798 | tcggctactgagactcattcaa | AA027678 | 90401 | U75680 |
| 5194 | agactgctcctatggccag | X66603 | 47799 | agactattcaactcatccatcat | AA027678 | 90402 | U75680 |
| 5195 | cccagttcagtcacctcagtcg | X66603 | 47800 | tattcaactcatcatggagct | AA027678 | 90403 | U75680 |
| 5196 | gcgctgctcaggagtgagaaac | X66603 | 47801 | actcatccatcatggagctcattc | AA027678 | 90404 | U75680 |
| 5197 | tctacctctcaatgtgttaacca | W49367 | 47802 | ccatcaggagctccattcagctg | AA027678 | 90405 | U77356 |
| 5198 | tacctctctcaatgttaaccaat | W49367 | 47803 | tccattcagctgcatccacaagc | AA027678 | 90406 | U77356 |
| 5199 |  |  |  |  |  | 90407 | U77356 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 5200 | W49367 | tgacttccttgccagtgtcacaag | 47804 | AA027678 | tactatgtgcatcacactgact | 90408 | U77356 | gtcactgctctgttcctgaaa |
| 5201 | W49367 | gacttccttgccagtgccagtcacaagc | 47805 | AA027678 | ttcagcgtgcatcccacaagccacc | 90409 | U77356 | gtgtcctgtttcctgaaatatgaa |
| 5202 | W49367 | ctccttgccagtgtcacaagcca | 47806 | AA027678 | gtgacatcacactggactaagaaag | 90410 | U77356 | attgtagcgacccagactgtagag |
| 5203 | W49367 | ttccttgccagtgtcacaagccag | 47807 | AA027678 | tgacacggcacctccacatcac | 90411 | U77356 | gcgacccagactgtagagatttt |
| 5204 | W49367 | ccttgccagtgtcacaagcagca | 47808 | AA027678 | cttccacatcatcccagaagactat | 90412 | U77356 | tttgggtacalctgctgtgtggaaa |
| 5205 | W49367 | cttgccagtgtcacaagccagca | 47809 | AA027678 | catcatcccagagactatccactt | 90413 | U77356 | gaactgtacttagtggctgtcat |
| 5206 | W49367 | ttgccagtgtcacaagccagcaa | 47810 | AA027678 | cccagaagactatccactgctgca | 90414 | U77356 | tacttagtggctgtcatgctctg |
| 5207 | W49367 | cagtgccaagccagccagcaaga | 47811 | AA027678 | agactaccactgctgcacgagg | 90415 | U77356 | tgtlcatgctctgagttaggtatt |
| 5208 | W49367 | gtgtcacaagccagccaagcaagat | 47812 | AA027678 | tccactgctgcacgacggggagat | 90416 | U77356 | atgaatactatccatgtaataagca |
| 5209 | W49367 | tgtcacaagccagccaagcaagattc | 47813 | AA027678 | caattagccactgcgcttatcgaga | 90417 | U77356 | acatacacacacctacctctcatg |
| 5210 | W49367 | ctctcaatggttaaccaatagt | 47814 | X78684 | gccactgccgttatcgagaagagtc | 90418 | U77356 | cttacctcatgcgtgttacct |
| 5211 | W49367 | ttcttcaatggttaaccatagic | 47815 | X78684 | ttgcaaactgtcataccatgaac | 90419 | U77356 | tctcatgcggttttacctgtcgtg |
| 5212 | W49367 | gttaaccaatagtcaggcctcagca | 47816 | X78684 | aactgtcataccactgaactgagt | 90420 | U77356 | agtggctcactgcctgggatcta |
| 5213 | W49367 | ttaaccaatagtcaggcctcagcag | 47817 | X78684 | ttatgttgactgtggattttccca | 90421 | U77356 | tcactgcctgggatctttacctgg |
| 5214 | W49367 | caatagtcaggcctcagagaaac | 47818 | X78684 | gtggatttccactgaccaaagctt | 90422 | U79525 | gggtcaccacagttctcctagga |
| 5215 | W49367 | gcctcagcagaaaacttcctttc | 47819 | X78684 | actggtattacctcagttattcatgc | 90423 | U79525 | ccaccgctctctagagaacagct |
| 5216 | W49367 | gcagaaaacttcctttcgcacta | 47820 | X78684 | attacctcagtttattcatgcctgt | 90424 | U79525 | tctctctttaggaaacagtcgttct |
| 5217 | W49367 | tttgacttccttgccagtgtcaca | 47821 | X78684 | tcagttattcatgcactgctatcata | 90425 | U79525 | aggagcttcaccaagatgctcgtctt |
| 5218 | W49367 | cttctccaagtgtccccaagccgtct | 47822 | X78684 | ttcatgcactgttatcatcatacaagatc | 90426 | U79525 | tcaccaagatgctcgttctgaaatg |
| 5219 | W49367 | gcccaagccgtcgtgccagagat | 47823 | X78684 | tatcatacgatctctctactatgt | 90427 | U79525 | ccgagcttctacaacagcgaggcagg |
| 5220 | W49367 | cgccaaggacgtttagccgcc | 47824 | X78684 | acagatctctctatagtgttctat | 90428 | U79525 | ctgtgaccaacatacaggccacat |
| 5221 | W49367 | gccatgacgacgttatgcgct | 47825 | X78684 | ttagggctctccaagcctcatgatt | 90429 | U79525 | tacacgatgccgtgcatgccct |
| 5222 | W49367 | acgagttttatgccctgggagact | 47826 | X78684 | ctcttcaagcctcatgattgtacaa | 90430 | U79525 | atgccctgaacatgctgcgcagttt |
| 5223 | W49367 | gacgtttatgccctgggggagctg | 47827 | X78684 | tgtacaacctactgaaatatgacca | 90431 | U79525 | tgaacatgcgccagtttgtggg |
| 5224 | W49367 | cacactgccccgtctctgccagtga | 47828 | X78684 | acctactgaaatatgaccactgct | 90432 | U79525 | gaagttaccgcaaccattgcaga |
| 5225 | W49367 | cactgccccgtctgtgatgtacc | 47829 | X78684 | tatgacacgactgttatgttgttgtgt | 90433 | U79525 | accgcaaaaccattgcagaccctg |
| 5226 | W49367 | actgccccgtctgtgcagtgacc | 47830 | X78684 | tgttgtactgctctgttctcca | 90434 | U79525 | aaccattgcagaccctgttatgca |
| 5227 | W49367 | tgtgcagtgaccctgcagtgggtt | 47831 | X78684 | tactgctgtctgtgcctatatagac | 90435 | U79525 | caacacctccaagaaccttgactt |
| 5228 | W49367 | tgcagtgaccctgcagtgggtte | 47832 | X78684 | cagtagctgctttcaagtcat | 90436 | U79525 | agacctttgaatttcagaag |
| 5229 | W49367 | gcagtgaccctgcgagtgggttc | 47833 | X78684 | tggttaccatttcggcgtctga | 90437 | AA027694 | gagaccagtacccctgaacctcac |
| 5230 | W49367 | tcccaggcctctgcgacgagatc | 47834 | AA027694 | ttacaacttttcgggcgtctgctaaa | 90438 | AA027694 | ctctgaaccctcacctgggaatgtcc |
| 5231 | W49367 | ccaggccgtctgcgcacgagatcac | 47835 | AA027694 | aactatggtctcacaattcatgaag | 90439 | AA027694 | ttgctccgggaagtggagacatgc |
| 5232 | W49367 | caagccgctgcgacgagatcacc | 47836 | AA027694 | ctatggctcacaattcatgaagaa | 90440 | AA027694 | gggaatgcttccacaagccccctgaat |
| 5233 | W49367 | agccgctgcgacgagatcaccggc | 47837 | AA027694 | atggcttcacaatttcatgaagaatt | 90441 | AA027694 | acgcccactgaatttgcacaagc |
| 5234 | W49367 | gtctgcgcacgagatcaccggcctg | 47838 | AA027694 | aggtgacctgccctgctgtcgtgaa | 90442 | AA027694 | acaaggcggctcagtttcaagttg |
| 5235 | W49367 | ctgcgcacgagatcaccggcctgc | 47839 | AA027694 | gacctgccctgctgtcgtgaacct | 90443 | AA027694 | actctctcagtaaaatgcaggcaa |
| 5236 | W49367 | gcgacgagatcaccggcctggac | 47840 | AA027694 | cgtgcctgcctgctgtcgaacctg | 90444 | AA027694 | caggcaagcaaccccagctgcttcaca |
| 5237 | W49367 | acgagatcaccggcctggccgacg | 47841 | AA027694 | cctgctcgtgtcgaacctgt | 90445 | AA027694 | agtacgacttttgttggccaccag |
| 5238 | W49376 | ataaggcctcaatacgagaagcagg | 47842 | AA027694 | tcctgcgtcctgtcgaacctgatggtg | 90446 | AA142505 | acagactttcgtgtgggcaccagtga |
| 5239 | W49376 | gtacaagagccgcattacacgatgt | 47843 | AA027694 | gtctgcgtgaacctgatgtgaaac | 90447 | AA142505 | gccactggataaaccagtcacagaa |
| 5240 | W49376 | gcacaagaccgcgcacaagcgcg | 47844 | AA027694 | acaacttttgcgctgatagaagg | 90448 | AA142505 | actgataaaccagtcacagaagtc |
| 5241 | W49376 | acaagagaccgcacaagccgcgt | 47845 | AA027694 | ctttctgcgctgtgataaagggtc | 90449 | AA142505 | ggataaaccagtcacagaagtctc |
| 5242 | W49376 | gacaccgagccaagccgctgcac | 47846 | AA027694 | ttgttgggcacctgacagaagttg | 90450 | AA142505 | acccagtcacagaagtctctgca |
| 5243 | W49376 | caccgagccaaagccgctgcacag | 47847 | AA027694 | tgtttgggcaccctgacgaagttg | 90451 | AA142505 | agtcacagaagtctctgcaggc |
| 5244 | W49376 | ccgagccaaagccgctgcacagga | 47848 | AA027694 | gtttgggcaccgcagaagtgcag | 90452 | AA142505 | aagtctctcgaggcattaggta |
| 5245 | W49376 | gacgcaaagccgctgccagaacg | 47849 | AA027694 | tggggcacctgacgaaagtgcagaag | 90453 | AA142505 | tctctcgaggcattaggtactg |
| 5246 | W49376 | cgcaaagccgctgcacaggacgag | 47850 | AA027694 | atcacgcaactaggcttcacaat | 90454 | AA142505 | ctctggcgtttggagcagggat |
| 5247 | W49376 | caaagcgccgctgcacaggagaga | 47851 | AA027694 | cacagcaactatggcttcacaatc | 90455 | AA142505 | caacttatccataatgatcgaca |
| 5248 | W49376 | acggcgctgcacggacgagggga | 47852 | AA027694 | gcaactatggcttcacaattcatga | 90456 | AA142505 | ctttaatccaattagatcgacactg |
| 5249 | W49376 | tgcacggacgaggacgagaaagc | 47853 | AA035870 | aggcccaggccgaccagatagcgc | 90457 | AA142505 | ctgtggccaccagtgaagataca |

| SEQ ID NO | sequence | DBAxnID | SEQ ID NO | sequence | DBAxnID | SEQ ID NO | sequence | DBAxnID |
|---|---|---|---|---|---|---|---|---|
| 5250 | aagagccgcatacacgatgctaacc | W49376 | 47854 | gcccaggctcgaccagatagccg | AA035870 | 90458 | tcatcgccgttttcaagtcaccag | AA142505 |
| 5251 | gagccgcatacacgatgctaaccga | W49376 | 47855 | tgccccgaagtggcaggacagtg | AA035870 | 90459 | ctttcaagtcaccagagacctgat | AA142505 |
| 5252 | gccgcatacacgatgctaaccgag | W49376 | 47856 | gactgtgcggactccgagcctg | AA035870 | 90460 | ttcaagtcaccagagacctgatagt | AA142505 |
| 5253 | cgcatacacgatgctaaccgagag | W49376 | 47857 | ggtcttcattcattcacccttcatct | AA035870 | 90461 | aagtcaccagagacctgatagtgc | AA142505 |
| 5254 | cgatgctaaccgagagcgccgaga | W49376 | 47858 | tttcattcattcacccttcatctgcta | AA035870 | 90462 | tagttgcagaggctcagaagctg | AA142505 |
| 5255 | atgctaaccgagagcgccgcacag | W49376 | 47859 | tcattcattcacccttcatctgctacg | AA035870 | 90463 | agaagctcgaggcctggcccctgg | AA142505 |
| 5256 | cgccgcacaagaccgacgcaaag | W49376 | 47860 | attcatcaccttcatctgctacgtg | AA035870 | 90464 | aacagagacatgcgccctgggca | AA142505 |
| 5257 | ccgcacaagaccgacgcaagcg | W49376 | 47861 | tcatcaccttcatctgctacgtgt | AA035870 | 90465 | aacagagcatccttttcacttcga | AA142505 |
| 5258 | tttctagtccagctgctgcagaaact | W49376 | 47862 | atcacccttcatctgctacgtggt | AA035870 | 90466 | agagcatcctttcacttcactga | AA142505 |
| 5259 | cccattctcattaagttttgcat | M26391 | 47863 | cacccttcatctgctacgtggtgtcc | AA035870 | 90467 | agtcctgtcatatcataatgactaag | L32372 |
| 5260 | agagatcctgctcgagattctta | M26391 | 47864 | ttcatcgctacgtggtgtccccg | AA035870 | 90468 | cataagactaagcacactgacat | L32372 |
| 5261 | gatcctgctcgagatttcttaaag | M26391 | 47865 | tcgacagatagggccgctatgtgg | AA035870 | 90469 | aatgactaagcacactaactgcatcaa | L32372 |
| 5262 | cctgctcgagattcttaaagctg | M26391 | 47866 | gaccagatagccgctatgtggcc | AA035870 | 90470 | gcacacttgacatcaactgcatcaa | L32372 |
| 5263 | agattctcttaaagctgcagacactg | M26391 | 47867 | ccagatagccgctatgtggccc | AA035870 | 90471 | ttgaactcaactgcatcaagatgtg | L32372 |
| 5264 | tttcttaaagctgcagacactgcac | M26391 | 47868 | agatagccgctatgtggcccccg | AA035870 | 90472 | tcaactgcacaagatgtggacctgt | L32372 |
| 5265 | cttaaagctgcagacactgcactat | M26391 | 47869 | acgagccagaccgcgatccaga | AA035870 | 90473 | gtatttcacagacaaactggcttt | L32372 |
| 5266 | gctgcagacactgcactattggttt | M26391 | 47870 | agagccagaccgatcccagagtcc | AA035870 | 90474 | ttttcaaagccaaatatgtaaatg | L32372 |
| 5267 | gcagacactgcactattggtttgt | M26391 | 47871 | agcccgatccagagtccgcgcatgg | AA035870 | 90475 | aatgatccgtcttaacattg | L32372 |
| 5268 | tgaaactataacatttcaaatgtcat | M26391 | 47872 | catggcccccgaagtgcaagacag | AA035870 | 90476 | gtatcctgtttttaacatttgtg | L32372 |
| 5269 | tatacattcaaatgtctatgtct | M26391 | 47873 | attgattaccccagcgaagactggtc | X78682 | 90477 | tctacttcgatgtcagagggaagcgt | L32372 |
| 5270 | tcttcattaagttttgcatgatcat | M26391 | 47874 | taccccagcgagagctaactgcatcaa | X78682 | 90478 | acatgcacgtaacactgaagtac | L32372 |
| 5271 | agtttgcatgatcatcacacagat | M26391 | 47875 | ctctgcgaggggtgactccaaggc | X78682 | 90479 | gaagtactcatcaactgaagtc | L32372 |
| 5272 | gcatgatcatcacacagattagtta | M26391 | 47876 | tgactccaaggccgctgagctgatc | X78682 | 90480 | ctatccattaactgaagtcttgta | L32372 |
| 5273 | tcatcacacagattagtttt | M26391 | 47877 | caaggccgctgagctgatcgccaac | X78682 | 90481 | gttccgcagccactattagtc | L32372 |
| 5274 | ccatatctcaggtctttttgctagt | M26391 | 47878 | cgctgcgatcgcaactgctg | X78682 | 90482 | tccgcagccactattgtgctct | L32372 |
| 5275 | tactctagtctttgctagtgagtc | M26391 | 47879 | gctgatcgcaactgctgctggccacg | X78682 | 90483 | actatttgtcctgattcata | L32372 |
| 5276 | ttctagtctttgctagtgagtc | M26391 | 47880 | tcggaacatcactactcgccagcg | X78682 | 90484 | attgtagtctcttgattcataatg | L32372 |
| 5277 | ttcaagatcctgctcgagattc | M26391 | 47881 | ctaactgcgggggccagtcgtg | X78682 | 90485 | tccctcatccttttgactagaccac | W41817 |
| 5278 | gaggctccaagatcatccaccat | M26391 | 47882 | cggcctccatcagtcgaatgacgc | X78682 | 90486 | tccctcatccttttgactagacacgt | W41817 |
| 5279 | ccaagatcatccaccatcaagag | M90316 | 47883 | ccatcatgtgaatgacgccttcct | X78682 | 90487 | tagaaccactttgccagcccactt | W41817 |
| 5280 | ccaacaccaagtcgccgatagcct | M90316 | 47884 | tgctgaatgacgccttcctctgcc | X78682 | 90488 | agaccacttttgccagcccacctg | W41817 |
| 5281 | accaagtcgccgatagcctctcctt | M90316 | 47885 | tgacctcacagagccgaggcaaca | X78682 | 90489 | gaccactttgccagccccacttga | W41817 |
| 5282 | aactctgctccaccatcagctaa | M90316 | 47886 | attggggcttaccctggaatgacgtg | X78682 | 90490 | accacttttgccagcccacttgat | W41817 |
| 5283 | gctctccaccatcagctaaagggac | M90316 | 47887 | cctggatcgacgtgcccgacacat | X78682 | 90491 | cactttgccagcccaccttgatca | W41817 |
| 5284 | ccagtcccatcaggtggagccaagagt | M90316 | 47888 | tgacgtgtcctgacacatctgacc | X78682 | 90492 | cttttgccagcccacctgatcatg | W41817 |
| 5285 | gagccaagagtcccaagggaagga | M90316 | 47889 | gtccctgaccacatctgaacttcggg | X78682 | 90493 | ttgccagcccaccttgatcatgt | W41817 |
| 5286 | aggcaagatcccaaccgatccaa | M90316 | 47890 | tctgacctcggaaggagttcaca | X78682 | 90494 | tgccagcccaccttgactcatgttgc | W41817 |
| 5287 | cactgccccatgctgaatgctcag | M90316 | 47891 | gggcagccatatctctgaggct | X78682 | 90495 | cacttgatcatgttgcctgcatc | W41817 |
| 5288 | tgctcagatctcgcgggtcctgccc | M90316 | 47892 | catcatctctgtgaggggtactcc | X78682 | 90496 | accttgatcatgtcgctgcatc | W41817 |
| 5289 | ctgttacgggatccctcatttgtg | M90316 | 47893 | tatctatactgtcagtcgaagtca | U03457 | 90497 | cctcatccttgactagaccactt | W41817 |
| 5290 | gcaccccatctggaagtggggtacaa | M90316 | 47894 | atacgtcagtgcaagtcaagaccaa | U03457 | 90498 | cctcatccttgactagaccactttt | W41817 |
| 5291 | tgccactggacatgggaagtacga | M90316 | 47895 | taccaagtgggaaccatttcattc | U03457 | 90499 | tcatccttgactagaccactttg | W41817 |
| 5292 | agggctcagcaccatagaccatgtt | M90316 | 47896 | ttcattccaactcaggcattgaaa | U03457 | 90500 | tcctttgactagaccactttgcca | W41817 |
| 5293 | cagcaccatagaccatgttcgtac | M90316 | 47897 | cccaacctaggcattgaaaatctgt | U03457 | 90501 | ctttgactagaccacttttgccagc | W41817 |
| 5294 | ccatgttcgatcggatagactc | M90316 | 47898 | ttagattgagctttctgcagggg | U03457 | 90502 | ttgactagaccacttgccagc | W41817 |
| 5295 | ttgcatcggatagactccggcg | M90316 | 47899 | tgagctttctcggagcatgat | U03457 | 90503 | tgactagaccacttttgccagccc | W41817 |
| 5296 | cctggatagactccggccgatgcc | M90316 | 47900 | tttctctgagggggcatgatccatg | U03457 | 90504 | tgactagaccactttgccagcca | W41817 |
| 5297 | cagccctgaccaagaaattgcttcc | M90316 | 47901 | cgtttcaagtcgtgtctccata | U03457 | 90505 | tcacggctgtctgaagaatgaaaa | W41817 |
| 5298 | tgtcagaactgcgctgcgcaagg | AA041982 | 47902 | ataatatgctgaactgtatttat | U03457 | 90506 | agatacgtccacttagaattcaaatt | D88315 |
| 5299 | tcagaactgcgctgcgcaaggag | AA041982 | 47903 | tattttatcataactgctgttaga | U03457 | 90507 | atatatagccgttccaggactgt | D88315 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5300 | atggctttgtgcacatagaggacaa | AA041982 | 47904 | tcataactgctgcttatgagccgga | U03457 | 90508 | agtggctttcaggactgtcacagt | D88315 |
| 5301 | aggacaagacgcgctgaggatgca | AA041982 | 47905 | aagaccatagagcaccttacaggag | U03457 | 90509 | ggccttcagctgactgtcacagtaac | D88315 |
| 5302 | caagacggccgctgaggatgccata | AA041982 | 47906 | atagagcaccttacaggagtagag | U03457 | 90510 | ctttcaggactgtcacagtaacact | D88315 |
| 5303 | agacgccgctgaggatgccatacg | AA041982 | 47907 | cacctacaggagctagagatggct | U03457 | 90511 | ggactgtcacgtaacacttatt | D88315 |
| 5304 | aggatgcatacgtaacctgcacca | AA041982 | 47908 | tggagcagtctcaaatcaaatata | U03457 | 90512 | ctgtcacagtaacacttattacca | D88315 |
| 5305 | cctgcaccactacaagctgcacgga | AA041982 | 47909 | atactggccctgctgaatttcca | U03457 | 90513 | tcacagtaacacttattacagag | D88315 |
| 5306 | tgcaccactacaagctgcacggagt | AA041982 | 47910 | gccgtctgaatttccagtctcct | U03457 | 90514 | cactttattacagagctaatgtt | D88315 |
| 5307 | ccactacaagctgcacggagtgaac | AA041982 | 47911 | tctgaattttccagtcctcatgg | U03457 | 90515 | atcttgtgtgttactgcctaat | D88315 |
| 5308 | actacaagctgcacggagtgaacat | AA041982 | 47912 | agctcctcattggattttaccaga | U03457 | 90516 | tgtgtgttactgcctaatgcttt | D88315 |
| 5309 | tacaagctgcacggagtgaacatca | AA041982 | 47913 | gaacatctcaaacatgatgccaca | U03457 | 90517 | agcctagccatctggctcaatctgt | D88315 |
| 5310 | gacctgcaggtatccatgcggctgt | AA041982 | 47914 | aacgatgccacatcaacagaaccga | X78683 | 90518 | ctagccatctggctcaatctgttta | D88315 |
| 5311 | ggtatccatgcggctgtggagat | AA041982 | 47915 | ggcacactgtccagcttggagag | X78683 | 90519 | atctggctcaatctgtttaaactg | D88315 |
| 5312 | tcattgaaatcgcccgggatgccgc | AA041982 | 47916 | gcccaggcatcatgtggactgat | X78683 | 90520 | gttctgctcattataccactattct | D88315 |
| 5313 | ggagatcgctcactctgagcag | AA041982 | 47917 | tatctgcccctgtcgattaaggaag | X78683 | 90521 | cataatcataaggaccctccaacatt | D88315 |
| 5314 | agatccgctcactctgagcagta | AA041982 | 47918 | gactgagaccagtccccttcagagtc | X78683 | 90522 | cataaggaccctccaacactgaatac | D88315 |
| 5315 | actcttgagcagtacggaaggtg | AA041982 | 47919 | cagagggttccttccctcctgtt | X78683 | 90523 | gacctcaacactgaatacataatc | D88315 |
| 5316 | tcttcgagcagtacggagaggtgct | AA041982 | 47920 | ctttccctccctgtgttggctg | X78683 | 90524 | ctcaacactgaatacataatcta | D88315 |
| 5317 | ttatggctttgtgcacatagaggac | AA041982 | 47921 | gtgatttctccgtgatttctcacag | X78683 | 90525 | tatcatactgataaacttagtact | AA116372 |
| 5318 | gcccagatccccagaatgtaaaccag | W51344 | 47922 | tctccgtgatttctacagcctga | X78683 | 90526 | ttttgtctgtgctactagtagtcc | AA116372 |
| 5319 | aatgtaaaccaggccaaaatggctg | W51344 | 47923 | tgatttctacagcctgagcctct | X78683 | 90527 | tctccttacttataggcagtgtga | AA116372 |
| 5320 | ggtcagagcccccagaccacagcg | W51344 | 47924 | gggagataaccaccatgccaggaatt | X78683 | 90528 | cctttacttaggcagtgtgacaga | AA116372 |
| 5321 | gcagagccccagaccttcagcag | W51344 | 47925 | cgcacatcacagaaccgatctat | X78683 | 90529 | gaaagtcaagcttccaaaagaaga | AA116372 |
| 5322 | gcagcccagaccttcagcagaggct | W51344 | 47926 | gagataaccaccacgccaggaattc | X78683 | 90530 | gtcaagcttccaaaagaagaagca | AA116372 |
| 5323 | cagacctcagagatggctcccagg | W51344 | 47927 | atccatcacagcgatatctcaca | X78683 | 90531 | aagcaacttgtccatgtggggttg | AA116372 |
| 5324 | acctcagcagatggctcccagtc | W51344 | 47928 | gaaccgaatctatctcacagctgac | X78683 | 90532 | gcaacttgccatgtggggttgta | AA116372 |
| 5325 | gatggctccaggtcagaatgtgg | W51344 | 47929 | aatctatctcacagctgacaacct | X78683 | 90533 | cttgtccatgtggggttgtaccca | AA116372 |
| 5326 | ggctccaggtccaggatgtggagt | W51344 | 47930 | tctcacagctgacaacctgtctg | X78683 | 90534 | attatgctacttccatattgca | AA116372 |
| 5327 | tccgttccgggaactgaggagt | W51344 | 47931 | agctgacaacctgtctgaatcta | X78683 | 90535 | ttatagctaccatattgcact | AA116372 |
| 5328 | tctgctccggtccagtaactact | W51344 | 47932 | caacctgtctgaatctacaagat | X78683 | 90536 | atagctccatattgcactag | AA116372 |
| 5329 | gctccggtccagtaaccactctga | W51344 | 47933 | aagtgacagcctccatttaaggataag | X78683 | 90537 | tgtctgctactagtagtccag | AA116372 |
| 5330 | gtaaacaggccaaaatggctgacg | W51344 | 47934 | tggcgttggcgtcatgtgtcgtga | AA028273 | 90538 | tgtgctactagtgtccagcagtat | AA116372 |
| 5331 | aaccaggccaaaatggctgacgtag | W51344 | 47935 | catgtgtctgtgacggagacgccgg | AA028273 | 90539 | tgctactagtgtccagcagtatc | AA116372 |
| 5332 | atggctgacgtagggaccacgtcag | W51344 | 47936 | ttggctgcttagcctgcctgggc | AA028273 | 90540 | ctactagtgtccagcagtattcca | AA116372 |
| 5333 | accagttgcaggtactctgaactg | W51344 | 47937 | ggctgcttagcctgcctgggctc | AA028273 | 90541 | actagtagtccagcagtattcca | AA116372 |
| 5334 | ggtatcctcagaaactgacggtgcag | W51344 | 47938 | gctgcttagcctgcctgggctcc | AA028273 | 90542 | cagcagtattccatgtcccatctc | AA116372 |
| 5335 | atctctgaaactgacggtgcagcag | W51344 | 47939 | gcttagcctgcctgggctccaa | AA028273 | 90543 | gtcatctccttacttataggga | AA116372 |
| 5336 | tctgaaactgacggtgcagcagccc | W51344 | 47940 | gctccacggctgcctgagggtctc | AA028273 | 90544 | cccatctccttacttatagggag | AA116372 |
| 5337 | gaaactgacggtgcagcagcccaga | W51344 | 47941 | ctccacggctgcctgagggtct | AA028273 | 90545 | taatactcaggatgcgacgaatac | AA110627 |
| 5338 | gatgcagttcgtcagaagagag | W46015 | 47942 | cacggctgcctgagggtctctgca | AA028273 | 90546 | atactcaggatgcgacgaatacaa | AA110627 |
| 5339 | gaagtcagttagcagcagggcag | W46015 | 47943 | cggctgcctgagggtctctgcagc | AA028273 | 90547 | agcccgctgcggcagagcagtgcaa | AA110627 |
| 5340 | tactcattacggtgcaattgctc | W46015 | 47944 | ctgcctgagggtctctgcagcc | AA028273 | 90548 | ccctgcgagagcagtgcaacaa | AA110627 |
| 5341 | tccattacggtgcaattgctctgt | W46015 | 47945 | acgccagcgacctgagtcggc | AA028273 | 90549 | cctgcggcagagcagtgcaacaa | AA110627 |
| 5342 | gtgcaattgctctgtttgctaalg | W46015 | 47946 | attgtgtcgacggagagccggt | AA028273 | 90550 | cctgcggcagagcagtgcaacaaa | AA110627 |
| 5343 | caattgctctgtttgctaatgctg | W46015 | 47947 | tcgtggttccgcgtgcagctgttg | AA028273 | 90551 | agcagtgcaacaaactcacagtgga | AA110627 |
| 5344 | cttctgtttgctaatgctgttgc | W46015 | 47948 | tggttccgcgcagctggctg | AA028273 | 90552 | gcagtgcaacaaactcacagtgaca | AA110627 |
| 5345 | ctgttgctaatgctgttgcaa | W46015 | 47949 | gttccgcgcagctggctggt | AA028273 | 90553 | gtgcaacaaactcacagtggacaca | AA110627 |
| 5346 | tttgctaatgctgttgcaaatta | W46015 | 47950 | tttccgcggcagctgttggctgctt | AA028273 | 90554 | gcaacaaactcacagtggacacaga | AA110627 |
| 5347 | gctaatgctgttgcaaattaaac | W46015 | 47951 | tccgcggcagctgttgctgctgttta | AA028273 | 90555 | caatcacagtggacacagatatc | AA110627 |
| 5348 | aatgctgttgcaaattaaactg | W46015 | 47952 | ctgtggctgtttagcctgctgcg | AA028273 | 90556 | actactggacacagatatccgc | AA110627 |
| 5349 | cacccacagggtaagaacaagagc | W46015 | 47953 | gttggctggcttagcctgcctggg | AA028273 | 90557 | ggaaacctccatacctgagtacct | AA110627 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5350 | gtcagcttagcgagcagggcaggt | W46015 | 47954 | tcgatctcatgtcaccaccagaa | X17501 | 90558 | gaaactctgcatacgagtacctg | AA110627 |
| 5351 | caagagacatctcagcattgcttaga | W46015 | 47955 | tcacaccacagaacaagtctacatt | X17501 | 90559 | aactctgcatacgagtacctgaa | AA110627 |
| 5352 | agcttaggcgagcaggcaggttcct | W46015 | 47956 | ttcacaggatcctgttaacctgaca | X17501 | 90560 | tcctgcatacgagtacctgaagc | AA110627 |
| 5353 | ttagcgagcaggcagcagttcctac | W46015 | 47957 | tgttaacctgacaagaactctctc | X17501 | 90561 | cctgcatacgagtacctgaagcc | AA110627 |
| 5354 | tcctagcgatgtcactgaaggc | W46015 | 47958 | tctctcaccaagaaggcaactg | X17501 | 90562 | gcatacgagtacctgaagccctg | AA110627 |
| 5355 | ttacgatgtgtcactgaaggcaac | W46015 | 47959 | acagagtcttgccttcatccctagc | X17501 | 90563 | ataccgagtacctgaagccctgct | AA110627 |
| 5356 | tataattacccgataattagagatt | W46015 | 47960 | cttcatccctagcagtgtcctagc | X17501 | 90564 | tacgagtacctgaagccctgct | AA110627 |
| 5357 | agagattactcatttacggtgcaat | W46015 | 47961 | ccagcgaacaactctggctctattt | X17501 | 90565 | tcctcatcgggttgctgatattac | AA110735 |
| 5358 | gattactcatttacggtgcaattgc | W46015 | 47962 | gagttgcatgcatgtcctatgaaa | X17501 | 90566 | tcatcggtgttgctgatatacata | AA110735 |
| 5359 | tgatctgcgcgcacaaagacagag | X12789 | 47963 | acaagcacagaacctgtacagtgc | X17501 | 90567 | ttctacttagtgtggctgaaatgtt | AA110735 |
| 5360 | gcgccacaaagacagagatctcc | X12789 | 47964 | acaggacctgtacagtgctccacc | X17501 | 90568 | tgtgctgatgcacagacctctagg | AA110735 |
| 5361 | aggactgagttcatcctagggga | X12789 | 47965 | cctgtacagtgctccaccactgac | X17501 | 90569 | tgctgatgcacagacctctagggag | AA110735 |
| 5362 | gagttcatcctatgggactact | X12789 | 47966 | ctacatttacacctgccaagtcag | X17501 | 90570 | tgatgcacagacctctagggagaag | AA110735 |
| 5363 | atcctatgggactactagccct | X12789 | 47967 | gcaatcctgtaagcagcaagaacga | X17501 | 90571 | acagacctctagggagaagatgagg | AA110735 |
| 5364 | actcactagccctgcttcagctac | X12789 | 47968 | acacagtgactcactcactcg | X17501 | 90572 | tcttagcagtcagtcacgcttacg | AA110735 |
| 5365 | tagccctggcttcagctaggaatg | X12789 | 47969 | tagccagatctctggagtagtg | X17501 | 90573 | tagcagtctagtctacgcttacggat | AA110735 |
| 5366 | tggcctttcaggtactgaatgagctcc | X12789 | 47970 | gatcttctgagtatgttggactgc | X17501 | 90574 | ctagctcacgttaccgatgggaag | AA110735 |
| 5367 | gtccagctctctgatgtctgtgcc | X12789 | 47971 | caacttgctagtggtcacaacact | X17501 | 90575 | gtctaagcttacgatgggaagcag | AA110735 |
| 5368 | tgatgctgtgtccaagtgaatggcc | X12789 | 47972 | tggtcacaacactcatcattcacag | X17501 | 90576 | tacgttacgatgggaagcaggtc | AA110735 |
| 5369 | aatgccactgaagtcctgccaagc | X12789 | 47973 | tcatcattcacaggatcctgttaac | X17501 | 90577 | catatccatcactgataatccatc | AA110735 |
| 5370 | cactgaagtcctgccaagctagctc | X12789 | 47974 | agaccaagaatgccgccatcgtagt | AA028220 | 90578 | atccatccactgataatcccatcc | AA110735 |
| 5371 | gaaccgcaaactcaaccgcctgcag | X12789 | 47975 | accaagaatgccgccatcgtagtgg | AA028220 | 90579 | gtaattcagcgcgttacagtcttt | AA110735 |
| 5372 | actgaagtcctgccaactagtcc | X12789 | 47976 | gattagctccagaacagcgccccag | AA028220 | 90580 | attcagcgcgttacagtcttcag | AA110735 |
| 5373 | caacatcaaccgcctgcaggagatt | X12789 | 47977 | attagctccagaacagcgccccagc | AA028220 | 90581 | tacagctttcagalacgtcctgt | AA110735 |
| 5374 | caacgcctgcaggagattgaagcc | X12789 | 47978 | tagctccagaacagcgccccagcag | AA028220 | 90582 | tcagatacctcctgtctactag | AA110735 |
| 5375 | tgaagccctcaaaggccagagggca | X12789 | 47979 | agctccagaacagcgccccagcaga | AA028220 | 90583 | gatacgtcctgttctactagt | AA110735 |
| 5376 | cctcaaaggccagagggcatcgttg | X12789 | 47980 | tccagaacagcgcccagcagaact | AA028220 | 90584 | ctgttctacttagtgtgctgaaat | AA110735 |
| 5377 | tcatacgaagaccaccagcgggtac | X12789 | 47981 | acgccccagcagaactgaagt | AA028220 | 90585 | ttcggatccatgcgggctctacgacc | AA110735 |
| 5378 | gaagaccaccagcgggtactactagga | X12789 | 47982 | acgccccagcagaactgaagttgg | AA028220 | 90586 | atgcggctctacgacctgtgacg | AA110774 |
| 5379 | caccagcgggtactactgaggactg | X12789 | 47983 | gcgccccagcagaactgaagttgaa | AA028220 | 90587 | gtgcctggaacctatgtgatgc | AA110774 |
| 5380 | ccaacacagccatggggaagatcac | W78478 | 47984 | gcccagcagaactgaagttggaat | AA028220 | 90588 | aaccttatgtgatgcctggacgac | AA110774 |
| 5381 | aacacagccatggggaagatccga | W78478 | 47985 | cccagcagaactgaagttggaatt | AA028220 | 90589 | gtgcggaacgacctggggttcaaga | AA110774 |
| 5382 | gctctatgcagccaacttcgaggt | W78478 | 47986 | ccaagaagccatcgtagtggga | AA028220 | 90590 | cggaacgactctgggcttcaagaaga | AA110774 |
| 5383 | tctatgagcagccaacttcgaggt | W78478 | 47987 | agaatgccgccatcgtagtggag | AA028220 | 90591 | acgactctggggcttcaagaagaag | AA110774 |
| 5384 | tatgagcagccaactttcgaggt | W78478 | 47988 | aatgccgccatcgtagtggaagtg | AA028220 | 90592 | ggctatgacaagccaactgtggccg | AA110774 |
| 5385 | tgagcagccaacttcgaggtc | W78478 | 47989 | atgccgccatcgtagtggaagttgg | AA028220 | 90593 | aagccacctgtgccgcgtgacgctta | AA110774 |
| 5386 | gccccaacttcgaggtcagtgc | W78478 | 47990 | gccgccatcgtagtggaagttgga | AA028220 | 90594 | ccaacttgggccgtgacgcttagc | AA110774 |
| 5387 | ccaacttcgaggtcagtgcagtact | W78478 | 47991 | cgccatcgtagtggaagttggaca | AA028220 | 90595 | cctgggccgtgacgcttatgcaac | AA110774 |
| 5388 | aacttcgaggtcagtgcagtactt | W78478 | 47992 | aagacggagtgacagtgctaga | AA028220 | 90596 | aagcttatgcaacagctcaaggcca | AA110774 |
| 5389 | ctcgaggtcagtagctcctg | W78478 | 47993 | aagattagctccagaacagcgccc | AA028220 | 90597 | atctaagaccttgatcgacctac | AA110774 |
| 5390 | tcgaggtcgcagtactctcgg | W78478 | 47994 | gtacacttcccgggtgatgctcagc | X55573 | 90598 | atgcaacagctcaaggcccatgcctg | AA110774 |
| 5391 | gcaggtgccagtactccgtc | W78478 | 47995 | cacttccgggtgatgctcaacag | X55573 | 90599 | gaccttgatcgacctacgaccc | AA110774 |
| 5392 | caccagcatggggaagatcacctt | W78478 | 47996 | ggacatgtcgggggacgtcacaca | X55573 | 90600 | accttcacctgaacgtgacagcaga | AA110774 |
| 5393 | ggcttccaagggcccactatgagtg | W78478 | 47997 | gtctgcgggacggcacagtccta | X55573 | 90601 | acctgaacgtgacagcagaggcctt | AA110774 |
| 5394 | cttccaagggcccactatgagtca | W78478 | 47998 | gacgtcacagtctagagaaagtc | X55573 | 90602 | caagagccttagccgggagttgct | AA110774 |
| 5395 | tccagggcccactatgagtcagc | W78478 | 47999 | ggtatccaaagccaactgaagcag | X55573 | 90603 | ttagccggagttgctcggtgctt | AA110774 |
| 5396 | cagggcccactatgagttcagcagc | W78478 | 48000 | gtatttctacgagacaagtgtaat | X55573 | 90604 | tgctcggtcctggaacttatgt | AA110774 |
| 5397 | gggcccactatgagtgcagcaacg | W78478 | 48001 | gcaatcgaactaaccaatcgtat | X55573 | 90605 | tcgggtgcctggaacttatgtgta | AA110774 |
| 5398 | gccccactatgagtgcagcaccgc | W78478 | 48002 | atgcgaactaccccatctatgtt | X55573 | 90606 | acatttgtccacctgctggtg | AA110812 |
| 5399 | atgctctatgagcagccaacttcg | W78478 | 48003 | aattgctggccattcattaaggata | X55573 | 90607 | acagatgtctccattgcagaccggc | AA110812 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5400 | gtatccacttggtgctgctgc | M18208 | 48004 | ttcctgtatgtacactgaccatt | X55573 | 90608 | gctgacacttgcggtacaactgtc | AA110812 |
| 5401 | ctgctgcagccctgcaggga | M18208 | 48005 | tgtatgtacactgaccattaaaag | X55573 | 90609 | gacacttggtacaatcgtcacg | AA110812 |
| 5402 | cagttggcttgattcctgctg | M18208 | 48006 | ttcccgggtgatgctcagcagtcaa | X55573 | 90610 | acttggtacaatctgtcacgcg | AA110812 |
| 5403 | tgctctgcgccctggagctgaagc | M18208 | 48007 | gatgctcagcagtcaagtgccttg | X55573 | 90611 | acaatctgcgccgtgacaaac | AA110812 |
| 5404 | gctctgcccaatgacttgcagctct | M18208 | 48008 | gctcagcagtcaagtgccttggag | X55573 | 90612 | atctgtcacgccgtgacaaactic | AA110812 |
| 5405 | cccaatgacttgcagcctctg | M18208 | 48009 | tctactcttctgctggaggaatac | X55573 | 90613 | gctgacaaactictctcagctgcg | AA110812 |
| 5406 | agactigcagcctctctgttca | M18208 | 48010 | actcttctgctggaggaataca | X55573 | 90614 | aaacttctcagctgcgctacca | AA110812 |
| 5407 | agcccgtggctgtaggagagtacag | M18208 | 48011 | ttacctgagtgccaaacatgtct | X55573 | 90615 | cttctcagctggcgctaccagag | AA110812 |
| 5408 | agtacaggtccagtcttcctctg | M18208 | 48012 | ggatgccgcaaacatgtctagagg | X55573 | 90616 | ctctcagctgcgctaccagagtt | AA110812 |
| 5409 | ggtccagtcttctctcgcagtct | M18208 | 48013 | cgcaaacatgtctatgagggttcgg | X55573 | 90617 | tcagctgcgctaccagagtttatg | AA110812 |
| 5410 | ttgcaacaacctgtccctgcaaa | M18208 | 48014 | cctcagtcgcaggtctaggcagtcc | X69619 | 90618 | gtgacctccattgagaccggctga | AA110812 |
| 5411 | gctccctgcaaactaaataaagca | M18208 | 48015 | acagttcttgcagttcaaggac | X69619 | 90619 | acctccattgagaccggctgaatg | AA110812 |
| 5412 | atgtaccaggcgactatcgtgacac | M18208 | 48016 | cattaaccactacgcatgagggt | X69619 | 90620 | attgagacgcggtgaatgtggatt | AA110812 |
| 5413 | gactatgcgacactgagcgagatgg | M18208 | 48017 | ccactaccgcatgaggggtcacagc | X69619 | 90621 | tttgcttgattcacaaggaacgga | AA110812 |
| 5414 | tatgaaactcagctccgcagataca | M18208 | 48018 | ctaccgcatgaggggtcacagcccc | X69619 | 90622 | cgcatggtacttgtgggatgtga | AA110812 |
| 5415 | ctctccagatatcatcaacacactga | M18208 | 48019 | cttigccaaccttaagtcatgctgt | X69619 | 90623 | gatgacatggctgacacttgcggta | AA110812 |
| 5416 | agatacatcaacacactgaccaggc | M18208 | 48020 | tgccaacttaagtcatgctgtgtg | X69619 | 90624 | gacatggctgacacttgcggtacaa | AA110812 |
| 5417 | acacactgaccaggcctaggtatggga | M18208 | 48021 | gctgagaccatgtcatgctgtat | X69619 | 90625 | atggtgacacttgcggtacaactc | AA110812 |
| 5418 | aacacaggtgacttcctggagtgc | M18208 | 48022 | catgtcatgctgtattacgatgat | X69619 | 90626 | actccagctaccaacagatgcctg | M64404 |
| 5419 | ggtggactcctggagttgcagctct | M18208 | 48023 | tggctcctagagtcgccaagtc | X69619 | 90627 | agcctaccaacagatgcctgaagaag | M64404 |
| 5420 | atatcatgatgcaggaggatg | M18208 | 48024 | ctgctcctagagtcgccaagtccca | X69619 | 90628 | tgtcctgactgttcctgccag | M64404 |
| 5421 | tatcatcatgcaggaggatgc | M81475 | 48025 | tgctccaggtcccagagaaaatggat | X69619 | 90629 | ctgcagacaatgaactctggagat | M64404 |
| 5422 | cctgtgcacagcaggggtcccaa | M81475 | 48026 | gatcatgctccctgctatacg | X69619 | 90630 | acacgcacgtgcagcacatgctat | M64404 |
| 5423 | ccaacctagagcaaatcacattt | M81475 | 48027 | tgctccctgctatcacgccaat | X69619 | 90631 | acgtgcacgtgcagcacatgctat | M64404 |
| 5424 | caacctagagcaaatcacatta | M81475 | 48028 | ctctgactcagcgccaattagt | X69619 | 90632 | atgcaactgcatgtatiggtcc | M64404 |
| 5425 | accctagagcaaatcacatttat | M81475 | 48029 | ggagtgccaagccacatagcagg | X69619 | 90633 | tgtattgggctccccaaggatgaa | M64404 |
| 5426 | attgtaatttcagtcgcattattc | M81475 | 48030 | aagccacatagcggcacctctgg | X69619 | 90634 | ggatgaaccctcttggcttagaa | M64404 |
| 5427 | ttgtaattcagtcgcattattctg | M81475 | 48031 | cttcactcaaacagtcattaaccac | X69619 | 90635 | ggttattcgtgtcacgaaagtt | M64404 |
| 5428 | taatttcagtcgcattattctgtaa | M81475 | 48032 | ccactcaacagtcattaacacac | X69619 | 90636 | gaaagtttctacctcatccctgaa | M64404 |
| 5429 | aaatcagtcgcattattctgaag | M81475 | 48033 | aaacagtcattaaccactacgcatg | X69619 | 90637 | ctcatccctgacttggctitat | M64404 |
| 5430 | tcagtcgcattattctgiaagaa | M81475 | 48034 | cctgcttcacagatattattccag | AA163866 | 90638 | gaagaagttcctcactactctgcaaa | M64404 |
| 5431 | tcagtcgcatttattctgiaagaaa | M81475 | 48035 | cctgttcacagatattattccag | AA163866 | 90639 | cactactgcaaaatgtggctctcag | M64404 |
| 5432 | caccccaggggcgtcaggaaggaaccg | M81475 | 48036 | ttaacgccacagatggcactggt | AA163866 | 90640 | atgtggctccaggcccttccgat | M64404 |
| 5433 | gaaagcccgtaatgactcaggagcc | M81475 | 48037 | taacgccacagatggcactggtg | AA163866 | 90641 | cttcagccctctgatgtrgatg | M64404 |
| 5434 | agcccgtaatgactcaggggcctg | M81475 | 48038 | aacgccacagatggcactggtgg | AA163866 | 90642 | ggccctctgatgatgaatgaa | M64404 |
| 5435 | cccgtaatgactcagggccctgt | M81475 | 48039 | acacgccacagatggcactggtggc | AA163866 | 90643 | atctaatcatticttgaccatt | M64404 |
| 5436 | gtaatgactcaggggccctgcagc | M81475 | 48040 | cagccacagatgggactggtggca | AA163866 | 90644 | tcatttatcattcttaacctgaa | M64404 |
| 5437 | taatgactcaggggccctgcagca | M81475 | 48041 | ccacagatggcactgggtggccaggtc | AA163866 | 90645 | ttctaacctgaaacatggaaagt | M64404 |
| 5438 | actcaggggccctgcagcagat | M81475 | 48042 | ccacagatggcactggtggcaggtc | AA163866 | 90646 | gaggacagctgctgtagtgtata | AA110992 |
| 5439 | aggccctggcagcacagatgggt | M81475 | 48043 | acagatggcactggtggcaggtcca | AA163866 | 90647 | gatagctgcgctgtagtgtataagg | AA110992 |
| 5440 | cgtacaagcagtcgcacagcagat | M81475 | 48044 | cagatggcactgggtgcaggtccat | AA163866 | 90648 | gatggctagcggttagtagccaag | AA110992 |
| 5441 | tgctatatttgcactgatctaat | M68915 | 48045 | tggcaggtccattctacgagatgga | AA163866 | 90649 | cttagtagccaagttgccagatct | AA110992 |
| 5442 | gcttctaccaactcacacattcct | M68915 | 48046 | tgctttcacagatattatccagga | AA163866 | 90650 | agccaagttgccagatctcactg | AA110992 |
| 5443 | tcacaaactcctgacagcttgca | M68915 | 48047 | cttcacagatattattccagatt | AA163866 | 90651 | caagttgccagatctcactgc | AA110992 |
| 5444 | aactctctgacgtgtcatgatct | M68915 | 48048 | ttcacagatattatttccaggttca | AA163866 | 90652 | gttgccagatctcactgcact | AA110992 |
| 5445 | ttgtgaaactgtcacctgtactg | M68915 | 48049 | tggtgacttaacgccacagatgg | AA163866 | 90653 | cagatctcactgcgactgggtct | AA110992 |
| 5446 | tccacctgactgctgaatacg | M68915 | 48050 | gggacttaacgccacagatggcat | AA163866 | 90654 | atcttcactgtgcactgggtct | AA110992 |
| 5447 | aatccgacactgcctgtgaatt | M68915 | 48051 | gtgacttaacacgccacagatggcat | AA163866 | 90655 | tgactgtcactgggtctggaaga | AA110992 |
| 5448 | ttgctccagttgcccaagaatcct | M68915 | 48052 | acttaacacgccacagatggcact | AA163866 | 90656 | atggtaagtgctctggccaggcctt | AA110992 |
| 5449 | tgcccaagatctgggccgcatggt | M68915 | 48053 | acttaacacgccacagatggcactg | AA163866 | 90657 | agtgctgcatggccaggccttggccgag | AA110992 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5450 | tgaagccgctcctcttcacaaaa | M68915 | 48054 | aatttgcgcagggatccaagatg | AA028462 | 90658 | catcatggaagcaccacttgacatg | AA110992 |
| 5451 | cgctcctcttcacaaaagtgatg | M68915 | 48055 | attgccagcgggatccaagatgg | AA028462 | 90659 | ccacttgacatgctacactgttc | AA110992 |
| 5452 | atttgcactgatctaatcctaaa | M68915 | 48056 | gctccggcgaccatgcagagcctt | AA028462 | 90660 | ctttgcactgtacactgtcgg | AA110992 |
| 5453 | tcaaactccagtgaccatgagga | M68915 | 48057 | ctcggccgaccatgcagagcctt | AA028462 | 90661 | catgctaccactgtcggctacaac | AA110992 |
| 5454 | atgaggaattcctgtatgaaagt | M68915 | 48058 | tcggccgaccatgcagagcctttc | AA028462 | 90662 | gctacactgtcggctacaactat | AA110992 |
| 5455 | aattcctctgtatgaagtctact | M68915 | 48059 | cggccgaccattgcagagcctttc | AA028462 | 90663 | acactgttcggctacaactatggc | AA110992 |
| 5456 | caattcctctggaaggactgaggg | M68915 | 48060 | ccgaccattgcagagcctttccaa | AA028462 | 90664 | gttcggctacaactatggcaaatac | AA110992 |
| 5457 | gatcaagctatatccggaattgat | M68915 | 48061 | cgaccattgcagagcctttcccaa | AA028462 | 90665 | caaatacatggcacactgctgatg | AA110992 |
| 5458 | gctatatccggaattgatcaaggc | M68915 | 48062 | gaccattgcagagcctttcccaaa | AA028462 | 90666 | gaggcctcaggagaagctgaagctgaacta | AA110992 |
| 5459 | cacagcgctactccaactccacaaa | M68915 | 48063 | accattgcagagcctttcccaaacg | AA028462 | 90667 | actgatggctcacacagtacggaa | AA110992 |
| 5460 | gagcacagaagcagcaccagagctc | M68915 | 48064 | ccattgcagagcctttcccaaacgg | AA028462 | 90668 | attttgcactgcactattgaacatgacc | AA111021 |
| 5461 | agcacagaagcagcaccagagctcc | W51418 | 48065 | cattgcagagcctttcccaaacgga | AA028462 | 90669 | tgcactgcactattgaacatgacct | AA111021 |
| 5462 | cccacagaaaaaccagctgaaggtg | W51418 | 48066 | ttgtggcagcgggatccaagatgc | AA028462 | 90670 | cactgcactattgaacatgaccct | AA111021 |
| 5463 | cccacagaaaaaccagctgaaggtga | W51418 | 48067 | tggcagcgggatccaagatggca | AA028462 | 90671 | cactattgaacatgacccctgccaga | AA111021 |
| 5464 | ccacagaaaaaccagctgaaggtgat | W51418 | 48068 | tggcaagctcggcgaccattgca | AA028462 | 90672 | aacatgacctgccagaaatgcaaa | AA111021 |
| 5465 | cacagaaaaccagctgaaggtgatc | W51418 | 48069 | gcaaagctcggccgaccattgcaga | AA028462 | 90673 | catgacctgccagaaatgcaaagg | AA111021 |
| 5466 | acagaaaaccagctgaaggtgatca | W51418 | 48070 | caaagctcggccgaccattgcagag | AA028462 | 90674 | tgacctgccagaaatgcaaaagga | AA111021 |
| 5467 | cagaaaaccagctgaaggtgatcaa | W51418 | 48071 | aaagtctcggccgaccattgcagagc | AA028462 | 90675 | accctgccagaaatgcaaagggaat | AA111021 |
| 5468 | gaaaccagctgaaggtgatcaact | W51418 | 48072 | aagctcggcgaccattgcagagcc | AA028462 | 90676 | gtcctgaagctcagatgaagttca | AA111021 |
| 5469 | aaccagctgaaggtgatcaactg | W51418 | 48073 | agctcggccgaccattgcagagcct | AA028462 | 90677 | gtcaaaccaggcgtccggcagag | AA111021 |
| 5470 | aaaccagctgaaggtgatcaactgg | W51418 | 48074 | gttgaccaccaggcgaaactgta | AA028462 | 90678 | gatggctcacacagtacggaaagac | AA111021 |
| 5471 | gcacagaagcagcaccagagctcct | W51418 | 48075 | gaccacacaggcgaaactgtactc | AA028462 | 90679 | gctcacacagtacggaaagactaca | AA111021 |
| 5472 | accagagctcctgccacatctctg | W51418 | 48076 | atctctatgaggtagatgttctaa | X69620 | 90680 | ctgcgcactgcgtgtcgttcct | AA111021 |
| 5473 | ccagagctcctgccacattctcgg | W51418 | 48077 | gatgttctaaacaatcctcgagtg | X69620 | 90681 | gccactgcgtgtcgttcctt | AA111021 |
| 5474 | cagagctcctgccacttctcgtg | W51418 | 48078 | aatcctctgcagttcccactctct | X69620 | 90682 | ttccttccatttgcactgcacta | AA111021 |
| 5475 | ctcctgccacattctcggttggga | W51418 | 48079 | ggcctgcagttgtcagggtataag | X69620 | 90683 | tcctttccattttgcactgcacta | AA111021 |
| 5476 | tcctgccacattctcggttggga | W51418 | 48080 | ctgcagttgtccgtacacccagaagg | X69620 | 90684 | ctttccatttgcactgcactatt | AA111021 |
| 5477 | tgggcagccacttctctggggc | W51418 | 48081 | ttctgtccgtacacccagaagg | X69620 | 90685 | ttccatttgcactgcactatga | AA111021 |
| 5478 | tgggcagccacttctctggccgc | W51418 | 48082 | gtcgtaagtccccaccttagtt | X69620 | 90686 | gcaattagcggtgcagcttacct | AA051500 |
| 5479 | tgaagttaattcctctggccgtcc | W51418 | 48083 | cccacagactgcgtgctaagta | X69620 | 90687 | attagcggtcagttacctttac | AA051500 |
| 5480 | aatgtaattcctctgcctgcctgcctt | M55617 | 48084 | atttttacgtcatgtacagtataag | X69620 | 90688 | ccatgttgcacagcctgccagcag | AA051500 |
| 5481 | ccaggtctgcgtgggcagtccaga | M55617 | 48085 | ttacgtcatgctacagtataagaca | X69620 | 90689 | tgtggtcacagcctgccagcagcaa | AA051500 |
| 5482 | caggtctgcgtgggcagtcccagaa | M55617 | 48086 | ttttgctctttctcaagcaagtga | X69620 | 90690 | agcctgccagcaagaagaccacctgg | AA051500 |
| 5483 | gtctgcgtgggcagtcccagaaga | M55617 | 48087 | tccttttctaagagaatgaatgtt | X69620 | 90691 | ctgcagcagaagagaacactgggtc | AA051500 |
| 5484 | tctgcgtgggcagtcccagaaagaa | M55617 | 48088 | atgattgcttcaatgttgcactg | X69620 | 90692 | cacctcagttggaagtagcagaatgc | AA051500 |
| 5485 | aaagctgacctgcgtgcaatacaga | M55617 | 48089 | ttcaatgttgcactgatctagtg | X69620 | 90693 | gctcttaggagactctgctagctt | AA051500 |
| 5486 | aagctgacctgcgtgcaatacaga | M55617 | 48090 | gttgcactgatctagtgcatggt | X69620 | 90694 | cttaggagactctgctatgctt | AA051500 |
| 5487 | cctgacctggtgcaatcagagt | M55617 | 48091 | actgactagttgcatggttagtca | X69620 | 90695 | aggagactctgctgctatgctgcc | AA051500 |
| 5488 | ctgacctgcgtgcaatcagagtct | M55617 | 48092 | agaaggccagcgggatcagattaat | X69620 | 90696 | gactctgctgctatgctgccag | AA051500 |
| 5489 | acctgcgtgcaatcagagtcttca | M55617 | 48093 | gaggccatctctatgagtagatg | AA028484 | 90697 | tgctgctatgctgccacaaatg | AA051500 |
| 5490 | acctggtcaatcagagtcttcaa | M55617 | 48094 | tgcatttgcttgcagatcaatt | AA028484 | 90698 | agggctgcagttcagcctttacaac | AA051500 |
| 5491 | cctcgcgtccttctgacttat | M55617 | 48095 | ccttttgcttgcagatcaattc | AA028484 | 90699 | gcttgcagttctactaacaca | AA051500 |
| 5492 | ctgcctgcgtcctctgactttca | M55617 | 48096 | tcttttcataaacatttcaagaat | AA028484 | 90700 | tgtcagttaccttaccaacacaga | AA051500 |
| 5493 | ctgcctcttgactttatcaagcc | M55617 | 48097 | ttttcataaacattctaagaatcct | AA028484 | 90701 | cagcttacttacaacacagagggt | AA051500 |
| 5494 | tttatcaagccgggaagatgtgcc | M55617 | 48098 | aacattctaagaatcctgatgagaa | AA028484 | 90702 | acttaacacagagggctccagct | AA051500 |
| 5495 | agggacagaacctacctcagataca | M55617 | 48099 | acatttctaagaatcctgatgagaaa | AA028484 | 90703 | ttacaacacagagggctccagctgtt | AA051500 |
| 5496 | gtgacagaacctacctcagatacac | M55617 | 48100 | atttctaagaatcctgatgagaaaac | AA028484 | 90704 | caacacagaggggtccagctgttcac | AA051500 |
| 5497 | tgcagaacctacctcagatacact | M55617 | 48101 | ttctaagaatcctgatgagaaaact | AA028484 | 90705 | cagccatgttgcacagcctgccag | AA051500 |
| 5498 | acctccaggctgcgtgggcagtcc | M55617 | 48102 | ggaaatgaaacaccaccattaaagc | AA028484 | 90706 | aagatgctccctgctgctcga | AA049017 |
| 5499 | atcagaaggaccatgctggttac | W51428 | 48103 | gaaatgaaacaccaccattaaagcc | AA028484 | 90707 | ccctgtgctgctgaagaagaggc | AA049017 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5500 | aggaccatgctgtgttacaaggcg | W51428 | 48104 | atgaaacaccaccattataagcccct | AA028484 | 90708 | atgcctgagtgctacatccgtgcca | AA049017 |
| 5501 | ctatcttgacaaccgaaccatgag | W51428 | 48105 | tgaaacacaccattataagccctg | AA028484 | 90709 | gagtgctacatccggcagcacca | AA049017 |
| 5502 | ctcttgacaaccgaaccatgagtca | W51428 | 48106 | ctttttgcttgcagatcaattca | AA028484 | 90710 | tgctacatccggcaccaccatca | AA049017 |
| 5503 | ttgacaaccgaaccatgtcatca | W51428 | 48107 | aacaccaccattataagccctggca | AA028484 | 90711 | tacatccgtggcagcaccatcaagt | AA049017 |
| 5504 | acaacgaaccatgagtcatcaccc | W51428 | 48108 | cagatcaatttcatcttttcataa | AA028484 | 90712 | cgtggcagcaccatcaagtaccgc | AA049017 |
| 5505 | acgaaccatgagtcatcaccctca | W51428 | 48109 | agatcaatttcatcttttcataa | AA028484 | 90713 | ggcagcaccatcaagtaccgcgca | AA049017 |
| 5506 | gaaccatgagtcatcaccctcatcc | W51428 | 48110 | atcaatttcatcttttcataaa | AA028484 | 90714 | agcaccatcaagtaccgcgcatcc | AA049017 |
| 5507 | ccatgagtcatcaccctcatcagg | W51428 | 48111 | tcaatttcatcttttcataacat | AA028484 | 90715 | atcaagtaccgcgcatccctgatg | AA049017 |
| 5508 | acccctcatccaggtcagattgtcga | W51428 | 48112 | caatttcatcttttcataaacat | AA028484 | 90716 | aagtaccgcgcatccctgatgagaca | AA049017 |
| 5509 | ctcatccaggtcagattgtcgagca | W51428 | 48113 | ttcatcttttcataaacattcta | AA028484 | 90717 | tacctgcgcatccctgatgagatca | AA049017 |
| 5510 | atccaggtcagattgtcgagcatg | W51428 | 48114 | catcttttcataaacattctaaga | AA028484 | 90718 | aagacagcgcagaatcacccatgc | AA049017 |
| 5511 | accatgctgtgttacaaggcgagg | W51428 | 48115 | tatttccacatggaatagacttta | AA119194 | 90719 | cgcatccgatgagatcattgaca | AA049017 |
| 5512 | aagcctttcatgtgtataggcata | W51428 | 48116 | cacagcaggcaggagcgatttcac | AA119194 | 90720 | gcgagaatcaccccatgctggtga | AA049017 |
| 5513 | atggctccaaagccaatatctac | W51428 | 48117 | ctactacagaggaggcaatggccatc | AA119194 | 90721 | gagactacaagggcatctggtgagt | AA049017 |
| 5514 | gcttccaaaagccaatatctactct | W51428 | 48118 | aatggcatcatgctagtgtatgac | AA119194 | 90722 | acctacaagggcatctggtgagct | AA049017 |
| 5515 | tccaaaagccaatatctactctga | W51428 | 48119 | agtgtatgacatccacaaggtaaa | AA119194 | 90723 | aacgggcatctgggagctgtgaca | AA049017 |
| 5516 | agccaatatctactctgacaacg | W51428 | 48120 | gtgtatgacatccacaaggtaaaa | AA119194 | 90724 | calctggagctgtgacaactga | AA049017 |
| 5517 | caatatctactctgacaaccgaac | W51428 | 48121 | gtatgacatcacccaacggtaaaagc | AA119194 | 90725 | tggatgaacatcaacctccgggag | AA049017 |
| 5518 | tatctactctgacaaccgaaccat | W51428 | 48122 | tatgacatcacccaacggtaaaagt | AA119194 | 90726 | atctgcacgtccgggatggtgaca | AA049017 |
| 5519 | cagctggtctttctggactcct | W51428 | 48123 | tgacatcaccacaacggtaaaagctt | AA119194 | 90727 | gaatggctgccttacaatgacagaga | AA049017 |
| 5520 | gcttgtcttttctggactccgg | W51428 | 48124 | gacatcaccaacggtaaaagtg | AA119194 | 90728 | atggcctccattacaatgacagaa | AA049017 |
| 5521 | gctttgccaagtgcgcggcccttt | W51430 | 48125 | catccaacggtaaaagcttggag | AA119194 | 90729 | atattccgaagtctaaltccgt | AA111135 |
| 5522 | agcggcccttgcctgctgcctgcgattggc | W51430 | 48126 | aacatcagcaagtggcttagaaaca | AA119194 | 90730 | agatagccagtccttcaagtgta | AA111135 |
| 5523 | cggcccttgcctgctgattggct | W51430 | 48127 | acagccaggccaggagcgatttcaca | AA119194 | 90731 | agccagtccttcaagtgtatctg | AA111135 |
| 5524 | gccccttgcctgctgaattggcct | W51430 | 48128 | ggagcgatttcacccatcacaacac | AA119194 | 90732 | agccagtccttcaagtgtatctg | AA111135 |
| 5525 | tttgccctgattgcctggcctgt | W51430 | 48129 | gagcgatttcacacccatcacaacct | AA119194 | 90733 | ccagtcctccaagtgtatctgacc | AA111135 |
| 5526 | ctgattggctgctgctgtgacaagaa | W51430 | 48130 | acaacctcctactacagaggagcaa | AA119194 | 90734 | agtcctcaagtgtatctgaccat | AA111135 |
| 5527 | gattggctgctgctgtgacaagagt | W51430 | 48131 | acctcctactacagaggagcaatg | AA119194 | 90735 | gtgtatctgaccatctctggc | AA111135 |
| 5528 | ttggctgctgctgacaaagaagtc | W51430 | 48132 | acctcctactacagaggagcaatgg | AA119194 | 90736 | gtaccatctctggcgaagcgaa | AA111135 |
| 5529 | tgacaagaagctgcccgtccgat | W51430 | 48133 | ctcctactacagaggagcaatggac | AA119194 | 90737 | accatctctgggccaagctgaagg | AA111135 |
| 5530 | acgcacagaggagagaagcgctcc | W51430 | 48134 | tcctactacagaggagcaatgggca | AA119194 | 90738 | tctctgggccaagctgaaggagag | AA111135 |
| 5531 | taccccctgggagtagactgatac | W51430 | 48135 | ccaactgcctgggaagcaagat | X71788 | 90739 | ggcctgcttacaatgacagaatg | AA111135 |
| 5532 | cccctctggagactgtgatactg | W51430 | 48136 | gggacacctgggctaagagaagacg | X71788 | 90740 | cctgcttacaatgacagaatggca | AA111135 |
| 5533 | gatactggagcacatcataggccagg | W51430 | 48137 | gctccatgcatacatagggaagt | X71788 | 90741 | atgggcaacctccacatcctg | AA111135 |
| 5534 | ctggagcacatcataggccaggcttt | W51430 | 48138 | ctagtacactcaagccaaccatgt | X71788 | 90742 | cctccacatcctgtacaagaa | AA111135 |
| 5535 | cacatctaggccaggcttttggcaa | W51430 | 48139 | ggatcccacctgggaaacccaatgt | X71788 | 90743 | catcctgtacatcagaatggta | AA111135 |
| 5536 | cattctaggccaggctttggcaagt | W51430 | 48140 | tccccacctgggaaaccaatgctata | X71788 | 90744 | tctcctgtacatcagaatggtgata | AA111135 |
| 5537 | tctaggccaggctttggccaagtga | W51430 | 48141 | aaccaatgctatagctttcagagact | X71788 | 90745 | tcctgtacatcagaatggtgatatt | AA111135 |
| 5538 | aggcttttggcaagtgagcgcct | W51430 | 48142 | caatgtatgacgtcttcagagatgta | X71788 | 90746 | tgtatttccggaagtgctaatttct | AA111135 |
| 5539 | cagaaatcctgatgacattacgaat | W51430 | 48143 | ttcagagactgtatccatttgcag | X71788 | 90747 | tacattcccagtgaatcctgggcta | AA118687 |
| 5540 | aaatcctgatgacgcttttgaa | W51430 | 48144 | gactgtatccatttgcagaaccgt | X71788 | 90748 | acatttcccagtgaatcctggcta | AA118687 |
| 5541 | gtcccagacgccgctcctttgatc | W51433 | 48145 | tgatcctcattgcagaaccgtgaa | X71788 | 90749 | gaacagtccttcagtgactgaatca | AA118687 |
| 5542 | tccaagacgcgctcctttgatgct | W51433 | 48146 | cccagcatccaacaaccagctggga | X71788 | 90750 | tccttcagtgactgaatcatgcat | AA118687 |
| 5543 | cccagagacgcgctcctttgatctca | W51433 | 48147 | tctgtcttcattggcagaggcaa | X71788 | 90751 | atgtcatccagaagacagtctcctt | AA118687 |
| 5544 | ccagagacgcgctccttttgatcat | W51433 | 48148 | tgtctttcattaggcagaggcaat | X71788 | 90752 | tccaagacgtcctcctgcataa | AA118687 |
| 5545 | caagacgcgcctcctttgatctat | W51433 | 48149 | taagaagccaactgggcaggcaagcc | X71788 | 90753 | agacagtcctcgcataaagctct | AA118687 |
| 5546 | aagacgcgctcctttgatctattg | W51433 | 48150 | gaagccaactggcgcaggcaagtcc | X71788 | 90754 | tcctttgcataaagctcgaaggtt | AA118687 |
| 5547 | agacgcgctcctttgatctattg | W51433 | 48151 | caagtccaaacccggaagcag | X71788 | 90755 | tgcataaagctcaaggtgtgca | AA118687 |
| 5548 | gacgcgctcctttgatctattga | W51433 | 48152 | gaggttaccacctcacatagaaccag | X71788 | 90756 | aagctcaaggtcgtgcatgact | AA118687 |
| 5549 | gcgcgctcctttgatctattgaaaa | W51433 | 48153 | ggtaccactcacatggaaccaagag | X71788 | 90757 | ttgttatctgatctgacc | AA118687 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 5550 | W51433 | ttgtatgtcgcagagtttatca | 48154 | X71788 | actcacatggaaccagaggaagctg | 90758 | AA118687 |
| 5551 | W51433 | aatcctgatgacattacgaatgaag | 48155 | X70472 | tgctcaaccaggttcctacaagc | 90759 | AA118687 |
| 5552 | W51433 | ctgcccctatgaccatgcctggaa | 48156 | X70472 | ctgcccctatgaccatgcctggaa | 90760 | AA118687 |
| 5553 | W51433 | agcattttctgttgaaggacaatt | 48157 | X70472 | tgagtctagctttgggaagttcctg | 90761 | AA118687 |
| 5554 | W51433 | catttttctgttgaaggacaattag | 48158 | X70472 | acaaggtccactcctgggcctgct | 90762 | AA118687 |
| 5555 | W51433 | tcttttgtcccaagacgcgctcct | 48159 | X70472 | tgtcctccaccaatgctagaaga | 90763 | AA118687 |
| 5556 | W51433 | tttgcccaagacgcgctcctttg | 48160 | X70472 | caggctctcatccagtcggcctca | 90764 | AA118687 |
| 5557 | W51433 | ttgtcccaagacgcgctcctttga | 48161 | X70472 | ctcatccagtcagactcctcag | 90765 | AA118687 |
| 5558 | W51433 | tgtcccaagacgcgctcctttgat | 48162 | X70472 | ggcctcatccagactcctgttag | 90766 | AA118687 |
| 5559 | W51433 | gtatccaagaagccccgaatacat | 48163 | X70472 | atctcagatcctgcttaggatggg | 90767 | AA118687 |
| 5560 | X04418 | ccccgaatacatcctatcaagagc | 48164 | X70472 | cctcgtccgttgtacactgc | 90768 | U03645 |
| 5561 | X04418 | aaatctgtcttgccgcaacacat | 48165 | X70472 | ctcctgttggtacactgcccaca | 90769 | U03645 |
| 5562 | X04418 | acaccattctgcctgcggcaggca | 48166 | X70472 | cactgccccacaataaaatgccat | 90770 | U03645 |
| 5563 | X04418 | gcctgcgcaggcattccacaagt | 48167 | X70472 | cccatgtccctggaagacgggcctg | 90771 | U03645 |
| 5564 | X04418 | ggtgccaaatgccccatcaaacaa | 48168 | X70472 | aagaccagtctctcatgcaggagaa | 90772 | U03645 |
| 5565 | X04418 | actgctaaaccaccaticagtccat | 48169 | X70472 | agctctctcaggagaaagccg | 90773 | U03645 |
| 5566 | X04418 | aaaccacattcagtcatctt | 48170 | X70472 | ggcagctcctggccgcctgaagtc | 90774 | U03645 |
| 5567 | X04418 | acattcagtccatctcttctgaga | 48171 | X70472 | tcctgagccgcctgaagtccagcca | 90775 | U03645 |
| 5568 | X04418 | agtccatctcttctgagatgaca | 48172 | X70472 | caagagccgggctcatgtttacag | 90776 | U03645 |
| 5569 | X04418 | ttgcttatagttttcagtcagtc | 48173 | X70472 | gtgaccagttcaggatgtcttcg | 90777 | U03645 |
| 5570 | X04418 | tgcatgctggtgcaattgctc | 48174 | X70472 | aactacttaggtggcagaagtcacg | 90778 | U03645 |
| 5571 | X04418 | aatacatcctatcaagagccaaga | 48175 | AA028396 | ccacatcccgactgaactgga | 90779 | U03645 |
| 5572 | X04418 | agcagctctgtagaggagttgagaa | 48176 | AA028396 | ctcccagactggaactggagttgtc | 90780 | U03645 |
| 5573 | X04418 | agataattagccaggctactccga | 48177 | AA028396 | tgaagccaactgcagctccctt | 90781 | U03645 |
| 5574 | X04418 | ttagccaggctatcctgagccaa | 48178 | AA028396 | tcccacagtcattatgtactccc | 90782 | U03645 |
| 5575 | X04418 | atgggatctacttgtttggtcaca | 48179 | AA028396 | agtcattattgtacttctcctgat | 90783 | U03645 |
| 5576 | X04418 | ttgttggtcacacttccatccct | 48180 | AA028396 | cattatgtactttcctgatg | 90784 | AA028396 |
| 5577 | X04418 | ggtcacacttccatccacaagg | 48181 | AA028396 | tgtactctcctgatgtggtaggaa | 90785 | AA028396 |
| 5578 | X04418 | aatccaaaacttgtcttggccaa | 48182 | AA028396 | tctcctgatgtgtaggaagtcctt | 90786 | AA028396 |
| 5579 | X04418 | agctagacgccccgactgtccagtg | 48183 | AA028396 | ggaagtcctgggctcaaaggtgat | 90787 | AA111168 |
| 5580 | W51466 | cgcagcgagccgcagccggcagaaacc | 48184 | AA028396 | agtcctgggctcaaaggtgatggc | 90788 | AA111168 |
| 5581 | W51466 | atcaggctcgtccagccggaa | 48185 | AA028396 | cctcatcccctggagaccggattgta | 90789 | AA111168 |
| 5582 | W51466 | catagaaaactgcccctttcacag | 48186 | AA028396 | catccccgaaacggttgtagcc | 90790 | AA111168 |
| 5583 | W51466 | taggaaactgcccctttcacagag | 48187 | AA028396 | tggagttgtacctgactactgga | 90791 | AA111168 |
| 5584 | W51466 | ccttttcacagaggctcttcatgac | 48188 | AA028396 | tgtagccaacattgtcgaacagc | 90792 | AA111168 |
| 5585 | W51466 | ttcacagaggctctcatgactct | 48189 | AA028396 | agttgtcacctgacttactggagt | 90793 | AA111168 |
| 5586 | W51466 | cagaggctctcatgactcttgg | 48190 | AA028396 | tgtcacctgacttactgagctgag | 90794 | AA111168 |
| 5587 | W51466 | gaggctctcatgactctttggct | 48191 | AA028396 | acttactggactgagggtctg | 90795 | AA111168 |
| 5588 | W51466 | ctcttcatgactctttggctcaa | 48192 | AA028396 | gggtcgttcctgcagacgaagg | 90796 | AA111168 |
| 5589 | W51466 | cttcatgactctttggctcaagga | 48193 | AA028396 | tctgttcctgcagcagacgaaggt | 90797 | AA111168 |
| 5590 | W51466 | tcatgactctttggctcaaggga | 48194 | AA028396 | gttcctgcagcagacgaaggtgtc | 90798 | AA111168 |
| 5591 | W51466 | cagcagcagccgaggccatggaaccgc | 48195 | AA028396 | cctgcagcagacgaaggctgccag | 90799 | AA111168 |
| 5592 | W51466 | cgggccagccaactggtccatgc | 48196 | AA028396 | tagcagacgtccagccggaatacta | 90800 | AA111168 |
| 5593 | W51466 | ccaactggtccatggcctgcatg | 48197 | AA028396 | agcagacgtccagcggatactaa | 90801 | AA111168 |
| 5594 | W51466 | tcatgactctttggctcaaggga | 48198 | AA028479 | atgtcaagtagtcttcagagtca | 90802 | AA111168 |
| 5595 | W51466 | ctgtcgatgccctgaacggact | 48199 | AA028479 | tcttcaagtagtcttcaagaac | 90803 | AA111168 |
| 5596 | W51466 | cgatgccccctgaacggactgaagga | 48200 | AA028479 | tagttcatcaagaacaaactatg | 90804 | AA111168 |
| 5597 | W51466 | atgcccctgaacggactgaaggagg | 48201 | AA028479 | gatgtcatgacgcattgtggcga | 90805 | AA111168 |
| 5598 | W51466 | tcaggctcttgtcaaggccgg | 48202 | AA028479 | tcaagaacagttcgttcatggc | 90806 | AA111168 |
| 5599 | K03237 | cgttcgaacagttgagagtc | 48203 | AA028479 | agaacagttgtcttcatggctga | 90807 | AA111209 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5600 | gctccatatgctgctagcctggaaa | K03237 | 48204 | acaagcttcgttcatgctgtgataa | AA028479 | 90808 | cgctgtcgttcgagctactcccag | AA111209 |
| 5601 | caattcctaaaatctgctcttctt | K03237 | 48205 | aagcttcgttcatgctgctgataaac | AA028479 | 90809 | aagttacttccaaagtgctgtggag | AA111209 |
| 5602 | cctaaaatctgctcttttatgat | K03237 | 48206 | cttcgttcatggctgataaactgt | AA028479 | 90810 | tacttccaaagtgctgtgggaggac | AA111209 |
| 5603 | atctctgctcttctatgatgatgtc | K03237 | 48207 | ttcgttcatgctgataaactgta | AA028479 | 90811 | cttccaaagtgctgtgaggcacaa | AA111209 |
| 5604 | tgatgtctgctactctgaatttga | K03237 | 48208 | cagacacgtccagtggatactaaac | AA028479 | 90812 | tggaggcacaatcaccggtcggac | AA111209 |
| 5605 | ctgctactctgaatttgagatatt | K03237 | 48209 | gacacgtccagtccggatactaaactt | AA028479 | 90813 | ggcacaatcaccggtcggacacag | AA111209 |
| 5606 | agatattacatgatccatcttttgg | K03237 | 48210 | gtagctatcacatgctcagagt | AA028479 | 90814 | cacaatcaccggtcggacacacag | AA111209 |
| 5607 | tacatgatccatcttttggaatct | K03237 | 48211 | tatcatcaacatgctcagagtctca | AA028479 | 90815 | caatcaccggtcggacacagagct | AA111209 |
| 5608 | atccatcttttggaatctcttctta | K03237 | 48212 | atcatcaacatgctcagagtctcaa | AA028479 | 90816 | atcaccggtcggacacagagtct | AA111209 |
| 5609 | tctctagtcttgcacttgaata | K03237 | 48213 | atcacatgctcagagtcttcagta | AA028479 | 90817 | gccgttcaggcgcaacagagtcgg | AA111209 |
| 5610 | agtcttgcacttgaatatatgat | K03237 | 48214 | cacatgctcagagtcttcaagtagt | AA028479 | 90818 | ttccagggcaacagagtcgggac | AA111209 |
| 5611 | agaatgccctataaggatcctatca | K03237 | 48215 | acatgctcagagtcttcaagtagtt | AA028479 | 90819 | ctgttgcttgagctactcccaggc | AA111209 |
| 5612 | taggatcctatcaaaggcgaagcc | K03237 | 48216 | agaggagtccatccctacttccac | AA028479 | 90820 | tgcttgagctactcccaggcttct | AA111209 |
| 5613 | agacctctagagtacatcataaga | K03237 | 48217 | cttccagagatctacagtgaccgg | AA028479 | 90821 | cttcgagctactcccaggcttctga | AA111209 |
| 5614 | tgaagcatccgacctgcgtcatgat | K03237 | 48218 | tctcctgaaacatctggaagttacc | AA028479 | 90822 | tcgagctactcccaggcttctgaag | AA111209 |
| 5615 | ctccctgaagtcgctgatataagaa | K03237 | 48219 | tattatcaacatcactctgcccact | AA028479 | 90823 | gagctactcccaggcttctgaagtt | AA111209 |
| 5616 | cctgctatgacctagaacaagtt | K03237 | 48220 | cactctgcccactggagttccgatt | AA028479 | 90824 | tactccccaggcttcgaagttactt | AA111209 |
| 5617 | tattgacctagaaacagttgattt | K03237 | 48221 | gccactggagttcgcatcgcttgctg | AA028479 | 90825 | cttcgaagttacttccaaagtgct | AA111209 |
| 5618 | tctagtcaattcctaaaatctcg | K03237 | 48222 | tggagttcgatctgctggagttg | AA028479 | 90826 | tgaagttacttccaaagtgctgtgg | AA111209 |
| 5619 | tgtagacaagtcgcgcaagagttc | W51476 | 48223 | tccgattctgctggagttgatgaa | AA028479 | 90827 | tgccaatgatgcctctgcccgggct | AA111212 |
| 5620 | aggagcttccattcaggagcaacactg | W51476 | 48224 | tggagctccaccagttcctggcgcaac | AA028479 | 90828 | caatgatgcctctgcccgggctgta | AA111212 |
| 5621 | acaagcctccaacatctataagtg | W51476 | 48225 | gcctccaccagttcctggggcaaccag | AA028479 | 90829 | atgctgatgtaccaaccaccaaaggg | AA111212 |
| 5622 | cgcctccaacatctataagttgaa | W51476 | 48226 | gttcctgggcaaccagcaggaggccatc | AA028479 | 90830 | atgatgtaccaaccaccaaaagccac | AA111212 |
| 5623 | ctgatcactaagctggagtcctcc | W51476 | 48227 | catccaggcagccattaagaaagtg | AA028479 | 90831 | atgtaccaaccaaaaggcacctg | AA111212 |
| 5624 | catccatcaagctgggctccttcat | W51476 | 48228 | ctacaggaccgagggtactaagatg | AA028479 | 90832 | taccaaccaaaggccacctgagc | AA111212 |
| 5625 | cactaagctggagtccttcattcag | W51476 | 48229 | tgtgccctggatcaactccacgt | AA028479 | 90833 | caaacaccaaaaggcacctgcgcgat | AA111212 |
| 5626 | gctggagtccttcattcaggaggcac | W51476 | 48230 | ctggatcaactgccacgttcagaa | AA028479 | 90834 | caaacaaaaggcacctgagcgattg | AA111212 |
| 5627 | ggagcttcattcaggaggcaactg | W51476 | 48231 | tcaactgccacgttcagaaagctg | AA028479 | 90835 | aaggcaccgagcgattgatgatca | AA111212 |
| 5628 | cttcattcaggaggcaactgcccgggtc | W51476 | 48232 | cattcgatatcgtcacgggaat | AA028479 | 90836 | gcacctgagcgattgatgtcatg | AA111212 |
| 5629 | cattcaggaggcaactgccgggtcatc | W51476 | 48233 | gatatctctcacggaatagcagt | AA028479 | 90837 | ttcctgatgcagcaggctgagcaggctg | AA111212 |
| 5630 | tcaggagcaactgccgggtcatcggg | W51476 | 48234 | tagcagtagagctcctgaaacat | AA028479 | 90838 | tgcagcagcaggctgagtgat | AA111212 |
| 5631 | gttccactgctgtggcagcaacaac | W51476 | 48235 | tagagctcctgaaacatctggaa | AA028479 | 90839 | tgcccggctgtagagctatgcac | AA111212 |
| 5632 | ccactgctgtggcagcaacaactct | W51476 | 48236 | cagctctcacggatgggaggcctga | AA028593 | 90840 | tgttggcacatctgttcagcccaac | AA111212 |
| 5633 | tggcagcaacactctcagactgctg | W51476 | 48237 | agctctcacggatggggaggcctgag | AA028593 | 90841 | ggcacatctgttcagcccaaccag | AA111212 |
| 5634 | agcagccgctgtggtccctgacag | W51476 | 48238 | cacagtctttgtgatgaatctagt | AA028593 | 90842 | acatctgttcagcccaaccaggca | AA111212 |
| 5635 | tggcctgacagctgctgtaagac | W51476 | 48239 | ctagttccagagccaggagcacg | AA028593 | 90843 | tctgttcagcccaaccaggcagat | AA111212 |
| 5636 | tcctgacgctgtaagactg | W51476 | 48240 | tagttccagagccaggagcga | AA028593 | 90844 | tgttcagcccaaccaggcagatgc | AA111212 |
| 5637 | ctgacagctgtaagactgtggt | W51476 | 48241 | agttccagaggcaggagcacgat | AA028593 | 90845 | gcccaaccaggcagatgcggatgc | AA111212 |
| 5638 | taactggctgtgggtaagcgggacac | W51476 | 48242 | gttccagagccaggagcacgatg | AA028593 | 90846 | agatgccggatcgatgataccaac | AA111212 |
| 5639 | actctggaatcctgccatccgc | AA107455 | 48243 | tttccagagccaggaggcacgatgt | AA028593 | 90847 | ggacatgccgttcacttcgcgaaga | AA111212 |
| 5640 | ccaactggaacttcacagtaga | AA107455 | 48244 | ttccagagccaggagcacgatgtt | AA028593 | 90848 | catgccgttcacttcgcgaaggataa | AA120716 |
| 5641 | agtccactggaactctccccgt | AA107455 | 48245 | tccagagccaggagcacgatgttt | AA028593 | 90849 | attggtgcgctactccattaatg | AA120716 |
| 5642 | ccctgtgtcaaggctggcatcat | AA107455 | 48246 | cagagccaggaggcacgatgttt | AA028593 | 90850 | ggtgacgtactccattaatgatgctg | AA120716 |
| 5643 | tttgtgccaaggctggcatcattgc | AA107455 | 48247 | gagccctgcgtgctagagattacg | AA028593 | 90851 | gctactccattaatgatgctgtca | AA120716 |
| 5644 | aggctggcatcattgcctctgccg | AA107455 | 48248 | ctctcaggtggaggcctgagtt | AA028593 | 90852 | gctactccattaatgatgctgtca | AA120716 |
| 5645 | ctggcatcattgcctctgccgc | AA107455 | 48249 | tctccaggatggaggcctgagttg | AA028593 | 90853 | actccattaatgatgctgtcaatg | AA120716 |
| 5646 | gcatcattgcctctgccgagtg | AA107455 | 48250 | aggcccacagtctttgtgatga | AA028593 | 90854 | aatcttttgtctgactatggctacc | AA120716 |
| 5647 | ctgcccgagctgggagacgcgctt | AA107455 | 48251 | gagccctgcgtcgtgtagagattacg | AA028593 | 90855 | cttttgtgactatggctaccatc | AA120716 |
| 5648 | tccacacctgcaaggatgagca | AA107455 | 48252 | gccccacagtcttttgtgatgaat | AA028593 | 90856 | gactaggctaccatctcagagggga | AA120716 |
| 5649 | acactcgcaagatgagaagagg | AA107455 | 48253 | gccccacagtcttttgtgatgaact | AA028593 | 90857 | taccatctcagaggaacgaggtgc | AA120716 |

| SEQ ID NO | sequence | DBAxnID | SEQ ID NO | sequence | DBAxnID | SEQ ID NO | sequence | DBAxnID |
|---|---|---|---|---|---|---|---|---|
| 5650 | gctgcatcacaatcaaatccaccgc | AA107455 | 48254 | cccacagctctttgtgatgaactca | AA028593 | 90858 | ctctacaattggattcactgaacgaa | AA120716 |
| 5651 | tagatcagatccgtgccatcatgga | AA107455 | 48255 | ccacagctctttgtgatgaactcag | AA028593 | 90859 | gccgttcacttgcgaaggataactc | AA120716 |
| 5652 | atcagatccgtgccatcatggaacaa | AA107455 | 48256 | gctagcatatccttccacttccag | X53532 | 90860 | aggataactcctgacatcatcataa | AA120716 |
| 5653 | agatccgtgccatcatggaacaaga | AA107455 | 48257 | atatcctccacttccagctgggg | X53532 | 90861 | ataactcctgacatcatcataaacc | AA120716 |
| 5654 | acaagaaagccaacatccggaacat | AA107455 | 48258 | ccccaaactactgaagaatgacat | X53532 | 90862 | attggtcacttgatcgaatgtctcc | AA120716 |
| 5655 | aagccaacatccggaacatgtcgcagt | AA107455 | 48259 | atgacatttggcactgtctcctgaa | X53532 | 90863 | cacttgatcgaatgtctccaagga | AA120716 |
| 5656 | acatccggaacatgtcagtcatcgc | AA107455 | 48260 | tttggcactgtctggaaccacat | X53532 | 90864 | atcgaatgtctccaaggaaggtct | AA120716 |
| 5657 | tcatcgccatggaccacggccgcaa | AA107455 | 48261 | accaagtcactcactagccaggtc | X53532 | 90865 | gaatgtctccaaggaaggtctctg | AA120716 |
| 5658 | tggaaccaagccaagtcacgcgtgc | AA107455 | 48262 | ggaccctgattctacattcactttc | X53532 | 90866 | gtcctgccaacaaggggfgaaattg | AA120716 |
| 5659 | aagccaagcaacatggccagataccg | AA062269 | 48263 | tgattctacattacattcaaatgt | X53532 | 90867 | gtgtaaggcacctaagccagatgca | AA120716 |
| 5660 | ccagccaacatggccagataccatg | AA062269 | 48264 | tacattacattcaaatgttactg | X53532 | 90868 | tgtaaggcacctaagccagatgcac | AA120716 |
| 5661 | gccgcgtcatcacaccataaggtg | AA062269 | 48265 | tatttctgtcatcatgggaaatgca | X53532 | 90869 | tgatcgactgcgaaggaggggatat | W07963 |
| 5662 | gccgtcatcacaccataaggtgtaa | AA062269 | 48266 | gggtcttgagacctggctagagt | X53532 | 90870 | agagagcgtttgcctgccaagaa | W07963 |
| 5663 | gctcatacaccataaggtgtaaaa | AA062269 | 48267 | acctggctagagtgaccatgtggt | X53532 | 90871 | agcgggtttggccctggccaagatgga | W07963 |
| 5664 | tagcaagtccatcaaactctgcgg | AA062269 | 48268 | tccacttccaggctggagctg | X53532 | 90872 | cggtttggccctggccaagatggact | W07963 |
| 5665 | caagtccatcaaaatcctgcgtga | AA062269 | 48269 | tagacagttccatctaaaagcac | X53532 | 90873 | ggtttggccctggccaagatggactc | W07963 |
| 5666 | gtccatcaaaatcctgcgtgagaa | AA062269 | 48270 | agttcatctaaaagcacttcagg | X53532 | 90874 | tggcctggccaagatgggactccagg | W07963 |
| 5667 | catcaaaatcctgcgtgagaattt | AA062269 | 48271 | catctaaaagcacttcaggtcaaa | X53532 | 90875 | agcacagacaggatcgcagggaact | W07963 |
| 5668 | aactcctgcgtgagaatttaccag | AA062269 | 48272 | aaggcaaccagcttgggfgctgtca | X53532 | 90876 | ggcacagacaggatcgcagggaactg | W07963 |
| 5669 | atttaccagactctcaagagcatct | AA062269 | 48273 | accagctgggtgtcaccttgc | X53532 | 90877 | ggaactgcattagcctggctgc | W07963 |
| 5670 | ttaccagactctcaagagcatctgc | AA062269 | 48274 | accttgccaagtttctaatactgt | X53532 | 90878 | gtaaggcacctaagccacagcaac | W07963 |
| 5671 | gcaccatggccagataccgatgctg | AA062269 | 48275 | ttctaatactgtatgtctgatagc | X53532 | 90879 | taaggcacctaagccagatgcacca | W07963 |
| 5672 | ccatgccagataccgatgctgcgt | AA062269 | 48276 | atatttgtgccctgcctgcgct | X87096 | 90880 | aaggcacctaagccagatgccaccag | AA111149 |
| 5673 | tggccagataccgatgctgccgag | AA062269 | 48277 | ctgcctacgcgggtggalactgtgc | X87096 | 90881 | aggcacctaagccagatgcaccagg | AA111149 |
| 5674 | ccagataccgatgctgccgcagaa | AA062269 | 48278 | ccctcagtctaggagagccgtga | X87096 | 90882 | ggcacctaagccagatgcaccagga | AA111149 |
| 5675 | gataccgatgctgccgcagcaaaag | AA062269 | 48279 | ctctcaactacaactgccagtgctct | X87096 | 90883 | gcacctaagccagatgcaccaggag | AA111149 |
| 5676 | acgatgctgccgcagcaaaagcag | AA062269 | 48280 | caactgccagtgtctccccatga | X87096 | 90884 | ccacctaagccagatgcaccaggagg | AA111149 |
| 5677 | gatgctgccgcagcaaaagcaggag | AA062269 | 48281 | ctgcagtgtctctcccatgag | X87096 | 90885 | atgalcgaggfggcagggaggta | AA111149 |
| 5678 | gcgctgccgcagcaaaagcaggag | AA062269 | 48282 | taagtcctagggcctcaactgcc | X87096 | 90886 | aatgtgaggtcaaccacagcagt | AA111149 |
| 5679 | accccagattctgagctgcagc | W51489 | 48283 | atgcagcgccctgctgatcttgat | X87096 | 90887 | attgtaggftcaaccacagcagg | AA111149 |
| 5680 | gatctgagctgcagccctggctc | W51489 | 48284 | ggacactgctgctattgatcttgat | X87096 | 90888 | accgctattagccagatgtgtc | AA111149 |
| 5681 | cagtagccagcagccctggctcga | W51489 | 48285 | tgtgctattcgatctgattgtcga | X87096 | 90889 | cgcctttattagccagattgtgtc | AA111149 |
| 5682 | gtcgtgaccgcagattgtgatgt | W51489 | 48286 | gctatttgcagccagattgtcttc | X87096 | 90890 | gcctattagccagattgtgtctc | AA111149 |
| 5683 | gctgaccgcagattgtgatgtcgt | W51489 | 48287 | atcgatcttgattgtcgaagagt | X87096 | 90891 | ccttattagccagattgtgtctcca | AA111149 |
| 5684 | ttgattcgtcttgcgaacagaaag | W51489 | 48288 | gtgcttcgatatcgatgccgaacg | X87096 | 90892 | ctattagccagattgtgtcttccat | AA111149 |
| 5685 | tcgtctgcaacagaaagcacgaa | W51489 | 48289 | cttcgatatcgatgccgaacggge | X87096 | 90893 | ttattagcagattggccctgaatgtgatctt | AA111149 |
| 5686 | ttctcaacagaaagcacgaatga | W51489 | 48290 | ctgatcgatgccgaacggccgttga | X87096 | 90894 | tgatttggccctgaaatggtgatctt | AA111149 |
| 5687 | actccgagcacgtccgtgcgtgtc | W51489 | 48291 | cagccgaactgcgttgatccgtct | X87096 | 90895 | gatttggccctgaatggtgatctta | AA111149 |
| 5688 | tgcgagacgctcccgtcgtcatc | W51489 | 48292 | ccgttgatccgctccaggagaaatg | X87096 | 90896 | atttggccctgaatggtgatctta | AA111149 |
| 5689 | caccttcatccgcagccacgagga | W51489 | 48293 | tgatccgctccaggagaatgggc | X87096 | 90897 | ttggccctgaatggtgatcttacag | AA111149 |
| 5690 | cttcatccgcagccagcaggacga | W51489 | 48294 | tccatgaccgcccaaggaaccac | X87096 | 90898 | ttgatggctcaaccacagcagtgg | AA111149 |
| 5691 | tctgagctcagcctggctcta | W51489 | 48295 | ggaccgctcgaggcaggaagaag | AA028701 | 90899 | gtaggtcaaccacagcagtggaa | AA111149 |
| 5692 | ctgcagcctggcttctccgtca | W51489 | 48296 | tttgaaatgtcaccacgctgtga | AA028701 | 90900 | tcaaccacagcagtggaaactggg | AA111149 |
| 5693 | tctcttcctcacagcagcacgcagt | W51489 | 48297 | ttgaatggtcaccagctgctggc | AA028701 | 90901 | aaccacagcagtggaaactggga | AA111149 |
| 5694 | acgtcaccacagcagtgaagt | W51489 | 48298 | accagctgcagctgccgcagttc | AA028701 | 90902 | atggagaactccaattccatccgca | AA111149 |
| 5695 | accgcaccacagtgaagtccgggg | W51489 | 48299 | ctgctgcagccgcagttcataatgg | AA028701 | 90903 | gagaactccaattccaatccgcacca | AA111149 |
| 5696 | cttgcgttccagccaacagc | W51489 | 48300 | tgctgcggccagtctaatgga | AA028701 | 90904 | ctaaccgcttattagccagatg | AA111149 |
| 5697 | gttccagtagcaacagctcgcc | W51489 | 48301 | gctgcagccgcagttcataatgac | AA028701 | 90905 | taaccgcttattagccagatgtg | AA111149 |
| 5698 | ccagtagcaacagtctgcgccagc | W51489 | 48302 | ctggcagccgcagttctaatggaca | AA028701 | 90906 | tgcfgccaccggagcgagaggga | AA111356 |
| 5699 | gcaccgaatcactgcgcttcgagtgccagg | AA073984 | 48303 | tggcagccgcagttcttatgggacat | AA028701 | 90907 | agctgcgaccagcatttgtcgcfgaag | AA111356 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5700 | cactgagtcgcccaggtgtcggga | AA073984 | 48304 | ggcagccgcagtctaatggcatc | AA073984 | 90908 | tgattgcatcaatgactgtgggcaa | AA111356 |
| 5701 | ttgaaaatgtcccacctgtcattc | AA073984 | 48305 | gcagccgcagttctaatggacatct | AA073984 | 90909 | attgcatcaatgactgtgggcaaag | AA111356 |
| 5702 | atgtcccacctgtcattccaacacc | AA073984 | 48306 | cagccgcagttctaatggacatct | AA073984 | 90910 | gatgtcagtgctcttcccgatg | AA111356 |
| 5703 | ctcaccactacctcattagtatcta | AA073984 | 48307 | cgtttgacgacgaatacctgaagtg | AA073984 | 90911 | tgtcagtgctcttcccgatgg | AA111356 |
| 5704 | accactacctcattagtatctaccg | AA073984 | 48308 | tgaaatggtcaccacgtctggca | AA073984 | 90912 | tcagtgctcttcccgatgtg | AA111356 |
| 5705 | tcattagtatctaccgggataagct | AA073984 | 48309 | gaaatgtcaccacgctgctggcag | AA073984 | 90913 | agtgctctctcctgatgtgtga | AA111356 |
| 5706 | ttagtatctaccgggataagctctt | AA073984 | 48310 | aaatgtcaccacgctgctggcagc | AA073984 | 90914 | ctctctcctgatgtgtgaactg | AA111356 |
| 5707 | gtatctaccgggataagctctctt | AA073984 | 48311 | aatggtcaccacgctgctggcagc | AA073984 | 90915 | ctcttcctgatgtgtgaactgca | AA111356 |
| 5708 | gggataagctctctttgtgtctgt | AA073984 | 48312 | atggtcaccacgctgctggcagccg | AA073984 | 90916 | cttcctgatgtgggtgaactgcatg | AA111356 |
| 5709 | ataagctctctttgtgtctgtgat | AA073984 | 48313 | tggtcaccacgctgctgcagccgc | AA073984 | 90917 | tccctgatgtggtgaactgcatgca | AA111356 |
| 5710 | tctcttttgtgtctgtgatacagac | AA073984 | 48314 | gtcaccacgctgctgcagccgcag | AA073984 | 90918 | ctgcggacatttgctgctgaagca | AA111356 |
| 5711 | tgagtcgccaggtgtcgggaaaat | AA073984 | 48315 | tcaccacgctgctggcagccgcagt | AA073984 | 90919 | ggacatttgctgctgaagcagagagc | AA111356 |
| 5712 | tgatccacagtctattctcataaa | AA073984 | 48316 | aaagttctctgccagagacact | AA073984 | 90920 | acatttgctgctgaagcagagagc | AA111356 |
| 5713 | tccacagtctattctcataaactg | AA073984 | 48317 | tctctcctgagagacactgaagta | AA073984 | 90921 | atttgctgctgaagcagagccgag | AA111356 |
| 5714 | gtctatttctataaactgctctgg | AA073984 | 48318 | tgaactcttattgattgctcaaacgt | AA073984 | 90922 | tttgttgagctcggccacagataaa | AA111356 |
| 5715 | ttctcataaactgctctggggacat | AA073984 | 48319 | ggaactctcattcttattcagctag | AA073984 | 90923 | tggagtcgccacagataaaggaa | AA111356 |
| 5716 | taaactgctctggggacattttct | AA073984 | 48320 | caatctcttattcagctagaatc | AA073984 | 90924 | tcaaaatcttaccacaccaagaa | AA111356 |
| 5717 | actgctctggggacattttctaga | AA073984 | 48321 | ccacagattcgcctgtctttct | AA073984 | 90925 | gatctttgagctgaaggcagagtt | AA111356 |
| 5718 | gcgttgtaagccagtcagtgtgtga | AA073984 | 48322 | agaaccgtctaccagtgacctctg | AA073984 | 90926 | atctctgagtgtgaagccagcctgt | AA111366 |
| 5719 | cggacacagtgccccaaggacaag | J05261 | 48323 | gtctaccagtgacctctgattatg | J05261 | 90927 | agcctgctaagaggggatgtccat | AA111366 |
| 5720 | catgtcccccaggacaagcctga | J05261 | 48324 | cagtgacctctgattatgatttga | J05261 | 90928 | tttgttttgagccagtgagtcccag | AA111366 |
| 5721 | gcaaccatggaaatctcagtactga | J05261 | 48325 | ctgcaaaactctctctcctcctag | J05261 | 90929 | tttgtagcagtgagccagaacaagg | AA111366 |
| 5722 | catggaaatctcagtactgatcca | J05261 | 48326 | atcgtctgctcgagctgaatfg | J05261 | 90930 | ctctgctgccctgccaggctagg | AA111366 |
| 5723 | tcctgactaaaactgccagact | J05261 | 48327 | gtttttgccatgtcaaaagccat | J05261 | 90931 | ctcaggctaggtgccaggggct | AA111366 |
| 5724 | actaaaactgctggggacaitctcaca | J05261 | 48328 | ccgatgacctctctccagta | J05261 | 90932 | tgccaggctggtcctccagata | AA111366 |
| 5725 | cagactctcacagctggtgatc | J05261 | 48329 | tctccactagaacactggatctt | J05261 | 90933 | tggctcctaggcaggggtagt | AA111366 |
| 5726 | agcctgtgcatcccagccttgggc | J05261 | 48330 | cactgaacctggatctcaacac | J05261 | 90934 | ctctaggatcaggggtagttcag | AA111366 |
| 5727 | ggtcacagacagtcctaggaacaag | J05261 | 48331 | ggatctccaacacggaggctcatcc | J05261 | 90935 | tgctggttgggccagcagt | AA111366 |
| 5728 | catgctccccaggacaagcctga | J05261 | 48332 | ccgaggtctcatccttccctatact | J05261 | 90936 | gtgtttgggccgaccagtcagtct | AA111366 |
| 5729 | cagacagtcctaggaacaagtgagca | J05261 | 48333 | ctatactccgtgacagaagaagga | J05261 | 90937 | tttgggccgagccagtcagtctctg | AA111366 |
| 5730 | gtgggcacttgtccggccatcgt | J05261 | 48334 | tctgctcgctccccactgcatac | J05261 | 90938 | ggagtcccataccagtcctcactt | AA111366 |
| 5731 | ccaggaaccccacaagagctagagaga | J05261 | 48335 | taatcttttcgtgtaatcagaca | J05261 | 90939 | ccgagctgcagctgctgcgagtgt | AA111366 |
| 5732 | ggcacaagctgagctgctttacc | J05261 | 48336 | tgctaccaagggcaacaaggtgggt | J05261 | 90940 | cagctccagctgcctgctgggtgt | AA111322 |
| 5733 | gcctcgagctgctttaccatgtc | J05261 | 48337 | agggcaactgtcagccgaaggaat | J05261 | 90941 | tcctcacttgacctgctgggct | AA111322 |
| 5734 | agctgctttaccatgtcctcgag | J05261 | 48338 | aatgcaaattctcagactctaacct | J05261 | 90942 | tcacttgacctgctgggcctct | AA111322 |
| 5735 | ctcgagttctgaacaagagcct | J05261 | 48339 | ccaaagaacaccacttggatcagt | J05261 | 90943 | cctgacctgctgggcctccttga | AA111322 |
| 5736 | gttctgaacaagagcctactga | J05261 | 48340 | gaccacttgagatcaagtaggacca | J05261 | 90944 | tgagactgcctgttgttgttg | AA111322 |
| 5737 | agagcctactgatagttccgctg | J05261 | 48341 | aatatctttcaggatggagggacca | J05261 | 90945 | agctacctgttgttgttgttg | AA111322 |
| 5738 | atagctctccggaccttgaaaatccc | J05261 | 48342 | atactaattatacccctgcaaagc | J05261 | 90946 | taccatgtttgtgttttggcag | AA111322 |
| 5739 | ttctgctcgcaaccatggaaatcctc | J05261 | 48343 | attatacccctgcaaagcccaac | J05261 | 90947 | tggatagctttcttgctgcagaga | AA111322 |
| 5740 | gttagagccctgctgggtgatcgtt | W49913 | 48344 | ccttgcaaagcccacttgaact | W49913 | 90948 | gctttgctgcgcagggaccct | AA111322 |
| 5741 | tagagccctgctgggtgatcgtttct | W49913 | 48345 | ccctgcaaagcccaacttgaatc | W49913 | 90949 | atgctcccggctgattgaagagtc | AA111322 |
| 5742 | gaagacatctctgaggttggg | W49913 | 48346 | gcaaaagcccaacttgaatctctt | W49913 | 90950 | tggtcaactaacagatccccacaga | AA111322 |
| 5743 | gacatctctgaggttgggcctg | W49913 | 48347 | ttgaaatctcttaggactatcgtc | W49913 | 90951 | cacagatcccacacagatccagga | AA111322 |
| 5744 | tctctctgaggttgggcctgtgt | W49913 | 48348 | tatccacgctccatagggtagacta | W49913 | 90952 | cacagatccacacagaagctgcagtg | AA111322 |
| 5745 | ttctctgaggttgggcctgtgta | W49913 | 48349 | ccaacgccatcaaggatggcctggc | W49913 | 90953 | gcccaagatcaagactgtggacat | AA111322 |
| 5746 | cgaataccaaggagaccaatgagacg | W49913 | 48350 | ccatcaaggatgccctggctaget | W49913 | 90954 | gcatgatcctcagaacactgtggacat | AA111322 |
| 5747 | actttatgtcgccatgcgggaacttg | W49913 | 48351 | cactctctggccaggagtttaatct | W49913 | 90955 | tgatcctccagaagccatccgccg | AA111322 |
| 5748 | tttatgtcgccatgcgggaacttg | W49913 | 48352 | ttaatctcttgcaatgttaagtcc | W49913 | 90956 | gccgaattcacaaggggagcatg | AA111322 |
| 5749 | tgccatgcgggaacttgaattgg | W49913 | 48353 | aggggccacagcagctcagctatg | W49913 | 90957 | gcggagtccatgccactttcag | AA111322 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5750 | acttgagtggacaatgctgccagt | W49913 | 48354 | agcagatacaacctgttaagga | X93035 | 90958 | ccatgcctacctttcagaaacat | AA111322 |
| 5751 | gagacctgcgggtggatcgttcct | W49913 | 48355 | tacacaacctgtaaggaatgcaa | X93035 | 90959 | ttctgtcgcagcagagaccctgaa | AA111322 |
| 5752 | gatcgtctccggttcgtatcg | W49913 | 48356 | ttatgtgaccatgtggtgttaaat | X95591 | 90960 | ttgctgcagcagagaccctgaagga | AA111322 |
| 5753 | tcgttctccggttcgtattcgtg | W49913 | 48357 | gattcctttgaattcatgtataa | X95591 | 90961 | tctttgatgccactcacggcttgt | AA111322 |
| 5754 | gttctcgttctgtattcgtggg | W49913 | 48358 | tatctgtagcctgcgaggtgaagg | X95591 | 90962 | ttgtgatggccactcacggcttgtt | AA111322 |
| 5755 | aacattcctatgaagctactgaag | W49913 | 48359 | tgtgacctgcgaggtgtaaggacat | X95591 | 90963 | ccactcacggcttgttacctcga | AA111322 |
| 5756 | cattcctatgaagctactcgttctg | W49913 | 48360 | gacttaaataccactcgttctg | X95591 | 90964 | ctcacggcttgttatcctgatgc | AA111322 |
| 5757 | ttccttalgaagctactgaagaaca | W49913 | 48361 | aataccactcgttctgttcgt | X95591 | 90965 | acggcttgttatcctgatgctcc | AA111322 |
| 5758 | ctgaaggacatctctcgaggttg | W49913 | 48362 | taccccactcgttcgttcagtta | X95591 | 90966 | ccctgatgctcccggctgattga | AA111322 |
| 5759 | tgttgtgatgctctgtcctaaact | L02241 | 48363 | cactctgtttctgtcagttagttc | X95591 | 90967 | atgccacatccaaggagatcgcaga | AA111422 |
| 5760 | tggatgcctgctccttaaactgca | L02241 | 48364 | ctgttctgtcagttagttcaaca | X95591 | 90968 | tgccacatccaaggagatcgcagac | AA111422 |
| 5761 | gccccacacaaatccactgctctac | L02241 | 48365 | gttctgtcagttagttcaacatg | X95591 | 90969 | ccattcgaggtgtgcagagtgcc | AA111422 |
| 5762 | tatatgctaattcgtctagtga | L02241 | 48366 | ttcgtctgtatattcaaagtcaaa | X95591 | 90970 | catcgaggtgtcggagatgcg | AA111422 |
| 5763 | atgcttaattcgtctagtgagtt | L02241 | 48367 | ctgtacttaattctcatgttcca | X95591 | 90971 | atcgaggtgtgcgtggatgcgt | AA111422 |
| 5764 | aattctgtcttagtgagttggaaca | L02241 | 48368 | taaatttacacattacattctgtgat | X95591 | 90972 | tcgaggtgtcggagatgccgtc | AA111422 |
| 5765 | tttcaccatatttccgtaaaatat | L02241 | 48369 | aatttacacattacattgtgatac | X95591 | 90973 | gtccctgcgatgcagccagagactc | AA111422 |
| 5766 | tgtaacactaaacatctctagga | L02241 | 48370 | tttacacattacattgtgatacg | X95591 | 90974 | tccctgcgatgcagccagagactcc | AA111422 |
| 5767 | aaagtattctccactcgactcgaat | L02241 | 48371 | tttcatatataagcatcatgatgtg | X95591 | 90975 | ccctgcgatgcagccagagactcg | AA111422 |
| 5768 | gtattttccatctagcctgaatga | L02241 | 48372 | tatctataagcagttgtgaaatcc | X95591 | 90976 | cctgcgatgcagccagagactcgt | AA111422 |
| 5769 | atctagcctgaatgtactgtaaatt | L02241 | 48373 | gaaatccaaaatgttctctgtaaca | X95591 | 90977 | ctgcgatgcagccagagactccgtc | AA111422 |
| 5770 | cattatgaccccatacataacataaaat | L02241 | 48374 | aatccaaaatgttctgtaaacatt | X95591 | 90978 | gccacatccaaggagatcgcagaca | AA111422 |
| 5771 | gctctgtcctaaacgtcagcatga | L02241 | 48375 | tgttctgtaaacattgtagtgt | X95591 | 90979 | ccacatccaaggagatcgcagacact | AA111422 |
| 5772 | ctgtcctaaactgcagcatcagcatgac | L02241 | 48376 | ccaacctctaccatgagagatcgcc | AA028748 | 90980 | ccacatccaaggagatcgcagacact | AA111422 |
| 5773 | tgttactttcaaattgcaccaagg | L02241 | 48377 | caacctctaccatgagagatcgcca | AA028748 | 90981 | acatccaaggagatcgcagacactt | AA111422 |
| 5774 | tactttcaaattgcaccaaggaag | L02241 | 48378 | ggatgctcccagagagaccacgga | AA028748 | 90982 | cagcagagtccattcgaggttgc | AA111422 |
| 5775 | attgcaccaaggaaggacacactg | L02241 | 48379 | gatgctcccagagagaccacgat | AA028748 | 90983 | agcagagtccattcgaggttgct | AA111422 |
| 5776 | ggaacactgtttatgccccaacaa | L02241 | 48380 | tgcctcccagagagaccacacgtg | AA028748 | 90984 | gtccattcgaggtgtcgagatg | AA111422 |
| 5777 | cacactgtttatgccccaacaaat | L02241 | 48381 | gcctcccagagagaccacgatga | AA028748 | 90985 | tccattcgaggtgtcggagatgc | AA111422 |
| 5778 | gtttatgccccaacaaatccactg | L02241 | 48382 | ctccccagagagaccacgatcgatga | AA028748 | 90986 | tgaaggctcgtaactaccggc | AA111422 |
| 5779 | actccctattattgccctctgct | L02241 | 48383 | aggagaccacgtcatcatgatga | AA028748 | 90987 | aggctcgtaactaccggcatg | AA111422 |
| 5780 | tttctggtagttctgacatgatg | Z14986 | 48384 | ccagatgcacatgaagtcac | AA028748 | 90988 | catggagctcagttcgacaccaca | AA111262 |
| 5781 | tatctgtctgatctgtaatgagca | Z14986 | 48385 | ccgatcgacatcgaagtcacactg | AA028748 | 90989 | gaggctcagttcgacaacgac | AA111262 |
| 5782 | gtaattgacacgcacacttattga | Z14986 | 48386 | acatcatgaagtcacggaggacat | AA028748 | 90990 | tcgaagtccgaactgccagaacgat | AA111262 |
| 5783 | agcacacacctatttgaattgct | Z14986 | 48387 | aagtcacggaagcatcctgcaag | AA028748 | 90991 | gagatcgaacgccaggacgatcca | AA111262 |
| 5784 | acagcacctatttgaatttgctatt | Z14986 | 48388 | accctaccatgagagatcgccatc | AA028748 | 90992 | atccgaacgccaggacgatccaggg | AA111262 |
| 5785 | tatttgagggcagttgcttatta | Z14986 | 48389 | cctccacatgagatcgccatca | AA028748 | 90993 | cacgcgtgccactgtgagagaagt | AA111262 |
| 5786 | ggtgccataatttctctgttgt | Z14986 | 48390 | tctaccatgagatcgccatcaca | AA028755 | 90994 | ggtgccactgtgagagaagttga | AA111262 |
| 5787 | aaaagtattctgtaccacatgta | Z14986 | 48391 | ctaccatgagatcgccatcaca | AA028755 | 90995 | agtgcaatatcacaagttggatc | AA111262 |
| 5788 | tgtatttctgtaccaacatgaagc | Z14986 | 48392 | atgagagatcgccatccaatact | AA028755 | 90996 | gcaatatcacaagttgatcgta | AA111262 |
| 5789 | atttcgtaccacaatgtaagcttc | Z14986 | 48393 | tgagatcgccatccaacaatcactg | AA028755 | 90997 | atatcacacaaagttgatcgtaagg | AA111262 |
| 5790 | tctgtaacacacaatgtaagcttcaat | Z14986 | 48394 | ctggagctttcaacccgggtcag | AA028755 | 90998 | ctctcgtaactgaccggcatgct | AA111262 |
| 5791 | ttctaaacagagtcgttagttg | Z14986 | 48395 | gacgctttcaaccctggtcacga | AA028755 | 90999 | tcgtaactgaccgcatgctaag | AA111262 |
| 5792 | ttggaacactgctcgactctttct | Z14986 | 48396 | cactgctcatttgcagcgctgag | AA028755 | 91000 | gcctgaacagctgcggaactcgttc | AA111262 |
| 5793 | gaacactgctctgactctctacaa | Z14986 | 48397 | ctgctcatttgcgcgcgtcagtc | AA028755 | 91001 | acagtcgcgaactcgttcatcggg | AA111262 |
| 5794 | ttctacacgtgtlgattgaaggct | Z14986 | 48398 | ggatcagtagctcgatttgcacag | AA028755 | 91002 | acggaactcgttcatcgggaggtc | AA111262 |
| 5795 | gcttctgcagttgatctcgtg | Z14986 | 48399 | atcagtccgcatttgcacagtc | AA028755 | 91003 | gaactcgttcatcggagctcagc | AA111262 |
| 5796 | ttcggtcagcttatclcgtcgatt | Z14986 | 48400 | cagtagctccgatttgcacagt | AA028755 | 91004 | ctcgttcatcgggagtcagctc | AA111262 |
| 5797 | ggtcagcttatcgtctgatctcg | Z14986 | 48401 | gtagctccgattgccacagttg | AA028755 | 91005 | gtccatcggaggctcagttcgac | AA111262 |
| 5798 | cttatctctgcgattcgtaatga | Z14986 | 48402 | agctccgattgccacagtttgat | AA028755 | 91006 | atgcaaactgcaaagcaaggccgct | AA111262 |
| 5799 | acgcagttcaccgcagcgagcctgtgc | M94632 | 48403 | ctgcattttgcacagtcttgtat | U08373 | 91007 | caaaactgcaaagcaaggccgctctg | U08373 |

TABLE 1-continued

| SEQ ID NO | DBAxnID | sequence | SEQ ID NO | DBAxnID | sequence | SEQ ID NO | sequence | DBAxnID |
|---|---|---|---|---|---|---|---|---|
| 5800 | M94632 | aacccactctgctgtctgctgagg | 48404 | AA028755 | cgcattgcacagtctgctgatatct | 91008 | gtgtccaggacagtgactgcgcatc | U08373 |
| 5801 | M94632 | ccaacaggcactctagacagagca | 48405 | AA028755 | cattgcacagtctttgatatctg | 91009 | acagtgactgcgcatctgcacaaac | U08373 |
| 5802 | M94632 | ggcactctagacagagcaatctct | 48406 | AA028755 | tttgcacagtctttgatatcttgat | 91010 | gtgactgcgcatctgcacaaactct | U08373 |
| 5803 | M94632 | ttgtgccagcccacaggctggc | 48407 | AA028755 | tatcttgattattgctatgccacg | 91011 | gcgcatctgcacaaactctttctaa | U08373 |
| 5804 | M94632 | cccagaggctgcttgtctggag | 48408 | AA028755 | gctcatttgtgcagcgtgatgccac | 91012 | catctgcacaaactctttctaagta | U08373 |
| 5805 | M94632 | ggaaccgcttcctgtgcacagggc | 48409 | AA028755 | tctgtattgctatgccacaga | 91013 | ctgcacaaactctttctaagtatct | U08373 |
| 5806 | M94632 | gtgagacagccagccacgccgtttg | 48410 | AA028755 | ctgtccgccacactggatgctgc | 91014 | aaactctttctaagtatctagcaat | U08373 |
| 5807 | M94632 | gtgcacatctccacagaaacagaa | 48411 | AA028755 | gtgccgcccacacttggatatgctg | 91015 | ctctttctaagtatctagccaatgtt | U08373 |
| 5808 | M94632 | aacagaactcatgcactgaccgc | 48412 | AA028755 | gtccgccacacttggatgctgga | 91016 | atctagcaatgttactcttcagac | U08373 |
| 5809 | M94632 | ttagcgtgtaatgcctgaggaata | 48413 | AA028755 | cacactggatctgcggatcagta | 91017 | tagcaatgttactcttcagacact | U08373 |
| 5810 | M94632 | tgtaatgcctgaggaataaagtgt | 48414 | AA028755 | cactggatctgcggatcagtagc | 91018 | gcaaagcaaggcgctctggaacaa | U08373 |
| 5811 | M94632 | ggccatgcagcatctgtgtggac | 48415 | AA028755 | tggtatcgtggatcagtagctgc | 91019 | caaggcgctctggaacaagatgca | U08373 |
| 5812 | M94632 | gagcatctcgtttgaacacgcct | 48416 | AA028755 | atcggctggatcagtagctgcatt | 91020 | gaaggcccagagaagccagaagat | U08373 |
| 5813 | M94632 | tgtggacacgcctgtgaatgaccct | 48417 | AA028755 | ggtcgctcatctgcagtgcccg | 91021 | tgatgagagcccaggatctggagac | U08373 |
| 5814 | M94632 | caogcctgtgaatgacccgtcact | 48418 | AA028755 | ttcatctgcagtgccggctlct | 91022 | tgagagcccaggatctggagacgcc | U08373 |
| 5815 | M94632 | tgtgaatgacccgtcacttacce | 48419 | AA028755 | aagggctctccagggttgacag | 91023 | gagcccaggatctggagacgccca | U08373 |
| 5816 | M94632 | tttaccctaactacagatatgca | 48420 | AA028755 | aagggctgcatttaccaggggactg | 91024 | cccactgaagtcattgcggaagagg | U08373 |
| 5817 | M94632 | tacagcatatgcatgccaggccggg | 48421 | AA028755 | cgcatttaccaggggcactgaagccg | 91025 | tctagagtcaggtgtccaggacag | U08373 |
| 5818 | M94632 | tgctggccaccaagaccggaagagg | 48422 | AA028755 | ggcactgaagccgacagcatctca | 91026 | atctactactcagaaagttactg | AA111263 |
| 5819 | W49956 | tggttgatctggctctgagaat | 48423 | AA028755 | gacagcatctcagcggattcctca | 91027 | ttaccagagaactctcctaagcaa | AA111263 |
| 5820 | W49956 | tgatcggtggctctgagaatcatt | 48424 | AA028755 | atctcagcggatctccatttcc | 91028 | tgtcaacagagtctaggaatggt | AA111263 |
| 5821 | W49956 | gcttcagacaccataggagtggcaa | 48425 | AA028755 | ttcctcatttccctccgctgag | 91029 | caatgattcatgagccagaaccog | AA111263 |
| 5822 | W49956 | ttcagacaccataggagtggcaaga | 48426 | AA028755 | ccctggccgagctgggggatctgc | 91030 | atgatcatgagccagaaccogga | AA111263 |
| 5823 | W49956 | gggccaagatccaccctgccaggtg | 48427 | AA028755 | ccgaactctgcaaagtgaaggggt | 91031 | gatcatgagccagaaccogcata | AA111263 |
| 5824 | W49956 | atcccaactgccaggccaagtggcg | 48428 | AA028755 | ttctgcacacgccagtggttct | 91032 | catgagccaacccgcatattc | AA111263 |
| 5825 | W49956 | tcagtgacttgacctgtacctgct | 48429 | AA028755 | tgtgcagtccggctctattact | 91033 | tgagccagaaccogcatattctt | AA111263 |
| 5826 | W49956 | agtgacttgacctgtacctgctgg | 48430 | AA028755 | gtgcccgcctctcaactccaagtgct | 91034 | agcccagaaccogcatattctct | AA111263 |
| 5827 | W49956 | tgacttgacctgtacctgctgtc | 48431 | AA028755 | tattacttccacttccaagtgatct | 91035 | cccagaaccogcatattctct | AA111263 |
| 5828 | W49956 | acttgacctgtacctgctgtcct | 48432 | AA028755 | ttccaagtgatctccaagtggacc | 91036 | ccgcatattcttctttaagacg | AA111263 |
| 5829 | W49956 | tggccctgactcaggcccaggg | 48433 | AA028755 | gtgatctccaagtgggaccttgtc | 91037 | gcatattcttcttcttaagagc | AA111263 |
| 5830 | W49956 | gcctgactcaggcccagaggccaggat | 48434 | AA028755 | tgggaccttgtcgtttatcaagt | 91038 | accagaaactctccttaagcaagt | AA111263 |
| 5831 | W49956 | actggtggctctgagaatcatct | 48435 | AA028755 | gattcctgagtttctctaacaca | 91039 | ctcctcaagcaagtaccaagactca | AA111263 |
| 5832 | W49956 | agaatcattctgattactgcttcag | 48436 | AA028755 | gactggttccaggatgtatgaccgta | 91040 | ctctcaagcaagtaccaagactca | AA111263 |
| 5833 | W49956 | tcattctgattactgcttcagacac | 48437 | AA028755 | acgcttccagatgtatgaccgtac | 91041 | tacccaagactcatctgatgttccg | AA111263 |
| 5834 | W49956 | attctgattactgcttcagacaca | 48438 | AA028755 | gaaggccttcctgtatgaccggg | 91042 | agactcatctgatgttccgaagaga | AA111263 |
| 5835 | W49956 | tctgattactgcttcagacaccata | 48439 | AA028755 | aaggccttcctgtatgaccgggc | 91043 | actcatctgatgttccgaagagaat | AA111263 |
| 5836 | W49956 | tgattactgcttcagacaccataggg | 48440 | AA028755 | ggcctcctgtatgaccgggctg | 91044 | tcatctgatgttccgaagaattg | AA111263 |
| 5837 | W49956 | tactgcttcagacaccataggagtg | 48441 | AA028755 | gcctcctgtatgaccgggcctga | 91045 | tgtgcacacagagttactaggaagg | AA111263 |
| 5838 | W49956 | ctgcttcagacaccataggagtggc | 48442 | AA028755 | ctcctgtatgaccggcgctggc | 91046 | cctccactgactgcaggaactacaa | AA111263 |
| 5839 | W49956 | ggggtctttcctgcagagaaatt | 48443 | AA028755 | ttccagtggcgggctgggaa | 91047 | tccactgactgcaggaactacaaga | AA111263 |
| 5840 | W49959 | agcagtgcaacatcgttcagaga | 48444 | AA028730 | ccgtgatgacgcgggctggaaaa | 91048 | catactgctggaaatggagctg | AA111386 |
| 5841 | W49959 | aatactgtgccagaaatctagaa | 48445 | AA028730 | ctgtgatagacgggcggctggaaatg | 91049 | atcatgtctggaaatgggaactgg | AA111386 |
| 5842 | W49959 | gaaatggccaccagcatttgcaaac | 48446 | AA028730 | ctgtgtatagacgggcggctggta | 91050 | gtctctggaaatggagctgtgacc | AA111386 |
| 5843 | W49959 | atgggaccacgcattgcaaacatg | 48447 | AA028730 | aatgggctgcatggctgctggta | 91051 | tgtgacttccaccatggggagtgg | AA111386 |
| 5844 | W49959 | ggaccacgcattgcaaacatgcc | 48448 | AA028730 | atggcgtcatggctgctgtat | 91052 | tgggctctggctgatctatcccaaa | AA111386 |
| 5845 | W49959 | cgcattgcaaacatgaccttcaa | 48449 | AA028730 | ctgggcagcagtctactaaccgcg | 91053 | ggctctgctctgatctatcccaaag | AA111386 |
| 5846 | W49959 | tgcaaacatgaccttcaaagcacag | 48450 | AA028730 | tcgtcatgctgctggtatcgtca | 91054 | gctctctgctgatctatcccaaagg | AA111386 |
| 5847 | W49959 | catgaccttcaaagcacagtggatc | 48451 | AA028730 | atgctgcagaccgtgggcacagaca | 91055 | tcgtcagactctgatctatcccaaaggag | AA111386 |
| 5848 | W49959 | gaccttcaaagcacagtggatccct | 48452 | AA028730 | ctgcagaccgtgggcacagaacgg | 91056 | ctgcttggtctatcccaaaaggagc | AA111386 |
| 5849 | W49959 | agcacaggagaccctgctcatca | 48453 | AA028730 | tgcagaccgtgggcacagaacgga | 91057 | aatgttccatggagacataa | AA111386 |

| SEQ ID NO | sequence | DBAxnID | SEQ ID NO | sequence | DBAxnID | SEQ ID NO | sequence | DBAxnID |
|---|---|---|---|---|---|---|---|---|
| 5850 | gtggatccgtctattcaaaagt | W49959 | 48454 | tgggcacgacaacggaccagagaac | AA028730 | 91058 | ccactgactgcaggaactacaagag | AA111386 |
| 5851 | agtgcacacatgcttcagagacac | W49959 | 48455 | ggcacgacaacggaccagagaact | AA028730 | 91059 | actgactgcaggaactacaaggaga | AA111386 |
| 5852 | cacatcgttcagagacacagcaac | W49959 | 48456 | agaacctagtattagtagaag | AA028730 | 91060 | ctgactgcaggaactacaagaggac | AA111386 |
| 5853 | atgcttcagagacacagcaactat | W49959 | 48457 | tagaaggcctcgtgtatgacgc | AA028730 | 91061 | cactagacacatgtctctgaaa | AA111386 |
| 5854 | gagacacagcaactatagcacagcgg | W49959 | 48458 | atttcaccagaactccgctcat | AA028730 | 91062 | ctaggacatcatgtctctggaatg | AA111386 |
| 5855 | acacagcaactatagcacagcgcgg | W49959 | 48459 | agaactccgagctcattgaacatct | AA028730 | 91063 | taggacatcatgtctctggaaatgg | AA111386 |
| 5856 | cagcaactatagcacagcgcggt | W49959 | 48460 | acaacttcattagcacacatgaaagt | AA028730 | 91064 | ggaacatcatgtctctggaaatggag | AA111386 |
| 5857 | ctatagcacgcgcggtgtataaac | W49959 | 48461 | caaagcagtatgcggtcatgcaggggatg | AA028730 | 91065 | gacatcatgtctctggaaatggagc | AA111386 |
| 5858 | tagcacagcgcggtgtataaacacc | W49959 | 48462 | tgtactgcagtagctccgtga | AA028730 | 91066 | tctactacaattcagccactgggaa | AA111386 |
| 5859 | tatcacaaaggtcatcacaggtg | L00654 | 48463 | actgcagtagctctagcctgtacaa | AA028784 | 91067 | ctactacaattcagccactgggaaa | AA111494 |
| 5860 | aaaggtctcatcacaggtgacaatg | L00654 | 48464 | gcagtagctctagcctgtacaaaca | AA028784 | 91068 | atgcacccgattaactacactgga | AA111494 |
| 5861 | gttcctccagcagtcgtcctg | L00654 | 48465 | aacacgcgaagattcacgctcgata | AA028784 | 91069 | gccaccgatttaactacactgatg | AA111494 |
| 5862 | atgctgcttcctgccgggtggcat | L00654 | 48466 | agattcacgctcgataaacccatag | AA028784 | 91070 | ccacgatttaactacactggatt | AA111494 |
| 5863 | catctgagtccaattctctgcc | L00654 | 48467 | acgctcgataaaccatcaggagagc | AA028784 | 91071 | accgatttaactacactcgatgtgg | AA111494 |
| 5864 | caattctgcctccactcaagt | L00654 | 48468 | aaaccatagagagcccatagaggggg | AA028784 | 91072 | ccgatttaactacactggatgtggg | AA111494 |
| 5865 | ttctgcctccactcaagtagctac | L00654 | 48469 | gaggtccctattcatctccatgaa | AA028784 | 91073 | taatttactaccgaagggagtac | AA111494 |
| 5866 | cttccactcaagtagctacactgag | L00654 | 48470 | actcacagctcattgaacactctaac | AA028784 | 91074 | atttttactaccagagagagatgct | AA111494 |
| 5867 | tagtacactgagccaggccgcgctc | L00654 | 48471 | cctatctactcctagaacacctg | AA028784 | 91075 | ttttactacccagaaggagtctctg | AA111494 |
| 5868 | gcgctctcgtatgctcctcaatat | L00654 | 48472 | agctcattgaacatctaacagtcca | AA028784 | 91076 | ggccgcctcgtgaaagttgtatat | AA111494 |
| 5869 | ctctgctatgcctcaatttaaaatgcg | L00654 | 48473 | atctaacagttcaccgcaagcctt | AA028784 | 91077 | cgcccctcgtgaagttgtatatga | AA111494 |
| 5870 | tatgcctcaatataaatgcgttaaag | L00654 | 48474 | taacagttcaccgccaagccttcaa | AA028784 | 91078 | actacaatcgccactgggaatg | AA111494 |
| 5871 | gacaatgttccacatgccgagatg | L00654 | 48475 | acggcaagctttcaaagtcaacag | AA028784 | 91079 | ctacaatgttcagccactggggaatgc | AA111494 |
| 5872 | atgcctcaatataataagcgttaaagc | L00654 | 48476 | tcaagtcaacaggtgtggacgagt | AA028784 | 91080 | ccaaatcagccactggggaaatgccca | AA111494 |
| 5873 | gtccaatgtcgcgagatgcatgc | L00654 | 48477 | attccagctacaacttcattagaca | AA028784 | 91081 | caattcagccactgggaaatgccac | AA111494 |
| 5874 | gacatgcgtgtgtgtggggaatgaag | L00654 | 48478 | gctacaacttcattagacacatgaa | AA028784 | 91082 | attcagccactggggaaatgccaccg | AA111494 |
| 5875 | gtcacctattactggaactgatcc | L00654 | 48479 | ctgtggtcaccaacctccagggca | AA028784 | 91083 | ttcagccactgggaaatgccaccga | AA111494 |
| 5876 | caccactgtgccccaaaggactctct | L00654 | 48480 | actacacatcgcatacggcaacct | AA028784 | 91084 | gaaatgccaccgatttaactacact | AA111494 |
| 5877 | tatgtcccccaaaggactctcgtca | L00654 | 48481 | tagagggtcccacagcgtctctc | AA028784 | 91085 | atgccaccgatttaacctccagatg | AA111494 |
| 5878 | gactctgagtcactcaagatga | L00654 | 48482 | acagcgtctctcggttcctact | AA028784 | 91086 | atgtgcacatggtgacctccagatg | AA111494 |
| 5879 | acactccaggatgacctcgttcctc | L00654 | 48483 | tgttcccgactagaacggcaggt | AA028784 | 91087 | gtgacctccagattgtggagctga | AA111494 |
| 5880 | tacaggcccaagccgtgccaactc | M90388 | 48484 | ccgactgaacggcaaggcgctc | AA028784 | 91088 | ctgtgcccagctgacaggagctg | AA111592 |
| 5881 | ccgtgcaaactctctactagcta | M90388 | 48485 | aagctcacctcgtgttcctgatccat | AA028784 | 91089 | cccagctgacaggagctgaaaatg | AA111592 |
| 5882 | gcaagcctacagaacgtgtcagcc | M90388 | 48486 | tgggccctgtctctcagatt | AA028784 | 91090 | aaacgaatgcatcatcatgggggtga | AA111592 |
| 5883 | ttcagccaaaaatccagctcct | M90388 | 48487 | ctccctagggttctgggaacca | AA028784 | 91091 | accatcatgggtgatctcagtt | AA111592 |
| 5884 | attccagtctcttctgaatttgg | M90388 | 48488 | tctctgggaaccacctaatggtatt | AA028784 | 91092 | atctcagttttagggccatggcga | AA111592 |
| 5885 | ggaacccgccatcagtcgtggaatat | M90388 | 48489 | tggtattatccgtgggcattat | AA028784 | 91093 | actgcctttctcatgggccccat | AA111592 |
| 5886 | tgtaacgcacctgatttataag | M90388 | 48490 | catttatcaatacttagagacta | AA028784 | 91094 | ctttctcatgggcccccattgagtg | AA111592 |
| 5887 | gcacctgatttataagaatatt | M90388 | 48491 | catcgatatcgggccaacctgtgcgt | X66295 | 91095 | tcatgggcccccatgatgtgcctgaa | AA111592 |
| 5888 | aaattgtaccgtcagataaagctac | M90388 | 48492 | atacggccaacctgtgcgtgcacct | X66295 | 91096 | tggggccccatgatgtgcctgaagga | AA111592 |
| 5889 | ttccagcaaactgtatttcatat | M90388 | 48493 | ccaacctgcgtgcactgaacct | X66295 | 91097 | aggagttgtcaccctgacacaga | AA111592 |
| 5890 | ttcctatatttcactgggaactgc | M90388 | 48494 | tgaaacctcaaactgccaggggc | X66295 | 91098 | acctcagattggaagctgaaga | AA111592 |
| 5891 | atatttcactgggaactgccaataa | M90388 | 48495 | tcaacctccaggtggccagctt | X66295 | 91099 | ccctgacacagacattaaggtcac | AA111592 |
| 5892 | ctagctatctgaaccacacagagaa | M90388 | 48496 | ccagctctgcgaccacatggtcaa | X66295 | 91100 | gatattcgtcagatcagaatcca | AA111592 |
| 5893 | atcctgaaaccacagaactacac | M90388 | 48497 | tctgtgaccacatgttcaacacgaa | X66295 | 91101 | attcgtccagatcagatcccaact | AA111592 |
| 5894 | aaaccagagaactccactccc | M90388 | 48498 | tgttcaacagcaagcaggtcagtc | X66295 | 91102 | cagatcaaacttcagccaagctag | AA111592 |
| 5895 | cagagaacctcacatctctaaaca | M90388 | 48499 | tacgtaattcctacagacgaactt | X66295 | 91103 | atcagatcccaacttcagcaagcccag | AA111592 |
| 5896 | catcttctaacacaatttgaggac | M90388 | 48500 | atgatcagtcacagcaagttaa | X66295 | 91104 | agatccaacttcagcaagccgaat | AA111592 |
| 5897 | gtaattctcaccaagccaagcc | M90388 | 48501 | ctataatttctgatgggcgtg | X05475 | 91105 | aacttcagccaaagccagaaattaatgg | AA111592 |
| 5898 | ctcccaccaagcaagctacaga | M90388 | 48502 | ttctctgatgggcagtgcctgg | X05475 | 91106 | ttaatgcatctcgtcgcccagc | AA111592 |
| 5899 | caccaagcaagctacagaagtgt | M90388 | 48503 | gcctgatcagtccgcccaatgtgt | X05475 | 91107 | cccatgcactgcagtcagtcacacagga | AA114552 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 5900 | ctgtacttcattgaactggataa | M13685 | 48504 | gaatggcctgcgaaatccatcaaac | X05475 | 91108 | ctgcagtcgcacgcatgactgtt | AA114552 |
| 5901 | agacaatctaaacattctaggc | M13685 | 48505 | cctcgaaatccatcaacaatata | X05475 | 91109 | ggcattcaggagcacaagaacctg | AA114552 |
| 5902 | gttccatccagtactaaatgcttac | M13685 | 48506 | atcaaacaatatagccttcaggaaa | X05475 | 91110 | cattcacgaggcacaagaacctga | AA114552 |
| 5903 | tgcttaccgtgaccctggctt | M13685 | 48507 | caatatagccttcaggaaacaaagc | X05475 | 91111 | aaactgtctcaagctctacgattc | AA114552 |
| 5904 | ttcagcgtgcactcagttccgtagg | M13685 | 48508 | tatagccttcaggaaacaaagcaaa | X05475 | 91112 | actgtctcaagctctacgattcag | AA114552 |
| 5905 | gtgcactcagttccgtaggattcca | M13685 | 48509 | aagcaaacctggttcacagaagcaag | X05475 | 91113 | tgtctcaagctctacgattcagag | AA114552 |
| 5906 | tcagttccgtaggattccaaagcag | M13685 | 48510 | cccaggacttccaacttagtcatct | X05475 | 91114 | gtctcaagctctacgattcagaga | AA114552 |
| 5907 | aagcagaccgtagctgtctgcttg | M13685 | 48511 | ctgtaaacatcaacccgtatacat | X05475 | 91115 | ctcaagctctacgattcagagaagc | AA114552 |
| 5908 | gaccccctagctgtctttgaatctg | M13685 | 48512 | ctttccaacttagcatcttacctg | X05475 | 91116 | caagctctacgattcagagaagca | AA114552 |
| 5909 | tagctgtctttgaatctgcatgta | M13685 | 48513 | acatcaccccgataacatcataga | X05475 | 91117 | agctctacgattcagagaagccatt | AA114552 |
| 5910 | gcatgtacttcacgttttctatat | M13685 | 48514 | cccgtgataacatcatagatgatgt | X05475 | 91118 | ccaattagcctgtaaacgcaatgt | AA114552 |
| 5911 | gttgctatcagacgtgacattaaat | M13685 | 48515 | tggcaaacctccagtctctcatcag | X05475 | 91119 | gcagtcagccacggcatgactgttaa | AA114552 |
| 5912 | tctaaacattcttaggctgcaga | M13685 | 48516 | cagctccatcagtcaaagaatgtc | X05475 | 91120 | agtcagcacggcatgactgttaact | AA114552 |
| 5913 | gaagtaggccattccaaagtggg | M13685 | 48517 | tatataatctcattccttgaaaat | X05475 | 91121 | taagcaagttctgtcaaggcccat | AA114552 |
| 5914 | aatctgctacatgattgttaaatca | M13685 | 48518 | aaagtgctaccacatgctcaaatgg | X05475 | 91122 | tcaaggccatttcgaagttggcca | AA114552 |
| 5915 | acccccagcagacataaactgcgata | M13685 | 48519 | gctaccacgtctaaatggagtac | X05475 | 91123 | ggccatttcgaagttgccaatg | AA114552 |
| 5916 | tgcgataccctcagttgcactgt | M13685 | 48520 | caggggtcatcgctcagtgcaggt | X05475 | 91124 | gggcgcagcattcacgaggcaca | AA114552 |
| 5917 | agctgcactgtggattctgtat | M13685 | 48521 | tgcatcgtctgcagagttgacag | X05475 | 91125 | cgacggcattcacgaggcacaagaa | AA114552 |
| 5918 | atataaacataactcaagcttat | M13685 | 48522 | aaatccttaccgtgataagaacag | X05475 | 91126 | acggcattcacgaggcacaagaacc | AA114552 |
| 5919 | ctggccgttccatccagtactaaat | M13685 | 48523 | gctgtatcgttcactcagggacc | X05475 | 91127 | caaagctacaccttcttcttggact | AA114552 |
| 5920 | ggtccgttccagctgtcttgctg | M13685 | 48524 | atactggggacctggctgtacata | X05475 | 91128 | tacaccttcttggactgactta | AA114552 |
| 5921 | gttcagccggtctgtctgaccctg | M13685 | 48525 | tagctacactgttggatacaacct | X05475 | 91129 | tctggtacagttgtaatgatagg | AA114576 |
| 5922 | tcccccaattcgcagcacccaggga | M13685 | 48526 | tgtgataccaacctggggttgctga | X05475 | 91130 | tgcagacttccagttcttctcg | AA114576 |
| 5923 | atccgcagaccaagggatctttc | M11900 | 48527 | ttttgctcaaactatctcatct | X05475 | 91131 | agactttccagttcttctcg | AA114576 |
| 5924 | cagacacagggatcttccagagt | M11900 | 48528 | tctcaaactatctcatct | X05475 | 91132 | ctttcctctgttcttctg | AA114576 |
| 5925 | atctttccagagtttgggcctctg | M11900 | 48529 | actactacatgttcttctca | X05475 | 91133 | gatgctcaaatctcttctcgc | AA114576 |
| 5926 | tcctcagttaaccagaagcctcga | M11900 | 48530 | atgtctttcttagatgctcaag | X05475 | 91134 | atctcttctctcgagctctgtt | AA114576 |
| 5927 | tcagtaaaccagaagcctctgaaag | M11900 | 48531 | ttttctagatgctctaagctata | X05475 | 91135 | cctctctcgagtctgttctaat | AA114576 |
| 5928 | aaccagaagcctctgaagacacaggga | M11900 | 48532 | gacatattcagacgtatgacacgg | U49112 | 91136 | tctctcagcgattcttaatcaa | AA114576 |
| 5929 | tccctcctgtttctcaactgcacg | M11900 | 48533 | ttcagacgtatgacacgggatcagg | U49112 | 91137 | ctgcagtcgcagttcttaatcaagca | AA114576 |
| 5930 | ttcaactgtcacgcaggggtcagaa | M11900 | 48534 | cgctatgacacggatcaggatggct | U49112 | 91138 | cagctggtctctaatcaagcagct | AA114576 |
| 5931 | aactgtcacgcaggggtcagaactg | M11900 | 48535 | gagcaatatctccatggtctca | U49112 | 91139 | tctctctgactgactaatccac | AA114576 |
| 5932 | gagctacgccaggggtcagagtgt | M11900 | 48536 | tatctccatggtctcagcattg | U49112 | 91140 | tctggtctatacaagcagctgat | AA114576 |
| 5933 | ctatgctcaagaggcaggtgatgaa | M11900 | 48537 | tccatggtcttcagcattgtataac | U49112 | 91141 | gactgattaatccactccttcaat | AA114576 |
| 5934 | tgataaactttcagagcctagaccag | M11900 | 48538 | aacagacaagcacgcatgcaaaaga | U49112 | 91142 | tgactaattcaacctctccaatggt | AA114576 |
| 5935 | tgaactttcagagcctctagaccaga | M11900 | 48539 | gatgccaaatcctacctgaggtgata | U49112 | 91143 | cttaatcaacctcttcaatggtggg | AA114576 |
| 5936 | tcagagcctagaccagacaccaaat | M11900 | 48540 | aggctgcagctcattgaaggtgca | U49112 | 91144 | caggagtcgcacctgcactctggta | AA114576 |
| 5937 | gagcctagaccagacaccaaatcag | M11900 | 48541 | tgaaggtcagctccagccccagtca | AA028875 | 91145 | gcatgccacctgacttcgtactaag | AA114576 |
| 5938 | cctagaccagacaccaaatcagaaa | M11900 | 48542 | tggtcagccctgtaggaagaggtt | AA028875 | 91146 | tgccactgcactctggtacagtt | AA114576 |
| 5939 | aggtcccaattcgagatccaggaccacag | M11900 | 48543 | gacctggaaacaccctgtgatg | AA028875 | 91147 | ctgactctgtacagttggtaat | AA114576 |
| 5940 | gcagttaccaagagccctggca | AA117812 | 48544 | tgtggaaacaccctgtgatggcct | AA028875 | 91148 | gaccttccggttcctggtcatgctg | AA114576 |
| 5941 | agcttaccaagagcctcgcaca | AA117812 | 48545 | ggaaacaccctgtgatgcctgg | AA028875 | 91149 | cctggtcatgctgagatgaccct | V01527 |
| 5942 | gccctctgcacagatggaagaaga | AA117812 | 48546 | accctgtgatggcctggacag | AA028875 | 91150 | cactccgactcagtctagcatgg | V01527 |
| 5943 | ccctctgcacagatggaagaagaa | AA117812 | 48547 | gactggcctggggacaggccctgc | AA028875 | 91151 | gactcagatgctagcatgtactat | V01527 |
| 5944 | tcagagctccagatggaagaaga | AA117812 | 48548 | tgatggctcagcccgaggcagcagc | AA028875 | 91152 | cctcactctgtgatctgagtcc | V01527 |
| 5945 | gagccctagactgacagaccacaccagca | AA117812 | 48549 | acacagcccctgcgaaggcagccagca | AA028875 | 91153 | ctctgtgatctgagtccccagt | V01527 |
| 5946 | agagctccatgagccgcatgageagcaa | AA117812 | 48550 | cgaaggcagccagcactgaggagcag | AA028875 | 91154 | gagctcccagatctcgtctag | V01527 |
| 5947 | agctcagcggccatgagccatt | AA117812 | 48551 | aaggcagccagcactgaggagcagge | AA028875 | 91155 | tctgtctagctctgctctg | V01527 |
| 5948 | cagtgcagccatgagcaaatgaaa | AA117812 | 48552 | aaggtgtcagcccccatagatgat | AA028875 | 91156 | tctagctcgtctctggatt | V01527 |
| 5949 | caggggcgccatgagcaaatgaaaa | AA117812 | 48553 | aggtgtcagcccatagatgatc | AA028875 | 91157 | gggattccagagactccatctg | V01527 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 5950 | AA117812 | agcgcggccatgagcaaatgaaaaa | 48554 | AA028875 | gtgtcagcccccatagatatgatcgg | 91158 | V01527 | tccagagactccatctgtgtacagc |
| 5951 | AA117812 | tttagagcacgcacaaagaatta | 48555 | AA028875 | tgtcagcccccatagatatgatcggt | 91159 | V01527 | gactccatctgtgtacagccgcacc |
| 5952 | AA117812 | gcttaccaagagccctctggcacag | 48556 | AA028875 | gtcagcccccatagatatgatcggtg | 91160 | V01527 | cctgaaggcccccatcactgtggag |
| 5953 | AA117812 | cttaccagagccctctggcacaga | 48557 | AA028875 | tcagcccccatagatatgatcggtgc | 91161 | V01527 | ggcacagtctgatctgccctggagc |
| 5954 | AA117812 | taccaagagccctctggcacagatg | 48558 | AA028875 | agcccccatagatatgatcggtgcca | 91162 | V01527 | gtctgcctggagcaagatgtgtggc |
| 5955 | AA117812 | accaagagccctctggcacagatgg | 48559 | AA028875 | atatgatcggtgccaaacgccgtgg | 91163 | V01527 | ggtgatctcctcgggcttggcctt |
| 5956 | AA117812 | ccaagagccctctggcacagatga | 48560 | X06340 | ctgcgtgggcacgtgcatctggacc | 91164 | V01527 | agggctcctgcagtgactcagagtg |
| 5957 | AA117812 | aagagccctctggcacagatggaag | 48561 | X06340 | acgtgcatctggaccacagaaggctg | 91165 | V01527 | gtttgactcagttgactgctcag |
| 5958 | AA117812 | agagccctctggcacagatggaaga | 48562 | X06340 | ttggaatggctccctccttagaa | 91166 | V01527 | aagaccttgaatgtctgctccgaa |
| 5959 | AA117812 | gagccctctggcacagatggaagaa | 48563 | X06340 | gaatggctccctcctttagaaga | 91167 | V01527 | ctccgaatctctgactgccagtcca |
| 5960 | AA117812 | gaggccacagcagaggaccccctca | 48564 | X06340 | tggctccctccttagaaagagc | 91168 | AA114591 | gaaaccacactatgatcatctgggc |
| 5961 |  | cacagcagagaccccctcaaggccc | 48565 | X06340 | gagaagctacaggcactggccct | 91169 | AA114591 | ctatgatctcacagcaatacggtc |
| 5962 |  | gccacagcagaccccactcaagg | 48566 | X06340 | aagcctacagggcactgcctggt | 91170 | AA114591 | catcctcgagatgcggtcacata |
| 5963 |  | cccacagaggccacagccgcgcg | 48567 | X06340 | cctacagggcactgcctggtaca | 91171 | AA114591 | agagtaccggttccgctttggagg |
| 5964 |  | gccacagccgagccccctcaagg | 48568 | X06340 | cactgcctggtacatttctga | 91172 | AA114591 | ccgcttgtgaggcgaggtccatc |
| 5965 |  | caacaggcccacagccgagaccccac | 48569 | X06340 | tggtacatttctgacatttcg | 91173 | AA114591 | ctttggtgggaggtctccattt |
| 5966 |  | gccacagccgagccactcaagg | 48570 | X06340 | ctgacatttcttgaggcctccacat | 91174 | AA114591 | cttccccaatggctcctgttaca |
| 5967 |  | agccgcagccactcaaggcccaca | 48571 | X06340 | acatttctgaggcctcacatggg | 91175 | AA114591 | caatggctctcgttcactgccc |
| 5968 |  | gccacaccccaacggaggccccaca | 48572 | X06340 | catctgaccagaaggctggactgt | 91176 | AA114591 | ggtggacaaacccgagccgacctct |
| 5969 |  | caggaggccacacaacactctc | 48573 | X06340 | ggactgtgagccttttccgatgaag | 91177 | AA114591 | ctgagcgacctctggctccacagtg |
| 5970 |  | gccacagcaaacacctctctctggc | 48574 | X06340 | ctgtgagcctttcgatgaaggat | 91178 | AA114591 | ctctggctccacagtgccacata |
| 5971 |  | cacctcctctggctgaaaccccca | 48575 | X06340 | gactctgacgacaacatgatcccca | 91179 | AA114591 | ctggctccacagtggtccacatagg |
| 5972 |  | gaggccacagccgagcccgagacccctca | 48576 | X06340 | ctctcagccgggaaatgtcaaagg | 91180 | AA114591 | ggaatccaacagagagtcatgggcaac |
| 5973 |  | cacccaaggtccacgccgagacc | 48577 | X06340 | ctctgccctctcagggcttgaactt | 91181 | AA114591 | tggctccacagtggctccacatagga |
| 5974 |  | caccccccaacagcccgagaccccgagca | 48578 | X06340 | agggcttgaactgtctccgatgcc | 91182 | AA114591 | atcccacagtcatggccaacatc |
| 5975 |  | caacaggagcccacagccagcgata | 48579 | X06340 | gatgccctggggtgactttcccact | 91183 | AA114591 | agtcatgggccaacatccaggtggta |
| 5976 |  | gaggccacagcagccgatacccta | 48580 | X06340 | ttaccactgtccagggatcgccga | 91184 | AA114591 | catgggcaacatccagttgtgtagaa |
| 5977 |  | cacagcaggagataccctcaaggcc | 48581 | X06340 | accactgtccaaggatcgccgatg | 91185 | AA114591 | caacatccagtggtgaagagacg |
| 5978 |  | gaggcccaagccgagccccctca | 48582 | X06340 | cagttcctgatacagattccgcag | 91186 | AA114591 | gacgcaggcatcctcgagagtac |
| 5979 |  | caacaggcccacagccgagaccccac | 48583 | X06340 | gttcctgatacagattcggcatggc | 91187 | AA114591 | gcaggtccatcctcgagagtacggc |
| 5980 |  | cacagcaaacacctctctggctgg | 48584 | X06340 | tcctgatacagattcggcatggcta | 91188 | AA114591 | ggtcatcctcgagagtacggctc |
| 5981 |  | acagcaaacacctctctggctga | 48585 | AA030066 | gatacagattcggcatggctaagga | 91189 | AA114540 | acgcaaaatcggttacagcacatga |
| 5982 |  | cctctctggctgaaaccccacaag | 48586 | AA030066 | tacagattcggcatggctaaggacg | 91190 | AA114540 | ccaaaatcgttacagccacatgacag |
| 5983 |  | ctcctctggctggaaaccccacaa | 48587 | AA030066 | cagattcggcatggctaaggacgat | 91191 | AA114540 | cggttattcccaatgtcagttcag |
| 5984 |  | tcctctggctgaaaccccacaaggc | 48588 | AA030066 | gttttaactgctgtggctctgga | 91192 | AA114540 | ttattccaatgtgtcagttcagatc |
| 5985 |  | cacaaggcagagaccccaggacctca | 48589 | AA030066 | ttaagtgagcactcctgcaacgag | 91193 | AA114540 | ttcccaatttgtcagttcagatccaa |
| 5986 |  | acaaggcagagccccaggacctca | 48590 | AA030066 | aagtgagcactcctgcaacgagta | 91194 | AA114540 | attgtcagttcagatccaaaaacagc |
| 5987 |  | ggccccacagcccgagccccctctgg | 48591 | AA030066 | gcactcctgcaacgagtagaactc | 91195 | AA114540 | tcagatccaaaaacgacgtcttaa |
| 5988 |  | gccccaagcaaacacctctctgg | 48592 | AA030066 | cactgtccaagggatccgcatgat | 91196 | AA114540 | cagcacgcttaaacatttactgc |
| 5989 |  | acaaggcagaaccccaggacctcag | 48593 | AA030066 | ctgtccaagggatccgcatgatta | 91197 | AA114540 | cattttactgctaaccagattgatga |
| 5990 |  | cacgcaaaacacctctctggctgg | 48594 | AA030066 | acgtactcagagacatagtaggctg | 91198 | AA114540 | ttactgctaaccagattgatgaaat |
| 5991 |  | acacgcaaacacctctctggctga | 48595 | AA030066 | tactcagactagtgaaggcgtt | 91199 | AA114540 | atgtcgacaagttgggatta |
| 5992 |  | cacctctctggctgaaaccccaca | 48596 | AA030066 | agtaattcagctacagggtgaccag | 91200 | AA114540 | tccagcgacaagtttgggattatct |
| 5993 |  | cctctctggctgaaaccccacaag | 48597 | AA030066 | taattcagctacagggtgaccagcg | 91201 | AA114540 | aaatcggttacgccatgacagtgt |
| 5994 |  | ctcctctggctgaaaccccacaag | 48598 | AA030066 | attcagctacagggtgaccagcga | 91202 | AA114540 | tcggttacagccatgacagtctc |
| 5995 |  | tcctctggctgaaaccccacaaggc | 48599 | AA030066 | gccagttcctgatacagattcggaa | 91203 | AA114540 | gttacgccatgacagtgctcggt |
| 5996 |  | aggcccaccacgcccgagcccgagaccccag | 48600 | AA030066 | cagcctggatctggaaaagagag | 91204 | AA114540 | acagccatgacagtgtctcggtat |
| 5997 |  | cgaaagcagaccccgagccgagactca | 48601 | X73985 | agggtcctggcctgatagacag | 91205 | AA114540 | atgacagtgtctcggttattcc |
| 5998 | W50027 | ggaaccatgacgcccgagggaagg | 48602 | X73985 | atgagttccctgctgtatgatta | 91206 | AA114540 | atgacagtgtctcggttatccca |
| 5999 | W50027 | gtgcaacgggcactggttgttg | 48603 | X73985 | agtccttcctgctgtatgatttggc | 91207 | AA114540 | acagtgtctcggttattccaattg |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6000 | cagcttccagcttgttggaaga | W50027 | 48604 | aggcttcgagtccacagagtgga | X73985 | 91208 | tctcggtattccaattgtcagtt | AA114540 |
| 6001 | aagacctattatcagatcaaccac | W50027 | 48605 | ctctggagtcccacagagtggactc | X73985 | 91209 | tcttgaactctgagacaaccctt | AA114638 |
| 6002 | acctattatcagatcaaccaccaa | W50027 | 48606 | tggactcctcctctgctgcgca | X73985 | 91210 | ggactctgcagacaacccttgacg | AA114638 |
| 6003 | caagatctcatggttggcgatga | W50027 | 48607 | cggactccagttctgccaccag | X73985 | 91211 | agatggctccgaatggcttaca | AA114638 |
| 6004 | ggatccatggttggcgatgaggga | W50027 | 48608 | acttccagttctgccaccagctt | X73985 | 91212 | gatggctccgaatggcttacagc | AA114638 |
| 6005 | tctcatggttggcgatgaggcaagt | W50027 | 48609 | tctctgccaccagctgcttaatga | X73985 | 91213 | tggctcctgcaatggcttacagcat | AA114638 |
| 6006 | aagtgagctgcgctccatgtggag | W50027 | 48610 | tgccccaccagctgcttaatgatct | X73985 | 91214 | tcctgcaatggcttacagcatta | AA114638 |
| 6007 | tgagctggctccatgtggaggtg | W50027 | 48611 | ccaccagctgcttaatgatctagc | X73985 | 91215 | tcctgcaatggcttacagcattag | AA114638 |
| 6008 | gggctccatgtggaggaactac | W50027 | 48612 | gtccttaggcctgatagacagttg | X73985 | 91216 | tggctacagcattacgccgacta | AA114638 |
| 6009 | gaactacccgatgagaacggcatc | W50027 | 48613 | acagtgtgcctgcgtggtcacg | X73985 | 91217 | gcttacagcattacgccgcactagg | AA114638 |
| 6010 | caaggcactggtttgtgaagtgt | W50027 | 48614 | gtgtgcctgggtcacggt | X73985 | 91218 | ttacagcattacgccgcactaggc | AA114638 |
| 6011 | atatgcaggctcaacttccagaa | W50027 | 48615 | aagcttctgctctcgcgcgat | X73985 | 91219 | gccgcagcctgcgagacagtgtgg | AA114638 |
| 6012 | tgcaggctctaacttccagaacac | W50027 | 48616 | ctgtcgtctccgcgatgcatga | X73985 | 91220 | tgctgcctagtcaacctaacgcg | AA114638 |
| 6013 | ctctaacttccagaacagcttc | W50027 | 48617 | tctccgctgcgatgcatgagttcct | X73985 | 91221 | acctcgagacaaccctgacgag | AA114638 |
| 6014 | taacttccagaacacagcttcca | W50027 | 48618 | ccgctgcgatgcatgagttcctcg | X73985 | 91222 | tctgcagacaaccctgacgggc | AA114638 |
| 6015 | cttccagaacacagcttccagct | W50027 | 48619 | tgcatgagttcctgcctgtatgat | X73985 | 91223 | tgcagacaaccctgacgggccgg | AA114638 |
| 6016 | agaacacagcttccagcttggtt | W50027 | 48620 | cagacactcagtgatacccttgtt | X73985 | 91224 | aagctgcagacagcctgcagactt | AA114638 |
| 6017 | acacagcttccacgcttggtga | W50027 | 48621 | ctcagttgataccaccccttcatcca | X63615 | 91225 | atgagcctggcagaccctggcctg | AA114638 |
| 6018 | tacaggcctctcaattgaggga | W50027 | 48622 | aaagctcgctgtggataattg | X63615 | 91226 | tgccagttcaccaggatggctcctg | AA114638 |
| 6019 | aataglaccaggcctagagtgt | W78418 | 48623 | gacaattctttgcatgaccctca | X63615 | 91227 | ccagttcaccaggagtgctcctga | AA114638 |
| 6020 | agagcacacactgttcagcttgt | W78418 | 48624 | aattctttgcatgaccctctaa | X63615 | 91228 | agttcaccaggatggctcctgcaat | AA114638 |
| 6021 | gagcacacactgttcagctgtatg | W78418 | 48625 | tttgcatgaccctaaagacgag | X63615 | 91229 | actggttcatgcactgtcatgt | AA114648 |
| 6022 | gcacacactgttcagctgtatggct | W78418 | 48626 | tgacctctaaagagcaggacactc | X63615 | 91230 | ggttccatgcactgcatggttgc | AA114648 |
| 6023 | cacacactgttcagctgtatggct | W78418 | 48627 | gacactcctgctctaacgctagg | X63615 | 91231 | tgggcacaccctgtacctgctgcg | AA114648 |
| 6024 | cacactgttcagctgtatggcttg | W78418 | 48628 | ctaactgctaggtgttgcagttg | X63615 | 91232 | tgctgccacaccgccacagaaggaa | AA114648 |
| 6025 | acactgtcagctgtatggcttg | W78418 | 48629 | actgctgcagtactggtgccctc | X63615 | 91233 | gcaacccgccacagaagaacactc | AA114648 |
| 6026 | actgttcagctgtatggctgcc | W78418 | 48630 | ttctgagcctgaggtgtacaa | X63615 | 91234 | aaccactcagagaaggcagcagga | AA114648 |
| 6027 | ctgtcagctgtatggctgcc | W78418 | 48631 | ttttgttgctgcgggaactgca | X63615 | 91235 | agaaggccagcaggcagcaggga | AA114648 |
| 6028 | agctgtatggctttgccccgggtg | W78418 | 48632 | ggatacaccctttcatccaacgt | X63615 | 91236 | aggacaggacaagcttctgcctc | AA114648 |
| 6029 | ctgacccgccatgttggttgat | W78418 | 48633 | ctttcatccacactgtcccaggac | X63615 | 91237 | aggacaaggaacaagcttctggcctc | AA114648 |
| 6030 | tagtaccaggcctatgagtggt | W78418 | 48634 | gtaaacactgccaggctccactg | X63615 | 91238 | cccctgatcatccacctggagaa | AA114648 |
| 6031 | agtaccaggcctatgagtgtggc | W78418 | 48635 | caggctccactgagtgcccaagg | X63615 | 91239 | catccacctggagaacagctggag | AA114648 |
| 6032 | taccaggcctagagtgtggcct | W78418 | 48636 | cccaaggccatgaaacagtggcag | X63615 | 91240 | ccacctggagaacagctggagccc | AA114648 |
| 6033 | accaggcctagagtgtggtggcctg | W78418 | 48637 | ccttgtatctccacaagctgcct | X63615 | 91241 | atgcactgcatggtgcctgt | AA114648 |
| 6034 | ctatgagtgtggcctgaggcaa | W78418 | 48638 | tgttatctccacaagctgccgtc | X63615 | 91242 | cactgcatggtgcctgttc | AA114648 |
| 6035 | tatgagtgtggcctgaggcag | W78418 | 48639 | ctccacaaagtgcctgtcggat | AA030144 | 91243 | ttctgccacaggaagtggtaca | AA114648 |
| 6036 | gcaaggcacacactgttcagctgt | W78418 | 48640 | cataacaacagttatcttccacca | AA030144 | 91244 | cttgccacaggaagtgtacagta | AA114648 |
| 6037 | caagacacactgttcagctgta | W78418 | 48641 | ttctccaccaagacaaagacaag | AA030144 | 91245 | tcctggcttggctacgttcctat | AA114615 |
| 6038 | ctttccactgagccacaccta | L27439 | 48642 | tggactccagtgccacactcca | AA030144 | 91246 | tggctaccgttcctatccgtgct | AA114615 |
| 6039 | actgagccacaccctcactgaaa | L27439 | 48643 | tgccacactccacacttaaggcct | AA030144 | 91247 | ccgttcctatcctgtcgtggcac | AA114615 |
| 6040 | agttcatgtgttctcatggg | L27439 | 48644 | cacacttcaacctgaatggcctct | AA030144 | 91248 | tgttgccagcaccctgtacct | AA114615 |
| 6041 | aagttacatgtctatcttgtaat | L27439 | 48645 | aacctgaatggctcttacctgaggg | AA030144 | 91249 | gcttacctgctccgaagctacg | AA114615 |
| 6042 | ttacatgtctatcttgtaatgaa | L27439 | 48646 | ctgaatggctctctacctgaggggtc | AA030144 | 91250 | tactctgctccgaagctacgga | AA114615 |
| 6043 | cargtctatcttgtaatgaaga | L27439 | 48647 | aggggtcccatataggctatggcga | AA030144 | 91251 | gatcctctgatcgaaaatgct | AA114615 |
| 6044 | ttgatcgtttcagggtgcatcgc | L27439 | 48648 | ggtcccataaagtagctagcgaatg | AA030144 | 91252 | ctccctgattcgaaaatatgctgt | AA114615 |
| 6045 | atcgtttcagggtgcatcagccgc | L27439 | 48649 | gggtacaactacgtcgcaaggtt | AA030144 | 91253 | cattacaataaggtctccagacaat | AA114615 |
| 6046 | gtgatcagccgctctgctgccatt | L27439 | 48650 | tacaactacgctgcaaggttctg | AA030144 | 91254 | aaggtctccagacaatgcagacaca | AA114615 |
| 6047 | catcagccgcttcgtcattga | L27439 | 48651 | tacagctgcaaggtttctgagatga | AA030144 | 91255 | gtctcagacaatgcagacacattc | AA114615 |
| 6048 | agatatgtcatcacatgaaacat | L27439 | 48652 | accaagccaagaccaatgacagga | AA030144 | 91256 | cacactgcactgattgccgca | AA114615 |
| 6049 | tgtcatcacatgaaacataaa | L27439 | 48653 | aatgcagtactccagctgtg | AA030144 | 91257 | cgcactgtattcgcgcaacaatc | AA114615 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6050 | tgagccaacacttcactgaaatat | L27439 | 48654 | gacggcagtacttccagctgtgcca | AA030144 | 91258 | agtattcgccgcacaaatccagaga | AA114615 |
| 6051 | gccaacacttcactgaaatatga | L27439 | 48655 | agtacttccagctgtgccatgggtt | AA030144 | 91259 | attcgccgcacaaatccagagaaag | AA114615 |
| 6052 | agattttccaaggagcagcacatg | L27439 | 48656 | acttccagctgtgccatgggttacc | AA030144 | 91260 | gtggcctacttggaatccatatca | AA114615 |
| 6053 | tgttgtctcaatcagttctatca | L27439 | 48657 | tccagctgccatggttaccatg | AA030144 | 91261 | tctgctctcgaagctacgcgcactt | AA114615 |
| 6054 | agatcactcaacctaagctgctgag | L27439 | 48658 | tgtgccatggttaccatggagcct | AA030144 | 91262 | cgaagtacggcacttaccgctgcg | AA114615 |
| 6055 | aacctaagctgctgagcacaaa | L27439 | 48659 | atgggttaccatggagcctgtgt | AA030144 | 91263 | agctacggcacttaccgctgcgacc | AA114615 |
| 6056 | agctgctgagcacacaaggtcag | L27439 | 48660 | tttctgaagctcggggcgcatcac | AA030144 | 91264 | gaccgtgaactagccatggctgtgc | AA114615 |
| 6057 | tgggcgccatccttaatggtcgga | L27439 | 48661 | catccacaggcctgcagaagctg | AA030144 | 91265 | ctagccatggctgtgcaacctcacc | AA114615 |
| 6058 | catactgagatggtccttgagatga | L27439 | 48662 | gtcaacctgattgtcagaagacgc | X51971 | 91266 | gccatggctgtgcaacctcaccagg | AA114615 |
| 6059 | agcatcgagcaccgaacaactcaga | L27439 | 48663 | cagaagacgcctatccacgttcgga | X51971 | 91267 | atggctgtgcaacctcaccaggatc | AA114615 |
| 6060 | gcttcgctagaaactccagaact | M38314 | 48664 | ccggccagtatccacgttccggaca | X51971 | 91268 | caacctcaccaggatcctccctgatt | AA114615 |
| 6061 | gctagaaaactccagaactccagg | M38314 | 48665 | agccagtccacgttccggacac | X51971 | 91269 | ttgctctgataattaccctcta | AA114666 |
| 6062 | cagaaattcaggccaagccctcca | M38314 | 48666 | cagtatccacgttccggacactct | X51971 | 91270 | tgtctgtcgataattaccctcta | AA114666 |
| 6063 | accttaagctgggccaggaggaag | M38314 | 48667 | ctatccacgttccggacactctgt | X51971 | 91271 | attaccctctatagctgatgtcaac | AA114666 |
| 6064 | gatactgttccgagctcgattctt | M38314 | 48668 | tccaagttccgacactcttgtct | X51971 | 91272 | taccctctatagctgatgtcaacta | AA114666 |
| 6065 | ctggctttccaggcctctgtga | M38314 | 48669 | aggtcttaatctcaggatgaagtct | X51971 | 91273 | accctctatagctgatgtcaactaa | AA114666 |
| 6066 | ggagagctaccactctactatatct | M38314 | 48670 | tcttaatctcaggatgaagtcgta | X51971 | 91274 | ccctctatagctgatgtcaactaaa | AA114666 |
| 6067 | ctaccactctactatatctagcatc | M38314 | 48671 | tttccagttgccagggccaccgac | X51971 | 91275 | ctctatagctgatgtcaactaaag | AA114666 |
| 6068 | tagcatccacaggtcgtctagaaac | M38314 | 48672 | acacaacaggtgccatgggaccct | X51971 | 91276 | actaaaagtatcgtcgagcatg | AA114666 |
| 6069 | tgcccagaaaccgtgggaagtcgt | M38314 | 48673 | acacaggtgccatgggaccccttg | X51971 | 91277 | aaagtatcgtctgagcatgccac | AA114666 |
| 6070 | accatgctaccctttccatccggat | M38314 | 48674 | ctgcctgccggattactgaa | X51971 | 91278 | tcgacatgccacgggcaactca | AA114666 |
| 6071 | gctaccttttcatcgctccactg | M38314 | 48675 | ccgccactctgagtcagtcaccgta | X51971 | 91279 | ttcaccaaaataactagcaccatg | AA114666 |
| 6072 | tttccatcgctccactggccacg | M38314 | 48676 | ccacttctgagtcagtcaccgta | X51971 | 91280 | tcaccaaaataactagcaccatga | AA114666 |
| 6073 | atggctccactgcatcgtgtgt | M38314 | 48677 | cttgctgagtcagtcaccctgattg | X51971 | 91281 | gtctcgataattaccctctata | AA114666 |
| 6074 | tatgactaccagggctcctgacgg | M38314 | 48678 | gagtcagtcaccgatggtcagaa | X51971 | 91282 | ctcgcgataattaccctctatagc | AA114666 |
| 6075 | cggctccgacggcctataagccag | M38314 | 48679 | tcagtcacctgattgtcagaaga | X51971 | 91283 | tcgtcgataattaccctctatagt | AA114666 |
| 6076 | agcatcccgtagtctgaggcttcg | M38314 | 48680 | gctgcagcctaatggtgagagagatg | D10576 | 91284 | tcgataattaccctctatagctgat | AA114666 |
| 6077 | cctagtctgaggcttctgctaga | M38314 | 48681 | gggagatgacccctcaagcagttcctt | D10576 | 91285 | cgataattaccctctatagctgatg | AA114666 |
| 6078 | catggtgcccacattggcttccaag | W50004 | 48682 | ttttctcatgccagctgctaagctc | D10576 | 91286 | gataattaccctctatagctgatgt | AA114666 |
| 6079 | tggtgcccacattggcttcaaggg | W50004 | 48683 | cttcatgccagctgctaagctcaag | D10576 | 91287 | taattaccctctatagctgatgca | AA114666 |
| 6080 | acctgggccaaggtcagaagagc | W50004 | 48684 | catgccagctgctaagctcaaggaa | D10576 | 91288 | aattaccctctatagctgatgtcaa | AA114666 |
| 6081 | ctgggccaaggtctcagaagagctg | W50004 | 48685 | ccagctgctaagctcaaggaagaga | D10576 | 91289 | ggctacacacacctttctgcaggag | AA114781 |
| 6082 | gtatgctggccaacacaaggccagcca | W50004 | 48686 | ccgcatgcggggcactggtgctt | D10576 | 91290 | ctacacacacttttctgcaggagag | AA114781 |
| 6083 | atgctggccaacacaaggagcagccatt | W50004 | 48687 | ccatgtcgggcactggctggctgag | D10576 | 91291 | agaatccagactcaacagtatggtga | AA114781 |
| 6084 | tgagcaacaccagagcactgctg | W50004 | 48688 | ggtgctgagctgtgctcaacgat | D10576 | 91292 | aatccagactcaacagtatggtgaac | AA114781 |
| 6085 | agcaacaccagagccattgctgta | W50004 | 48689 | gcttgagctgctgcaacgatgaa | D10576 | 91293 | cagactcaacagtatggtgaacttat | AA114781 |
| 6086 | caaacacagagccatgctagg | W50004 | 48690 | tgagctgtgctgcaacgatgaaagc | D10576 | 91294 | ggaccaaacaatggctgccaatgct | AA114781 |
| 6087 | acaacacgagccatgctaggct | W50004 | 48691 | tctcaccgtcgttgtacctgtt | D10576 | 91295 | accaaacaatggctgccaatgctca | AA114781 |
| 6088 | agccattgctgtaggctgggctc | W50004 | 48692 | gatgaccccaagcagttccttgat | D10576 | 91296 | caaacaatggctgccaatgctcaga | AA114781 |
| 6089 | acatggcctagaaggatatg | W50004 | 48693 | gaccctcaagcagttccttgatacc | D10576 | 91297 | atggctgccaatgctcagaagaata | AA114781 |
| 6090 | gtgccccacattggctcagggtt | W50004 | 48694 | cctcaagcagttccttgattactt | D10576 | 91298 | atggctgccaatgctcagaagaatataa | AA114781 |
| 6091 | ggccattaaccaccagatcccacc | W50004 | 48695 | caagcagttccttgattacttag | D10576 | 91299 | ctgcaagctcagaagaataaatt | AA114781 |
| 6092 | catttaattaccagatcccacctg | W50004 | 48696 | attggagatcaccatgtcgcccaag | D10576 | 91300 | caagaaatcaagaaccttttcaag | AA114781 |
| 6093 | ttaattaccagatcccacctgt | W50004 | 48697 | gggatcaccatgtcgtcccagggc | D10576 | 91301 | acacaccttctgcaggagagct | AA114781 |
| 6094 | atgcccactggtaccactgg | W50004 | 48698 | gatcaccatgtcgtcccagggtg | D10576 | 91302 | acaccttctgcaggagagagctc | AA114781 |
| 6095 | catccacctggtaccactggtg | W50004 | 48699 | ttcttttctcatgccagctgctaag | D10576 | 91303 | acactttctgcaggagagctctt | AA114781 |
| 6096 | cacctggtgggaacctggccaagg | W50004 | 48700 | gcacaccacagttctggaattc | D10576 | 91304 | acctttctgcaggagagctcttg | AA114781 |
| 6097 | cgacctgggccaaggtctcagagaa | W50004 | 48701 | tctcaccgtcgttgtacctgt | D10576 | 91305 | ctttctgcaggagagagctctgtg | AA114781 |
| 6098 | ctgtttcgaatgtcaggcagg | L34611 | 48702 | aagcacattcccagccagtcat | X61397 | 91306 | gagagttctcgtgatgaaaggaa | AA114781 |
| 6099 | gtctggagccgctgacactgga | L34611 | 48703 | attccagagcccaagtcatttattt | X61397 | 91307 | gagcttctcgtgatgaaaggaaga | AA114781 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6100 | cgctccagccaattgagaacgaaacc | L34611 | 48704 | cccagagccaagtcattattcct | X61397 | 91308 | gaagaatccagactcacgtatggt | AA114781 |
| 6101 | gaacgaaaccataccagttactgg | L34611 | 48705 | atatgctcactagtgtatttctga | X61397 | 91309 | tggagccatcagagatccacaaagt | AA114788 |
| 6102 | aaccataccagttactatgacagtt | L34611 | 48706 | gttgatctaacaacagcttagaaca | X61397 | 91310 | catcagagatcacaaagtgtgaga | AA114788 |
| 6103 | cataccagttactatgacagttccc | L34611 | 48707 | tgaactacaacgcttagaacatca | X61397 | 91311 | ccgtcagacgcaaactcatatagat | AA114788 |
| 6104 | aacagtcatgtgactgggcatcaag | L34611 | 48708 | tctacaacagcttagaacatcaaaa | X61397 | 91312 | gtcagacgcaaactcatatagattg | AA114788 |
| 6105 | gccagagttggctggctgctcatt | L34611 | 48709 | atatacttatgcatatcgaatgt | X61397 | 91313 | cagagcgcaaactcatatagattgta | AA114788 |
| 6106 | agagttggctggctgctcattcag | L34611 | 48710 | agcatacaagtaatagcttgttc | X61397 | 91314 | gacgcaaactcatatagatgtaac | AA114788 |
| 6107 | ctggctgtcattcaggactggacc | L34611 | 48711 | atagcttgtttccatatagaaata | X61397 | 91315 | cagcctccggctgggttaaacag | AA114788 |
| 6108 | gctgctattcaggactggaccaag | L34611 | 48712 | accacagtctcggaattcatacct | X61397 | 91316 | tcactctgcagatccgcctggggt | AA114788 |
| 6109 | gtctattcaggactggaccaggttg | L34611 | 48713 | atccactagtatactatgttaattt | X61397 | 91317 | tgtcgcagatccgcgctttggggtttga | AA114788 |
| 6110 | ccgctggacactggcattggactca | L34611 | 48714 | ggaatttcatacatcgcacatacg | X61397 | 91318 | tcgagatccgcctggggttgaca | AA114788 |
| 6111 | ctggacactggcattggacttccag | L34611 | 48715 | catacttttgcacatactgctgtt | X61397 | 91319 | gcagatccgcctggggttgacatt | AA114788 |
| 6112 | tagcagctacagtactatgcccaatg | L34611 | 48716 | actttgcacatactgctgtttgct | X61397 | 91320 | ccgcctggggttgacattactcat | AA114788 |
| 6113 | cagctacacagtctatggcccaatggt | L34611 | 48717 | tttgcacatactgctgttgctcat | X61397 | 91321 | tgggaacatctccggaccgtcagac | AA114788 |
| 6114 | tggcccaatggtcacacacagt | L34611 | 48718 | catactgctgtgttcttatgttgag | X61397 | 91322 | ggaacatctccggaccgtcagacgc | AA114788 |
| 6115 | cccaatggtcacacacgagtgtg | L34611 | 48719 | actgctgtgttcttatgttgtgtagaaa | X61397 | 91323 | aacatctccggaccgtcagagcgca | AA114788 |
| 6116 | gtcacacagtgtgaccaatgtg | L34611 | 48720 | taagaaaagcacatcccagagcca | X61397 | 91324 | catccggaccgtcagacgcaaac | AA114788 |
| 6117 | gaccaatgggcccccgcagga | L34611 | 48721 | caccaggacatcgaaagcggaact | X61397 | 91325 | tctccggaccgtcagacgcaaactc | AA114788 |
| 6118 | aagatccgatttgggctgtag | W50088 | 48722 | gttttcatccgccctcgtcgaac | X92346 | 91326 | tccggaccgtcagacgcaaactcat | AA114788 |
| 6119 | attttgggctgtagaagagacgg | W50088 | 48723 | gacatgcctgatgccagcacatt | X92346 | 91327 | ccggaccgtcagacgcaaactcata | AA114788 |
| 6120 | tggttctgccttcctacagtc | W50088 | 48724 | cctgatgccagccacattcatcact | X92346 | 91328 | gaccgtcagacgcaaactcatatag | AA114788 |
| 6121 | gccttcttcctacagtctcctcact | W50088 | 48725 | tgccagccacattctacctggactg | X92346 | 91329 | gtgccccggcccagcattcagg | AA114788 |
| 6122 | tttccttacagtctcctcatcta | W50088 | 48726 | ccacatctacctggacgaggtgc | X92346 | 91330 | cccaaacctgaggccaaagctgtg | L34570 |
| 6123 | tacagtctcctcatcctactcca | W50088 | 48727 | cctgctcaggtgctatgtcccaaga | X92346 | 91331 | tgcagtggggaaccctttccaag | L34570 |
| 6124 | agctcctccatctcatctatgatg | W50088 | 48728 | caggtctatgtcccaagagccata | X92346 | 91332 | ttccaagccgcgttccaagtc | L34570 |
| 6125 | ctcctcatctcatctatgatgaag | W50088 | 48729 | gaaactgcctgagattaacttctc | X92346 | 91333 | caagagcccgcttccatatgctgc | L34570 |
| 6126 | atctcatctatgatgaagtccgaa | W50088 | 48730 | ctttccattcaaccccagtggtgcct | X92346 | 91334 | gctttccatagctgctgatgtgaa | L34570 |
| 6127 | gaagtccgaaagtcatcctccgggc | W50088 | 48731 | tattttctagtctaggtggggac | X92346 | 91335 | ttcatatgctcgtctagtgaaccac | L34570 |
| 6128 | gtccgaaagtcatccgccgggt | W50088 | 48732 | tctagtgctagtgggcacagcagg | X92346 | 91336 | acatgttacaactgctatgaat | L34570 |
| 6129 | aagctcatcctcgcgggggaccctg | W50088 | 48733 | gtcgaactgcccccggaagatccctca | X92346 | 91337 | tgttaacactgctctatgaatcaa | L34570 |
| 6130 | acgcgtggctgccttcctgctctt | W50088 | 48734 | cggaagatctccagctgagtagagc | X92346 | 91338 | ttacacactgcttaagaatcaaata | L34570 |
| 6131 | ctggcctccttcctgcttcactgcc | W50088 | 48735 | gtaggcctctgggtccaagtggg | X92346 | 91339 | aatagatctcaagcctttaatagat | L34570 |
| 6132 | gttggcctccgaatgtaccactctca | W50088 | 48736 | ggccgagcctttccacagctctg | X92346 | 91340 | agatctcaagccttaatagatcta | L34570 |
| 6133 | ctccgaatgtaccactcaaggtca | W50088 | 48737 | ttacagctcttgggcctaggatgt | X92346 | 91341 | tgaggccaaagctgtgctgaaggag | L34570 |
| 6134 | cgaattgtaccactcaaggtcacgt | W50088 | 48738 | gtgcctccaattggtgctcagccc | X92346 | 91342 | gctgctgcctggataaggaaatt | L34570 |
| 6135 | atgtaccactcaaggtcacgtggt | W50088 | 48739 | ccaattggtcttcagccctggccc | X92346 | 91343 | ttggacatacctttatgagtaccg | L34570 |
| 6136 | ccactcaaggtcacgtggtttct | W50088 | 48740 | gaaacatgcatccaggggcctgtctc | X92346 | 91344 | accttatagctacctgcggccgcagc | L34570 |
| 6137 | aaggtcacgtggtttctgtgcct | W50088 | 48741 | agaattcctacgtttatgtggcat | X92346 | 91345 | tttatacaagaccaactcaagtgcat | L34570 |
| 6138 | agacccctttaagcatgtgtgtg | X69019 | 48742 | tctctagtttatgcgaatcaatta | AA030251 | 91346 | caagacaactcaagtgcatccgt | L34570 |
| 6139 | gacccctttaagcatgtgtgttg | X69019 | 48743 | tactctgagtctgcagattcatct | AA030251 | 91347 | gaccactcaagtgcatccctgcct | L34570 |
| 6140 | tttgcttgctttaaggccattggg | X69019 | 48744 | actctgagtctgcagaatcatga | AA030251 | 91348 | agtgcatccgtgctggagcccg | AA114623 |
| 6141 | atatttgcaagggtgatgtctggt | X69019 | 48745 | cttctgagtctgcagaattcatga | AA030251 | 91349 | gatgcaatgcaactccctgcctt | AA114623 |
| 6142 | tgatggtctggttgggtgaattc | X69019 | 48746 | ttctgagtctgcagaatcatcgac | AA030251 | 91350 | gcacctccgtgcctcctcaagag | AA114623 |
| 6143 | catcctttcctaggcctttgca | X69019 | 48747 | agatcatcgactctgcaatggtg | AA030251 | 91351 | aacaaggccactacaaattcgtg | AA114623 |
| 6144 | atcctcttcctaggcctttgcat | X69019 | 48748 | gattcatcgactctgcaatggtg | AA030251 | 91352 | aaggccactacaaattcgtggct | AA114623 |
| 6145 | tcttttcctaggcctttgcattga | X69019 | 48749 | attcatcgactctgcaatggtggc | AA030251 | 91353 | ggaaatacaccactttggctgcat | AA114623 |
| 6146 | cctaggcctttgcattgaaatg | X69019 | 48750 | ttcatcgactctgcaatggtggct | AA030251 | 91354 | acaccacttggctggcatccaatg | AA114623 |
| 6147 | cctaggcctttgcattgaaaatg | X69019 | 48751 | tctctgactctgcaatggtggcta | AA030251 | 91355 | ctttggccgatccaatggtgtc | AA114623 |
| 6148 | ctaggcctttgcattgaaatgc | X69019 | 48752 | catctgactctgcaatggtggtac | AA030251 | 91356 | tggctggcaatcaatggtgtcatt | AA114623 |
| 6149 | taggcctttgcattgaaatgcac | X69019 | 48753 | ctctcactgttatgcgaatcaattac | AA030251 | 91357 | ctggcatccaatggtgtcatttg | AA114623 |

| SEQ ID NO | sequence | DBAxnID | SEQ ID NO | sequence | DBAxnID | SEQ ID NO | sequence | DBAxnID |
|---|---|---|---|---|---|---|---|---|
| 6150 | cccctttaagcatgtgtgtgtct | X69019 | 48754 | atctgactctgcaatgtggctacc | AA030251 | 91358 | caattgctagtgcaagcaggctg | AA114623 |
| 6151 | ttgtcttagcatgtacctgctggg | X69019 | 48755 | aatcaattacttctgagtctgcaga | AA030251 | 91359 | ttgctagtgcaagcaggtgctgatg | AA114623 |
| 6152 | tcttagcatggtacctgctgggttt | X69019 | 48756 | atcaattacttctgagtctgcagat | AA030251 | 91360 | caagcaggtgctgatgtggaatgcag | AA114623 |
| 6153 | ttagcatggtacctgctgggtttgt | X69019 | 48757 | tcaattacttctgagtctgcagatt | AA030251 | 91361 | cctcctgcctcctccaagagaca | AA114623 |
| 6154 | tagcatggtacctgctgggtttgtt | X69019 | 48758 | caattacttctgagtctgcagattc | AA030251 | 91362 | cgaaaaatcacacctcttatgtcag | AA114623 |
| 6155 | catggtacctgctgggtttgttgt | X69019 | 48759 | aattacttctgagtctgcagattca | AA030251 | 91363 | cctgtgcctcctccaagagacactg | AA114623 |
| 6156 | tggtacctgctgggtttgttgtg | X69019 | 48760 | attacttctgagtctgcagattcat | AA030251 | 91364 | cctccaagagaacactgctttaa | AA114623 |
| 6157 | tgcctgcttgctttaaggccat | X69019 | 48761 | ttacttctgagtctgcagattcatc | AA030251 | 91365 | tcctcaagagacactgctttaaccca | AA114623 |
| 6158 | tgtttccatgcatgaaagacgctg | X69019 | 48762 | aacatataccttaataaggcagtgca | AA030251 | 91366 | gacactgcttaaccatagcagcag | AA114623 |
| 6159 | cagcaagccaaacatgtgtgggaagcc | L10106 | 48763 | atatacctaataaggcagtgcatat | AA030068 | 91367 | actgcttaaccatagcagcagcagaca | AA114623 |
| 6160 | gagccagtcagtgtaacctgta | L10106 | 48764 | algattttgccactgtacaagttga | AA030068 | 91368 | actgcttaaccatagcagcagcagaca | AA114623 |
| 6161 | cctgtactgcacgcagagatttta | L10106 | 48765 | attttgccactgtacaagttgacca | AA030068 | 91369 | accatagcagcagcagcagaagccact | AA114623 |
| 6162 | actgatcagtttctgtgactgtat | L10106 | 48766 | tgccactgtacaagttgaccatt | AA030068 | 91370 | gacaaatttgaccttgacttcaagc | AA114623 |
| 6163 | tcagttctgtgactgtatgagagc | L10106 | 48767 | tacaagttgaccattctgggctc | AA030068 | 91371 | caaatttgaccttgacttcaagcgc | AA114811 |
| 6164 | tgagagcatccacatttcatgccac | L10106 | 48768 | aagttgaccattctgggctcgat | AA030068 | 91372 | gattgaaatcatctctgggcgtgct | AA114811 |
| 6165 | catccacatttcatgccacctaatt | L10106 | 48769 | ttctaatctcatcttactgcat | AA030068 | 91373 | ttgaaatcatctctgggcgtgctgc | AA114811 |
| 6166 | ctccgcttttcgtagagcagtac | L10106 | 48770 | ttaatctcatcttactgcatcaa | AA030068 | 91374 | tgaaatcatctctgggcgtgctgct | AA114811 |
| 6167 | gtagagcagtcgacacacattgcat | L10106 | 48771 | atctcatcttctactgcattgactc | AA030068 | 91375 | gaaatcatctctgggcgtgctgctc | AA114811 |
| 6168 | cagtaccacacatttcatgcactt | L10106 | 48772 | tctctactgcattgactcctcgg | AA030068 | 91376 | aaatcatctctgggcgtgctgctct | AA114811 |
| 6169 | ccacacattgcactgcacttgtaag | L10106 | 48773 | actgcattgactcctcgcgctgtg | AA030068 | 91377 | atcatctctgggcgtgctgctgg | AA114811 |
| 6170 | tcgttttgcatgatgtgggctta | L10106 | 48774 | gttgaagctccgtcacaatcgcca | AA030068 | 91378 | tcatctctgggcgtgctgctgga | AA114811 |
| 6171 | ttgctatgatggcgttagagtac | L10106 | 48775 | tgactccctcggcctgtggattct | AA030068 | 91379 | catctctgggcgtgctgctctgat | AA114811 |
| 6172 | aagagtacctggagtctcatagtc | L10106 | 48776 | aagctccgtcacaaatcgccact | AA030068 | 91380 | atctctgggcgtgctgctctcgatt | AA114811 |
| 6173 | cctggggtccatagtcctgag | L10106 | 48777 | aattataccaacaacagctagag | AA030068 | 91381 | tctctgggcgtgctgctctcgatta | AA114811 |
| 6174 | gtcctatagtcgctgagactatt | L10106 | 48778 | ttataccaacaacagctagagcc | AA030068 | 91382 | tgacctgactcaagcgccaccg | AA114811 |
| 6175 | atagttcgtgagactattgcaga | L10106 | 48779 | tacaacaaacagcctagagcccaaa | AA030068 | 91383 | accgcccaggcgtcatcacaaga | AA114811 |
| 6176 | ttgcagagcatccaagccagaaatcc | L10106 | 48780 | cagcctagagcccaaatatctgcct | AA030068 | 91384 | ccgcaggcgtcatcacaagaga | AA114811 |
| 6177 | cattgctcgtcgagccagcgctg | L10106 | 48781 | gcccaaatatctgccttgtaagtga | AA030068 | 91385 | cgcaggcgtcatcacaagagagt | AA114811 |
| 6178 | caatgtcacctacaaccactcgg | L10106 | 48782 | atatctgccttcgtaggtgatgatt | AA030068 | 91386 | gcaggcgtcatcacaagagaggt | AA114811 |
| 6179 | tgtcacctacaaccactcttggc | W50102 | 48783 | tgccctccgcatgtacaacctcgt | AA030068 | 91387 | ccaggcgtcatcacaagagagagt | AA114811 |
| 6180 | cctcttctttgataattacgagcac | W50102 | 48784 | acctcgtgtgtgcgcgcagagaata | AA030256 | 91388 | ggctgtcatcacaaagagagtgat | AA114811 |
| 6181 | ttagcagcacaaacaacagcgtcgt | W50102 | 48785 | accgaggttcaacctgatgctggg | AA030256 | 91389 | tgatgaaatcatctctggggcgtc | AA114811 |
| 6182 | cagcacaaacaacagcgtcgtcaag | W50102 | 48786 | cgcactgcccttcggagaactagcgt | AA030256 | 91390 | atttactatggctgtctctgcgc | AA114811 |
| 6183 | gcacaaacaacagcgtcgtcaagaag | W50102 | 48787 | ctgccctcggagactagcgtgg | AA030256 | 91391 | tctcccagggaatgctcgtcgt | AA116282 |
| 6184 | caacaaacaacagcgtcgtcaagaagac | W50102 | 48788 | ctgccctcggagactagcgtgg | AA030256 | 91392 | gtttggctcttttccagataacact | AA116282 |
| 6185 | caacagcgtcgtcaagaagatcccac | W50102 | 48789 | ctgccctcggagactagcgtgcg | AA030256 | 91393 | ttcttttccagataacactgcactt | AA116282 |
| 6186 | cgtcaagaagatcaccctggaggtg | W50102 | 48790 | agactaggggggactcatggcg | AA030256 | 91394 | tgcactgcgtctctgccctgcat | AA116282 |
| 6187 | agatatggcatccatcgtcagag | W50102 | 48791 | gactaggtgggggactccatgagt | AA030256 | 91395 | tgcgtctctgcctgcatacatcg | AA116282 |
| 6188 | cgtgctcattggtgttaacatat | W50102 | 48792 | ctaggtgggggactccatggagtg | AA030256 | 91396 | gtctctgcctgcatacatcgtct | AA116282 |
| 6189 | gttaacatatggctgctgggagaa | W50102 | 48793 | cgactccatgagtggttggaa | AA030256 | 91397 | tctctgcctgcatacatcgtcttg | AA116282 |
| 6190 | ctacaactctcggtgactacgaa | W50102 | 48794 | tccatgagtggttgggaagact | AA030256 | 91398 | cctgatacacatcgtcttgttgtt | AA116282 |
| 6191 | caaccactcggtgactacgaatgt | W50102 | 48795 | tcgtgtgcgcaccgagaatagcag | AA030256 | 91399 | gtctttgttcttctagcaaga | AA116282 |
| 6192 | ccactctggagactacgaatgtcac | W50102 | 48796 | ctgtcgccaccgggctactggaaga | AA030256 | 91400 | tttgttgttcttctagcaagatgc | AA116282 |
| 6193 | ctctggagactacgaatgtcacgtc | W50102 | 48797 | tgctggcccaccgggctactgaagag | AA030256 | 91401 | tcttctagcaagatgcagtcgtaggg | AA116282 |
| 6194 | cgactaagtgcacgtcacctgcgt | W50102 | 48798 | ctggccaccgggctactggaagagc | AA030256 | 91402 | gaatgctggtctgtctttgcctct | AA116282 |
| 6195 | ctacgaatgcacgtcaccgtcc | W50102 | 48799 | tggccaccggctactggaagaggt | AA030256 | 91403 | tgctggtctgtctttgcctccca | AA116282 |
| 6196 | atgtcaacgtctacgctctcctc | W50102 | 48800 | gccaccggctactggaagagctac | AA030256 | 91404 | gtctgtttttgcctccaggcaat | AA116282 |
| 6197 | tctcctctttgataattacgag | W50102 | 48801 | gagacaaccgagggtcaacctgat | AA030256 | 91405 | cttgcctctccaggcaatcctagc | AA116282 |
| 6198 | tgaggctttactgtcacccteatc | L09562 | 48802 | gtcagattgtgccctgccctgc | AA030256 | 91406 | ctccaggcaatcctagcctgat | AA116282 |
| 6199 | ctttactgtcaccctcatcagcaaa | L09562 | 48803 | gtcagattgtgccctgccctgc | X52886 | 91407 | tccaggcaatcctagcctgaattt | AA116282 |

| SEQ ID NO | sequence | DBAxnID | SEQ ID NO | sequence | DBAxnID | SEQ ID NO | DBAxnID |
|---|---|---|---|---|---|---|---|
| 6200 | agcagtttcgcaggaatgttgtgt | L09562 | 48804 | cagattgctgccctcgcctgctg | X52886 | 91408 | tcctagcctgaatttcaagcccct | AA116282 |
| 6201 | taccacctgtccagcagctagag | L09562 | 48805 | cctccaactctggcctgcaaaggc | X52886 | 91409 | ttcctgttggcttctttccagat | AA116282 |
| 6202 | tgtgttccaggtgcaaaaatgatc | L09562 | 48806 | ccaactctggcctgcaaaggcctg | X52886 | 91410 | tgggaactgaccgacatctggaaga | AA116344 |
| 6203 | acaataccagttgtctaccaaagca | L09562 | 48807 | actctggcctgcaaaggcctgaag | X52886 | 91411 | gaactgaccgacatctggagactc | AA116344 |
| 6204 | tgtctacaaagcaagctcagttg | L09562 | 48808 | ctggcctgcaaaggcctgaaggtg | X52886 | 91412 | agttcacagtcgcggagccagccaag | AA116344 |
| 6205 | caaagcaatgctcagcttgatcagt | L09562 | 48809 | cctcctgggaaggcatgcctcagcc | X52886 | 91413 | tcacagtgccgagcagccaaggat | AA116344 |
| 6206 | agaggaatcagacccgcagagagc | L09562 | 48810 | aaggcatgcctcagccgctgggtaga | X52886 | 91414 | cagtgccgagcagccaaggatgtg | AA116344 |
| 6207 | atcagaccctgcagagagcatggag | L09562 | 48811 | gccatgcctcagcctggtagaagt | X52886 | 91415 | tgccgagcagccaaggatgtaatg | AA116344 |
| 6208 | catggatgtctgggtgactagtc | L09562 | 48812 | tcctgggctaggcagctgggagca | X52886 | 91416 | cgcagagaagccatcgctgcggcagt | AA116344 |
| 6209 | actcattgtaaactctgagact | L09562 | 48813 | cctgggctaggcagctgggagcaa | X52886 | 91417 | agagaagccatcgctgcagcgcatcg | AA116344 |
| 6210 | cctcatcagcaaagacaggctagc | L09562 | 48814 | ctaggcagctgggagccaagtga | X52886 | 91418 | gccatcgctggcagtcgcatgcta | AA116344 |
| 6211 | agacaggctatgcctctgcaatgaa | L09562 | 48815 | cccagtaccgaggctgccttcaaa | X52886 | 91419 | atccgttggccagtccgatgctatg | AA116344 |
| 6212 | gctatgcctctctgaatgaagaaccta | L09562 | 48816 | agtacacgaggctgcctcaaaggc | X52886 | 91420 | gcttggccagtccgatgctatgtaac | AA116344 |
| 6213 | agaacaaattatcatccatgactc | L09562 | 48817 | ggctgcctcaaaggccctactgg | X52886 | 91421 | tggcagtccgatgctattgaacatg | AA116344 |
| 6214 | aattatcatccatgactcatcct | L09562 | 48818 | ccctactgtttaatagctgtga | X52886 | 91422 | ctgaccgacatctggagactccat | AA116344 |
| 6215 | atggcctaacccagcagtccccata | L09562 | 48819 | tgccgcccttgctgtgtgggcagt | X52886 | 91423 | cagtccgatgctattgaacatgaga | AA116344 |
| 6216 | taaccagatgcccctataagtagt | L09562 | 48820 | cctttgctgtgtgggcagtactg | X52886 | 91424 | cgacatctggagactccatactga | AA116344 |
| 6217 | taccttgaactgatcaatgtcatc | L09562 | 48821 | cagtactctgaagcaggcaaatggg | X52886 | 91425 | catctggagactccatactgagaga | AA116344 |
| 6218 | cgcacgctgggagcatccagaaggg | X17463 | 48822 | tactctgaagcaggcaaatgggtct | X52886 | 91426 | ctggagactccatactgagaaaag | AA116344 |
| 6219 | accagaagatgcgcgcgcgctcgcg | X17463 | 48823 | ggtgatgcccacaatcagcgtcatg | X52886 | 91427 | taaatgtcaggagtgtggaaggc | AA116344 |
| 6220 | ctcaaccgagggtcagcctggctta | X17463 | 48824 | gatgcccacaatcagcgtcatgaga | X52886 | 91428 | atgtcaggagtgtggaaggcctt | AA116344 |
| 6221 | gggtcagcctggctagttggccacg | X17463 | 48825 | atcacgaaaagctgttcatagaag | X52886 | 91429 | ctggaaggcctttgctctcgtcgta | AA116344 |
| 6222 | tcagcctggctagttggccacgtg | X17463 | 48826 | gaggacaactatagtctccgatgcgc | X52886 | 91430 | ctttattcaacagtcacaacctcatt | AA116344 |
| 6223 | gctggcttagtggccacgtgtctt | X17463 | 48827 | actatagtctccgatgcgcacc | X52886 | 91431 | aaggcttagcctctaggggtcaca | AA145535 |
| 6224 | tgcttagtggccacgtgtcttcct | X17463 | 48828 | atatgtctcgatgcgcaccatgagc | X52886 | 91432 | ttagctccctaggggtcagcactgga | AA145535 |
| 6225 | cttagtggccacgtgtctctctg | X17463 | 48829 | gtccgatgcgcaccatgcagttc | X52886 | 91433 | agctccacaggaaccggatccattc | AA145535 |
| 6226 | gtctgcgctggcaccttgtatt | X17463 | 48830 | gtccgatgcgcaccatgactctc | X52886 | 91434 | tccacaggaaccggatccatcactaccac | AA145535 |
| 6227 | tgggctgcgcaccttgtatattgaa | X17463 | 48831 | tccgatgcgcaccagcttc | X52886 | 91435 | ggatccatcacctacgattaccac | AA145535 |
| 6228 | cgctggccactttgtatattgaa | X17463 | 48832 | caccatgagctctcagctctgc | X52886 | 91436 | tatcgctggactcctttcatctgt | AA145535 |
| 6229 | tgggaccttttgtatattgaatgc | X17463 | 48833 | catgagctctcagctctgctgtc | X52886 | 91437 | cctctctatcctggacatcttatc | AA145535 |
| 6230 | tgggcaactacggcaagacaggcga | X17463 | 48834 | gagctctccagctctcgctgctg | X52886 | 91438 | ctttcatctggggcatcctatctc | AA145535 |
| 6231 | gaactacggcaagacaggcgagt | X17463 | 48835 | gccacaatcagtcgtcatgagatac | AA030294 | 91439 | ctggccatccttatcctcttagcaag | AA145535 |
| 6232 | agagaagctcacctcacagttcag | X17463 | 48836 | ctcctgtcgttggtgccgtcagc | AA030294 | 91440 | catcctcatcctagcaagaa | AA145535 |
| 6233 | agctcacctaccagttcagcgggga | X17463 | 48837 | cacaatcagtcgtcatgagatactg | AA030294 | 91441 | tatcatcctagcagagatgtcga | AA145535 |
| 6234 | tcacctaccagttcagcgggcgaagt | X17463 | 48838 | tgtaaagtctgggctcatgttcggg | AA030294 | 91442 | gtccctagggtgcacagtcggacat | AA145535 |
| 6235 | actgatccgccgcagaagcgcgccag | X17463 | 48839 | ggcataacttctgcagctctgggcc | AA030294 | 91443 | gtgccgagcagccggacattggggtc | AA145535 |
| 6236 | gcctcaaccaggcgctgggccacc | X17463 | 48840 | ataacttctgcagctctgggccacc | AA030294 | 91444 | cacgctggacactgggggtctc | AA145535 |
| 6237 | gacctcaaccaggcgacctggctgc | X17463 | 48841 | actcttgcagtctgggccacc | AA030294 | 91445 | acatttgggggtctcgtcaacg | AA145535 |
| 6238 | agagtgaagccacctggatcaacg | X17463 | 48842 | ctccactgatcacgaaaggcctgt | AA030294 | 91446 | ctttctgtcaacaggggacagcgtga | AA145535 |
| 6239 | tgaaggccacctggatcaacgttga | W50000 | 48843 | ccactgatcacgaaaggcctgttca | AA030303 | 91447 | ctgtcaacaggggacagcgtgaatg | AA145535 |
| 6240 | gcctgggctgcggaggtgacacat | W50000 | 48844 | ggctccatggtgactagagtta | AA030303 | 91448 | cctcccagcagtcgcagaagct | AA145535 |
| 6241 | ttgagttctgtgctaccaatgggg | W50000 | 48845 | ttcaaaatgtccggctccgcagca | AA030303 | 91449 | cctcccagcagtcagaagct | AA145535 |
| 6242 | gagttctgtaccaatgggaa | W50000 | 48846 | ctgcacacggtagttcaacacg | AA030303 | 91450 | tgcagaagtccacaggaaccggat | AA145535 |
| 6243 | tctgtaccaatgggaacag | W50000 | 48847 | gtgttctaacagcaaggcgcaccacc | AA030303 | 91451 | agctcgccattcctccaccatg | AA145535 |
| 6244 | acagcaagctgcctgaagtcat | W50000 | 48848 | ttctaacagcaaggcgccaccttg | AA030303 | 91452 | tcctcaccatgtgttttcacatg | U04334 |
| 6245 | caagctgcgcctgaagtcagcag | W50000 | 48849 | taacagcaaggcgcaccacctgag | AA030303 | 91453 | gtcgccagccagacatggtacc | U04334 |
| 6246 | agctgcgcctgaagtcatgcagga | W50000 | 48850 | caccacctggctgcccattgcg | AA030303 | 91454 | tgcagacatgtacctctagg | U04334 |
| 6247 | gcgcctgaagttcatgcagactta | W50000 | 48851 | actgacatagcccagcaggtagcgg | AA030303 | 91455 | tggtacctctaggacaccacacaga | U04334 |
| 6248 | acagacacttgtcaactgaacga | W50000 | 48852 | gaccatacgcaggctagcggata | AA030303 | 91456 | ccaaagctgtgctcagcccaattca | U04334 |
| 6249 | ggacacttgtcaactgaactgagt | W50000 | 48853 | atagccaggtagcgggatacg | AA030303 | 91457 | ctgtctgctcagcattcaagcaga | U04334 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 6250 | W50000 | gccacctgtgatcaacgttgagccg | 48854 | AA030303 | gatatcgtctctgaccggttaagg | 91458 | U04334 | tcagccaatttcaagcagcagatttga |
| 6251 | W50000 | cacttgatcaacgttgagccgcca | 48855 | AA030303 | gctctcgaccggttaaggagcaag | 91459 | U04334 | ttacagcccggaatgagcaactga |
| 6252 | W50000 | ttggatcaacgttgagccgagcc | 48856 | AA030303 | cgcagcaccaaagagcagtggca | 91460 | U04334 | atgagcaactgacctgccttatga |
| 6253 | W50000 | atcaacgttgagccgagcccactg | 48857 | AA030303 | agcaacaccaaagagcagtggcaccg | 91461 | U04334 | cttatgaataccttcaagccgaccg |
| 6254 | W50000 | caacgttgagccgagccactgt | 48858 | AA030303 | aagcagtggaccgtcaatgaca | 91462 | U04334 | tcaagccagccgcatagagaacag |
| 6255 | W50000 | gcagccactgctcgagccgaggacctg | 48859 | AA030303 | agcagtggaccgtcaatgacatac | 91463 | U04334 | cccagcatgctgccatcaaccagg |
| 6256 | W50000 | agcccactgctcgagccgaggacctgcc | 48860 | AA030303 | agtggcaccgtcaatgactaccg | 91464 | U04334 | atgctgccatcaaccagggccagct |
| 6257 | W50000 | cactgctcgaggaggacctgccggg | 48861 | AA030303 | accgtcaatgactatacccgtcaag | 91465 | U04334 | ccatcaaccagggccagctggactg |
| 6258 | W50000 | tcacatgacggcgctgtgcacaagc | 48862 | AA030303 | ctgtgggtctgcacacggtagt | 91466 | U04334 | tacctaatgctccatgcacaatgag |
| 6259 | W50000 | gctgtgcacaagccctacaactgct | 48863 | AA030303 | ctgggtgcacacggtagtgtct | 91467 | U04334 | tggggtgctacctgatgcagaa |
| 6260 | W50000 | atgctgagctcggttatattccg | 48864 | AA030303 | gcttatgattccaagcagatgaac | 91468 | U04334 | cgctacctgatgtcgaagaaggcctg |
| 6261 | L04649 | attttcgaccacatgaaggtgcaca | 48865 | AA030303 | gatgaacctgtacaccctcccaaattc | 91469 | U04334 | tgcagaaggcctgtcttcagatgac |
| 6262 | L04649 | tgtccaatgggcagcttgagcgagcag | 48866 | AA030303 | caaggccatgctgcaactgactgatgaa | 91470 | U04334 | ctatcacatgcgacctgggcgct |
| 6263 | L04649 | cctggtgagctccaagttgatggg | 48867 | X70533 | tgtgctgcctgctcgccaccaatggc | 91471 | AA116479 | ttatctgccctaagtctctgttat |
| 6264 | L04649 | ggaaagtctcttggtacagtctc | 48868 | X70533 | ctccgaatcatccacctccagtac | 91472 | AA116479 | tctgcctaagtctctgttatgtt |
| 6265 | L04649 | tcacgactctcatcaaccaaggag | 48869 | X70533 | caagtacaacagccgcttcatctc | 91473 | AA116479 | tctcttcatagagctctatatc |
| 6266 | L04649 | ctctcatcaaccaaggaggcctcca | 48870 | X70533 | gccctcatctctggccttgac | 91474 | AA116479 | cttcatcatagagctctatatctg |
| 6267 | L04649 | atcaaccaaggagcctccagacaga | 48871 | X70533 | catcttcctggcctttgacagtac | 91475 | AA116479 | catcatagagctctatatctggtt |
| 6268 | L04649 | caaggagcctccagacagagaggag | 48872 | X70533 | cctggccttgacaagtacacatgg | 91476 | AA116479 | agagctctatatctggttaatgaa |
| 6269 | L04649 | gcctccagacagagaggaggagaa | 48873 | X70533 | aaaccatgtgccatctgacttga | 91477 | AA116479 | gctctatctggttaatgaagta |
| 6270 | L04649 | aactgctcccactgtggccaagagct | 48874 | X70533 | tgggccatcgacttgagcaacgtc | 91478 | AA116479 | cttggcaacttaacaatttcaat |
| 6271 | L04649 | tgtgggcaagagctctccgccgg | 48875 | X70533 | catctgacttgagcaacatgagaagt | 91479 | AA116479 | tcaaaacctgcagaactattatcat |
| 6272 | L04649 | gatcacctcaacagtcacgtcagac | 48876 | X70533 | catcccaaattccatgtctgact | 91480 | AA116479 | agctgccatcagacgactcggaacatc |
| 6273 | L04649 | caagtgcactcaacagcagcggcct | 48877 | X70533 | ctccatgtcgatacctatgacctt | 91481 | AA116479 | tgccatcagacgtcgggaacatcaaa |
| 6274 | L04649 | cactcaacagcagcgggcctcaaat | 48878 | X70533 | gtctcgataccctagaactt | 91482 | AA116479 | catcagacgtcgggaacatcaaatag |
| 6275 | L04649 | acagagcggcctcaaatgtgaga | 48879 | X70533 | tgacctttcaagatgtgctggcagat | 91483 | AA116479 | ctaagtcttcgttatgttcagagc |
| 6276 | L04649 | gctacgaaggatgcctccgagcgc | 48880 | X70533 | tcaagatgctggcagatgtgggc | 91484 | AA116479 | tttcctgatgcgccgaaccca |
| 6277 | L04649 | gctccatgtcatgtctgggcaaga | 48881 | X70533 | tgtgctgcagatgtgggccatagg | 91485 | AA116479 | agtctcgttatgtcagagctcga |
| 6278 | W50127 | agatgcaagagctgcccaagaga | 48882 | X70533 | gttcaacaacaatctgatttcgca | 91486 | AA116479 | cttctgttatgttcagagctcggca |
| 6279 | W50127 | gatgacaagagctcgcccaagaaga | 48883 | X70533 | aacgtactccacaaggccatgctg | 91487 | AA116479 | ttatgttcagagtcggcactgcag |
| 6280 | W50127 | atacaatacgacgtgctgcagggt | 48884 | AA030276 | aacttcccagccacaaggccatgg | 91488 | AA116479 | ggcactgcagctgtgaatctgtct |
| 6281 | W50127 | tacaatacgacgtgctgcagggtc | 48885 | AA030276 | cttcccagccaggaatccattgggt | 91489 | AA116479 | gctgaatctgtctctcatcata |
| 6282 | W50127 | aatacgacgtgcgtgcagggtctga | 48886 | AA030276 | ttgcctactccgaagtctgacat | 91490 | AA116479 | gtgaatctgctctcatcatagag |
| 6283 | W50127 | taccgactgcgtgcagggtctgtca | 48887 | AA030276 | ggattttgccataatcgagcct | 91491 | AA116479 | aatctgtctctcatcatagagtc |
| 6284 | W50127 | acgacgtgcgtgcagggtctgacac | 48888 | AA030276 | atttgccaataatcgagcctgt | 91492 | AA116335 | taacttcctagctgctaaggagaaa |
| 6285 | W50127 | cgactgcgtgcagggtctgacacac | 48889 | AA030276 | tgccaataatcgagcctgtaga | 91493 | AA116335 | cttcctagctgctaaggagaaatcc |
| 6286 | W50127 | gactgcgtgcagggtctgacacaca | 48890 | AA030276 | tgccataatcgagcctgtagat | 91494 | AA116335 | ttacctgaagccacctattctgac |
| 6287 | W50127 | tctgacacacacagtaaagccccagag | 48891 | AA030276 | ccaataatcgagcctgtagattg | 91495 | AA116335 | cctcagaagccacctattctgactcc |
| 6288 | W50127 | ctgacacacagtaaagcccagaga | 48892 | AA030276 | caataatcgagcctgtagattgc | 91496 | AA116335 | cagaagcacctattctgactccacc |
| 6289 | W50127 | gacacacacagtaaagcccaggagatc | 48893 | AA030276 | taatcgagcctgtagattgccca | 91497 | AA116335 | cacctattctgactccacctcgaga |
| 6290 | W50127 | gacacagtaaagcccaggagagca | 48894 | AA030276 | gcttgtagattgcccagtgtaaa | 91498 | AA116335 | ttctgactccacctcggaaccaag |
| 6291 | W50127 | acacacagtaaagcccaggagatcc | 48895 | AA030276 | tgtagattgcccagtgtaaaagg | 91499 | AA116335 | ctccacctcggaaccaaggataact |
| 6292 | W50127 | caagagtcgcccaagaagaagcaag | 48896 | AA030276 | ttccagccaggaatccattgggtt | 91500 | AA116335 | cacctcgaaccaaggatactctt |
| 6293 | W50127 | aagagtctgcccaagaagaagcaagg | 48897 | AA030276 | ccgaccaggaatccattgggttggc | 91501 | AA116335 | agatgttcacgatttgactacgt |
| 6294 | W50127 | caagaggtcgggaactgactgac | 48898 | AA030276 | agccaggaatccattgggttggcg | 91502 | AA116335 | tccaagatttgactacgttcgta |
| 6295 | W50127 | gacctgatgaccctcaagaaggag | 48899 | AA030276 | gaatccattgggttggcgactg | 91503 | AA116335 | attttgactacgttgcattggtg |
| 6296 | W50127 | cctggatgacctcaagaaggaagtg | 48900 | AA030276 | aatccattgggttggcgcactgc | 91504 | AA116335 | gaaatcctgagcggccgcctggggc |
| 6297 | W50127 | cggaaataccaatacgacgtcgctgc | 48901 | AA030276 | ccatgggttggccgactgtctcac | 91505 | AA116335 | actacgttgctgattggttaagt |
| 6298 | W50167 | gaaatacaatacgactgcgtgca | 48902 | AA030276 | taaaagttgctactccgaagtct | 91506 | AA116335 | tccggttaaccgactgaggtgct |
| 6299 | W50167 | cagttcacccagctgactctg | 48903 | AA030276 | agagttgctactccgaagtctag | 91507 | AA116335 | taaccgactgaggtgctcaatgga |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6300 | gttcaccaaggctgtactcttgga | W50167 | 48904 | catgtgactgtgaccagcagatcga | X57111 | 91508 | cgactggagtgctctaatggacaa | AA116335 |
| 6301 | cagtggacaccctcactcagtactcg | W50167 | 48905 | accagcagatcgacagctgtaccta | X57111 | 91509 | agccaccatttgtacctaccattag | AA116335 |
| 6302 | tctacagtactgccctggctcag | W50167 | 48906 | caccgcagtctcaagtgagattga | X57111 | 91510 | caccattgtacctaccattagaagg | AA116335 |
| 6303 | tacagctactgccctggctcagtg | W50167 | 48907 | agattgaaccgcctcatgatgagg | X57111 | 91511 | cattgtacctaccattagaagacg | AA116335 |
| 6304 | cagctactgccctggctcagtgc | W50167 | 48908 | aacgcctcatgatcagggctattc | X57111 | 91512 | atgaatttacctcagaagcacctat | AA116335 |
| 6305 | gctactgccctggctcagtgcaa | W50167 | 48909 | gtcaggctcatcctaccagagacat | X57111 | 91513 | ggcttggtgctcagagagagacaagt | AA033499 |
| 6306 | tactgccctggctcagtgtcaaca | W50167 | 48910 | gctattcctacaggacattcagaa | X57111 | 91514 | tctcagctaggaagacacggcgctg | AA033499 |
| 6307 | gccctggctcagtgtcaacagtaa | W50167 | 48911 | cctaccaggacattcagaaagcttt | X57111 | 91515 | tgtctcacgagatgtacctgaat | AA033499 |
| 6308 | cctggctcagtgtcaacagtaagg | W50167 | 48912 | aagcttgtcattgcccacaacaa | X57111 | 91516 | cacgatgacctgaatctgtctgc | AA033499 |
| 6309 | ttggctcagtgtcaacagtaagggc | W50167 | 48913 | tggtcattgcccacaacaacatttga | X57111 | 91517 | gatgacctgaatctgtctgctgcctt | AA033499 |
| 6310 | ctcagtgtcaacagtaagggccact | W50167 | 48914 | ttgcccacaacaacattgagatggc | X57111 | 91518 | gaatctgtgcctgattcctg | AA033499 |
| 6311 | tcaccaaggctgtacctcttggaga | W50167 | 48915 | tttcttctcctgctcactgagccac | X57111 | 91519 | tctgtgccttgatcctggccg | AA033499 |
| 6312 | tggttctctttcgttctaatac | W50167 | 48916 | agatcagacagctgtacctacgaagc | X57111 | 91520 | ctgccttggatctctggcgctggtc | AA033499 |
| 6313 | gcttcctctttcgttctaatacg | W50167 | 48917 | cccaagcacgtcgtgtacagaaaa | X57111 | 91521 | cctggatctcggcgctgctcac | AA033499 |
| 6314 | tcttttcgttctaatacgtaatc | W50167 | 48918 | ggaatctggccacagctcacacgag | X57111 | 91522 | tggatcctggcgtgctgtcactct | AA033499 |
| 6315 | tttcgttctaatacgtaatcag | W50167 | 48919 | tggccacgctcacacagtactgg | X57111 | 91523 | ccactctgcaaggccgagaccag | AA033499 |
| 6316 | tttctaatacggtaatacagccag | W50167 | 48920 | ccctgtcatctccaatgccag | X57111 | 91524 | tgtcaaggccgaccaagaagtg | AA033499 |
| 6317 | taatacgtgatactacacctctacagt | W50167 | 48921 | tgtctttgatgtgacctacaa | X57111 | 91525 | agacacggcgtggaaccatggac | AA033499 |
| 6318 | atcagtgaaccctctacagtac | W50167 | 48922 | cattcctcggaatcaactcga | X57111 | 91526 | gctgaaccatggacacctcatat | AA033499 |
| 6319 | acagttcaaactgtctttgatcgg | W50167 | 48923 | aagccagtactatcaacaaggctcg | X57111 | 91527 | tccaatcccgcaaggctgatgt | AA033499 |
| 6320 | aactgctctgatcgggaacagcag | W50167 | 48924 | gtgcagtccaccaaggcttgtg | X57111 | 91528 | atccgcaaggctgatgctgcagcc | AA033499 |
| 6321 | acaatgccaggtaatcctgtggg | M89777 | 48925 | ttccaccaaggctctcggtgacctg | W43968 | 91529 | ctcatgggaacacctggcctcaca | AA033499 |
| 6322 | taatcctgtggggaacaagtgtga | M89777 | 48926 | acgcagacgggtatccagcgtgaa | W43968 | 91530 | tcacagctctgctcagc | AA033499 |
| 6323 | tctgaccctgtgggaatgatggccgag | M89777 | 48927 | cagacgggtatccagcgtggaacta | W43968 | 91531 | ctggtctgctcacgatgtac | AA033499 |
| 6324 | tacgctgagatggggccgaggct | M89777 | 48928 | gctatccagcgtggaactaagaaca | W43968 | 91532 | gtcgtctcagcagatgtacctg | AA033499 |
| 6325 | agttctggaggcctggccaagga | M89777 | 48929 | actaagaacaattaccgatgagag | W43968 | 91533 | ctcttacatcctactacactaca | AA116410 |
| 6326 | aggttctggagcgcctggtggacat | M89777 | 48930 | aattaccgatgagctgccctg | W43968 | 91534 | tctcttcatctcctactacactacaa | AA116410 |
| 6327 | tcgaggccgtggtggacatctg | M89777 | 48931 | cccccaggatgccatcaaaacggag | W43968 | 91535 | cactacacattatcatcactccaaa | AA116410 |
| 6328 | tggaacatctgtgacacagatgaa | M89777 | 48932 | ccaggatgccatcaaaacggagtca | W43968 | 91536 | actacacattatcatcactcacta | AA116410 |
| 6329 | acaatgccaggtaatcctggtccag | M89777 | 48933 | catgccttggaaccagaaggtcca | W43968 | 91537 | tacaacattatcatcactcaaaaca | AA116410 |
| 6330 | gctcagccccaggcagccaatggaaa | M89777 | 48934 | tccaatcagaaaagcctgtacacct | W43968 | 91538 | acaacattatcatcactcaaaacat | AA116410 |
| 6331 | ctgccttcgcgagcacagtgggat | M89777 | 48935 | cagaaaagcctgtacacctctatgg | W43968 | 91539 | acattatcatcactcaaaaacatcc | AA116410 |
| 6332 | acagccggagccagcgcagctgttag | M89777 | 48936 | caccaaggcttcggtgacctggcta | W43968 | 91540 | acattatcactcaaaacatccc | AA116410 |
| 6333 | ccttctggagcacagtggcatcga | M89777 | 48937 | ttccggacctggctatccctcaagcca | W43968 | 91541 | ttatcactcactcaaaacatcccta | AA116410 |
| 6334 | gcatcgactcaaggtcaagacgt | M89777 | 48938 | ggtgacctgctatctccaagccca | W43968 | 91542 | atcatcactcaaaactccccttaaa | AA116410 |
| 6335 | tcaagcgactacgacacgacaa | M89777 | 48939 | gctatcctcaagccaggcaacaag | W43968 | 91543 | tctcatcactcaaaactccccttaaaa | AA116410 |
| 6336 | cagaggccgagagggctcaccggac | M89777 | 48940 | aaagtgctcaggtcagcatcggac | W43968 | 91544 | tttcacaaactactactcccatc | AA116410 |
| 6337 | cctactacggagactatgggtt | M89777 | 48941 | caggtcagcatcggaccggcatgc | W43968 | 91545 | tcttacatctactactacaaca | AA116410 |
| 6338 | accaggagtcttcacgcgtgca | M89777 | 48942 | agagaaaccgtcaccgcagca | W43968 | 91546 | cttacactctactactacactacaat | AA116410 |
| 6339 | cgcagtcaaaaactattcctggga | M89777 | 48943 | accacgcagaggtatcagcgtg | W43968 | 91547 | atctctactacactacaacattat | AA116410 |
| 6340 | tatactctgaggaattactttggtg | M29475 | 48944 | cgacaacttatctttggtcagagt | AA030364 | 91548 | atcctactacactacaacattatca | AA116410 |
| 6341 | gctaaggtctactatttcacagg | M29475 | 48945 | gacaacttatctttggtcagagt | AA030364 | 91549 | tcctactacactacaacattatcat | AA116410 |
| 6342 | gagactctccaatgccagcttg | M29475 | 48946 | gtggactccagccttgtcgtgc | AA030364 | 91550 | ctactactacaacattatcatca | AA116410 |
| 6343 | ctccatgccagccttggttaaact | M29475 | 48947 | tggactcagtcctagatgtcgtggcg | AA030364 | 91551 | ctactactacacaacattatcatcatctc | AA116410 |
| 6344 | tgatacatttgttcaatggcttcc | M29475 | 48948 | actcactagtatgctgcatcggac | AA030364 | 91552 | tacactacaacattatcatcactca | AA116410 |
| 6345 | atttgttcatagtcatcagt | M29475 | 48949 | actcactagtatgctgtcagtcta | AA030364 | 91553 | aaaccctgcaacagtagccattggtg | AA116677 |
| 6346 | tgttcaatggtcacgagtca | M29475 | 48950 | agaatttgactgctgcagggtt | AA030364 | 91554 | aaatggccaccatgcaattgacacaagg | AA116677 |
| 6347 | cacgagtcttactcttcctctgag | M29475 | 48951 | ttccagttgacactcactgggt | AA030364 | 91555 | aaatgccattccaattgacacaagg | AA116677 |
| 6348 | gagctactttcctctcgaggg | M29475 | 48952 | tccagtgacactccactggtg | AA030364 | 91556 | atgcattccaattgacacaaggt | AA116677 |
| 6349 | gtttagacaccaggatgcatgtac | M29475 | 48953 | gggcacagtcaggcatggggacac | AA030364 | 91557 | gccattccattccaattgacacaaggtgt | AA116677 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6350 | tagacaccaggatgcaatgtactat | M29475 | 48954 | ggcacagctcaggcatgggcacact | AA030364 | 91558 | cattccaattgacacaaggctgtct | AA116677 |
| 6351 | aggactatattccatgtcaaatg | M29475 | 48955 | cacagctcaggcatgggcacactgc | AA030364 | 91559 | aattgacacaaggctgtctgaacct | AA116677 |
| 6352 | aaggtctcactatttcacaggctg | M29475 | 48956 | acaacttatcttggtcagagtgg | AA030364 | 91560 | ttgacacaaggctgtctgaacctg | AA116677 |
| 6353 | gtctcactatttcacaggctgacc | M29475 | 48957 | caacttatcttggtcagagtgt | AA030364 | 91561 | caaggctgtctgaacctgtgaatg | AA116677 |
| 6354 | tcactatttcacaggctgacctg | M29475 | 48958 | ttatcttggtcagagtggtgctgg | AA030364 | 91562 | aggctgtctgaacctgtgaatgt | AA116677 |
| 6355 | tttcacaggctgacctgaattg | M29475 | 48959 | atctttggtcagagtgtgctgca | AA030364 | 91563 | tgtctgaacctgtgaatggtacct | AA116677 |
| 6356 | tcacaggctgacctgaattgaga | M29475 | 48960 | ctttggtcagagtgtggctggcaac | AA030364 | 91564 | tcaaattgaaaggccccctgagattg | AA116677 |
| 6357 | caggctgacctgaattgagactc | M29475 | 48961 | tgctggcaacaactgggccaaagg | AA030364 | 91565 | tggttgccacatgctgaacccaatt | AA116677 |
| 6358 | gaattgagactccaatgccagc | M29475 | 48962 | caaatggggcaaaggcaactatacg | AA030364 | 91566 | gtgccacacatgctgaaccccaattgc | AA116677 |
| 6359 | tttgagactctccaatgccagcctt | M29475 | 48963 | ggttggactcagtcctagatgctgtg | AA030364 | 91567 | ccatgctgaaccccaattgctaaaat | AA116677 |
| 6360 | gagctactgcggagttcggctcacc | W50181 | 48964 | gccacggccgcatcgggtaagcaccg | X05021 | 91568 | atgctgaaccccaattgctaaaatgc | AA116701 |
| 6361 | agatctcaggagcatgttgtcagaa | W50181 | 48965 | gcacgtaagcaccggcaagcaccacc | X05021 | 91569 | gctgaacccaattgctaaaatgcct | AA116701 |
| 6362 | taagcaggtctgggatgggccaca | W50181 | 48966 | aaactggagttgtccccatcatga | X05021 | 91570 | ctaaaatgctgggtccaaggaatg | AA116701 |
| 6363 | atgtggccacactcagctgctgaa | W50181 | 48967 | tgctcccatcatgattgattgtcg | X05021 | 91571 | tgcctgggtccaaggaatgaaatt | AA116701 |
| 6364 | ccacacttcagctgtgtgacacagg | W50181 | 48968 | ctccalcatgatgttgttgtcgatc | X05021 | 91572 | tcaccgaaaaaatgccatccaat | AA116701 |
| 6365 | acttcagctgctgacacaggcttt | W50181 | 48969 | atgttgtcgatcaggctactacaa | X05021 | 91573 | caaatcagtgctggcacgctccgt | AA116701 |
| 6366 | ttcagctgctgacacaggcttct | W50181 | 48970 | caggctactacaaagtctgggccaa | X05021 | 91574 | acacagaccacatatgttaagtt | AA116701 |
| 6367 | cagctgctgacacaggcttctg | W50181 | 48971 | gctactacaaagtctgcggcaaggg | X05021 | 91575 | tgtccccaaatcttcaagtctggga | AA116701 |
| 6368 | tgctgacacaggcttctgagca | W50181 | 48972 | ctaagcaacctgtcatcgtgaaggc | X05021 | 91576 | ccccaaatcttcaagtctgggatgc | AA116701 |
| 6369 | ctgacacaggcttctgagcaag | W50181 | 48973 | ctgcatcgtgaaggccaaattctt | X05021 | 91577 | caaatctcaagtctggatgctgc | AA116701 |
| 6370 | acacaggcttctgagcaaggcga | W50181 | 48974 | cccaattctcagaagagctgaa | X05021 | 91578 | atctcaagtcgggatgctgccac | AA116701 |
| 6371 | acaggcttctgagcaaggcgat | W50181 | 48975 | aattcttcagcagaagctgagga | X05021 | 91579 | aagtcgggatgctgccacagtgga | AA116701 |
| 6372 | atctcagagacatgtgcagaagt | W50181 | 48976 | tcggtaagcaccgcaagcaccaagcag | X05021 | 91580 | atatgatcctcgtaagaaccatgtt | AA116701 |
| 6373 | aggcttctgagcaaggcgatgc | W50181 | 48977 | gtaagcaccgcaagcaccaagcagga | X05021 | 91581 | tgatctcgtaagaaccatgtt | AA116701 |
| 6374 | cagaagcctgcgttctgcgag | W50181 | 48978 | tgcggcattaccacttgaagaggaa | X05021 | 91582 | tctccgtaaaccccatgtgtgag | AA116701 |
| 6375 | ctgctggtctgccgggaaagtc | W50181 | 48979 | ggcattaccacttgaagaggaacca | X05021 | 91583 | ccgtaagaaccatgtgtgagaga | AA116701 |
| 6376 | tggtctgccgggaaagtcatct | W50181 | 48980 | accagctgtcgcccaacagtcaa | X05021 | 91584 | taagaaccatgttgagagatgc | AA116701 |
| 6377 | tgtctgccgggaaagtcatctt | W50181 | 48981 | agagttctgccaacagtcaactt | X05021 | 91585 | cgagacatatcgtaagttgc | AA116701 |
| 6378 | aagtcatctcatggagaacatgctg | W50181 | 48982 | tctgccaacagtcaacttgataa | X05021 | 91586 | accacatatgtgaagttgctca | AA116701 |
| 6379 | gtcatctcatggagaacatgctgg | W50181 | 48983 | aaccgtggacatggtcagggaga | X05021 | 91587 | ttgctcagtttaagagaagatcta | AA116701 |
| 6380 | tccatggcaaggtagctcagggtg | W50181 | 48984 | ggtaacaaccgagccaagatgtgc | X05021 | 91588 | agaagtatcaccgctgtataagctg | AA116701 |
| 6381 | cccccaaaacagaactcaggagcag | W50181 | 48985 | tgtgaatctgctggccctcgtc | X05021 | 91589 | tctatcaccgctgtataagctg | AA116701 |
| 6382 | caggtttaccacgcctgtgccatgc | W50181 | 48987 | gttcatctgaaagcgggggcatctg | X05021 | 91590 | atcaccgctgtataagctgtag | AA116701 |
| 6383 | aagtcgacgaccctcagctcatgg | W50181 | 48988 | catctgaaagcgggggcatctgat | X05021 | 91591 | accgtcgtgtataagctgtataag | AA116701 |
| 6384 | cacgaccctcagctcatgggccatca | W50186 | 48989 | tctgatgcctcctacagagcgac | X05021 | 91592 | gtaggagtgcccaaatcttcaagt | AA116710 |
| 6385 | atgggcatcatcccccgatcgcc | W50186 | 48990 | gcctcctctacagagccacaatggc | X05021 | 91593 | attccggatccatgatccagacagca | AA116710 |
| 6386 | atccccggatcgcccgagacatct | W50186 | 48991 | tctacagagccacaatggctctgac | X05021 | 91594 | catcaccaactacctgggccagtg | AA116710 |
| 6387 | cggatcgcccgagacatctcacc | W50186 | 48992 | acagagccacaatggctctgacg | X05021 | 91595 | tgtccaaggagctgtctcaagagtg | AA116710 |
| 6388 | ttcaaccacactctcatggat | W50186 | 48993 | caatggctgacgctggtgcac | X05021 | 91596 | tgccaaggagctgtctcaagagtaca | AA116710 |
| 6389 | aaccacatctactccatggatgaga | W50186 | 48994 | tgctgacgctggtgcacagc | X05021 | 91597 | caacggagctgctcaagagtaca | AA116710 |
| 6390 | aacctgagttccacattagaggtg | W50186 | 48995 | cgctggtgcacagctgccatc | X05021 | 91598 | ctctcggggcctattgcagtg | AA116710 |
| 6391 | ttactgataagatccgtgacctt | W50186 | 48996 | gtggcacagctgccctctgtcaga | X05021 | 91599 | cagctgcctgccaggccatcatg | AA116710 |
| 6392 | taagatccgtgaccttttgaatgg | W50186 | 48997 | aatctgctgggccctctgcagattg | X05021 | 91600 | gtccctgcaggccattcatgc | AA116710 |
| 6393 | gttaccacgcctgcccatgcga | W50186 | 48998 | gccctgcagattgccagagga | X05021 | 91601 | gtcctgcaggccattcatgtc | AA116710 |
| 6394 | tacaaggctgccatgcagatcg | W50186 | 48999 | ctcgcagattgccaaagacg | X05021 | 91602 | cggcaggccattcatgtcaac | AA116710 |
| 6395 | tgtgccatgcagatcgccaagaacg | W50186 | 49000 | cagattgcccagagaccacagagcc | X05021 | 91603 | caggccattcatgtcaccaggccc | AA116710 |
| 6396 | gtcaaagagcgcctttgctgctgctaca | W50186 | 49001 | cagattgcccagagaccacagagccc | X05021 | 91604 | atcatgtgcaccaggcccacacc | AA116710 |
| 6397 | ggctcaaacgcacaattttgctt | W50186 | 49002 | ggccagagaccatcagcaccactt | X05021 | 91605 | caccaactacctggcaccagtgt | AA116710 |
| 6398 | attttgcttatgacagacatct | W50186 | 49003 | aggaccatcagcaccttcagaa | X05021 | 91606 | ctacctgcaccagtgtctgat | AA116710 |
| 6399 | cagacatcctcaggggaaaacgcaca | W50186 |  |  |  | 91607 | cctgcaccagtgtctgagtgtc | AA116710 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6400 | ggaaagctgcacgaccctcagctca | W50186 | 49004 | cggcacaggttccggctggtggct | | 91608 | ggcacaagtctgtctagtgcagc | AA116710 |
| 6401 | ttgagaaagcccaggactttagctga | X15788 | 49005 | ggcacaggttccggctggtggctt | | 91609 | gtctgctagtgtcagcccagcgct | AA116710 |
| 6402 | aagcccaggactttaggctgaagaggt | X15788 | 49006 | gcacaggttccggctgtggtggctt | | 91610 | tgctagtgtcagcccagcgctgtc | AA116710 |
| 6403 | atctcagatgcctgcaaacaatgg | X15788 | 49007 | tctcggtggcttcgatttttggcgt | | 91611 | tgtcagcccagcgctgcagcagt | AA116710 |
| 6404 | gatgcctgcaaacaatggcactag | X15788 | 49008 | tggcttcgatttttggcgtcagt | | 91612 | cgctgcagagtgcaacggcaagacc | AA116710 |
| 6405 | acaatggcactagagagctgcccaa | X15788 | 49009 | ttcgatttttggcgtcagtagtcg | | 91613 | tctcaacggttaccatgcaagacc | D00208 |
| 6406 | ttgtggactcagcgccatctg | X15788 | 49010 | gatttttggcgtcagtagtcgcgg | | 91614 | ttaccatggcaagaccctggagga | D00208 |
| 6407 | gacttcagccgccatctgggtttc | X15788 | 49011 | tgggtaacaaccgagccaagatgtt | | 91615 | tctttgagggctgcccagataagga | D00208 |
| 6408 | agcggccatctgggtttccacaca | X15788 | 49012 | cggcacaggttccggctggtggct | | 91616 | agtgaagactcctgcatgaagtgt | D00208 |
| 6409 | ggtcctcatagccaactcagcgca | X15788 | 49013 | ggcacaggttccggctggtggctt | | 91617 | gatctccgttggctgtgagata | D00208 |
| 6410 | ccatagccaactcagcgcagaggc | X15788 | 49014 | gcacaggttccggctggtgggctt | | 91618 | ccctggcgtggagatagtgcct | D00208 |
| 6411 | ccaactcagccgcagggcctgcttg | X15788 | 49015 | tctggctttcgatttttggcgt | | 91619 | tgagatagtgccttactctggcttc | D00208 |
| 6412 | ggcctgcttgctcctctgggcc | X15788 | 49016 | tggcttcgatttttggcgt | | 91620 | gatagtgccttactctggcttctc | D00208 |
| 6413 | agctcaagctgcattgcctgagtga | X15788 | 49017 | ttcgatttttggcgtcagtgcg | | 91621 | ttactctggcttctcgcacatgt | D00208 |
| 6414 | agctgcattgcctgagtgagaacat | X15788 | 49018 | gatttttggcgtcagtagtcgcgg | | 91622 | tggcttcttcgcacatgtcacagt | D00208 |
| 6415 | aagcatcaccgccgccagcaagggt | X15788 | 49019 | tgggtaacaaccgagccaagatgt | | 91623 | cgcacatgtcacagtgcacggctgagcaa | D00208 |
| 6416 | tgcagcgtgcagaggcctgctgt | X15788 | 49020 | ttcatccagaatgcaatgatcacg | | 91624 | acatgtcacagtgcagcaaatt | D00208 |
| 6417 | tgcgcacgcagtaggtaggtcca | W50073 | 49021 | tcattccagaatgcaatgatcacgg | | 91625 | taattgtccacctccacaaata | D00208 |
| 6418 | ctgagcttactgcggcctcgtgg | W50073 | 49022 | cagtgtcacagttacacacaggatact | | 91626 | ttgtgtccaactccacaaataca | D00208 |
| 6419 | cccacactctttcatcctagatgct | W50073 | 49023 | agtgtcacagttacacacaggatact | | 91627 | aagctgcattccagaaaggtgatgag | D00208 |
| 6420 | tctttcatccagatgcctgcaaaa | W50073 | 49024 | tgtcacagctacacacaggatactgt | | 91628 | aagttgactccaggagtactgt | D00208 |
| 6421 | cctgatcagctgtggtcactga | W50073 | 49025 | gtcacagctacacacaggatactgtg | | 91629 | gtgtctctgctcctgccatgccat | D00208 |
| 6422 | tgtatcagctgtggtcacctgcac | W50073 | 49026 | cacagctacacacaggatactgtggt | | 91630 | tctcctgccctgcattgccatgat | D00208 |
| 6423 | gtacccgcactgagagaaaatgcagg | W50073 | 49027 | agctacacacaggatactgtggtg | | 91631 | gcattgcatgtgcaatgaatt | D00208 |
| 6424 | ttggactccaggcgcacacatca | W50073 | 49028 | gctacacaggatactgtggtgt | | 91632 | aatctttgagggctgcccagatga | D00208 |
| 6425 | atcctggccaaccatcatcaaagc | W50073 | 49029 | acacaggatactgtggtgtac | | 91633 | ctaacatcccggctttgtagg | D00208 |
| 6426 | cctggccaaccatcatcaaagctg | W50073 | 49030 | tgtgttaccacaaatgaagaaccca | | 91634 | aagtgccactgcgtcgcccttgt | D00208 |
| 6427 | ggccaaccatcatcaaagctaggt | W50073 | 49031 | acacaaaatggaagaaccctacagtg | | 91635 | cttagcagcttcgattccaagt | D00208 |
| 6428 | ccaaccatcatcaaagctaggtaa | W50073 | 49032 | aatgatgaggcacctcacagcctag | | 91636 | tttgtatgccaggccagcctctag | D00208 |
| 6429 | aaccatcaaagctaggtaag | W50073 | 49033 | aaatggaagaaccatcagtgcact | | 91637 | tcagctcactcagaggatcctg | D00208 |
| 6430 | ccatcatcaaagctaggtaagt | W50073 | 49034 | gatgacggcacctcacacaggggcc | | 91638 | caggagattcctgacctctgggat | D00208 |
| 6431 | tgaacctgctaacaattccaactg | W50073 | 49035 | tacagtcaggtcagtgtcacagt | | 91639 | aggattcctgacctctgggatat | D00208 |
| 6432 | tgctacaatttccaactgccaaaa | W50073 | 49036 | acagtcaggtcagtgtcacagcta | | 91640 | cctgaccctgggattatgtctcc | D00208 |
| 6433 | ctgggtcactgcaacctttgt | W50073 | 49037 | agtcaggtcagtgtcacagtaca | | 91641 | gaccctgggatatgtcctcga | D00208 |
| 6434 | gtgggtcactgcaacctctttgttg | W50073 | 49038 | caggtcagtgtcacagtacacag | | 91642 | ggattatgtcctcgacattgggaa | D00208 |
| 6435 | tcacctgtcaacctcttgtgtacc | W50073 | 49039 | aggtcagtgtcacagtacacacag | | 91643 | ttatgtctccgacattgggaaacac | D00208 |
| 6436 | ctgaacctttgttgtacccgca | W50073 | 49040 | tccagtcacagtacacacaggata | | 91644 | tgctcctgacactcaccgaggg | D00208 |
| 6437 | gcaacctcttgttgtacccgcat | W50073 | 49041 | ttttcaaggaagcgacaggttct | | 91645 | cctttgagacactcaccgagg | D00208 |
| 6438 | cctttgttgtacccgcactgaga | W50073 | 49042 | ggtcttctcgagtgcgggcgaagca | | 91646 | gttttcagttttgctctcgtggag | U12570 |
| 6439 | tctttgttgtacccgcactgagaa | W50073 | 49043 | actctggccagttcatagccaaagt | | 91647 | ttgcttccttgtgaggctgaagt | U12570 |
| 6440 | tgtttgtacccgcactgagaaaatg | W50073 | 49044 | gaattgacctgtccatgaatgcctt | | 91648 | ctttcatttgaagccgaggctctg | U12570 |
| 6441 | aagctgcctgcctggatatccgca | W50073 | 49045 | acctgtccgtcctggatattg | | 91649 | ccgctcctaaagctggagtcttc | U12570 |
| 6442 | gctgcctgcctggatatcctgatt | X57528 | 49046 | tgtccatgatagccttaagtttgaa | | 91650 | cctggctcttgtctggaggaagcc | U12570 |
| 6443 | acgggtacacgcctgagcaagaca | X57528 | 49047 | ccatagccttaagttgaacat | | 91651 | ggctcttttgtgaggaggagctta | U12570 |
| 6444 | cggtacacgcctgagcaagaacaa | X57528 | 49048 | tgaacattagctgacctctgtt | | 91652 | tctttgctggaggagggctaagt | U12570 |
| 6445 | gacacaatgaccttctcagatggac | X57528 | 49049 | ttagctgacctctgtaaacat | | 91653 | taatgaccaagtaacttttgatga | U12570 |
| 6446 | acaatgaccttctcagatggactga | X57528 | 49050 | ttcaattccatacaattcagtgt | Z31553 | 91654 | atgttgctgggtgaggaccacaaagg | AA116752 |
| 6447 | atgaccttctcagatgatgaccc | X57528 | 49051 | atttcatacaatcagttgatt | Z31553 | 91655 | cagatacatagcatccacgtgtgc | AA116752 |
| 6448 | actgctaggttcagttgcatctgcc | X57528 | 49052 | attcaagttctttcatacatg | Z31553 | 91656 | cagatcacatagcatccacgtgtgc | AA116752 |
| 6449 | ggactcgtcagttgccatctgccta | X57528 | 49053 | tctcggggggggcgaagcagca | Z31553 | 91657 | atcacatagcatccacgtgctga | AA116752 |

| SEQ ID NO | sequence | DBAxnID | SEQ ID NO | sequence | DBAxnID | SEQ ID NO | sequence | DBAxnID |
|---|---|---|---|---|---|---|---|---|
| 6450 | gaccgacaggaccggagcagccag | X57528 | 49054 | tctgatgcggctgaagcagcagag | Z31553 | 91658 | gcatccacgtgctgagcttatag | AA116752 |
| 6451 | atgaagatcacagaccttcggagca | X57528 | 49055 | cattatcaaagcagcaccaaggaaa | Z31553 | 91659 | catccacgtgctgagcttataga | AA116752 |
| 6452 | aagatcacagaccttcggagcatca | X57528 | 49056 | ctgttaagcattccccattgctgat | Z31553 | 91660 | tccacgtgctgagcttatagaaa | AA116752 |
| 6453 | gcctgccggatatcctgatcctgc | X57528 | 49057 | agccatcccattgctgatgaactc | Z31553 | 91661 | ccacgtgctgagcttatagaaaa | AA116752 |
| 6454 | ctggatatcctgatcctggaatct | X57528 | 49058 | cccattgctgatgaactcggggcc | Z31553 | 91662 | aagaggatcgtgtctcgtggga | AA116752 |
| 6455 | gatatcctgatcctggaatctgca | X57528 | 49059 | atttgctgatgaactcggggccagt | Z31553 | 91663 | agatggatcgtgtctcgtgggaa | AA116752 |
| 6456 | atcctgatctcgaatctgcacgc | X57528 | 49060 | tgaactcggccagttcatagcaa | Z31553 | 91664 | atggatcgtgtctcgtgggaag | AA116752 |
| 6457 | ctggaatctgcacgcggtacca | X57528 | 49061 | cctcgaagccggatctctcctgt | Z31553 | 91665 | gaccacaaaaggagcaccaatggaa | AA116752 |
| 6458 | ctggaatctgcacgcggtacagc | X57528 | 49062 | cgaagcctcggatctctccggtcaa | Z31553 | 91666 | tggatcgtgtctcgtgggaagct | AA116752 |
| 6459 | cgaatctgcacgcggtacagcctg | X57528 | 49063 | tctcctggtcaactgaatgtcttg | Z31553 | 91667 | ggaagcagctggcttcactgtgtac | AA116752 |
| 6460 | tgcacgcggtacacgcctgagcaag | X57528 | 49064 | tctcctggtcaactgaatgtcttgg | AA030267 | 91668 | tggcttcactgtgtacgtgagtatc | AA116752 |
| 6461 | ccgtgctacctgctgaagtac | X57528 | 49065 | tcctggtcaactgaatgtcttggg | AA030267 | 91669 | tgagtactccagacatcatctaggggg | AA116752 |
| 6462 | tgtacctgctgaagtacagact | X57528 | 49066 | tcaactgaatgtcttgggaaaag | AA030267 | 91670 | ttctcggttcggggtcatacagac | AA116752 |
| 6463 | gcttagctgctgatccacttgaccca | M34476 | 49067 | aaaggtttgaccgaccagcatgtac | AA030267 | 91671 | ctcggtcttggggtcatacagatc | AA116752 |
| 6464 | tagtgatccacttgaccctgaccagg | M34476 | 49068 | aaggttgaccgaccagcatgtaag | AA030267 | 91672 | gtcatacagatcacatagcatccac | AA116752 |
| 6465 | ccaacttgaccgaggaagcctct | M34476 | 49069 | agcgttgaccgaccagcatgtaagg | AA030267 | 91673 | catacgatccacatcatctacccagt | AA116752 |
| 6466 | ccttgaccagaggaagcctctatt | M34476 | 49070 | gccgttgaccgaccagcatgtaagga | AA030267 | 91674 | tactgagccaccaaaactgagcgg | AA116778 |
| 6467 | tgaccccagaggaagcctctattat | M34476 | 49071 | aagcctcgatctcctggtccaact | AA030267 | 91675 | tggagccaccaaaactgagcgggat | AA116778 |
| 6468 | atattagctgccaaataagatcc | M34476 | 49072 | ctcgatctcctggtcaactgaat | AA030267 | 91676 | catgccaacagttgcattccattccac | AA116778 |
| 6469 | ctaaccgcgtgtcgcatatgctg | M34476 | 49073 | tcggatctcctggtcaactgaatg | AA030267 | 91677 | gtccaacagttgcattccattcaag | AA116778 |
| 6470 | cccccgtcgttgcatatgctgagt | M34476 | 49074 | cggatctcctggtcaactgaatgt | AA030267 | 91678 | cagttgcattccatcaagtctg | AA116778 |
| 6471 | gcgtgttcgcatatgctgagttt | M34476 | 49075 | ggatctcctggtcaactgaatgtc | AA030267 | 91679 | tttgcattccatcaagtctgagg | AA116778 |
| 6472 | tgttcgcatatgctgagtttcta | M34476 | 49076 | gatctcctggtcaactgaatgtct | AA030267 | 91680 | catcaagtctgaggtccagcacc | AA116778 |
| 6473 | acctcgtgaagtacagcactcat | M34476 | 49077 | atctcctggtcaactgaatgtctt | AA030267 | 91681 | gaaggcatcatctacagactct | AA116778 |
| 6474 | gaagtacagcactcatctcgaagct | M34476 | 49078 | ttctcctggtcaactgaatgtcttt | AA030267 | 91682 | aggcacatcatctacagactctgt | AA116778 |
| 6475 | tccattactctgtctgtgcctg | M34476 | 49079 | ctccagttctcagccaccggtagtg | AA030267 | 91683 | cacatcatctacagactctggaga | AA116778 |
| 6476 | ccctcatctcagccatcaggccagg | M34476 | 49080 | ccagttctcagccaccggtagtgtg | AA030267 | 91684 | atctacagactctggagagacagcac | AA116778 |
| 6477 | tcatctcagccatcagccaggggcc | M34476 | 49081 | aattatgtaacctgcagggtgtgcttt | AA154451 | 91685 | tacagactctggagagacagcactg | AA116778 |
| 6478 | gccctctcacacagagaggggcca | M34476 | 49082 | ttatgtaaccctgcagtgtgcttttc | AA154451 | 91686 | agccaccagactgagagggtggc | AA116778 |
| 6479 | tcctagcctctaccctgat | M34476 | 49083 | atgaaccctggagtgtgctttttca | AA154451 | 91687 | tggcatccaccagactgagagggatg | AA116778 |
| 6480 | gctgctagctgatccccacctgac | M34476 | 49084 | gtaacctggagtgtggcactttttgcagt | AA154451 | 91688 | catcaccagactgaggagtgagatg | AA116778 |
| 6481 | gctgaccatccagtcatccagtcc | W41501 | 49085 | ccaggtggcacctttgcttctg | AA154451 | 91689 | gtcttcctttgggccgaccag | AA116778 |
| 6482 | catccagttcatccagtcctactttt | W41501 | 49086 | tggtgcacctttttgtctgagtt | AA154451 | 91690 | tcctttgggccgaccagtccaac | AA116778 |
| 6483 | cacaaagatcctgactggacggc | W41501 | 49087 | agaaccccaggtgtcagaggggtgcg | AA154451 | 91691 | ttgggccgaccagtccaacagt | AA116778 |
| 6484 | cactgtgaccggcatcctggacggg | W41501 | 49088 | gtgcgtcctgcctgaatcaaagggt | AA154451 | 91692 | gggccagaccatgccaacagttg | AA116778 |
| 6485 | tgcaccgtgacatcctggacact | W41501 | 49089 | gcgtctgcctggaatcaaagggtct | AA154451 | 91693 | gaccatgccaacagttgcattcc | AA116778 |
| 6486 | tggccatgcgggacgaggtacatg | W41501 | 49090 | ttttgcagttactgcatgtgt | AA154451 | 91694 | tgtcatccagcattgcacagcac | AA116778 |
| 6487 | cggatacatgcgtggcgacaggtac | W41501 | 49091 | agttctcagccacgcgtagtgtgcg | AA154451 | 91695 | gtcatccagcattgcacagcaca | AA116756 |
| 6488 | gtacatgcgtggcgacaggctc | W41501 | 49092 | ttctcagccaccggtagtgtgcag | AA154451 | 91696 | cagcaacgtgaggcatgagaagc | AA116756 |
| 6489 | tgcgtgcaacggctctcgtcggtg | W41501 | 49093 | ctcagccaccggtagtgtgcgagca | AA154451 | 91697 | aagcagcagatgcggaagtaccgtg | AA116756 |
| 6490 | cggctcctgtcggttttgccatt | W41501 | 49094 | cagccaccggtagtgtgcgagcagt | AA154451 | 91698 | cagcagatgcggaagtaccgtgacaag | AA116756 |
| 6491 | cctgctctgttttgccattacaac | W41501 | 49095 | gcctccggttgctgattttcat | AA154451 | 91699 | gatgcgaagcgtaccgtgacaag | AA116756 |
| 6492 | gtttgcattaacgacagcagagt | W41501 | 49096 | ccggcttgtcgatttcatgaagtt | AA154451 | 91700 | atgcggaagctaccgtgacaaga | AA116756 |
| 6493 | ccagtcatccagtccactttgtg | W41501 | 49097 | tttgttctttcaaacgaaatgt | AA154451 | 91701 | acgtaccgtgacaagattgaggt | AA116756 |
| 6494 | ccagtcatccagttctgcgactat | W41501 | 49098 | tgtcttcaaacgaaatttgtcg | AA154451 | 91702 | gattgaggctgactgccaagaac | AA116756 |
| 6495 | gtcctactttgctcgtgactatgat | W41501 | 49099 | gagatctccttttgcactacaaag | Z31555 | 91703 | attgaggctgactgccaggcactct | AA116756 |
| 6496 | ctactttgtctgtgactatgatccc | W41501 | 49100 | tctcccatgtccctgtgtca | Z31555 | 91704 | ctgccaggacatcttgaacgatgt | AA116756 |
| 6497 | tcccaccatgaagattcctacaca | W41501 | 49101 | ggcatgaatccattcagaccatga | Z31555 | 91705 | tgccaggacatcttgaacgatgttc | AA116756 |
| 6498 | accatgaagattcctacacaca | W41501 | 49102 | aatcccatcagaccatgactgaag | Z31555 | 91706 | catccagcattcgacagcaccac | AA116756 |
| 6499 | tgaagattcctacacaagatctgc | W41501 | 49103 | attcagaccatgactgaagtcga | Z31555 | 91707 | atctccagcattcgacagcacaacg | AA116756 |

| SEQ ID NO | sequence | DBAxnID | SEQ ID NO | sequence | DBAxnID | SEQ ID NO | sequence | DBAxnID |
|---|---|---|---|---|---|---|---|---|
| 6500 | ttcctacaaagatctgcactgtg | W41501 | 49104 | gttcgagccagacaggtgaaggagt | Z31555 | 91708 | ctccagcattgcacagcacaacgtg | AA116756 |
| 6501 | ccggctcggctgcaaccatgatca | W51262 | 49105 | attgactgttgcaaggcagta | Z31555 | 91709 | tccagcattgcacagcacaagtga | AA116756 |
| 6502 | cggctcggctgcaaccatgatcaa | W51262 | 49106 | tgtttgcacaaggcagtaacgta | Z31555 | 91710 | cagcattgcacagcacaagtgagg | AA116756 |
| 6503 | aaccatgcaaccacttcctggag | W51262 | 49107 | cagcagatctctcttgccacccaga | Z31555 | 91711 | agcattgcacagcacaacgtgagc | AA116756 |
| 6504 | accatgatcaagcacttcctggag | W51262 | 49108 | cttgccaccagatggttaggatga | Z31555 | 91712 | cattcgacagcacaacgtgaggcat | AA116756 |
| 6505 | tggagttcagagccacgttggtc | W51262 | 49109 | gatgacatccgtaagcctggagaat | Z31555 | 91713 | acagcacaacgtgaggcatgagaag | AA116756 |
| 6506 | agttcagagccacgtgtggtccc | W51262 | 49110 | actgtaccattaccactgtgacta | Z31555 | 91714 | tttggatccatgcctgaagaagat | AA116793 |
| 6507 | agttcagagccacgtgtggtccca | W51262 | 49111 | catgatgcctgtgtcatccgga | Z31555 | 91715 | ggatccatgcctgaagaagatagg | AA116793 |
| 6508 | gttcagagccacgtgtggtcccag | W51262 | 49112 | gccctgtgtcatccggaacctca | Z31555 | 91716 | tattaatgctgattcttccatagaa | AA116793 |
| 6509 | ttcagagccacgtgtggtcccagc | W51262 | 49113 | tgtgtcatccgaacctcatcctg | Z31555 | 91717 | tgctgattcttccatagaaggaaat | AA116793 |
| 6510 | cagtcagcagtactctgtaccag | W51262 | 49114 | aacctcatccgtgacaacgtgtg | Z31555 | 91718 | tgattcttcatagaaggaaattac | AA116793 |
| 6511 | agtcagcagtactctgtaccagc | W51262 | 49115 | gccgaaatatcctggcgccctggcag | Z31555 | 91719 | ttacactctaagagttgattgcaca | AA116793 |
| 6512 | gtcagcagtactctgtaccagcc | W51262 | 49116 | atatctgccctggcgcagtcagc | Z31555 | 91720 | agttgattgcaccactgatgtac | AA116793 |
| 6513 | cggctcggctgcaaccatgatcaag | W51262 | 49117 | gcagacaagtgccaacttggaac | Z31555 | 91721 | tgattgcacaccactgatgtacagc | AA116793 |
| 6514 | gctcggctgcaaccatgatcaagca | W51262 | 49118 | tttgaatgcctgaaggtcatcc | Z31555 | 91722 | ttgcacaccactgatgtacagctta | AA116793 |
| 6515 | tcggctgcaaccatgatcaagcat | W51262 | 49119 | agagagtcccctacatgatgccatc | Z31555 | 91723 | agtgtacaacctaacacaaagagctg | AA116793 |
| 6516 | cggctgcaaccatgatcaagcactt | W51262 | 49120 | gtcctacatgatccatcatgat | Z31555 | 91724 | caacctaacaaagagctgcaaagc | AA116793 |
| 6517 | gctgcaaccatgatcaagcacttc | W51262 | 49121 | catcgccgcacaacttccaggcatt | Z31555 | 91725 | gctgcaaagcccagatgaaggttt | AA116793 |
| 6518 | ctgcaaccatgatcaagcactcc | W51262 | 49122 | cgcaaacttcaggccattgtgtgg | Z31555 | 91726 | ttgttttcaagctgggatgcagaa | AA116793 |
| 6519 | tgcaaccatgatcaagcactctg | W51262 | 49123 | agccatggctgcatcaacgctctg | Z31555 | 91727 | gtttgcaagctgggatgcagaagaa | AA116793 |
| 6520 | gcaaccatgatcaagcactcctg | W51262 | 49124 | ggtgcatcaacgctctgacacga | Z31555 | 91728 | cctcttgttcctactgaagtggca | AA116793 |
| 6521 | ggcatcactctatgggcaaagtgtt | M33581 | 49125 | agctctcgaggctgcatgcctttatt | Z31555 | 91729 | tggttctactgagtcgcagggaa | AA116793 |
| 6522 | aagtttactcagacatgggccacct | M33581 | 49126 | tgaggctgcatgccttattgtcc | Z31555 | 91730 | ggaacattcaagactcctaccaagag | AA116793 |
| 6523 | catageggttccaggttcagtag | M33581 | 49127 | cctattgtccgtggatgagact | Z31555 | 91731 | acattcaagactcctaccaagagga | AA116793 |
| 6524 | tcagccatgtgacctgccatcaaag | M33581 | 49128 | cactgagatcctcctaccatca | Z31555 | 91732 | actcctacaagagcgagtgtggct | AA116793 |
| 6525 | atgtgcactcatgcaaatgccatac | M33581 | 49129 | tccatcagctggccgtggcagagc | Z31555 | 91733 | cctacaagagcgaggtggcttat | AA116793 |
| 6526 | actcatgcaaatgccatacatgcag | M33581 | 49130 | ggtctgctggttcactgaggtt | Z31399 | 91734 | aacatctgcaaggtagtggcagtcc | AA116633 |
| 6527 | gcaaatgccatacatgcagaagtat | M33581 | 49131 | atalgccaaggcctggagatatt | Z31399 | 91735 | atctgcaaggtagtggcagtccgg | AA116633 |
| 6528 | tgtgcacacacgcacacattaac | M33581 | 49132 | acagctatgtgacaacgctggcttt | Z31399 | 91736 | tcatctactgcaggtgaattgaga | AA116633 |
| 6529 | cacacacgcacacattaaccaacga | M33581 | 49133 | caagctgcttgatgcccaaacaac | Z31399 | 91737 | catcctactgccaggtgaattgaa | AA116633 |
| 6530 | cgcaacattaaccaacgactagca | M33581 | 49134 | tgatgccacaaacatcctcaacaagc | Z31399 | 91738 | atctcactgccaggtgaattgagaa | AA116633 |
| 6531 | tcgtactgaaactcactacaatga | M33581 | 49135 | cacaacatgcgggtcgacaagcgcgg | Z31399 | 91739 | tccactgcaggtgaattgagaaaa | AA116633 |
| 6532 | tgaaactcactacaatgtatactta | M33581 | 49136 | caacaagcatgcgaaggagtatggtgat | Z31399 | 91740 | ctcactgcaggtgaattgagaaaag | AA116633 |
| 6533 | tactgacaatggcacctgagttc | M33581 | 49137 | acacgcacagggaggtatgtggtat | Z31399 | 91741 | tcctgtccgaagtggaacaatag | AA116633 |
| 6534 | gacatgggccacctgagttcagatcc | M33581 | 49138 | tgagaacatgccgacaacttccag | Z31399 | 91742 | tcctggtgccgaagtggacaatag | AA116633 |
| 6535 | cctatacactaaggtctctgcct | M33581 | 49139 | cgatgtcctgtcgcaggtcgtatgg | AA030557 | 91743 | gacaatatggctccattggcagca | AA116633 |
| 6536 | ttgtaatgccacactacgacaag | M33581 | 49140 | gtcgccgttatgggtcctgctc | AA030557 | 91744 | acaatatggctccatggcagcaa | AA116633 |
| 6537 | cagatcctgcaggtcagaggcaga | M33581 | 49141 | tatagttcattgtaccgctacacta | AA030557 | 91745 | caatatggctccattggcagcag | AA116633 |
| 6538 | ctgaggtccagtcgctggcaaac | M33581 | 49142 | atagttcattgtaccgctacacta | AA030557 | 91746 | catctgcaaggtagtccagttcagc | AA116633 |
| 6539 | tggcctgcaaacagctagcaac | M33581 | 49143 | agttcattgtaccgctacactaatg | AA030557 | 91747 | atctgcaaggtagtggcagttcgca | AA116633 |
| 6540 | gccaaacagctgcaactagcccg | M33581 | 49144 | tcattgtaccgctacactaatgatt | AA030557 | 91748 | tagtgccgctagatctacta | AA116633 |
| 6541 | ctatagtagatgccaaccatcct | L46815 | 49145 | cattgtaccgctacactaatgattc | AA030557 | 91749 | cagtccgcgctagatctaaattga | AA116633 |
| 6542 | catcctactgaaagagcacagct | L46815 | 49146 | tgtaccgctacactaatgattccg | AA030557 | 91750 | agtccgcagtagatctaaattgac | AA116633 |
| 6543 | tcctatacactataggtctctgct | L46815 | 49147 | taccgctacactaatgattccgtg | AA030557 | 91751 | gtccgcagtagatctaaattgacg | AA116633 |
| 6544 | acctatagctgtcctctgccagg | L46815 | 49148 | accgctacactaatgattccgtgt | AA030557 | 91752 | tccgcagtagatctaaattgacga | AA116633 |
| 6545 | caaagctggctctctatgattag | L46815 | 49149 | cgctacactaatgattccgtgtct | AA030557 | 91753 | gctcatccgcaggtgaattga | AA116633 |
| 6546 | gtggctcctctatgattagaaatac | L46815 | 49150 | tacactaatgattccgtgtctg | AA030557 | 91754 | gaacttaatccaatatatgaaag | AA116633 |
| 6547 | gaaatacctgcaggatgaaggaccc | L46815 | 49151 | gtcgtatgctctcgtccgttc | AA030557 | 91755 | ttaatccaatatatgaaagccct | AA116789 |
| 6548 | aggatggcccctagtcgggctgtt | L46815 | 49152 | acactaatgattccgtgtctcgc | AA030557 | 91756 | gagcacagctgtgtgtatattg | AA116789 |
| 6549 | ctgccctgaggaacaacgtcac | L46815 | 49153 | tcgtatgctctcgtctccgttcg | AA030557 | 91757 | atacaagaacctgaacctcgatg | AA116789 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6550 | acgtcacattccttcatggtgga | L46815 | 49154 | tgcacctgccggatacctgatgc | AA030557 | 91758 | acaagaacctgaacctctgatgcc | AA116789 |
| 6551 | cattctcatgctggattaacg | L46815 | 49155 | ggataccctgatgccgtcctctag | AA030557 | 91759 | gaacctgaacctctgatgccatct | AA116789 |
| 6552 | cttcatggctggatttaagtatgtg | L46815 | 49156 | gacggtctcgtagtcgagtgtatag | AA030557 | 91760 | cgtgaacctctgatgccatccac | AA116789 |
| 6553 | ttctctgccatcagaggacacaaa | L46815 | 49157 | cggtctcgtagtcgagtgtatagt | AA030557 | 91761 | tgaacctctgatgccatcccacag | AA116789 |
| 6554 | tactttctagcatccagccgcaca | L46815 | 49158 | ggtctcgtagtcgagtgtatagtc | AA030557 | 91762 | aacctctgatgccatccacagt | AA116789 |
| 6555 | ctagcatctcagcagcacagactag | L46815 | 49159 | tctcgtagtcgagtgtatagtcat | AA030557 | 91763 | cctctgatgccatccacagtta | AA116789 |
| 6556 | tctcagcagcacagactagcagcag | L46815 | 49160 | atgccagcagttgcctggaagcc | AA108956 | 91764 | tgatgccatccacagtttattaa | AA116789 |
| 6557 | cagcagcacagactagcaggaaga | L46815 | 49161 | ccagcagttgtgcctgaagccta | AA108956 | 91765 | tcttactcagttctttcaccgatg | AA116789 |
| 6558 | ggttgccatcctttctccta | L46815 | 49162 | aacctcatcaagttcaggaaggaag | AA108956 | 91766 | atatatgaaagccctcttagactg | AA116789 |
| 6559 | ccatctcctttcctctatacactat | L46815 | 49163 | ctagaggcacacggcactgggtcc | AA108956 | 91767 | ttacttcagttctttcaccgatgat | AA116789 |
| 6560 | ccttttcctataccatataggct | L46815 | 49164 | cacggcgactggtccgagtgttg | AA108956 | 91768 | atgaaagccctcttagacgtgcaa | AA116789 |
| 6561 | gccgctgacgacggaacgaaatg | AA060409 | 49165 | attggctgccaccaccgccaccattg | AA108956 | 91769 | tagaagtgcaaaagccatggaagag | AA116789 |
| 6562 | ccgctgacgacggaacgaaaatgg | AA060409 | 49166 | agcaccattgccacgctgctccag | AA108956 | 91770 | gacgtgcaaaagccatggagaagct | AA116789 |
| 6563 | tgtctctcagatgaactaaagac | AA060409 | 49167 | attgccagctgctctcaggatggtc | AA108956 | 91771 | tgcaaaagccatgagagaagctagac | AA116789 |
| 6564 | gtctctcagatgaactaaagacg | AA060409 | 49168 | tctcaggatgctgagtgttatt | AA108956 | 91772 | ttagaagacgtcacagctgtgtgta | AA116789 |
| 6565 | ctctccagatgaactaaagacgaa | AA060409 | 49169 | tttattttgaccctgacgatgcct | AA108956 | 91773 | agaagacgtcacagctgtgtata | AA116789 |
| 6566 | agacgaactaccgagcggcacgt | AA060409 | 49170 | tggaactggagatgcctcagca | AA108956 | 91774 | aagcagctcacagctgttgtatatt | AA116789 |
| 6567 | taaatacaacatgatgatggcaga | AA060409 | 49171 | tgtgacgatgctcaggcaatatgt | AA108956 | 91775 | aaagttgcagctgctccctgcaca | AA116789 |
| 6568 | aataccaacatgtagatggcagagt | AA060409 | 49172 | gcagttgctggaagccttatag | AA108956 | 91776 | cttccctgcacaaacgagacagaca | W08028 |
| 6569 | atgccagagtctgtaccgcctctg | AA060409 | 49173 | gatgcctcaggccaatatgtgtcac | AA108956 | 91777 | ctctccattccggaaacgtgcatttta | W08028 |
| 6570 | atggcagagtctgtaccgcctctg | AA060409 | 49174 | gtgcctgaagccttatagaccaac | AA108956 | 91778 | ttcattccgacgtgcatttacca | W08028 |
| 6571 | ggcagagtctgtaccgcctctgt | AA060409 | 49175 | atgaccaacatcaggcagaaaac | AA108956 | 91779 | gacgtgcatttaccacaacctgcagc | W08028 |
| 6572 | gcagagtctgtaccgcgcctctgtt | AA060409 | 49176 | gaccaacatcaggcagaaaccaacca | AA108956 | 91780 | gtgcatttaccaacctgcacgcggg | W08028 |
| 6573 | gagtctttgtgggttgatgtg | AA060409 | 49177 | ccatgggcagaaaccaattaca | AA108956 | 91781 | catttaccaacctgcacgcggggca | W08028 |
| 6574 | gaaaccacaatgctgctattataa | AA060409 | 49178 | cccaattacactcaagaagtttgcat | AA108956 | 91782 | tttaccaacctgcagggggcgca | W08028 |
| 6575 | caaggataaagcctgtgtgtctg | AA060409 | 49179 | aagtttgtcatcaggtggctgtgaca | AA108956 | 91783 | accaacctgcagcggggcagtcatg | W08028 |
| 6576 | atgaacgcctgggtctgctggatga | AA060409 | 49180 | gacaactccatcaagctatggagg | AA108956 | 91784 | aacctgcagcggggcagtcatgtc | W08028 |
| 6577 | agctcgggggtctctccagatga | AA060409 | 49181 | atctccagccgctcggggagaagga | AA108956 | 91785 | ctgcaggcggggcagtcagtcttt | W08028 |
| 6578 | gggtgtctccagatgaactaaa | AA060409 | 49182 | ccgagcccagcaccctacctgaa | AA030569 | 91786 | ccattcgaacgaagatgacttg | W08028 |
| 6579 | gggtgtctccagatgaactaaag | AA060409 | 49183 | gaacctggagccagcagccactgaa | AA030569 | 91787 | ccctgcacaaacgagcagacatca | W08028 |
| 6580 | ggtctctccagatgaactaaaga | AA060409 | 49184 | gcacatccagccgcctgcgggaa | AA030569 | 91788 | cctgtaagctgagctcggacagag | W08028 |
| 6581 | cctcaggtccactgcagataaagatg | AA060409 | 49185 | atctccagccgcctcaagctatgggagg | AA030569 | 91789 | aaacggacagcatcacagtgtca | W08028 |
| 6582 | ggcacctatgctcgtgtggccaccc | L33412 | 49186 | atctccagccgcctcggagaagga | AA030569 | 91790 | acagacacatggtcaaggcct | W08028 |
| 6583 | taaggcacccagatgcgctccactg | L33412 | 49187 | ccgagccccagcagccactgaa | AA030569 | 91791 | ttcctgacctgacactcagcctg | W08028 |
| 6584 | caccgatgccagctgtgtgatgg | L33412 | 49188 | gaacctggagccagcagccactgaaga | AA030569 | 91792 | gacactcagcctctctcttcatcc | W08028 |
| 6585 | gatccggctgtgctgtggccctag | L33412 | 49189 | ctgcagccagccagccactgaagacacg | AA030569 | 91793 | actcagcctgtctctcttcattccgg | W08028 |
| 6586 | gcctgtgatggccatggccctag | L33412 | 49190 | ggcagccagccactgaagaacg | AA030569 | 91794 | cagcctgtctctcttcattccgaag | W08028 |
| 6587 | caattcctctgaggcactcct | L33412 | 49191 | cagccagccactgaagacgca | AA030569 | 91795 | cctgtctctcttcattcggagtgc | W08028 |
| 6588 | ctccttgaggcactccttccaa | L33412 | 49192 | gccagccactgaagacacgcacatt | AA030569 | 91796 | attggcgcttgtgtacatggagt | W08028 |
| 6589 | gaggcactccttccaaccccagag | L33412 | 49193 | agtccaacaagaacatattactgga | AA030569 | 91797 | tgttcgaaagaaccaagatggag | W08028 |
| 6590 | acgaggcccacatcagatccatgctg | L33412 | 49194 | ccagcaagaacatatacctgaacgt | AA030569 | 91798 | ctctgcaagctgaagctgggaagaa | W08033 |
| 6591 | gcccacatgatccatgctgagtaaa | L33412 | 49195 | agaacataatccgaacgtggccgt | AA030569 | 91799 | aagtcggtggcctcatctgtgaa | W08033 |
| 6592 | atgatccatgctgagtaaacatttg | L33412 | 49196 | aacatatacctgaacgtggccgtga | AA030569 | 91800 | gtctgggtgccatctctgtgaagc | W08033 |
| 6593 | ggacctcaggaagccctcctgtca | L33412 | 49197 | catatacctgaacgtggccgtgaac | AA030569 | 91801 | ctggtgccctcatctctgaagcct | W08033 |
| 6594 | caggaagccctccgtcagcatca | L33412 | 49198 | tataccctgaacgtggccgtgaacac | AA030569 | 91802 | cagcctgtctcttcattccgaag | W08033 |
| 6595 | agccctctgcagcatgcagagtca | L33412 | 49199 | tacctgaacgtggccgtgaacacgca | AA030569 | 91803 | gtgcctcatctgtgaagcctttg | W08033 |
| 6596 | cctgtcagcatgggtcacagaaa | L33412 | 49200 | caaaccgtgccaacacagagaggt | AA030569 | 91804 | gcctcatctgtgaagcctttgtgaa | W08033 |
| 6597 | acagaaaccgcgatgagggccag | L33412 | 49201 | ttgaaccttgcctgcatgcataac | D12644 | 91805 | catatctgtgaagcctttgtgaacg | W08033 |
| 6598 | ctgagcccgctggggatctcg | L33412 | 49202 | ttgcgtgcattcatacctcatgagt | D12644 | 91806 | catctgtgaagccttgtggaacga | W08033 |
| 6599 | gccctgctcgtggggatccctct | L33412 | 49203 | ctaaggctattgaccctagatttct | D12644 | 91807 | tactggccttttcatttatctataa | W08033 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6600 | ggaccgtaagagcgcaccgatcgag | L33412 | 49204 | gattaattacattcctgttttgtga | D12644 | 91808 | ttttgagatggccacgagagctgc | W08033 |
| 6601 | agaggaacctgaatccatcttcaatga | W50092 | 49205 | taattacattcctgttgtgactg | D12644 | 91809 | taattacctaagattacaaatcag | W08033 |
| 6602 | ggaacctgaatccatctcaatga | W50092 | 49206 | cattcctgttgtgactgtaaatt | D12644 | 91810 | tgagatggccacgagagctgctctg | W08033 |
| 6603 | tcatcatcactgtcatggacaaga | W50092 | 49207 | tacattttacgtattgagacat | D12644 | 91811 | agatggccacgagagctgctctgca | W08033 |
| 6604 | aagacaagctcatgtcaatgacgt | W50092 | 49208 | taattttcaggatgtgcatatca | D12644 | 91812 | atggccacgagagctgctctgcaag | W08033 |
| 6605 | acaagctcatgtgcaatgacgtcat | W50092 | 49209 | gacatagctgctgaccattccatc | D12644 | 91813 | ccacgagagctgctctgcaagctag | W08033 |
| 6606 | gcaatgacgtcatgtcaagatcta | W50092 | 49210 | ggaccatccatcttatgttaaag | D12644 | 91814 | gagagctgctctgcaagctagacgt | W08033 |
| 6607 | tcattgcaagatctacctgtcctg | W50092 | 49211 | ttccatctatgtttaagaaatct | D12644 | 91815 | gagctgctctgcaagctagacgtgg | W08033 |
| 6608 | ttggcaagatctacctgtcctggaa | W50092 | 49212 | tatacatgcagtgtgtgccag | D12644 | 91816 | tgctgcaagctagacgtgggaag | W08033 |
| 6609 | gcaagatctacctgtcctggaagat | W50092 | 49213 | cgtgcatgcataccatcatgagtgat | D12644 | 91817 | gaatgccagcttccggatgttg | W08033 |
| 6610 | agatcggacaggtgaggtgaagca | W50092 | 49214 | catgcataccatcatgagtgatgt | D12644 | 91818 | tgccagcttccggatgttg | AA116951 |
| 6611 | aagacatgatcgctgtcccggca | W50092 | 49215 | atacctcatgagtgattgtacatac | D12644 | 91819 | tcctgagcagtgtgcagcagaac | AA116951 |
| 6612 | ctcgtcccgcatgcgtgttgctca | W50092 | 49216 | tgtacatacttgcctactcctag | D12644 | 91820 | tgaagcagtgtgcagcagaactct | AA116951 |
| 6613 | acctgaatccatctcaatgagtc | W50092 | 49217 | ctactcctagagacactcgtgctta | D12644 | 91821 | gcagcagaactctctcatcaactct | AA116951 |
| 6614 | tgaatccatctcaatgagtctt | W50092 | 49218 | ctagagacactcgtgctactcatc | D12644 | 91822 | gcagaactctctctcatcaactctggt | AA116951 |
| 6615 | tttacatacccactgatttctgag | W50092 | 49219 | cttactcatcctctgtgcctggc | D12644 | 91823 | gaactctctctcaactctggtagg | AA116951 |
| 6616 | taccactgatttctgaggaggtc | W50092 | 49220 | actccatcctctgtgcctggtaa | D12644 | 91824 | ctctctatcaactctggtaggccg | AA116951 |
| 6617 | attttctgaggaggtccatcat | W50092 | 49221 | cagccaggctggagaggctgccaag | D12644 | 91825 | tctatcaacttctggtaggccgctg | AA116951 |
| 6618 | ggggtccatcatcatcatcactgt | M83380 | 49222 | tttgcgggcttccaagtggtgccg | D16464 | 91826 | atcaacttctggtaggccgtgagt | AA116951 |
| 6619 | agtccatcatcatcatcactgtcat | W50092 | 49223 | cactctgggacttccatgtggagacg | D16464 | 91827 | aacttctggtaggccgctgagtgct | AA116951 |
| 6620 | ccatcatcatcatcatcactgtcat | W50092 | 49224 | ttccgacctcatgtggagccgtgg | D16464 | 91828 | ttctggtaggccgctgagtgctgca | AA116951 |
| 6621 | ctctcatcatgttgacctgctgc | W50092 | 49225 | gagaccgtgggaactgaggaggct | D16464 | 91829 | ccagcttccggagatgttgaga | AA116951 |
| 6622 | gcaccactctgccatgctgtgg | M83380 | 49226 | gaactgagaccgtcaggccactgct | D16464 | 91830 | gcagacccgcagtcttgccaagt | AA116951 |
| 6623 | ccattccgaagccaacctga | M83380 | 49227 | tcagccatgctacccgtaaagtc | D16464 | 91831 | gacccgcagtcttgccaagtatg | AA116951 |
| 6624 | attccgaagccaacctgatcagc | M83380 | 49228 | agtgactgaacactgcactgcattg | D16464 | 91832 | cccgcagtctgccaagtatgcag | AA116951 |
| 6625 | atcagtcttccagtcctctcat | M83380 | 49229 | gactcatgcactgcattgtat | D16464 | 91833 | gcagctctggccaagtatggaag | AA116951 |
| 6626 | cttccagttcctctcatctgaatcg | M83380 | 49230 | tgaccatgcactgcattgtata | D16464 | 91834 | gtaaaggcctctcgaagcagctgtg | AA116951 |
| 6627 | tcatccgaatctggacatctgcagc | M83380 | 49231 | catattgattgcgctttgtatta | D16464 | 91835 | aaggcctctgaagcagctgtgcag | AA116951 |
| 6628 | tgagccatttacagaaatgctgag | M83380 | 49232 | attgattgcgcctttgtattataa | D16464 | 91836 | gcctctgaagcagctgtgcagctgcag | AA116951 |
| 6629 | gctcctgcagtgagccccttctca | M83380 | 49233 | cgggttccaagtggtgccgggctcct | D16464 | 91837 | agatcttgggccggatgcccat | AA116951 |
| 6630 | gcagatggaccccttcagatctcagggacag | M83380 | 49234 | tgacggccaaattgcctttcatc | D16464 | 91838 | tgccatttgtgtgctcgaagctt | U12785 |
| 6631 | ggaccccttcagagcagatctc | M83380 | 49235 | ggtcaccccggtcacaccacagcaac | D16464 | 91839 | acatcactgcgccacttgccctt | U12785 |
| 6632 | cttctcaggacagatctctcagagat | M83380 | 49236 | cccggtctacacacacccagcaacgggg | D16464 | 91840 | tgagtctctgcggaatgaagaagc | U12785 |
| 6633 | ctgaactctttgcagtcgggtga | M83380 | 49237 | ggtcatacacccagcaacagtggaa | D16464 | 91841 | gccaagcaagatgcccccgatg | U12785 |
| 6634 | ggtactgctagcctgttgggcagca | M83380 | 49238 | tcctaaggcagtgtcaacctccagt | D16464 | 91842 | gacacttgtttgtctggtgtctg | U12785 |
| 6635 | ggcagcaacatgttctccaaccagt | M83380 | 49239 | taacgcagtgtcaacctccagtgcc | D16464 | 91843 | tgttttgcggctgctgtcctg | U12785 |
| 6636 | ggcctctcaacttccagggcctgag | M83380 | 49240 | cgcagtgctgtcaaccctccagtggctcc | D16464 | 91844 | tgtctcaaggcctcatcctggct | U12785 |
| 6637 | ccaggggccctagacacgtagcctc | M83380 | 49241 | atgcctctcgaaggtgaccgc | D16464 | 91845 | ttgctcaggagcctcatcctggct | U12785 |
| 6638 | cctgagccagtagcctctgagtg | M83380 | 49242 | tatttttgccaagttcaagtgat | Z31557 | 91846 | acggagcctcatctaccgaaggtctc | Z31557 |
| 6639 | tagcctctgaggttacagaggagc | M83380 | 49243 | atggtttctctaaataaggcatg | Z31557 | 91847 | catgctcaactaccccggaaggctctc | Z31557 |
| 6640 | gtatagcactccattccgaagccca | M83380 | 49244 | ttctccaataaggcatgtgaca | Z31557 | 91848 | ctgctgtttcgaagcgatgaga | Z31557 |
| 6641 | gaagcactgactgaaccattgtc | W50213 | 49245 | acatgactgtaagcctagcccttg | Z31557 | 91849 | tgtgtgttcgaagcttgaatga | Z31557 |
| 6642 | actgactgaaccattgtcctgtc | W50213 | 49246 | gaattttcatgccaactcaggctac | Z31557 | 91850 | gtgttgaagcttggatggaggccat | Z31557 |
| 6643 | atgcaagtatctcactccttgtca | W50213 | 49247 | ctatgccaactcaaggtccaggaga | Z31557 | 91851 | ttatcaaccacgcgcaagaaggccct | Z31557 |
| 6644 | aacttaccgttctgtatgccag | W50213 | 49248 | caactcaggctacaaggagaccccag | Z31557 | 91852 | tggacttcatgtttccaacaa | Z31557 |
| 6645 | ccgttctgtatgccaagtaccca | W50213 | 49249 | ttgaaattatccacactagcctg | Z31557 | 91853 | tctatgtctcccaacaatgacaa | Z31557 |
| 6646 | ctgtatgccagtaccacagcgcag | W50213 | 49250 | ctccgttaacatgtaagatcct | Z31557 | 91854 | tgtctccacaatgacaagtgat | Z31557 |
| 6647 | tgtccagtaccacagcagaggcc | W50213 | 49251 | catgtaagatcctgccagtgtaaa | Z31557 | 91855 | acgtcattgttcatcactgtgcc | U12785 |
| 6648 | gaccccagagctccagcagaggctg | W50213 | 49252 | agacctgccagtgtaaaacacat | Z31557 | 91856 | ttgttcactcactgccccatt | U12785 |
| 6649 | acagcagagctccagcgtctctc | W50213 | 49253 | tgtcaagcttcaagtgattggaa | Z31557 | 91857 | caacatcccaacagcagaaccg | AA117004 |

TABLE 1-continued

| SEQ ID NO | DBAxnID | sequence | SEQ ID NO | sequence | DBAxnID | SEQ ID NO | sequence | DBAxnID |
|---|---|---|---|---|---|---|---|---|
| 6650 | W50213 | gaggtccagctgtctccaagtac | 49254 | ggacatttgacacctattcaaatta | Z31557 | 91858 | aacattcccaacaagcagacaccga | AA117004 |
| 6651 | W50213 | ccagctgctcctcaagtactatca | 49255 | ttgacacctattcaaattatacgt | Z31557 | 91859 | ccgacttcaacaactaatcctgaac | AA117004 |
| 6652 | W50213 | ctattcaggagaccagtgttcaa | 49256 | gacacctcaaagcagctcttttcaa | Z31557 | 91860 | gactttcaacaactaatcctgcaac | AA117004 |
| 6653 | W50213 | ccgttctctgctgcagctgaat | 49257 | caaagcagctcttttcaaccact | Z31557 | 91861 | ctttcaacaactaatcctgcaacca | AA117004 |
| 6654 | W50213 | ctctgctgcagctgaattgagtt | 49258 | ttttcaaccactgaacaagatgt | Z31557 | 91862 | tttcaacaactaatcctgcaaccaa | AA117004 |
| 6655 | W50213 | ttgagttgccaagctcagtcagtg | 49259 | accactgaacagatgttagct | Z31557 | 91863 | tcaacaactaatcctgcaaccaacc | AA117004 |
| 6656 | W50213 | tgccaagctcagtcagtgactcaa | 49260 | agatgtttagctacaccgatacaa | Z31557 | 91864 | caacaactaatcctgcaaccaacct | AA117004 |
| 6657 | W50213 | gtcagtgactcaacctgatgctcat | 49261 | gggatgtcgccacagtccaggcaa | AA030482 | 91865 | acaactaatcctgcaaccaacctg | AA117004 |
| 6658 | W50213 | gactcaacctgatgctcatgtcact | 49262 | gccacagtccaggcaaccacaagg | AA030482 | 91866 | aactaatcctgcaaccaacctgt | AA117004 |
| 6659 | W50213 | acctgatgctcatgtcactgtct | 49263 | ctcagcctttgcaggaggattta | AA030482 | 91867 | ctaatcctgcaaccaacctgtgta | AA117004 |
| 6660 | W50213 | tgctcatgtcactgtctgaagaa | 49264 | ttactagggcgcatcaggggctct | AA030482 | 91868 | taatcctgcaaccaacctgtgtaa | AA117004 |
| 6661 | W50213 | ggaacactggttcatccttttctg | 49265 | actaggggcatcatgggctgtgg | AA030482 | 91869 | acattcccaacaagcagacaccgac | AA117004 |
| 6662 | W50213 | atccttatctcggcctctacgtg | 49266 | ggccatcatgggctctgtgaattcc | AA030482 | 91870 | aatcctgcaaccaacctgtgtaat | AA117004 |
| 6663 | J00621 | ggctctccatgccagtgacatccca | 49267 | calcatgggctctgtgaattccaga | AA030482 | 91871 | altcccaacaagcagacaccgactt | AA117013 |
| 6664 | J00621 | tgcaccttcatccgcaagttctat | 49268 | gaattccagaaggtcacaagcagag | AA030482 | 91872 | ttcccaacaagcagacaccgacttt | AA117013 |
| 6665 | J00621 | cttcatccgcaagttctatacagag | 49269 | tcaacaaggcagaggcccaggggta | AA030482 | 91873 | tcccaacaagcagacaccgactttc | AA117013 |
| 6666 | J00621 | tcggcataacactcgtctggattc | 49270 | aatggaggcctcgactcgctggc | AA030482 | 91874 | caacaagcagacaccgactttcaac | AA117013 |
| 6667 | J00621 | taacaatcggttggattcgcctg | 49271 | cctcgactcgctgcgcaagaccaca | AA030482 | 91875 | acaagcagacaccgactttcaacaa | AA117013 |
| 6668 | J00621 | cagtaacctaggccaagccaagt | 49272 | cgactctggccaagaccaagt | AA030482 | 91876 | caagcagacaccgactttcaacaac | AA117013 |
| 6669 | J00621 | ccctaggccaagccaagctggact | 49273 | acagtccaggcaaccacgagaggta | AA030482 | 91877 | caccgactttcaactaactcctg | AA117013 |
| 6670 | J00621 | gccaagccaagctggcactcttgg | 49274 | cacaattcgtacaaactgaaagga | AA030482 | 91878 | tcaacatcggcatcgagggctcga | AA117013 |
| 6671 | J00621 | tggcactcttgggggccatttgtct | 49275 | gtccaggcaaccacgagagggtagga | AA030482 | 91879 | caacatcggcatcggggggctcgac | AA117013 |
| 6672 | J00621 | ttttgtcgcttgtcccaacatg | 49276 | gccaaccacagaggggtaggagctcag | AA030482 | 91880 | atggtgactgacactccaagccct | AA117013 |
| 6673 | J00621 | tacgagctcccgaagttgatcatg | 49277 | aggagctcagttcatgcatgcatg | AA030482 | 91881 | tggtgactgacactccaagccta | AA117013 |
| 6674 | J00621 | ctccctgaagttgatcatcgaagcc | 49278 | agctcagtcatgcatgcatgg | AA030482 | 91882 | ggtgactgcactccaagccctga | AA117013 |
| 6675 | J00621 | cagggctacacactcagctggatcc | 49279 | gattgcatttctcagaaaagtgc | AA030482 | 91883 | gtgactgcactccaagccctact | AA117013 |
| 6676 | J00621 | ctacacactcagctggactgactac | 49280 | ttgcatttctcagaaaagntgac | AA030482 | 91884 | gagccctccaattccagacaccga | AA117013 |
| 6677 | J00621 | actcagctgactgactacgtgcta | 49281 | ctgatgtgctctcagctcttctg | AA030482 | 91885 | gccctccaattccagacaccgaag | AA117013 |
| 6678 | J00621 | cagtacgactgtgctcagtat | 49282 | tcggcacgatggtgactggatatg | AA030590 | 91386 | cttccaattccagacacgaaggag | AA117013 |
| 6679 | J00621 | cggtcacagatcccaacaagagaga | 49283 | gaattcctaattaaccaaacgac | AA030590 | 91887 | ttccaattccagacaccgaaggagg | AA117013 |
| 6680 | J00621 | acagtaatcccaacaagagaggacaag | 49284 | attgattgctgtttccaaccacta | AA030590 | 91888 | tccaattccagacaccgaaggaggg | AA117013 |
| 6681 | AA071777 | cttaggacacactggctgtgctccct | 49285 | tgattgctgtgttccaacactag | AA030590 | 91889 | aacatcggcatggggggctgacc | AA117013 |
| 6682 | AA071777 | tgtgctgctctgctcatggacaag | 49286 | aggacattatactgctttgcaaag | AA030590 | 91890 | ctgactggaccctcatgctgac | AA117013 |
| 6683 | AA071777 | agtcagtatgtcatcctgaacgcg | 49287 | gacattatactgctttgcaaaaa | AA030590 | 91891 | tgactggaccctcatggtgact | AA117013 |
| 6684 | AA071777 | cagtatgtcatcctgaaagcgctg | 49288 | ttctaccagagacaggacactttca | AA030590 | 91892 | acctggaccctcatggtgactga | AA117013 |
| 6685 | AA071777 | tattgcatcctgaacgcgctggac | 49289 | ctaccagagacaggacacttcagt | AA030590 | 91893 | cctggaccctcatggtgactgac | AA117013 |
| 6686 | AA071777 | atcctgaacgcgctggacgtcgtg | 49290 | gacccagagacaggacactttcagtgggactgg | AA030590 | 91894 | tggaccctcatggtgactgac | AA117013 |
| 6687 | AA071777 | ctggaacgcgctggacgtcgtgact | 49291 | caggacacttcagtgggactgtg | AA030590 | 91895 | ggaccctcatggtgactgacact | AA117013 |
| 6688 | AA071777 | gaacgcgctggacgtcgtgactgtt | 49292 | ggacactttcagtgggactggctc | AA030590 | 91896 | catggtgactgacactccaagcc | AA117013 |
| 6689 | AA071777 | gctggacgtcgtgactgttgaactc | 49293 | acacttcagtgggactggcttt | AA030590 | 91897 | gtcctgtgactgtgtgcatac | AA117013 |
| 6690 | AA071777 | tgttgaactctaccctcgacacaag | 49294 | ttaacccaaatgcaggtcctgccg | AA030590 | 91898 | ccgtcgaggactggtgcataag | AA117013 |
| 6691 | AA071777 | ggcctcggttcctcgacacgcctg | 49295 | cccaaatgcaggtcctgccgtat | AA030590 | 91899 | agtgtctccttaatagaattag | AA116993 |
| 6692 | AA071777 | cggttcctcgaatgcctgtgtaag | 49296 | caaatgcaggtcctgccgctataa | AA030590 | 91900 | atgaaggtcatctacgagagact | AA116993 |
| 6693 | AA071777 | tctgctcatggacaagatggccagg | 49297 | aatgcaggtcctgccgctataat | AA030590 | 91901 | tagaatctgtctatggcgtattct | AA116993 |
| 6694 | AA071777 | cctgaatggcctgttgaagctggca | 49298 | tgcaggtcctgccgctataattg | AA030590 | 91902 | atcttgtctagggtattctgaag | AA116993 |
| 6695 | AA071777 | gtcctgttcctgctctccctg | 49299 | caggtcctgccgctataattgat | AA030590 | 91903 | cttgtctatgggtattctgaagca | AA116993 |
| 6696 | AA071777 | cttcctgtttttggaacagtgag | 49300 | ggtcctgccgctataatttgatg | AA030590 | 91904 | gtatctgaagcattcactaaaggt | AA116993 |
| 6697 | AA071777 | cctgttttggaacagtagtca | 49301 | tcctgccgctataatttgattgct | AA030590 | 91905 | tctgaagcattcactaaaggttcac | AA116993 |
| 6698 | AA071777 | gtcaggatcctgctctgc | 49302 | ggcgttccggttgtcaacgtga | X65453 | 91906 | ggttcacagtgtttcagctgactg | AA116993 |
| 6699 | AA071777 | agccatgatcgctctgcctt | 49303 | gcaagccaagtgatccacagagtg | X65453 | 91907 | ttcacagtgttcagctgactgcc | AA116993 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6700 | catgatcgctctgctctgcctttt | AA071777 | 49304 | tgctgcagtctcctactacaca | X65453 | 91908 | cacagtgttcagctgctgctgccaa | AA116993 |
| 6701 | cgctctgctgcctttgggga | AA071777 | 49305 | tccctacagacaagtcagtagga | X65453 | 91909 | cagtactcatacaacttcgatct | AA116993 |
| 6702 | tctcccacattaaaatgaaaactgc | M80360 | 49306 | tttataacctaggatcctcctcat | X65453 | 91910 | cagttgttcagctgtactgccaaga | AA116993 |
| 6703 | gattcaaactgtacaaacaactct | M80360 | 49307 | gtaccccaaggcacatagactgg | X65453 | 91911 | gtacatcataacttcgatctct | AA116993 |
| 6704 | aggttctggtgcctacattacag | M80360 | 49308 | tgctcctaagaacttacaactga | X65453 | 91912 | atcatacaacttcgatctctgatg | AA116993 |
| 6705 | ttgtgcctacattatcagggggc | M80360 | 49309 | ctaagaacttacaactgaaacagc | X65453 | 91913 | catacaacttcgatctctgatgac | AA116993 |
| 6706 | cagtgcctattaggttcagacaat | M80360 | 49310 | cactgattcagacaaccagaaaaga | X65453 | 91914 | caacttcgatctctgatgactgga | AA116993 |
| 6707 | ttgacaacaggctaatctgacagga | M80360 | 49311 | ccataatacacagatgacagagctc | X65453 | 91915 | tcgatctcgatgactgagagata | AA116993 |
| 6708 | taatctgacaggaacctactttgt | M80360 | 49312 | cagctcacaatctgtatggttgac | X65453 | 91916 | gatctctgatgactgagaggaggg | AA116993 |
| 6709 | ataatgccaagggttgctcaccaaa | M80360 | 49313 | tgttatggttgacctgggctcctg | X65453 | 91917 | tgagtgtctccttttaatagaatt | AA116993 |
| 6710 | tttgctcaccaaacacataaacgt | M80360 | 49314 | atcccacagagttgcttctcatct | X65453 | 91918 | gctaaatatccaatcaagcagtctc | AA116993 |
| 6711 | agaggcagagcacagaaggaaag | M80360 | 49315 | agagttggcttctcalctttggct | X65453 | 91919 | aatatcaatcaagcagtctctgaa | AA117064 |
| 6712 | aatgctgtcatcttttaacagct | M80360 | 49316 | ggctctcatctttggcttactca | X65453 | 91920 | gaacgctggagaaatcgtgaagaa | AA117064 |
| 6713 | gtcatcttttaacagctgaaggt | M80360 | 49317 | tcatctttggcttactcaaactct | X65453 | 91921 | tgacttgtctgatctcggagtat | AA117064 |
| 6714 | aactgtacaaaacaactctgtggca | M80360 | 49318 | ttactcaaactcgaacagtgcgct | X65453 | 91922 | agttgttctgatctcggagtatct | AA117064 |
| 6715 | caactctgtggcacaagccgtctct | M80360 | 49319 | aaactgaacagtgcgtgtccta | X65453 | 91923 | agtactctgtcacattgctgggtggt | AA117064 |
| 6716 | tgtgggtctccttttgagatgct | M80360 | 49320 | tgaacagtgcgtgctctaggctgc | X65453 | 91924 | tcttgtcacattgctgtggtagtt | AA117064 |
| 6717 | cttccttctgagatggctctgctc | M80360 | 49321 | gtgcgtcctaggctgccagcagg | X65453 | 91925 | ttgtcacatttgctggtgtagttcc | AA117064 |
| 6718 | atggctctgctctgtgaagggagc | M80360 | 49322 | ccaactatcctgatacaacagtg | X65453 | 91926 | tcccaagctgaaccacaatgactgg | AA117064 |
| 6719 | cttttcaggctctgtcctcctgct | M80360 | 49323 | caactatcctgatacaacagctga | X65453 | 91927 | ccaagctgaaccacaatgactgat | AA117064 |
| 6720 | gtctccattttctaggcagtacat | M80360 | 49324 | acagtcgacctcattccgatacc | X65453 | 91928 | gctgaaccacaaatgactgattaag | AA117064 |
| 6721 | atttctctaggcagtacattcata | M80360 | 49325 | agctgacctcattccgatactt | X65453 | 91929 | tgaaccacaatgactgattaagca | AA117064 |
| 6722 | gcttgctccaccaagaaggcttga | AA071856 | 49326 | gctgacctcattccgatacctt | X65453 | 91930 | tatccaatcaagcagtctcgaaaa | AA117064 |
| 6723 | ttttgctcaccaagaaggctttgag | AA071856 | 49327 | gcctaagatacctcaaagaagcag | X65453 | 91931 | caatcaagcagtctctgaaaaatat | AA117064 |
| 6724 | agcccagaggccagtcccccagaag | AA071856 | 49328 | ataccctaaagataccaagaagagag | X65453 | 91932 | aatgactcaaagtctcggcgtctg | AA117064 |
| 6725 | gaacgccaatccagggatcaagtgt | AA071856 | 49329 | cgtcgcacatctggcctctcgact | X65453 | 91933 | acctaaagtctcgggctcgtgcata | AA117064 |
| 6726 | acgccaatccagggatcaagtgtt | AA071856 | 49330 | gtcgcacatctggcctctcgacta | X65453 | 91934 | ctaaagtctcggggctctgcataca | AA117064 |
| 6727 | atcaagtgttcctctgtgcgtccc | AA071856 | 49331 | cgcacattcggcctctcgactc | X65453 | 91935 | agtctcggggctctgcatacaata | AA117064 |
| 6728 | tgtgccttcccagtctgggtagag | AA071856 | 49332 | cacattcgccctctgcgactcgg | X65453 | 91936 | tctcgggcgtctgcatacaataaccc | AA117064 |
| 6729 | tgcctcctaggctgggtagagat | AA071856 | 49333 | attcggcctctgcgactcgggc | X65453 | 91937 | gcgctcgatacaataaacctgaaag | AA117064 |
| 6730 | cgtcctaggctgggtagagatga | AA071856 | 49334 | aactatcctgatacaacagctgac | X65453 | 91938 | cgcaaccaactgaaacgcccgatg | AA117064 |
| 6731 | ccctaggctgggtagagatgactga | AA071856 | 49335 | ctatcctgatacaacagctgacct | X65453 | 91939 | caaccaactggcctaggcgccaga | AA117074 |
| 6732 | cccttaggctgggtagagatgactga | AA071856 | 49336 | atcctgatacaacagctgacctca | X65453 | 91940 | tagcaacctggcctaggcgctagga | AA117074 |
| 6733 | ggcccagaggccgcagtgtggca | AA071856 | 49337 | cctlgatacaacagctgacctcatt | X65453 | 91941 | cttagaggagctggggccacaagtacct | AA117074 |
| 6734 | tgctcaccaagaaggctttggaaga | AA071856 | 49338 | ctlgatacaacagctgacctcattt | X65453 | 91942 | agagctggggccacaaagtacct | AA117074 |
| 6735 | agaggcccaatggaagtltgggactg | AA071856 | 49339 | tgtatacaacagctgacctcattc | X65453 | 91943 | acgctggggccacaaagtacctga | AA117074 |
| 6736 | cattgccttcagctcagagcct | AA071856 | 49340 | caacagctgacctcattccgata | X65453 | 91944 | ctgggggccacaaagtacctgatgt | AA117074 |
| 6737 | ttgccttcagctcagagccta | AA071856 | 49341 | aacagctgacctcattccgatac | X65453 | 91945 | tgggccacaaagtacctgatggt | AA117074 |
| 6738 | ttctcagctcagagcctcagccag | AA071856 | 49342 | aaggccaagcgccgccaaccagaga | X65453 | 91946 | cggccacaaagtacctgatggtgga | AA117074 |
| 6739 | ctcagctcagagcctcagcccagag | AA071856 | 49343 | tgtcggccgagaacgaagaagtgc | X61800 | 91947 | tgccacaaagtacctgatggtgag | AA117074 |
| 6740 | tcagagccctttggaccggaagcagtg | AA071856 | 49344 | gtcggccgagaacgaagaagtgcga | X61800 | 91948 | tgcctagccgccaaggctgacg | AA117074 |
| 6741 | agagcctcagagccaggccagtgc | AA071856 | 49345 | tgggcactgactgcgagaagct | X61800 | 91949 | agagctgccgaaggctgacggccag | AA117074 |
| 6742 | tgtcctagagacacaccgggg | AA071856 | 49346 | gcactgactgcgagaagctata | X61800 | 91950 | aacccaactgaaacgcccgatgcag | AA117074 |
| 6743 | agaggacacccgggccacagt | W50324 | 49347 | agcatttctacgtctattaccat | X61800 | 91951 | tgcattgctacctagcacctggc | AA117074 |
| 6744 | cgagaaccattaactcactgctacc | W50324 | 49348 | ttctacgtctattaccatgcagc | X61800 | 91952 | cattgctacctagcacctggt | AA117074 |
| 6745 | gctcaccagcttaccattaccag | W50324 | 49349 | tacgtctattaccattgcagctaa | X61800 | 91953 | attgctacctagcacctggcta | AA117074 |
| 6746 | cagccagcctttggaccgagagtca | W50324 | 49350 | gtctattaccattgcagctaaggt | X61800 | 91954 | ttgctgtacctagacctggctag | AA117074 |
| 6747 | gcctttgaccgagagtcacatccc | W50324 | 49351 | ttattaccattgcagctaaggtaca | X61800 | 91955 | gctgtacctagacctggcctagcc | AA117074 |
| 6748 | gaccgagagtcacatccattacca | W50324 | 49352 | ttaccattgcagctaagglacatt | X61800 | 91956 | tgtaccttagacctggccctaggg | AA117074 |
| 6749 | agagtcacatccattaccatcg | W50324 | 49353 | gacattccgacagacttttgtaga | X61800 | 91957 | taccttagacctggccctaggggct | AA117074 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 6750 | cattacaccatgacctgctggca | W50324 | 49354 | gagcagctcaccggacctggctg | X61800 | 91958 | cgccacagtgtcgtgttgctgtc | AA117128 |
| 6751 | gactctgcggccagtgatgctggat | W50324 | 49355 | actctgacgacctataccteagac | X61800 | 91959 | cacagtgtcgtgttgctgtcgtc | AA117128 |
| 6752 | calctcaccatcaggctgaacatt | W50324 | 49356 | gccgcccgaatcgctagttlcttg | X61800 | 91960 | gctcttctacacgctgaatattcc | AA117128 |
| 6753 | accatcacgtgaacatttcagatg | W50324 | 49357 | gctagtttcttggacctgccgc | X61800 | 91961 | ctacacgtcgaatattccataatc | AA117128 |
| 6754 | taatgtgtcggggacctgagactcagt | W50324 | 49358 | ttccttggacctgcggacgac | X61800 | 91962 | gtcgaatattccataatcctccag | AA117128 |
| 6755 | cctggagacaactgccaaactgcca | W50324 | 49359 | tttgggacctgcgagcgacagaag | X61800 | 91963 | cataatcctccagtctgccctagtt | AA117128 |
| 6756 | gacaacctgccaaactgccatttcag | W50324 | 49360 | acctggcgagccgacgaagctgcag | X61800 | 91964 | aatcctccagtctgccctagttca | AA117128 |
| 6757 | tccaaactgccatttcagatcaag | W50324 | 49361 | gaagcgcagctggggactggact | X61800 | 91965 | aaactgtacgtcatttcccagatg | AA117128 |
| 6758 | cctgccatttcagatcaagcctcc | W50324 | 49362 | gatatgatgcgggccgtgcgtagaa | X61800 | 91966 | cttgtacgtcatttcccagatgtc | AA117128 |
| 6759 | atttcagatcaagcctccgagaac | W50324 | 49363 | atatgatgcgggccgtgcgtagaa | AA030635 | 91967 | ttcccagatgctgtctgcgattt | AA117128 |
| 6760 | gatcaagcctccgagaaccattac | W50324 | 49364 | tgatcacggtcgtatggaagccca | AA030635 | 91968 | gatgctgtctgcgatttagtgcc | AA117128 |
| 6761 | gccttccgagaaccattactcactg | W50324 | 49365 | tgatcacggtctgtatgaagcgcaac | AA030635 | 91969 | gctgctgtctgcgatttagtggccaac | AA117128 |
| 6762 | tcttttctgacttaaactgagt | W50324 | 49366 | tcgtagaagcccaacgatgatg | AA030635 | 91970 | tgctgctgtcatctatttcagggg | AA117128 |
| 6763 | ctcctgacttaaactgagttcctga | W76814 | 49367 | gtatgaagcccaacgagtgatgaa | AA030635 | 91971 | tgttgactgtgccattaagtcggca | AA117128 |
| 6764 | gcatctgtagtgacgattggagagg | W76814 | 49368 | tggaagcccaacgagtgatggagat | AA030635 | 91972 | cttgccattaagtcggcacggtat | AA117128 |
| 6765 | cccggtctcaggcgagctagccgcca | W76814 | 49369 | ggaagcccaacgagtgatggagatg | AA030635 | 91973 | cattaagtcggcacggtatcgtgga | AA117128 |
| 6766 | gagtccaggcagctagcgagtcagc | W76814 | 49370 | aagcccaacgagtgatggagatgaa | AA030635 | 91974 | taagtcggcacggtatcgtgacag | AA117128 |
| 6767 | agcagtccagcacgcgccacaag | W76814 | 49371 | agcccaacgagtgatggagatgaat | AA030635 | 91975 | gtacagagtatctatcaagctc | AA117128 |
| 6768 | agccacgcgccacaaaggaggcgcc | W76814 | 49372 | acacgttatagggctgagtacg | AA030635 | 91976 | cagtagtatctatcaagtctc | AA117128 |
| 6769 | cccaaatgtcctggccatgaaagg | W76814 | 49373 | gtcacactggcgataagatgacag | AA030635 | 91977 | tatcaagctcttctacagctgaat | AA117128 |
| 6770 | caatgctcctggccatcgaaaggaa | W76814 | 49374 | atgatgggcgcgtgctagaagc | AA030635 | 91978 | aatcctagaatcagagtcgagtctc | AA162093 |
| 6771 | atgtcctcctggccatcgaaaggaa | W76814 | 49375 | tgatgcgggccgtgcgctagaagc | AA030635 | 91979 | gagtctctcgtgactgccatta | AA162093 |
| 6772 | gtcctcgccatcgaaaggaagagc | W76814 | 49376 | gtgcgctagaagcctacacgcgcg | AA030635 | 91980 | caggacaacacctatccgagatcc | AA162093 |
| 6773 | cctcggccatcgaaaggaagaagct | W76814 | 49377 | tgcgctagaagcctacacgcgcga | AA030635 | 91981 | gacaacacctatccgagatcgc | AA162093 |
| 6774 | tgactaaactgagttcctgacat | W76814 | 49378 | cgctagaagcctacacgcgcga | AA030635 | 91982 | acctatccgagatcgcgctcta | AA162093 |
| 6775 | actgagttcctgacatttcggaa | W76814 | 49379 | tagaagcctaccagccgaggtga | AA030635 | 91983 | tatcctgagatcctgcgtctaacc | AA162093 |
| 6776 | tgagttcctgacatttctggaaag | W76814 | 49380 | agcctaccagccgcgaggtgatcac | AA030635 | 91984 | cctgagatcctgcgtctaacctag | AA162093 |
| 6777 | aggcatttctacctgcatctgact | W76814 | 49381 | aggtatcacggtgtatggaagcc | AA030635 | 91985 | gagatcctgcgtctaacctaggat | AA162093 |
| 6778 | gcatttctacctgcatctgtga | W76814 | 49382 | agaggactctactcagacagtgat | AA030635 | 91986 | ctgcgtctaacctaggtgtgt | AA162093 |
| 6779 | atttctacctgcatctgtagtgacg | W76814 | 49383 | catggttacttgccatggccaag | AA030635 | 91987 | cgctctaacctaggatcggtgtgt | AA162093 |
| 6780 | ttctacctgcatctgtagtgacgat | W76814 | 49384 | ctgctggagatgctgagaagccc | X55038 | 91988 | tctaacctaggatcggttgttgc | AA162093 |
| 6781 | acctgcatctgtagtgacgattgga | W76814 | 49385 | gaagcccaggcttcacaacgct | X55038 | 91989 | aacctaggatcggttgtgtgcagc | AA162093 |
| 6782 | gagatgatctcctatgagggaat | W76814 | 49386 | caggcttcagcaacgcttcgcca | X55038 | 91990 | tctcttcgtgactgccattagta | AA162093 |
| 6783 | gatcctatgagggaattgactt | W50329 | 49387 | ggcttcagcaacgcttcgcaggt | X55038 | 91991 | cttcgtgactgccattagtaaag | AA162093 |
| 6784 | cctgagatgcaactagacaagt | W50329 | 49388 | tttcagcaacgcttcgccaggtcc | X55038 | 91992 | aaagttcagctcagcaaaggggcgg | AA162093 |
| 6785 | tgccaactagacaagtcaacagatca | W50329 | 49389 | cgcttcagcaacgcttcgccaggtccag | X55038 | 91993 | ggaccgaaccagacctggaaaatgct | AA162093 |
| 6786 | caactagacaagtcacagatcatga | W50329 | 49390 | ttcgccaggtccaggctccaggt | X55038 | 91994 | ccgaaccagacctggaaatgctca | AA162093 |
| 6787 | tggtctacagatcccagatcaga | W50329 | 49391 | aggttccaggctccaggctgaa | X55038 | 91995 | aaatgcttaggcttatacagaga | AA162093 |
| 6788 | tctacagaatccaagatcgaaac | W50329 | 49392 | caggtccaggctctgagacaggcc | X55038 | 91996 | tgcttcaggctttatacagagaag | AA162093 |
| 6789 | acagaatccaagatcgaaactct | W50329 | 49393 | atttagccctggcccaggcactg | X55038 | 91997 | atgcaggaacaacctatccgaga | AA162093 |
| 6790 | gaatccaagatcagaaactctgaa | W50329 | 49394 | ggcttacttgccatggctcaagg | X55038 | 91998 | tgctgcatcgcagaaggagaact | AA117151 |
| 6791 | tccaagatcagaaactctgaagat | W50329 | 49395 | cccatgatgaccgagttgcaagt | X55038 | 91999 | gcttgcagcagaaggagaactt | AA117151 |
| 6792 | aaactcgaagattctcatggaaa | W50329 | 49396 | gaagaaccatgcaggcaggcggca | X55038 | 92000 | gcacgccgcgttgttcacaagt | AA117151 |
| 6793 | actcgaagattctcatggaaga | W50329 | 49397 | acatcaaagctgagctgctggacat | X55038 | 92001 | cacgcccgcttggtcttacaagtt | AA117151 |
| 6794 | gaattgactctcaactccatacc | W50329 | 49398 | tcaaagctgagctgctggacatag | X55038 | 92002 | gtcctctgacaacgcaattca | AA117151 |
| 6795 | ttgactctcaactccatacccgt | W50329 | 49399 | ctgagctgctgaacagctgacc | X55038 | 92003 | cttctgacaactgaattcaaac | AA117151 |
| 6796 | actctacactcccataccgtgct | W50329 | 49400 | ctccgcccaaggcagctgctgagaag | X55038 | 92004 | ttcctgacaacactgaatcaaaca | AA117151 |
| 6797 | tgtgactgtccgtggcacatgggac | W50329 | 49401 | aactctgggcagctgctgagaatgg | X55038 | 92005 | cctgacaacactgaattcaaacaa | AA117151 |
| 6798 | gactgtccgtggcacatggaccct | W50329 | 49402 | gccggagaccctttcagagctctt | AA031244 | 92006 | aagtgtcctatgtgagagctata | AA117151 |
| 6799 | tgtccgtggcacatgaccctga | W50329 | 49403 | ggaggaccctttcagagctctt | AA031244 | 92007 | gtgtgacctctatgtgagagctaag | AA117151 |

| SEQ ID NO | sequence | DBAxnID | SEQ ID NO | sequence | DBAxnID | SEQ ID NO | sequence | DBAxnID |
|---|---|---|---|---|---|---|---|---|
| 6800 | gtggcacatggaccctgtagagaag | W50329 | 49404 | ctctctcttcgtcctttcctgctaa | AA031244 | 92008 | tgacctctatgtgagagctaagtag | AA117151 |
| 6801 | ggccctgagagctgccaactagaca | W50329 | 49405 | tcgtccttcctgctaactccgctt | AA031244 | 92009 | gacctctatgtgagagctaagtagt | AA117151 |
| 6802 | acctgaaacacatcaccaagtgaa | W50138 | 49406 | tcctcatctttcgttcagcccgg | AA031244 | 92010 | ttaaacctttgaagacattgactga | AA117151 |
| 6803 | aacacatcaccaagtgaagcctg | W50138 | 49407 | ctcatctttcgttcagccgagg | AA031244 | 92011 | tgttttctggttcaagcgatgaa | AA117151 |
| 6804 | tgcccatgttggagtcatgcctga | W50138 | 49408 | tcggtccttcgtcctcgtttctac | AA031244 | 92012 | tgttttctggttcaagcgatggaac | AA117151 |
| 6805 | tgagctcatgctgagaagagagc | W50138 | 49409 | ggccgcgcatcactacacgcagaa | AA031244 | 92013 | ttttcttgttcaagcgatggaactt | AA117151 |
| 6806 | agctcatgctgagaagagagccac | W50138 | 49410 | cgcatcactacacgcagaatcatgg | AA031244 | 92014 | ttctgttcaagcgatggaactta | AA117151 |
| 6807 | ccactgccgaggtgtctccggca | W50138 | 49411 | catcactacacgcagaatcatgga | AA031244 | 92015 | gtctcaagaagcactaggcacagcc | AA117151 |
| 6808 | ccgctgagtgctccggcatcctg | W50138 | 49412 | tcactacacgcagaatcatggaga | AA031244 | 92016 | agaagactaggcacagcccgctg | AA117151 |
| 6809 | agtgctccggcatcctggctgaa | W50138 | 49413 | actacacgcagaatcatggagaacg | AA031244 | 92017 | taggcacagcccgctggtcttaca | AA117151 |
| 6810 | gtcccgcatcctggctgaatcc | W50138 | 49414 | agacctttcagagctcttgat | AA031244 | 92018 | caaatgatgcgggctcggcagtat | AA116977 |
| 6811 | tccggcatcctggctgaatcctaa | W50138 | 49415 | cctttcagctcttgact | AA031244 | 92019 | aaatgatgcgggctcggcagatc | AA116977 |
| 6812 | atcctggctgaatcctaagccagc | W50138 | 49416 | ttttcagagctcttgtagactg | AA031244 | 92020 | atgctgattcgggtcaacatggagg | AA116977 |
| 6813 | ggctgaatcctaagccagccctgc | W50138 | 49417 | ttttcagagctcttgtagactggg | AA031244 | 92021 | tgctgatcgggtcaacatggaagga | AA116977 |
| 6814 | acatccaccaagttgaagcctggg | W50138 | 49418 | ctttgatgactttggggtgtcttctcg | AA031244 | 92022 | gctgatcgggtcaacatggaggat | AA116977 |
| 6815 | tcaccaagttgaagcctgggtct | W50138 | 49419 | tgactttgggtgtcttctccggcagct | AA031244 | 92023 | ctgatcgggtcaacatgagagatc | AA116977 |
| 6816 | tgaagcctggggtctctccgaagt | W50138 | 49420 | acttgggtcttctccggcagttc | AA031244 | 92024 | gatcgggtcaacatggaggattc | AA116977 |
| 6817 | gtctctgaggtctcgtgggaga | W50138 | 49421 | ttcagacaccagggtcccgactca | AA031244 | 92025 | tcaacatggaggatcgcgggacag | AA116977 |
| 6818 | ttctgaggttctggtgagaagta | W50138 | 49422 | acgccacgctccgtgagagtacc | AA031244 | 92026 | aacatggaggatcgcgggacaga | AA116977 |
| 6819 | tcacagattcctgctgccatgtt | W50138 | 49423 | gctccgtgagagtaccaccgagttc | AA031244 | 92027 | aacatggaggatcgcgggacagac | AA116977 |
| 6820 | cagatttcctgccgccatgtgaa | W50138 | 49424 | ctatgccagagatataggggaccag | AA031244 | 92028 | aattgagcgggctcggcagtatcc | AA116977 |
| 6821 | tgtgccatgttgagctcatgcc | W50138 | 49425 | ggcacacgcagatgaccacacagcgca | AA031244 | 92029 | attgatgcgggctcggcagtatcct | AA116977 |
| 6822 | catcctcagatactcatatgcaag | W50138 | 49426 | gccagatgacacacgcgcaagaga | AA031244 | 92030 | ttgatgcgggctcggcagtatcctt | AA116977 |
| 6823 | aagatgtggattcatacggtgtga | M31314 | 49427 | gatgcaccacgcagcaagagaacac | AA031244 | 92031 | tgatgcgggctcggcagtatccctg | AA116977 |
| 6824 | tgaacacgttctctatgtgaaat | M31314 | 49428 | agaacacacatttcctactc | AA031244 | 92032 | ggctcggcagtatcttggggagact | AA116977 |
| 6825 | tgaaatacacaggctgcagagaa | M31314 | 49429 | atggctgtgtcactatgacgaca | AA031244 | 92033 | tgaaacgaggctcactgcgactttg | AA116977 |
| 6826 | aagcaaatccttcagcaagttag | M31314 | 49430 | catgtatcctataccgtgtcgta | AA031244 | 92034 | aaacgaggctcactgcgactttgtg | AA116977 |
| 6827 | atticcttcagcaagttagaaggcga | M31314 | 49431 | gtatcctctataccgtgtctgtcg | AA031244 | 92035 | tgaagctcgggagatgcgattcg | AA116977 |
| 6828 | taacgccactgcgagccagaccac | M31314 | 49432 | tctcctatacgtgtctgtaatgct | AA031244 | 92036 | cactcagccaggccgaccaggccga | AA116977 |
| 6829 | cgcccgatgactcggaagctcagt | M31314 | 49433 | tacggtgtctaatgctgtgtc | AA031244 | 92037 | agacagccgagctgctctagagaca | W08049 |
| 6830 | atggacctgaagctcagtgggtga | M31314 | 49434 | tgagagtaccaccgagttctcctg | AA031244 | 92038 | cagagaccctaatctggtgaacga | W08049 |
| 6831 | ccctcccagtgacagtacgg | M31314 | 49435 | cctgagtactcatctatgctatc | AA031244 | 92039 | atccctacagcatacagctct | W08049 |
| 6832 | gttgaccctgaaactgtgggaccat | M31314 | 49436 | gtgagtactcatcatctatcatg | AA031244 | 92040 | cctcacagacgatacagctctggc | W08049 |
| 6833 | ggaaccatggcgaactctaaat | M31314 | 49437 | agtactcatctatgctatcatgt | AA031244 | 92041 | ctacagacgatacagctctggctga | W08049 |
| 6834 | ctgattctactggtgtgaggtagc | M31314 | 49438 | tgctatcatgtgatctactagccaga | AA031244 | 92042 | atacagctctggctgatatcacacc | W08049 |
| 6835 | aggtagccactgaggagacagcagtgt | M31314 | 49439 | tatcatgatctactatgccagacag | AA031244 | 92043 | cagctctgcgtatatcacacctc | W08049 |
| 6836 | caacgactccagtgtcgctcctg | M31314 | 49440 | aagtcaaagcctcaggcggccgaa | AA031244 | 92044 | ctgatatcaccaccttccacagatga | W08049 |
| 6837 | agtgagctcaagtgcagcctgtcc | M31314 | 49441 | tcccatcctgatgatgatgcagtc | AA031244 | 92045 | cacttcaccacttcacagatagctgg | W08049 |
| 6838 | agctccaagctgctggtggctccagtc | M31314 | 49442 | ggtgagtactcacatctatgctatc | AA031244 | 92046 | ccacagatccaagctgtgacaa | W08049 |
| 6839 | ttcacatcctgtttatctgcagt | M31314 | 49443 | gtgactgagtcactcatgtact | AA031244 | 92047 | ctactgagatgccgggatgagaa | W08049 |
| 6840 | tttatctgtcagtgggaatatgtt | M31314 | 49444 | ccctcgagggtcttgaggatcag | AA031244 | 92048 | cagatgcagctgtagacaaat | W08049 |
| 6841 | ttcgttgaacaggtctctagt | M31314 | 49445 | ttcctgaggtcttgaggatcagg | AA031244 | 92049 | acaatatgctgttctgggcagaa | W08049 |
| 6842 | gcgcgggcaacgactccaggttgc | AA120695 | 49446 | aagtcaaagccttcaggcggccaga | AA031244 | 92050 | tgcgttctctggggcagaaggcctt | W08049 |
| 6843 | caagactccagtgtcgtcctcg | AA120695 | 49447 | tcccatcctgatagatgcagtc | AA031244 | 92051 | tctggggcagaaggcctgctgct | W08049 |
| 6844 | tttaactactggaggactttg | AA120695 | 49448 | cccatcctgatatagctcagctc | AA031244 | 92052 | ttgcttgcaatcagcatccctc | W08049 |
| 6845 | aactactggagacttttgcaa | AA120695 | 49449 | ccatccctgatatgatcagctcc | AA031244 | 92053 | tcttgcaatcagcatccctga | W08049 |
| 6846 | tactctgagacctttctgcaacag | AA120695 | 49450 | gatagatgcagctccataacccc | AA031244 | 92054 | ctgactggctaccccctaggggtgca | W08049 |
| 6847 | gagagcttctgcaacaggagagaa | AA120695 | 49451 | atagatgcagctcccataaccccct | AA031244 | 92055 | atgtgcctgagacatttcacacaga | W08049 |
| 6848 | ctcttgcaacaggagacaaaggtg | AA117183 | 49452 | tagatgcagctcccataacccctg | AA031244 | 92056 | aatcacgagactctcagaaatccg | AA117183 |
| 6849 | ctcttgcaacaggacacaaaggtg | AA117183 | 49453 | gcccttgaacagggccataatgaa | X51983 | 92057 | atacagagaactctcagaatctga | AA117183 |

| SEQ ID NO | sequence | DBAxnID | SEQ ID NO | sequence | DBAxnID | SEQ ID NO | sequence | DBAxnID |
|---|---|---|---|---|---|---|---|---|
| 6850 | aaaggccgctcactcaggggag | AA120695 | 49454 | tgactgacctccgcatgatcgggc | X51983 | 92058 | tcagagctcttcgcgataatacac | AA117183 |
| 6851 | gttacgtaccttcagagtcatg | AA120695 | 49455 | actgacctcgcatgatcgggcct | X51983 | 92059 | agagctattcgcgataatacacat | AA117183 |
| 6852 | agtaccttcagagtcatgagccag | AA120695 | 49456 | tgacctccgcatgatcgggcctgc | X51983 | 92060 | gagctcttcgcgataatacacatg | AA117183 |
| 6853 | accttcagagtcatgagccagagt | AA120695 | 49457 | cccgctcctccgaggtcttgag | X51983 | 92061 | agctcttcgcgataatacacatgt | AA117183 |
| 6854 | cttccagtgggtcttctgccaggtc | AA120695 | 49458 | ccgctcctccgaggtcttgagg | X51983 | 92062 | ctcttccgcgataatacacatgtgt | AA117183 |
| 6855 | tttcagagtcatgagccagagttg | AA120695 | 49459 | cgctcttcctgaggtcttgagga | X51983 | 92063 | tcttccgcgataatacacatgtgtc | AA117183 |
| 6856 | gtgctctcgcaggtcaaggcgct | AA120695 | 49460 | gctcttccgagggtcttgaggat | X51983 | 92064 | cttccgcgggtcttgaggat | AA117183 |
| 6857 | cttctcgcaggtcaaggcgcgtc | AA120695 | 49461 | tcttctcgaggtcttgaggatca | X51983 | 92065 | tgtcgttccaagagcactctac | AA117183 |
| 6858 | ctcgcaggtcaaggcgcgtcgac | AA120695 | 49462 | tacatcacatgtttcactgct | X51983 | 92066 | gtgttccaagagcacttctaca | AA117183 |
| 6859 | acgcattcatatctatcgttgagt | AA120695 | 49463 | gcagcagctgcagccactgcaggtt | AA168900 | 92067 | tgttccaagagcacttctaccc | AA117183 |
| 6860 | acatcatatctatcgttgagtta | AA120695 | 49464 | atagctatggcagctcaaatggcag | AA168900 | 92068 | cacgagaacctcagaatctcgaaa | AA117183 |
| 6861 | ttcatatcatcgttgagtttaact | AA120695 | 49465 | gcagctcaaatggcagccctgcaag | AA168900 | 92069 | gttctcaagagcactctacacca | AA117183 |
| 6862 | atatctatcgttgagtttaactact | AA120695 | 49466 | gctcaaatggcagccctgcaagcta | AA168900 | 92070 | acgagactctcagaatctcgaaaa | AA117183 |
| 6863 | tgaaatctcctgctaacagactca | X01450 | 49467 | caaatggcagccctgcaagctaaag | AA168900 | 92071 | cgagaactctcagaatctcgaaaaa | AA117183 |
| 6864 | gtaacagacctcaagaaggagacag | X01450 | 49468 | caagctaaaggcctggccagagactg | AA168900 | 92072 | agaactctcagaatctcgaaaaact | AA117183 |
| 6865 | tgtactggagccctcatcatg | X01450 | 49469 | aaagcctgccagagactggcatag | AA168900 | 92073 | gaactctcagaatctcgaaaaactt | AA117183 |
| 6866 | tgggagccctttcatcatgatctta | X01450 | 49470 | actggcatagcagtgccagctact | AA168900 | 92074 | ctctcagaatctcgaaaaacttca | AA117183 |
| 6867 | catcatgatcttaatctgactgtt | X01450 | 49471 | ggcatagcagtgcccagctactaca | AA168900 | 92075 | ctcagaatctcgaaaactttcaga | AA117183 |
| 6868 | aaagcgtctcgggtatctctcactc | X01450 | 49472 | atagcagtgcccagctactacaacc | AA168900 | 92076 | atctcgaaaaacttcagagctctt | AA117183 |
| 6869 | ttacatcattcagtctcacctgtaa | X01450 | 49473 | gcagtgcccagctactactacaaccag | AA168900 | 92077 | ttggcttccagtcaggttaatcttt | AA117183 |
| 6870 | cattcagtctcacctgtaactaaca | X01450 | 49474 | gttcttaatgttgctcacctgtaa | AA168900 | 92078 | gcttccagtcaggttaatcttgca | AA117183 |
| 6871 | gcttaactgtgacaaccacatcact | X01450 | 49475 | gtgccagtactacaaccagcagag | AA168900 | 92079 | cgcagaaacaagatcattgcattgca | AA117183 |
| 6872 | ctgtacaaccacatcactgttacc | X01450 | 49476 | cttaatgttgctgcactgttgcat | AA168900 | 92080 | aaccaagatcattgcagctct | AA117183 |
| 6873 | aaccacatcactgttacctgaagt | X01450 | 49477 | aatgttgctcactgttgcacag | AA168900 | 92081 | caagatccatttgcagtcttca | AA117183 |
| 6874 | accacgtatcatgtaactacaac | X01450 | 49478 | gctgcactgttgcatcagcaacgc | AA168900 | 92082 | ttctccacctgttcctgcgaccaca | W08050 |
| 6875 | taaatctctgagctgacaggcat | X01450 | 49479 | ggaaccagggttactctcagatatg | AA168900 | 92083 | ttcacctgttcctgcgaccacgc | W08050 |
| 6876 | gcttgacaggcatcctccacacagg | X01450 | 49480 | acgcagttactctcagatgctca | AA168900 | 92084 | tggttctcgaccacagcctctcag | W08050 |
| 6877 | caggatcctccacacagcaggattttc | X01450 | 49481 | caggttacctccagatagctagg | AA168900 | 92085 | ttccgaccacagccttccagat | W08050 |
| 6878 | atagttttcctcgaagccaccatgct | X01450 | 49482 | actcctcagaagctatgcagctgt | AA168900 | 92086 | tcggaccacagcctccagaatctg | W08050 |
| 6879 | tcctctagaacaccagctacagac | X01450 | 49483 | gcctggatccagaagggaggcccac | AA168900 | 92087 | gaccacagccttccagaatctgacac | W08050 |
| 6880 | tccacgccacgaagctctctgtac | X01450 | 49484 | aaccacagtaccagcctggagagaca | AA168900 | 92088 | gaatctgacagaatctgctgagatta | W08050 |
| 6881 | gccgaagctctgtgtacatttcc | X01450 | 49485 | cgacgctgaagcattttataga | AA168900 | 92089 | ccctactcagaaacaagctgatg | W08050 |
| 6882 | tcgtacatctgtactggagagc | X01450 | 49486 | tcctcgtgacccaaggttcattt | X16440 | 92090 | agatacactgtgagtgtgctgctc | W08050 |
| 6883 | aggccgagctgaggacatctgcag | X01450 | 49487 | tctagggcatccactcattcaca | X16440 | 92091 | tccactccaatcattgtggggag | W08050 |
| 6884 | acatcgcagtgagtgactgtgaact | W50367 | 49488 | gcatccactcatttcacagagtaa | X16440 | 92092 | gggcagagccccagtcgcctcattc | W08050 |
| 6885 | cttctgaagttgcactgctctcctga | W50367 | 49489 | tgatgctcagctcctcctgaa | X16440 | 92093 | catgagccccagtcgcttcattcgca | W08050 |
| 6886 | tgtcaaatccccagcagtcgtacca | W50367 | 49490 | ttcctgccaattaggctccgaca | X16440 | 92094 | gagcccagtccttcattcgcagaa | W08050 |
| 6887 | caaactccagcagtcgtaccaaga | W50367 | 49491 | tcccatggccgacatacccagat | X16440 | 92095 | cagtcttcattcgcagaaccaag | W08050 |
| 6888 | actcccagcagtcgtaccaagagc | W50367 | 49492 | taggctccgatacccagtagtctc | X16440 | 92096 | ttcattcgcagaaaccaagatctca | W08050 |
| 6889 | gcctgctgaatttctcagtct | W50367 | 49493 | ccatctccaaaatactcatctt | X16440 | 92097 | tgttaaccattcgaataatcaga | W08050 |
| 6890 | tggctctgaatttctcagtcttta | W50367 | 49494 | aatactcatctttgtctagttatt | X16440 | 92098 | accattcgaatatacagatctggc | L19932 |
| 6891 | ctctgaattctcagtcttttacta | W50367 | 49495 | agtaacgctgaggacgcagacata | X16440 | 92099 | attctgaaagccttgccatggttc | L19932 |
| 6892 | tgaatttctcagtcttttactag | W50367 | 49496 | gagaccagacatagcctgactgggc | X16440 | 92100 | gaaagcctggcatgttctgtaaa | L19932 |
| 6893 | attctcagtctttactagagat | W50367 | 49497 | agacatagcctgactgggcatcact | X16440 | 92101 | ctgtaaagctctgtaccgctggag | L19932 |
| 6894 | tctcagtctttactatagatct | W50367 | 49498 | agtagtactgtctctgccaatcc | X16440 | 92102 | tgtaccgctggagaaacggatcac | L19932 |
| 6895 | tctgcagtgacgttctgaactgtt | W50367 | 49499 | tactgtctgccaatcccgaagtt | X16440 | 92103 | gcatcactaaagctatgaggtgaa | L19932 |
| 6896 | tactcattccaatgctaaccatgc | W50367 | 49500 | cactctgcccagtgcccaagatgt | X16440 | 92104 | actgttctcagtaatgtcttgt | L19932 |
| 6897 | tcattctcaatgctaaccatgcaga | W50367 | 49501 | ccctgggaatctagcacacaggat | X16440 | 92105 | tctgtcaagtatgtctgtgtccac | L19932 |
| 6898 | tcaatgctaaccatgcagaaagcaa | W50367 | 49502 | tggaatcctagcacaggatcagaga | X16440 | 92106 | aagtatgtctgtgtccacacatg | L19932 |
| 6899 | atgctaaccatgcagaaagcaaagt | W50367 | 49503 | cgactgacactcagaactag | X06368 | 92107 | gtcttgtccacacatggttga | L19932 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 6900 | W50367 | ctaaccatgcagaaagcaaagtt | 49504 | X06368 | tgaacttcagaacatgagggtct | 92108 | L19932 | tagaatccgaattccgagtgtga |
| 6901 | W50367 | ggtacctctgaagttgcatctgg | 49505 | X06368 | tcctgacagatgcttagactacag | 92109 | L19932 | atctggcagtcatagcttggcacca |
| 6902 | W50367 | atccttctgaagttgcatctggga | 49506 | X06368 | gtactgagcgggcagctaaaaagtg | 92110 | L19932 | gggccatggtgcattgtaataa |
| 6903 | W50374 | cattccatcgttgcgtgtgaac | 49507 | X06368 | gccctgcacttcagactggaagt | 92111 | L19932 | cagtcatagcttgccaccaaattc |
| 6904 | W50374 | ttccatcagcttgcgtggaactt | 49508 | X06368 | tcacttagacgtgaagtatgggg | 92112 | L19932 | tagcttggcaccaaattccgaaag |
| 6905 | W50374 | ccagcaatcccgagctggg | 49509 | X06368 | tgcaaggctgaccacacacaaaa | 92113 | L19932 | ccgaaagacctctgaaagcatgaa |
| 6906 | W50374 | caatcccgagctgcagctgggcag | 49510 | X06368 | aaccgtgtctcctccaagtctg | 92114 | L19932 | gcatgaattcctgactgctgccaag |
| 6907 | W50374 | atcccgagcagctgggcaggat | 49511 | X06368 | gtgctcctccaagtcgactgt | 92115 | L19932 | tgactgtgccaaggcctgataagg |
| 6908 | W50374 | atcccgagcagctgggcaggtct | 49512 | X06368 | gactgctccaattaatcgtcaa | 92116 | L19932 | tgccaaggctgataaagggaacta |
| 6909 | W50374 | gccaggatcctactgctcacga | 49513 | X06368 | tcctcaattaactgtcaacattaa | 92117 | L19932 | tcttggagctcacaaatgtgaatca |
| 6910 | W50374 | aggatctctactgctcacgata | 49514 | X06368 | ctgcaacattaaactaacagtcat | 92118 | W83337 | tggcatccgcgatgattggcgct |
| 6911 | W50374 | gatctctactgctcacgataag | 49515 | X06368 | ttccagagcctggccatcactgc | 92119 | W83337 | ctgcatccatgcacgaattctc |
| 6912 | W50374 | tcctactgctcacagataagacag | 49516 | X06368 | cattaaactaacagtcattaacatc | 92120 | W83337 | catcgtcaccaacgtggcctgcaa |
| 6913 | W50374 | ctactgctcacagataagacagg | 49517 | X06368 | gggccatcacgccagtggggtct | 92121 | W83337 | tcgtcaccaacgtggcctgcaatg |
| 6914 | W50374 | actgctcacagataagacaggac | 49518 | X06368 | ggttctcacagtgctagcctctat | 92122 | W83337 | cgtcaccaacgtggcctgcaatga |
| 6915 | W50374 | cccatcagattcgcgtgaactgg | 49519 | X06368 | tgctgcctataattactacgc | 92123 | W83337 | tcaccaacgtggcctgcaatgag |
| 6916 | W50374 | ctgctcacagataagacaggacc | 49520 | X06368 | cctctatatttactatgccaactgg | 92124 | W83337 | tggcctgcaatgagcaaaactgg |
| 6917 | W50374 | caagatcgtgcacgctgggtgatt | 49521 | X06368 | caactggtgcaccctagttctctt | 92125 | W83337 | aactgacgtaaactacactcagcta |
| 6918 | W50374 | agatcgtgcacgctgggtgattcg | 49522 | X06368 | gtgcaccctagttctcttctcca | 92126 | W83337 | ctgacgtaaactacactcagctagt |
| 6919 | W50374 | tgtacagctgggtgattcgcaggga | 49523 | X06368 | cgtcccaaactctggttccaatg | 92127 | W83337 | tgacgtaaactacactcagatagtc |
| 6920 | W50374 | tacagctgggtgattcgcaggga | 49524 | X06368 | cctgcatgcgacggtgaacttgt | 92128 | W83337 | acgtaaactacactcagctagtcga |
| 6921 | W50374 | cagctgggtgattcgcaggattcc | 49525 | X06368 | gcatgcgacggtgaacttgtggcg | 92129 | W83337 | cgtaaactacactcagctagtcgat |
| 6922 | W50374 | tgattcgcaggattccaaaatccc | 49526 | X06368 | tgctcacacccgcaagttgagtc | 92130 | W83337 | tgtccgctccatgcacgaattctca |
| 6923 | W50374 | gtggctccgttccgacacaatccccg | 49527 | X06368 | tttacttcctcaggaggagagagaa | 92131 | W83337 | tccgctccatgcacgaattctcagc |
| 6924 | W50374 | atgagcccttggcagatgtccagge | 49528 | X06368 | actttcctcagggatgagaagacag | 92132 | W83337 | gttcgtctgcatcgtcaccaacgt |
| 6925 | W50374 | cagatgccagcgctgctccca | 49529 | X06368 | acatgtttctgcgtgtgcggctgga | 92133 | W83337 | ttcgtgtgcatcgtcaccaacgtg |
| 6926 | X60103 | ctcaataccgaagcacatcattgt | 49530 | X06368 | tgttctgcgtgtgcgggcgact | 92134 | W83337 | tcgtgtgcatcgtcaccaaacgtggc |
| 6927 | X60103 | accagaagcacactcattggccctg | 49531 | X06368 | agtttaccagtgcacacaaggcctat | 92135 | W83337 | gtggtcatcgtcaccaaacgtggcc |
| 6928 | X60103 | agcacatcattggcctgaagg | 49532 | X06368 | ttaccagtgcacaaagcctatat | 92136 | W83337 | gtgcatcgtcaccaaacgtggcctg |
| 6929 | X60103 | tccacttgatgctactgtaggg | 49533 | X06368 | ccagtgacacaaagcctattatcaa | 92137 | W83337 | gcatcgtcaccaaagtggcctgca |
| 6930 | X60103 | ttgatgctactgtaggctcac | 49534 | X06368 | acacaaagcctattatcaacaaagt | 92138 | AA117227 | gacgagggcagcgagccaaggctg |
| 6931 | X60103 | cataggccaaacagtgagatgct | 49535 | X06368 | caaagcctattatcaacaaagttgc | 92139 | AA117227 | aaggctgccacgcgtgaccctgaag |
| 6932 | X60103 | gttcctgccatgtcccagtccca | 49536 | X06368 | tgcgacggctgaacttggcgtct | 92140 | AA117227 | ctgctgccaacgcgtgacgt |
| 6933 | X60103 | gtcctgtcatgctccagatccc | 49537 | X06368 | aaagcctattatcaacaaagttgct | 92141 | AA117227 | tgtccaacgcgatgacgtaccc |
| 6934 | X60103 | tgtcatgctccagatccctctt | 49538 | X06368 | tgaacttgtgcgtctcatgct | 92142 | AA117227 | tccaacgcattgacgtgaccccgc |
| 6935 | X60103 | ctcccagatcctctctgtgtgta | 49539 | X06368 | acttttgcgtctgcatgtctcta | 92143 | AA117227 | aggcattgacgtgaccgcagaa |
| 6936 | X60103 | atgtcacctgcaagaacaggagaag | 49540 | X06368 | ttgtggctcgtctcatgtctcac | 92144 | AA117227 | ttgacgtaccgcagaagaggtt |
| 6937 | X60103 | gtcaacagcaagatctgcctgca | 49541 | X06368 | tcggctctgcatctcatcaccg | 92145 | AA117227 | tgaccgcagaagagtttgatga |
| 6938 | X60103 | aggccagctgccctgcacatcac | 49542 | X06368 | gctctgtctcatctacaccccgaa | 92146 | AA117227 | gagatgatccattgctgctggtgg |
| 6939 | X60103 | acatcactgactgccactgaaggg | 49543 | X06368 | tgctcatgctcaccgcaagtt | 92147 | AA117227 | gttgagaataccactcactgtaat |
| 6940 | X60103 | ctgactgccactgaagggcaactc | 49544 | X06368 | tcatgctcacaccgcaagttga | 92148 | AA117227 | ccactcactgaatttgctactt |
| 6941 | X60103 | gcaactcaagtatccaactgtga | 49545 | X06368 | ccctcagctcagtgaaacgcaa | 92149 | AA117227 | actcactgaatttgcttacgc |
| 6942 | X60103 | actgtgactacagaagaccactcaata | 49546 | X06368 | gttggacagctgcttcactacag | 92150 | X53028 | ctgacacgtgacccctgcggagagag |
| 6943 | X60103 | agaccactcaataacgaagacat | 49547 | X06368 | acgagcctttcactgaaggaccaca | 92151 | X53028 | gggtcacttcaaacagcggatcac |
| 6944 | X60103 | taaacgttcgtccaatgggtgtg | 49548 | X06368 | gacaccattgattccaccaaggga | 92152 | X53028 | acttcaaacaggatcactgccaga |
| 6945 | W50375 | tggcttcaatggtgtgtgatcca | 49549 | X06368 | attgattccaccacaggcaaagc | 92153 | X53028 | ttcaaacaggatcactgcgacca |
| 6946 | W50375 | gcctgatgccagttccagttcgcgccgaa | 49550 | X06368 | tcacccacaggcagaagcagaatt | 92154 | X53028 | aacaggatcactgcagacctgct |
| 6947 | W50375 | ctgatgccagttgccgagcgcgcga | 49551 | X06368 | atcttgcagaatgctaatgccat | 92155 | X53028 | atcactgcagacctgtccaaacg |
| 6948 | W50375 | tgcccgttgccgagcgaaaagtc | 49552 | X53028 | atgcaatggatgctcagcgtgactgt | 92156 | AA117227 | ctgacgcctgctgccaacggcat |
| 6949 | W50375 | gccagtgccgagcgaaaagtcat | 49553 | X53028 | tgtgactagcgtgactgtagcgta | 92157 | AA117227 | gcagacctgctccacgcggcattg |

TABLE 1-continued

| SEQ ID NO | sequence | DBAxnID | SEQ ID NO | sequence | DBAxnID |
|---|---|---|---|---|---|
| 6950 | agtagagatcgcaccactatttat | W50375 | 49554 | atctctcctgcaaaatagatgtttc | X53028 | 92158 | tgcacgacacagtcatctccaagtg | AA117284 |
| 6951 | tagagatcgcaccactatttatg | W50375 | 49555 | atgtttcagtgtctgtgacaatga | X53028 | 92159 | gcacgacacagtcatctccaagtgc | AA117284 |
| 6952 | gagatcgcaccactatttattgat | W50375 | 49556 | acaatgaccgttactgtgttga | X53028 | 92160 | aagccttgcatatcatagtacact | AA117284 |
| 6953 | tgcaccactatttatgaag | W50375 | 49557 | ccagctgcttcactacagaagaag | X53028 | 92161 | gccttgcatatcatagtacactcc | AA117284 |
| 6954 | gcaccactatttatgatgaagt | W50375 | 49558 | gcttcactacaggaaggaggcagac | X53028 | 92162 | tgcatatcatagtacactccaagta | AA117284 |
| 6955 | accactatttatgatgaagttg | W50375 | 49559 | tttctacgactcggagggacagatg | X53028 | 92163 | gcatatcatagtacactccaagtac | AA117284 |
| 6956 | gtgattccatatccagtcgccagg | W50375 | 49560 | gggcctccacaggaggcaaacgat | X53028 | 92164 | atatcatagtacactccaagtacat | AA117284 |
| 6957 | gattccatatccagtcgccaggt | W50375 | 49561 | tcaccaggaggcaaacgatgaaag | X53028 | 92165 | tatcatagtacactccaagtacatc | AA117284 |
| 6958 | ttccatatccagtcgccagggtg | W50375 | 49562 | ccagagagttcgacggcggaagag | X53028 | 92166 | atcatagtacactccaagtacatca | AA117284 |
| 6959 | ccatatccagtcgccagggtggt | W50375 | 49563 | cttggctgcgatgatctggaactc | X53028 | 92167 | catagtacactccaagtacatcaaa | AA117284 |
| 6960 | atccagtcgccagggttggtgtca | W50375 | 49564 | gttcagccagcggggcgacagttg | X53028 | 92168 | atagtacactccaagtacatcaaag | AA117284 |
| 6961 | ccagttcgccagggttggtcaat | W50375 | 49565 | ggagccaagttcagccagtggtcg | AA030895 | 92169 | ggcaaagccttgcaaatcaaagtt | AA117284 |
| 6962 | agttcgccagggttgtgtcaatat | W50375 | 49566 | agccaagttcagccatgcatggcgat | AA030895 | 92170 | acgacacagtcatctccaagtgcat | AA117284 |
| 6963 | ttcgccagggttgtgtcaatatgg | W50375 | 49567 | ctctctctatcctggcactgacgg | AA030895 | 92171 | cgacacagtcatctccaagtgcata | AA117284 |
| 6964 | ctgagtctgcagtcctgcgaggagat | W50375 | 49568 | tctctctatcctggcactgacggt | AA030895 | 92172 | gacacagtcatctccaagtgcataa | AA117284 |
| 6965 | agtctgcagtcctgaggagatccc | W50375 | 49569 | tctcctatcctggcactgacggtga | AA030895 | 92173 | cacagtcatctccaagtgcataaaa | AA117284 |
| 6966 | tacagaagatctggcccagagat | W50375 | 49570 | ccatatcctggcactgacggtgatct | AA030895 | 92174 | acagtcatctccaagtgcataaaat | AA117284 |
| 6967 | agatctgggcccagagatctgga | W50375 | 49571 | ctatcctggcactgacggtgatctc | AA030895 | 92175 | cagtcatctccaagtgcataaaata | AA117284 |
| 6968 | tctgggcccgagatcttggact | W50375 | 49572 | tcctggcactgacggtgatctcag | AA030895 | 92176 | taaagccctgcatatcatagtaca | AA117284 |
| 6969 | aggtggatctccatactgccaagg | W50375 | 49573 | ctgcactgacggtgatctcatgtg | AA030895 | 92177 | aaagccctgcatatcatagtacac | AA117284 |
| 6970 | tggatctccatactgccaaggct | W50375 | 49574 | tggcactgacggtgatctcatgtgg | AA030895 | 92178 | tacaattacaactccaactctttag | AA117284 |
| 6971 | atcctcactcgccaaaggtctttt | W50375 | 49575 | gcactgacggtgatctcatgtggtt | AA030895 | 92179 | tattacaatcaactcttaagggact | AA117284 |
| 6972 | tccatctgccaaaggtctttccg | W50375 | 49576 | cactgacggtgatctcatgtggttc | AA030895 | 92180 | gcttgcagacttggagtcgagcaggt | AA117286 |
| 6973 | gtcttttccggtcagtcccag | W50385 | 49577 | gccaagttcagccatgtcgcagtc | AA030895 | 92181 | agactttggagtcgcagtcaactt | AA117286 |
| 6974 | tcccagtgggccgtccaagtccag | W50385 | 49578 | tgacggtcatctcggtctcc | AA030895 | 92182 | ctttggagtcgcaggtcaacttaca | AA117286 |
| 6975 | ggccgtccactgcgatctatgagc | W50385 | 49579 | caagttcagccatggtgcgatccg | AA030895 | 92183 | aaggtcaacttacagatacccatggca | AA117286 |
| 6976 | ctgagtccactggcgagatcccagc | W50385 | 49580 | gttcagccatggtgcgatccgaaa | AA030895 | 92184 | tcaacttacagataccatgccaaag | AA117286 |
| 6977 | gtctgaggggcctgccgtaag | W50385 | 49581 | tttcagccatggtgcgatccgaaac | AA030895 | 92185 | aacttacagatatcatcggcaaagg | AA117286 |
| 6978 | cagtctgcgaaggggcctgcgccat | W50385 | 49582 | cagccatgtgcgatccgaaagag | AA030895 | 92186 | cagataccatggcaaagaggaatac | AA117286 |
| 6979 | tcctgaggagatccagccatcat | W50385 | 49583 | gccatgtgcgatccgaaagaagct | AA030895 | 92187 | ggctccgaagttattcaggaaatt | AA117286 |
| 6980 | agggagatccagccatcatgctcat | W50385 | 49584 | tgctgccgggctctccctatcctg | AA030895 | 92188 | acatctggtctcgggaataactgc | AA117286 |
| 6981 | agatccccagccatcagctatcacaa | W50385 | 49585 | ggctctccctatcctggcactgac | AA030895 | 92189 | aactgccatagaaatggctgaagga | AA117286 |
| 6982 | tcccagccatcagtctatacagaa | W50385 | 49586 | ctgcctcatgagaccacagccc | AA030895 | 92190 | tacaatccaacttaaggagctaga | AA117286 |
| 6983 | cagccatcagtctatacagaat | W50385 | 49587 | tcatgagacaccagccctg | AA030895 | 92191 | actagaatacctcatttatgaga | AA117286 |
| 6984 | ccatcagtctatacagaagatcgt | W50385 | 49588 | gccctgaagggcctcaatcact | Y00746 | 92192 | tagaatacctcattttatgaaaa | AA117286 |
| 6985 | cctgcactcgtgcccaaaatcatg | U00677 | 49589 | gggaggccttcaatcacctagagct | Y00746 | 92193 | tacacgagatatcaaggcgggaaa | AA117286 |
| 6986 | tccaaaacgatgtcttttatcatc | U00677 | 49590 | atccactagagctgcgaagtccga | Y00746 | 92194 | acacgagatatcaaggcgggaaat | AA117286 |
| 6987 | acctggcgacgagtcggggtgt | U00677 | 49591 | tagagctgcagtcgagtctggc | Y00746 | 92195 | atatttgctaaacacgaagggcca | AA117286 |
| 6988 | gagtctcgctgtgtggcagct | U00677 | 49592 | tgacagagctggccagtatggcat | Y00746 | 92196 | tatttgctaaacacgaagggccat | AA117286 |
| 6989 | ggcttgttgggcagccttcctac | U00677 | 49593 | agctgccagtatggcatcattta | Y00746 | 92197 | gctaaaacagaaggccatgccaaag | AA117286 |
| 6990 | accagtgcctttctaagagatat | U00677 | 49594 | tcatttagtcagatccctgctgt | Y00746 | 92198 | aaagctccaagatgggtgaaagt | AA117313 |
| 6991 | gtacacagaagccattccgagccctg | U00677 | 49595 | agtcagaccctgctatgctgaggcc | Y00746 | 92199 | agctccaagatgggtgaaagtc | AA117313 |
| 6992 | agaagccattccgagccctgaacct | U00677 | 49596 | atccctgctatgtgagcctgggaa | Y00746 | 92200 | atttcaggaaggctctcgttta | AA117313 |
| 6993 | ggcctcaagcaccctgagatctc | U00677 | 49597 | tgccaacctgagaattgtaatag | Y00746 | 92201 | ttcaggaagctccgttagtg | AA117313 |
| 6994 | taagcacctgagatctgcagc | U00677 | 49598 | ccagccaagtttcgacagtccaga | Y00746 | 92202 | caggaagctccgtgtgagtag | AA117313 |
| 6995 | agatctgcagcgagctctg | U00677 | 49599 | agggtcactgcagtgtctgccag | Y00746 | 92203 | gggaagctccgttagtgagcc | AA117313 |
| 6996 | ctgagtctcgcagtcagttgcgca | U00677 | 49600 | ccatgaacctgggcagcacccaagg | Y00746 | 92204 | gaagctccgttagtggccta | AA117313 |
| 6997 | gctcttgcctagaactgaagcct | U00677 | 49601 | gaccacactaagttaagcacgcgga | Y00746 | 92205 | agctccgtgttagtgagcctaa | AA117313 |
| 6998 | tgcaccagtccttctaagaggatcagat | U00677 | 49602 | tcattagtcagacctgtgcatgt | Y00746 | 92206 | ctccgttagtgagcctaaagc | AA117313 |
| 6999 | tgtcctctgcgactgcctgctg | U00677 | 49603 | aaaccaggcagttcaaggcaagcc | Y00746 | 92207 | ctccgttagtgagcctaaagcac | AA117313 |

| SEQ ID NO | sequence | DBAxnID | SEQ ID NO | sequence | DBAxnID | SEQ ID NO | sequence | DBAxnID |
|---|---|---|---|---|---|---|---|---|
| 7000 | tctgctgactgcctgcctgctgtctggg | U00677 | 49604 | tcacgtcatctgcctgcctgggagc | Y00746 | 92208 | tagtgagctaaagcaccaaggca | AA117313 |
| 7001 | gggcctcagaaccagcctgaagaa | U00677 | 49605 | tcatctgccctggaggccttcaa | Y00746 | 92209 | gtgagcctaaagcaccaaggcaac | AA117313 |
| 7002 | cagagaccagcgtgaggaagcagaa | U00677 | 49606 | tagcttggctgacaggagagccagg | X67083 | 92210 | ctctccaagatgggtgaaagttcac | AA117313 |
| 7003 | agcagaactcagaccgggaacaggg | U00677 | 49607 | cagagtcaacgcacatcccaaag | X67083 | 92211 | tggaacagagtccagtgtttataa | AA117313 |
| 7004 | actcagaccgggacagcgagtctg | U00677 | 49608 | gcctgcaccaagcatgaacagtggg | X67083 | 92212 | gacacagagtccagtgttataatc | AA117313 |
| 7005 | tccaatcagttcactctgaacaag | K02927 | 49609 | ggaagtgtaccccagcaccatcgcgc | X67083 | 92213 | aagattgcattcacagagtggatg | AA117313 |
| 7006 | gaaacacagcagccatggtgtgctct | K02927 | 49610 | atcgcgcaagtggccagccatggac | X67083 | 92214 | gatgtcattcacagaggtggattgaa | AA117313 |
| 7007 | aaagccagtttgatattaggaaatc | K02927 | 49611 | ccaagcatggacccctgccactgcac | X67083 | 92215 | ttgcattcacagaggttgattgaacc | AA117313 |
| 7008 | aatactaaagagccttcctgcaaat | K02927 | 49612 | atgtgacccctgcactgcactgcaca | X67083 | 92216 | gccaactatgctgtgatgcatatt | AA117313 |
| 7009 | ccttcctgcaaatagtgaggagact | K02927 | 49613 | ccctgcactgcactgcacatgacggtaca | X67083 | 92217 | caactatgctgtgatgcatattc | AA117313 |
| 7010 | agtctcgtctccagcttcctccg | K02927 | 49614 | ctctgcacatagagctacatagacggtaca | X67083 | 92218 | agtcctttatcaagctgcacctg | AA117363 |
| 7011 | ttccctgcctggccattctcagttt | K02927 | 49615 | cttgcacatagacgttacatcagtgtttt | X67083 | 92219 | gtcacctgaacgtagaatccaggt | AA117363 |
| 7012 | gcctggccattctcagtttggccaa | K02927 | 49616 | atgttattactgtccatgtccag | X67083 | 92220 | acagtcctctcacagacagactcc | AA117363 |
| 7013 | ccattcagtttgggcaaagagat | K02927 | 49617 | tattactgtccagtcagtaaagt | X67083 | 92221 | agtcctctcacagacagactcctc | AA117363 |
| 7014 | caagcaattactcatcagctaaaga | K02927 | 49618 | gctctccagattccagtcagagttc | X67083 | 92222 | cttcacagacagactcctcagag | AA117363 |
| 7015 | attactcatcagctaaagactctttg | K02927 | 49619 | cagattccagtcagagttctatggc | X67083 | 92223 | cttcacagacagactcctcagaggc | AA117363 |
| 7016 | gtctagacaaactctatagctcat | K02927 | 49620 | agagttatatggcccaggagagga | X67083 | 92224 | tcacagacagactcctcagaggcg | AA117363 |
| 7017 | agcagccatggtgtgctcttggag | K02927 | 49621 | tggcacagctagctgaagagaacga | X67083 | 92225 | ttttagcaggcaaatgtatatgtc | AA117363 |
| 7018 | catgggtgtgctcttggagaacaga | K02927 | 49622 | agaacgacgcggctcaagcaggaagaat | X67083 | 92226 | atgtatatgtccacatatctcgga | AA117363 |
| 7019 | ttatcagcagcctgctggacgtg | K02927 | 49623 | agaccaacggcgggctctgatcga | X67083 | 92227 | gtatatgtccacatatctcggatgt | AA117363 |
| 7020 | gcagctctgttgacgtgcctgcc | K02927 | 49624 | tgatcagccatggtcagcctgca | X67083 | 92228 | atatgtccacatatctcggatgct | AA117363 |
| 7021 | agggagccacgactactacgtactgt | K02927 | 49625 | tggtcagcctgcaccaagcatgaac | X67083 | 92229 | atgtccacatatctcggatgctgc | AA117363 |
| 7022 | cttacagtactgtttctcacacagtg | K02927 | 49626 | tgctttcacagtcagttaaacc | X67083 | 92230 | cacctgaacgtagaatccaggtat | AA117363 |
| 7023 | gtactgtttctcacacagtaaata | K02927 | 49627 | ttcacagtcagttaaacctcacagtct | X67083 | 92231 | gtccacatatctcggatgctgeat | AA117363 |
| 7024 | tttctcacagtaaatatcattt | K02927 | 49628 | cagagtttcactcacattcctct | X67083 | 92232 | agaatccagtatgcacatgcctat | AA117363 |
| 7025 | gtgaccgtcagcctgctttcg | K02927 | 49629 | ccctttacaagaatgtcaagtg | X67083 | 92233 | tccaggtatgcacatgcctacat | AA117363 |
| 7026 | gcaccgatccagctgcttttcgcc | X15666 | 49630 | aggatcactgttccattcagaagaa | D17384 | 92234 | ttatacagagcgagcctccttca | AA117363 |
| 7027 | accggtcctggccagcaaagctg | X15666 | 49631 | actgttccattcagaagaatgggac | D17384 | 92235 | atacagagcgacagtcctcttcaca | AA117363 |
| 7028 | ccgggtcctggccagcaaagctgcg | X15666 | 49632 | atgggaacagctgaccaggatccag | D17384 | 92236 | acaggcgacagtcctcttcacaga | AA117363 |
| 7029 | tggccagcaaagctgcgaggagaat | X15666 | 49633 | cacagtcgacaggatccagtgctg | D17384 | 92237 | aggagacagtcctcttcacagacaga | AA117363 |
| 7030 | gccagcaaagctgcgaggagaatct | X15666 | 49634 | gatccagtcgctgagtctggatttcatc | D17384 | 92238 | cgacagtcctcttcacagacagact | AA117363 |
| 7031 | aatctccaagactccgccgagctg | X15666 | 49635 | atggcagcctttaaatactatctat | D17384 | 92239 | ataccaattcagcaccttaattgt | AA117363 |
| 7032 | gggcctactaaccccagctgagg | X15666 | 49636 | gcctaaatacttattctattgct | D17384 | 92240 | ctagcacctaattgtaccctgct | AA120054 |
| 7033 | gggcctactaaccccagcgttgagg | X15666 | 49637 | tattgtgatctgtacctaagaataa | D17384 | 92241 | cgtctgtatgtgccgccacacac | AA120054 |
| 7034 | ctactaaccccagcgttgaggtga | X15666 | 49638 | taaataccttgcagctactgctgcta | D17384 | 92242 | aacacacagcactgacaaattcatt | AA120054 |
| 7035 | actaaccccagcgttgaggtgagagc | X15666 | 49639 | ctgttcagctactgctacaaagca | D17384 | 92243 | cactctttccgatccttgtctaa | AA120054 |
| 7036 | accccagcgttgaggatgagccgtt | X15666 | 49640 | ctgctacacagcatggctgatttca | D17384 | 92244 | tgctaatacactctttaacgtatac | AA120054 |
| 7037 | ttccagctgttgcctgtctc | X15666 | 49641 | atggctgattcagtgctgctttc | D17384 | 92245 | tctcacttccacagctatataatc | AA120054 |
| 7038 | catctgctgaccagcagcagctgcag | X15666 | 49642 | gatttcagtgctgctttcatataa | D17384 | 92246 | cacttccacaagctatataatcctcc | AA120054 |
| 7039 | gctgaccagcagctgcagtgt | X15666 | 49643 | agtgctgctttcatataatgggtg | D17384 | 92247 | ttccacacgctatatataatcctcatt | AA120054 |
| 7040 | tgacctaaccagcgttgcagttcg | X15666 | 49644 | ttcaacattccacagtttcact | D17384 | 92248 | agctatataatctccattggaagc | AA120054 |
| 7041 | gaaagactcacccggctgacaag | X15666 | 49645 | attcaccacagtttcactcacat | D17384 | 92249 | ctatataatccattggaagcaag | AA120054 |
| 7042 | agcgactcaccagcgtgacaagga | X15666 | 49646 | atgtactgcactactagacaca | D17384 | 92250 | tataatctccattggaagcaaggcc | AA120054 |
| 7043 | tacccggctgacaaggagaaacac | X15666 | 49647 | actgactgcactactagacacaggt | Z50013 | 92251 | ttgtacctcggcttgtcagcaat | AA120054 |
| 7044 | accaccggtgacaaggagaacacgc | X15666 | 49648 | tgacctggtccgtgctgagttgag | Z50013 | 92252 | tacctcggctgtcagcaatcag | AA120054 |
| 7045 | gctgctcacctatcgatgatagcc | W50285 | 49649 | ggctgctgcactgtgagtctcgg | Z50013 | 92253 | tgtttagcaatcagcacatttga | AA120054 |
| 7046 | gcctctcactttatcgatgatagcc | W50285 | 49650 | tcgcactgtgagtctgcgcaggggc | Z50013 | 92254 | tagcaatcagcacattggactc | AA120054 |
| 7047 | tttagcgctcagctgctctct | W50285 | 49651 | tgtgactcgcaggcccaggac | Z50013 | 92255 | cagcaatcagcacattggactccc | AA120054 |
| 7048 | gccctcggccattagccgc | W50285 | 49652 | tcaggaacctgctcgcagctaggc | Z50013 | 92256 | tcgacattgactcccgtcga | AA120054 |
| 7049 | gccctctgccattgccattaggggt | W50285 | 49653 | tcgcagtgccatccacacatt | Z50013 | 92257 | gcacatttgactccccgtctgatag | AA120054 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 7050 | W50285 | ctctcgccattgctaggggtcta | 49654 | Z50013 | ctatgcatccctactattgaaaca | 92258 | AA120054 |
| 7051 | W50285 | tgcgccattgcttaggggtctagccg | 49655 | Z50013 | catccctacattgaaacatcagcc | 92259 | AA117444 |
| 7052 | W50285 | gcattgctttaggggtctagccgat | 49656 | Z50013 | ctatacactagtccgtgattcgg | 92260 | AA117444 |
| 7053 | W50285 | ttgcttaggggtctagcgagtcgg | 49657 | Z50013 | actagtccgtgagattcgcagcat | 92261 | AA117444 |
| 7054 | W50285 | ggaacaggatctcatcgacgtccgc | 49658 | Z50013 | ctacttagacacagcaggtcaagaa | 92262 | AA117444 |
| 7055 | W50285 | ggatccatcgacgtccgctcac | 49659 | Z50013 | agagtatagtgccatgcgggaaccag | 92263 | AA117444 |
| 7056 | W50285 | catccatcgacgtccgctcacgaatgg | 49660 | Z50013 | tgtattgccatcaacaacaccaag | 92264 | AA117444 |
| 7057 | W50285 | tcacctatcgatgtagcccgcgaa | 49661 | Z50013 | tgccatcaacaacaccaagtcctc | 92265 | AA117444 |
| 7058 | W50285 | cgtccgctcacgaatggaagtcg | 49662 | Z50013 | caccaagtcctcgaggacatccat | 92266 | AA117444 |
| 7059 | W50285 | tatcgatgtagcccgcgaacgtcgt | 49663 | Z50013 | cgaggacatccatcagtacgagggag | 92267 | AA117444 |
| 7060 | W50285 | cgatgtagcccgcgaacgtcgttga | 49664 | Z50013 | catccatcacagtacaggagcagatc | 92268 | AA117444 |
| 7061 | W50285 | tgtagcccgcgaacgtcgttgagcg | 49665 | Z50013 | caagtgacctgcgctcgcact | 92269 | AA117444 |
| 7062 | W50285 | agcccgcgaacgtcgttgagcgcct | 49666 | Z50013 | tgagatgttcagttcctgctcatt | 92270 | AA117444 |
| 7063 | W50285 | ccgggaacgtcgttgaggcctgca | 49667 | Z50013 | gatgctcagttcctgctcattag | 92271 | AA117444 |
| 7064 | W50285 | cgaacgtcgttgaggcctgcagt | 49668 | Z50013 | cattggactctcatgtgcgagaccca | 92272 | AA117444 |
| 7065 | W50285 | acgtcgttgaggcctgcagctgct | 49669 | Z50013 | cttcatgtcgagaccccatgccag | 92273 | AA117444 |
| 7066 | W50285 | cggagcgtatccgcttccatccg | 49670 | Z50013 | gtgcagagaccacgccaggatggt | 92274 | AA117444 |
| 7067 | W50285 | ggagagctatccgctccatccga | 49671 | Z50013 | tgtctggcttcctagccattgcact | 92275 | AA117444 |
| 7068 | W50285 | aaacctgccggagcccgatgaagct | 49672 | Z50013 | ctggattccctagcccattgcactgca | 92276 | AA117444 |
| 7069 | W50288 | accctgccggagccgatgaagcta | 49673 | Z50013 | gctctagccattgcactgcaggt | 92277 | AA117444 |
| 7070 | W50288 | accctgccggagccgatgaagctat | 49674 | Z50013 | tcctagccattgcactgcaggtgg | 92278 | AA117444 |
| 7071 | W50288 | ccctgccggagccgatgaagctat | 49675 | Z50013 | tagccattgcactgcaggtgggaac | 92279 | AA117444 |
| 7072 | W50288 | ctgccggagccgatgaagctatagga | 49676 | Z50013 | ccattgcactgcaggtgggaacatg | 92280 | AA117446 |
| 7073 | W50288 | tgccggagccgatgaagctatggat | 49677 | Z50013 | ttgcactgcaggtgggaacatgcg | 92281 | AA117446 |
| 7074 | W50288 | tgtaccagaagaactagaaaagca | 49678 | Z50013 | gcttcagttcctgctcattagga | 92282 | AA117446 |
| 7075 | W50288 | agagcgaaaccttagtctgatgca | 49679 | Z50013 | tgtaggctccgtcgtcgatttgtt | 92283 | AA117446 |
| 7076 | W50288 | agagcgaaaccttagtctgatgcata | 49680 | Z50013 | aggccgccgtcgatttgttgcc | 92284 | AA117446 |
| 7077 | W50288 | ggaaaccttagtctgatgatcat | 49681 | Z50013 | ctccgtcgcgtcgatttgttgccggt | 92285 | AA117446 |
| 7078 | W50288 | gagcagctatccgcttccatccgac | 49682 | Z50013 | cgtcgtcgatttgttgccggt | 92286 | AA117446 |
| 7079 | W50288 | agcagctatccgcttccatccgacg | 49683 | Z50013 | attgttgccggcccatagac | 92287 | AA117446 |
| 7080 | W50288 | gcagctatccgcttccatccgacgt | 49684 | Z50013 | cgggcccatggactcatgtgc | 92288 | AA117446 |
| 7081 | W50288 | tatccgcttccatccgacgtgcaaa | 49685 | AA031030 | tgccctcatggactcatgtcgcag | 92289 | AA117446 |
| 7082 | W50288 | atccgcttccatccgacgtgcaaa | 49686 | AA031030 | tcctacaagattcaggtaggttgc | 92290 | AA117446 |
| 7083 | W50288 | gcttccatccgacgtgcaaacc | 49687 | AA031030 | ttaggcggttgccatgaacctg | 92291 | AA117446 |
| 7084 | W50288 | tgcaaacctgccggagccgatgaa | 49688 | Y00864 | gttaccgcgtctgttgaaacatg | 92292 | AA117446 |
| 7085 | W50288 | caaacctgccggagccgatgaagc | 49689 | Y00864 | acccggtcgtttgaaacatgt | 92293 | AA117446 |
| 7086 | M96760 | gaaacctgcagggttatcaggca | 49690 | Y00864 | tactaagggccaccaccatgaga | 92294 | AA117446 |
| 7087 | M96760 | cctcccaaggaagttctagcgagg | 49691 | Y00864 | agggggccaaccatgagaattttg | 92295 | AA117446 |
| 7088 | M96760 | acaatcgttactcagactcagga | 49692 | Y00864 | ctttcagttgctgattgaat | 92296 | AA117446 |
| 7089 | M96760 | tatcttttcctggggctgaaag | 49693 | Y00864 | tcagttgctgattgaattt | 92297 | AA117446 |
| 7090 | M96760 | tttcctggggctgaaagatacatac | 49694 | Y00864 | tttgaatattccgagcccatgagt | 92298 | AA117446 |
| 7091 | M96760 | gcccacacgactcggctgaggagg | 49695 | Y00864 | gaatattccgagcccatgaatcc | 92299 | AA117446 |
| 7092 | M96760 | aagccagcacctggctgaggccccac | 49696 | Y00864 | tgagcccatgagtcctgaaaatat | 92200 | AA117446 |
| 7093 | M96760 | cctcccaaggaagttctagctgagg | 49697 | Y00864 | gtgtccaagtgttgacagttctga | 92301 | AA117453 |
| 7094 | M96760 | atccaggtcgtccggaacccagt | 49698 | Y00864 | atcgttccgactgagtcgtcact | 92302 | AA117453 |
| 7095 | M96760 | aaccaccaggttgaagaacagatga | 49699 | Y00864 | aactgttcagtctgaagaattc | 92303 | AA117453 |
| 7096 | M96760 | atgtttcagcatccagatttctaca | 49700 | Y00864 | tcgacttagtgctacactcttgca | 92304 | AA117453 |
| 7097 | M96760 | ctagcatccagattctacaataaag | 49701 | Y00864 | tgagtgctacacctctgcactttc | 92305 | AA117453 |
| 7098 | M96760 | tcaaggcacacgagaagtattctgg | 49702 | Y00864 | gtgctacacctctgcacctttcaa | 92306 | AA117453 |
| 7099 | M96760 | gctgcacctattgctgcagattc | 49703 | Y00864 | tcttgcacctttccaaagtaagctg | 92307 | AA117453 |

| SEQ ID NO | DBAxnID | SEQ ID NO | sequence | DBAxnID | SEQ ID NO | sequence | DBAxnID |
|---|---|---|---|---|---|---|---|
| 7100 | M96760 | 49704 | tgcacttccaaagtaagctgtt | Y00864 | 92308 | tctcagcgtcctgcctgctgga | AA117453 |
| 7101 | M96760 | 49705 | ttggagtcctggtcatgtacga | Y00864 | 92309 | cgtccgctcctgctgctggacagaaa | AA117453 |
| 7102 | M96760 | 49706 | acgagactgtcaccagttaccgc | Y00864 | 92310 | cctgctccgtcctggacacagaagaa | AA117453 |
| 7103 | M96760 | 49707 | cagtcggggactgcatgcaggtacct | AA031112 | 92311 | gctcctgctggacagaagaagga | AA117453 |
| 7104 | M96760 | 49708 | atgcggggacctgtccagaggcc | AA031112 | 92312 | aacatgtcaaactctggagattgt | AA117453 |
| 7105 | M29015 | 49709 | taccctgcacctgctgcacatct | AA031112 | 92313 | gattgtcatgagcgtgcagtcac | AA117453 |
| 7106 | M29015 | 49710 | accgtgcacctggtcgcacatcg | AA031112 | 92314 | tgttcatgcgctgcagtcactca | AA117453 |
| 7107 | M29015 | 49711 | cgtgcacctggctgcaatctggcc | AA031112 | 92315 | ttcatgagcgtgcagtcactcaag | AA117453 |
| 7108 | M29015 | 49712 | gtgcacctggtgcacatctggcc | AA031112 | 92316 | agcgtgcagtcactcaatggggatt | AA117453 |
| 7109 | M29015 | 49713 | tgcacctggctgcacatctggccag | AA031112 | 92317 | cagtcactcaatgggattcttacc | AA117453 |
| 7110 | M29015 | 49714 | gcacctggctgcacatctggccgg | AA031112 | 92318 | gtagggaccccagccaatagccaatc | AA117453 |
| 7111 | M29015 | 49715 | tgcgagtaccgtccagaggcct | AA031112 | 92319 | acccaggccaatatgccaaccagg | AA117453 |
| 7112 | M29015 | 49716 | ctgtccagaggcctttataccgtg | AA031112 | 92320 | tgcagtcggcgcctcatcagaacaa | AA117418 |
| 7113 | M29015 | 49717 | tgttccagaggccttataccgtgc | AA031112 | 92321 | agtcggccgtcatcagaacaatga | AA117418 |
| 7114 | M29015 | 49718 | caggagcttataccgtgcacctg | AA031112 | 92322 | ttcctccagttcaaggtacagga | AA117418 |
| 7115 | M29015 | 49719 | ctttataccgtgcacctggtcgac | AA031112 | 92323 | taaagatgccctgctgtgatg | AA117418 |
| 7116 | M29015 | 49720 | ttataccgtgcacctggtgcaca | AA031112 | 92324 | agagtgccctgctgtgtgata | AA117418 |
| 7117 | M29015 | 49721 | tgtcaccccatgtgattttgtaaatc | AA031112 | 92325 | gagtgccctgctgtgtgtgtataac | AA117418 |
| 7118 | M29015 | 49722 | agaactatttctgcaatcgcaaa | AA031112 | 92326 | gtccctgctgttggtgatacaa | AA117418 |
| 7119 | M29015 | 49723 | atctatttctggcaatcgcaaact | AA031112 | 92327 | ccctgctgttgggtgatacaacga | AA117418 |
| 7121 | M29015 | 49724 | tattttctggcaatcgcaaactg | AA031112 | 92328 | ccctgctgttggtgataaacgag | AA117418 |
| 7122 | M29015 | 49725 | ttctggcaatcgcaaaactgtgt | AA031112 | 92329 | gatacacgagggcgctaagttc | AA117418 |
| 7123 | M29015 | 49726 | gtgagactcacctagtttgaatt | AA031112 | 92330 | ataacacgagggcagcctaagttg | AA117418 |
| 7124 | M29015 | 49727 | tcctctggtatattgcctatg | AA031112 | 92331 | gctgcctcatcagaacaatgac | AA117418 |
| 7125 | M29015 | 49729 | cctcctgtatattgcctatg | AA031112 | 92332 | gctgcctcatcagaacaatgac | AA117418 |
| 7126 | AA033424 | 49730 | tgtgattgctcaatcccagttgtg | AA031112 | 92333 | tggcctcatcagaacaatgacac | AA117418 |
| 7127 | AA033424 | 49731 | gtgattgctcaatcccagttgg | AA031112 | 92334 | cactcaggctgctgttcctgggtc | AA117418 |
| 7128 | AA033424 | 49732 | tgattgctcaatcccagttgga | AA031112 | 92335 | ctcaggctgctgtccggtctc | AA117418 |
| 7129 | AA033424 | 49733 | gattgtcaatcccagttgtgac | AA031112 | 92336 | agcctgctgttcctgggtctcaac | AA117418 |
| 7130 | AA033424 | 49734 | attgctcaatcccagttgtgact | AA031112 | 92337 | ggctgctgttcctgggtctcaact | AA117418 |
| 7131 | AA033424 | 49735 | agaatggcccctgacggtatggagc | AA031112 | 92338 | ctgctgttccctgggctctcaactc | AA117418 |
| 7132 | AA033424 | 49736 | ttgctcaatcccagtgttgac | AA031112 | 92339 | ctgttcctggctctcaactctc | AA117418 |
| 7133 | AA033424 | 49737 | gcgcactggtcgtcagttgactg | AA031112 | 92340 | aagccaatcccagttggacgtga | AA117418 |
| 7134 | AA033424 | 49738 | gaatggccctgacggtatggagc | AA031112 | 92341 | tcaaggtgtctcctccagttcagg | AA117418 |
| 7135 | AA033424 | 49739 | gtatggacccggacgtctatctgag | AA031115 | 92342 | tccaacaattctgtctcgtattt | AA117418 |
| 7136 | AA033424 | 49740 | tggagccggagcgtctactgagagt | AA031115 | 92343 | aattctgtctggtattcattga | AA117418 |
| 7137 | AA033424 | 49741 | gagccggagcgtctactgagagtaa | AA031115 | 92344 | aagacatcttgcacatgaccat | U10871 |
| 7138 | AA033424 | 49742 | agccggagcgtctactgagagtaac | AA031115 | 92345 | tcttgcacatgaccatgctgtg | U10871 |
| 7139 | AA033424 | 49743 | gccgacgtctactgagagtaacg | AA031115 | 92346 | cacatgaccatgctgtgttaggg | U10871 |
| 7140 | AA033424 | 49744 | ccggagctgtctactgagagtaacgt | AA031115 | 92347 | ggctgttccagggactggactcg | U10871 |
| 7141 | AA033424 | 49745 | cgctcctggaagtccaatcattgg | AA031115 | 92348 | gttcaggactgaactgaactgctca | U10871 |
| 7142 | AA033424 | 49746 | gctccctggggttctggccaatga | AA031115 | 92349 | ggactgaactagaacggccagaa | U10871 |
| 7143 | M23453 | 49747 | tgtcctggggttctggccaatgag | W13236 | 92350 | tcttcatcagaagacaaggggaacga | U10871 |
| 7144 | M23453 | 49748 | tccctggggttctggccaatgaga | W13236 | 92351 | tcagtaataccacctcagttaaaata | U10871 |
| 7145 | M23453 | 49749 | cctctggggttctggccaatgaaac | W13236 | 92352 | gcaggaacccgaatcattggagc | U10871 |
| 7146 | M23453 | 49750 | ctctggggtctggccaatgaaact | W13236 | 92353 | aatcattggagcccagaaggaggc | U10871 |
| 7147 | M23453 | 49751 | ctgggttctggccaatgaaactgg | W13236 | 92354 | ggccaggttcacctcagttggtc | U10871 |
| 7148 | M23453 | 49752 | ttcggccaatgagaaactgctct | W13236 | 92355 | gtctcacccacctcagtgtcagttc | U10871 |
| 7149 | M23453 | 49753 | caatagaactgctccccgagcc | W13236 | 92356 | cacctcagtgcagtcaactcc | U10871 |
|  |  |  |  |  | 92357 | catgccatccatcagagtgggtta | U10871 |

TABLE 1-continued

| SEQ ID NO | sequence | DBAxnID | SEQ ID NO | sequence | DBAxnID |
|---|---|---|---|---|---|
| 7150 | gagccatttcttcagccaaacatcc | M23453 | 49754 | aatgagaacctgcctctcggagcc | W13236 | 92358 | atcccatcaagatgggttagtagca | U10871 |
| 7151 | ccatttctcagccaaacatcccat | M23453 | 49755 | atgagaacctgcctctcggagcc | W13236 | 92359 | gtgatttccaacaattcgctctgg | U10871 |
| 7152 | catttctcagccaaacatcccata | M23453 | 49756 | ctcctggaagtccaatcattgggt | W13236 | 92360 | catcacggaggcaccaccgacagc | W08014 |
| 7153 | attctcagccaaacatcccatat | M23453 | 49757 | tcctggaagtccaatcattgggct | W13236 | 92361 | aggaggcaccaccgacagctgccca | W08014 |
| 7154 | ttctcagccaaacatcccatatt | M23453 | 49758 | cctggaagtccaatcattgggctc | W13236 | 92362 | cattacagttctttgaggatgtt | W08014 |
| 7155 | ttctcagccaaacatcccatattt | M23453 | 49759 | gaagtccaatcattgggctctgtcc | W13236 | 92363 | tatcagttcttgaggatgtttgac | W08014 |
| 7156 | tcttcagccaaacatcccatattt | M23453 | 49760 | agtccaatcattgggctctgtcc | W13236 | 92364 | gctccaactgggcctcgtcgtgt | W08014 |
| 7157 | cttcagccaaacatcccatattta | M23453 | 49761 | gtccaatcattgggctctgtcct | W13236 | 92365 | gtgaaatatccaacaacgaggcca | W08014 |
| 7158 | gggtcaaatgccctggaactggaa | M23453 | 49762 | caatcattgggctctgtcctctg | W13236 | 92366 | tataccaacaacggccaattgaa | W08014 |
| 7159 | tgtcaaatgccctggaactggagt | M23453 | 49763 | aatcattgggctctgtcctctggt | W13236 | 92367 | aacgaggccaattgatggtggtgaa | W08014 |
| 7160 | gtcaaatgccctggaactggagtt | M23453 | 49764 | tgatctgccacaggaccacagtgcca | W13236 | 92368 | agatatacgatcattgacaagtca | W08014 |
| 7161 | tcaaatgccctggaactggagtta | M23453 | 49765 | atctgccacaggaccagtcgaag | W13236 | 92369 | tatacgcatcatgacaagtcaggt | W08014 |
| 7162 | aattatggagcattgctctcagcca | M23453 | 49766 | cttcacgcgagccacttagctt | W13236 | 92370 | acgatcattgacaagtcaggttcc | W08014 |
| 7163 | attatggagccattcttcagccaa | M23453 | 49767 | ttcacgcgagccacttagcttgt | W13236 | 92371 | tgacaagtcaggttccacagtcacc | W08014 |
| 7164 | ttatggagccattcttcagccaaa | M23453 | 49768 | gacgagccacttagcttgtccac | W13236 | 92372 | aggcaccacccgacagtgcccagt | W08014 |
| 7165 | atggagccattcttcagccaaaca | M23453 | 49769 | cggagcccacttagctgtccacat | W13236 | 92373 | gtcaggttccacagtcaccgctgct | W08014 |
| 7166 | gaccaagtcgtctagaagttgct | M23453 | 49770 | gagcccacttagctgtccacagt | W13236 | 92374 | caccacgaagtcgcccagtgaa | W08014 |
| 7167 | caagtcgtctagaagttgctgac | M23453 | 49771 | gccacactagcttgtccacatgat | W13236 | 92375 | caccgacagtcgcccagtggaagc | W08014 |
| 7168 | agctcgcaaacatctgatctgctt | W50468 | 49772 | actagcttgtccacatgtactca | AA031158 | 92376 | cagctccagttggaagctggtcc | W08014 |
| 7169 | gctcgcaaacaatcgatctgctt | W50468 | 49773 | ttagctgtccacatgtatctcaat | AA031158 | 92377 | ccccacatgggtctccgtgatg | W08014 |
| 7170 | gctcgcaaacaatcgatctgttc | W50468 | 49774 | agctgtccacatgtatctcaatg | AA031158 | 92378 | gggtctccgtgatgttgacc | W08014 |
| 7171 | tccgcaaacaatcgatctgcttc | W50468 | 49775 | ctgtccacatgtatctcaatgca | AA031158 | 92379 | gctcctgtatggttgacact | W08014 |
| 7172 | cgcaaacaatcgatctgcttccct | W50468 | 49776 | tctgccacagtgaccagtccaagc | AA031158 | 92380 | gaccactgtccgagaatagtggga | W08014 |
| 7173 | gcaaacaatgctcgatctgctccct | W50468 | 49777 | tgtccaccagttatctcaatgcaac | AA031158 | 92381 | taatctcacgctgtgccagact | AA117492 |
| 7174 | acaatgcgatcgcttcccttgc | W50468 | 49778 | aggaccagtccaaggccaatcagat | AA031158 | 92382 | tccccatcagacgcggaatga | AA117492 |
| 7175 | tctgccaccggacacatgccgt | W50468 | 49779 | gaccagtccaaggccaatcagatct | AA031158 | 92383 | ggcctcaaagctcatccattctt | AA117492 |
| 7176 | ctgccaccgggacacatgccgtc | W50468 | 49780 | ccagtccaaggcaatcagatcttt | AA031158 | 92384 | ctctcaaagctcatccattctga | AA117492 |
| 7177 | acgtgtcctagaagttgctgacc | W50468 | 49781 | taaagttcgtggatggaatgccaac | AA031158 | 92385 | tcaaagctcatccattctttgagc | AA117492 |
| 7178 | aagtcgtctagaagttgctgacc | W50468 | 49782 | gatgaatgccaacttttcagcgag | AA031158 | 92386 | aagctcatccattctttgagacct | AA117492 |
| 7179 | ccgtgggcatcatgccgccaacag | W50468 | 49783 | tgaatgccaacttttcagacggagc | AA031158 | 92387 | ctcatccattctttgagaccatcac | AA117492 |
| 7180 | gtcgtctagaagttgctgaccct | W50468 | 49784 | aatgccaacttttcagacggagccca | AA031158 | 92388 | atcatttctttgagaccatcactg | AA117492 |
| 7181 | agttgctgacctaaatgctctgt | W50468 | 49785 | cgtggagactcctcatcaaggagacaa | Z49916 | 92389 | tcttttgagaccatcactgggga | AA117492 |
| 7182 | gttgctgacctaaatgctctgtt | W50468 | 49786 | agactacaacggctttcctgctc | Z49916 | 92390 | tctttggaccatcacttggggagaa | AA117492 |
| 7183 | ttgctgacctaaatgctctgttgta | W50468 | 49787 | gagggcatttcaacctgagcct | Z49916 | 92391 | ttgagaccacactggggagat | AA117492 |
| 7184 | ctgacctaaatgctctgttagtc | W50468 | 49788 | cattcaacctgagcccttcag | Z49916 | 92392 | ccatcactttggggaagaattgcacca | AA117492 |
| 7185 | cctaaatgctctgttagtccaag | W50468 | 49789 | caacctgagcccttcacggtcaca | Z49916 | 92393 | caccattgagcgggaatgaata | AA117492 |
| 7186 | cgagctcgcaaacaatgatctgc | W50468 | 49790 | gagcccttcaggttcacagatcac | Z49916 | 92394 | agaattgcaccgacagaacaactcc | AA117492 |
| 7187 | ttgtataacaccctccatgcttca | W54878 | 49791 | gctccgacaatgcctgtgaccag | Z49916 | 92395 | cattcagccggaatgaatatct | AA117492 |
| 7188 | tataacaccctccatgcttcagca | W54878 | 49792 | tgttctgagacacatgcccagag | Z49916 | 92396 | tggaatatcatttccagaaaatt | AA117492 |
| 7189 | gagaagtcagtcgtccgtcaaatcc | W54878 | 49793 | gagacacagcccagatggcaaac | Z49916 | 92397 | aattcttcctaaggctagaagact | AA117492 |
| 7190 | agtcagtcgtccgtcaaatccccaa | W54878 | 49794 | ggcaaacccagacccgtcaatccat | Z49916 | 92398 | tttttgatgccaacaaagcgtttagg | AA117492 |
| 7191 | ctcagtcgtcaatccaaatga | W54878 | 49795 | ccagacccgaatccatcgtt | Z49916 | 92399 | tagatgccaaagcgtttaggctg | AA117492 |
| 7192 | agctccgtcaatccaatgatt | W54878 | 49796 | cctgaatccatcgtttaattag | Z49916 | 92400 | atgccaaaagcgtttaggctgta | AA117492 |
| 7193 | tccgtcaatccaaatgatttag | W54878 | 49797 | caacggcttcctgctgctgcc | Z49916 | 92401 | acgggcctctcaagctcatccatt | AA117492 |
| 7194 | gtcaaatcccaaatgatttatgaga | W54878 | 49798 | tgtgctgtccagagaactggag | Z49916 | 92402 | cgccgggaactcagagtccactga | W29527 |
| 7195 | aaatcccaaatgatttatgagatta | W54878 | 49799 | ctcgagcgtctcaccggttgcc | Z49916 | 92403 | gccccgaactcagagtccactgac | W29527 |
| 7196 | atgaacattcgttcgcattggta | W54878 | 49800 | gcgtctcaccgggtttgcccaagg | Z49916 | 92404 | tcagagtccactgactttccgca | W29527 |
| 7197 | atccgtttcgcattggtaacagca | W54878 | 49801 | aaatgccaggacggaggcaagaggge | Z49916 | 92405 | ttttgacagtgccaactgcaagcaag | W29527 |
| 7198 | cgtttgcattggttaacagcaaag | W54878 | 49802 | gagcaattccatcatgtaacttcaca | Z49916 | 92406 | ttgacagtgccaacgtcaagcaagt | W29527 |
| 7199 | acaccctccatgcttcagcatcacg | W54878 | 49803 | tgagctgctgccaacagccccat | Z49916 | 92407 | tgacagtgccaacgtcaagcaagtg | W29527 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 7200 | cctccatgcttcagcatatacgtca | W54878 | 49804 | tccactgaagctgaggcgcattttc | Z49916 | 92408 | gacagtgccaagtcaagcaagtgg | W29527 |
| 7201 | tgcttcagcatctacgtcatgggca | W54878 | 49805 | tggcttcctgtataatgtcaaaa | X78874 | 92409 | acagtgccaacgtcaagcaagtgga | W29527 |
| 7202 | ttcagcatctacgtcatgggcattg | W54878 | 49806 | agacctgactattgcaatagaaagt | X78874 | 92410 | cagtgccaagtcaagcaagtggac | W29527 |
| 7203 | agcactacgtcatgggcatgtcc | W54878 | 49807 | tggctgccagtgcctgtaact | X78874 | 92411 | agtgccaagtcaagcaagtggacg | W29527 |
| 7204 | tacgtcatgggcatggcctggaat | W54878 | 49808 | gtgccttaactcacaacgacgc | X78874 | 92412 | gtgccaacgtcaagcaagtggacgt | W29527 |
| 7205 | gtcatgggcatggtcctggaatgga | W54878 | 49809 | tcaacacgagcgcctccttggcatt | X78874 | 92413 | tgccaacgtcaagcaagtggacgtg | W29527 |
| 7206 | atgggcatggcctggaatggatca | W54878 | 49810 | agatatcctccgtcataggcccag | X78874 | 92414 | ccggaactcagagtccactgact | W29527 |
| 7207 | cagaggtaccaatcattccagt | W54878 | 49811 | cctccgtcatatggcccagacggca | X78874 | 92415 | ccggaactcagagtccactgactt | W29527 |
| 7208 | taccaattcattccagttgctc | W54878 | 49812 | tcatatgcccagacggcaaaccaa | X78874 | 92416 | gcgaactcagagtccactgactttt | W29527 |
| 7209 | tgctcggtagctgggtgattggaaga | K02060 | 49813 | gtcaactgagtcctgtagatgagg | X78874 | 92417 | cgaactcagagtccactgactttc | W29527 |
| 7210 | agacactgcaacattactcactg | K02060 | 49814 | aatagacaatcttaatctgcgg | X78874 | 92418 | gaactcagagtccactgactttcc | W29527 |
| 7211 | acactgcaacattactcactgaa | K02060 | 49815 | acaatcttaatctgcgggaactg | X78874 | 92419 | aactcagagtccactgactttccg | W29527 |
| 7212 | actcgcaacattactcactgaagg | K02060 | 49816 | ctttaactcggggactgctccat | X78874 | 92420 | actcagagtccactgactttccgc | W29527 |
| 7213 | tctgcaacattactcactgaaggcc | K02060 | 49817 | cagttcggtggtgtttgcacag | X78874 | 92421 | ctcagagtccactgactttccgcc | W29527 |
| 7214 | tgcaacattactcactgaaggctg | K02060 | 49818 | gtgttttgcacagcatatctcatct | X78874 | 92422 | caattcggttcgaggcgtcacagt | W08057 |
| 7215 | caacattactcactgaaggcctgag | K02060 | 49819 | gcatactccatctctccagcagaa | X78874 | 92423 | attcggttcgaggcgtcacagtga | W08057 |
| 7216 | attactcactgaaggccgtgagacgc | K02060 | 49820 | tccatctctccagcagaaagtcca | X78874 | 92424 | tccctggcacactccgtga | W08057 |
| 7217 | ctcactgaaggcctgagacgcagcc | K02060 | 49821 | tctctccagcagaaagtccacggcca | X78874 | 92425 | cgtttgcaaagcagtcacgcactg | W08057 |
| 7218 | cactgaaggcctgagacgcagcccc | K02060 | 49822 | aagcatcctgacatagagccctttt | X78874 | 92426 | tttccgcaaagcagtcacgcactga | W08057 |
| 7219 | cccatttcattccagttgctcgg | K02060 | 49823 | catgagcccttttacgttgacagac | X78874 | 92427 | tttccaaagcagtccactgag | W08057 |
| 7220 | ccatttcattccagttgctcgta | K02060 | 49824 | agacatcttcgaaagctggtcg | X78874 | 92428 | gcaaagcagtcacgcactgagccg | W08057 |
| 7221 | tttcattccagttgctcggtagc | K02060 | 49825 | aattatggaaccagtggggctg | X78874 | 92429 | aaagcagtcacgcactgagcgcga | W08057 |
| 7222 | tcatttccagttgctcggtagctg | K02060 | 49826 | gagaccagtggggctgtctgtgtca | X78874 | 92430 | aagcagtcacgcactgagcgcgat | W08057 |
| 7223 | atttccagttgctcggtagctgct | K02060 | 49827 | ggataaaacagaacccatagagc | X78874 | 92431 | agcagtcacgcactgagcgcggat | W08057 |
| 7224 | ccagttgctcggtagctgctggt | K02060 | 49828 | taacagaacccatagagcagttgtg | X78874 | 92432 | cagtcacgcactgagcgcggatctc | W08057 |
| 7225 | agttgctcggtagctgctggtgatt | K02060 | 49829 | aaccccatagagcagtgtgaacaat | X78874 | 92433 | agtcacgcactgagcgcggatctca | W08057 |
| 7226 | tttgctcggtagctgctggtgattgaa | K02060 | 49830 | tagatcccacagtgtttctgtgga | X78874 | 92434 | ttcggttcgcggcgtcacagtgaa | W08057 |
| 7227 | gttgctaccactactatgacgat | W50352 | 49831 | acatgtttcgtcctggataggg | X78874 | 92435 | gtcacgcactgcgcgggatctcaa | W08057 |
| 7228 | tgctaccactactatgacgatgc | W50352 | 49832 | gttcttgctccggatagtgagtt | Z22649 | 92436 | tcggttcgaggcgtcacagtgaag | W08057 |
| 7229 | cgatgtaccaaggttcgacgtttg | W50352 | 49833 | tgctccggatagtgagttgaaagg | Z22649 | 92437 | tgttggatacctgcaagcacga | W08057 |
| 7230 | tgttccgacgtgggcttagcactc | W50352 | 49834 | cccagcatctcaatactatttca | Z22649 | 92438 | tttcctatcctgagggcacactt | W08057 |
| 7231 | ttccgacgtgggcttagcatctcag | W50352 | 49835 | catcttcaatactatcacgatg | Z22649 | 92439 | tccctatcctgagggcacactttc | W08057 |
| 7232 | ggcttagcatctcaggaaggccaag | W50352 | 49836 | tattttcacgtatgacaggtgcagg | Z22649 | 92440 | cctatcctgagggcacacttccg | W08057 |
| 7233 | atctcaggaatggacctgtctg | W50352 | 49837 | gtgccacagtatcacctcctcct | Z22649 | 92441 | tatcctgagggcacacttccgtg | W08057 |
| 7234 | gaatggaccctgtctggcttccgt | W50352 | 49838 | cagtatcacctccctcctcgttct | Z22649 | 92442 | atcctgagggcacacttccgtgg | W08057 |
| 7235 | atggaccctgtctggcttccgtat | W50352 | 49839 | gccaatctggagctagaacccagt | Z22649 | 92443 | tgatgttcctggatagatgccctt | AA117646 |
| 7236 | ggaccctgtctggcttccgtatag | W50352 | 49840 | caactgctagtcgtggcaaaactagg | Z22649 | 92444 | ttcctggatagatgccctgcct | AA117646 |
| 7237 | tctggcttcctgtatagcagatgaa | W50352 | 49841 | agccttagcagttccctcctat | Z22649 | 92445 | atctggacactagggtatacttc | AA117646 |
| 7238 | ttggcttcctgtatagcagatgaat | W50352 | 49842 | tgagccttcccctccatcacga | Z22649 | 92446 | cctgttcgttctaagtttcacat | AA117646 |
| 7239 | ctaccactactatgacgatgccc | W50352 | 49843 | ttttccctcatctacgaagtg | Z22649 | 92447 | agatgccctctgcctcagttcatt | AA117646 |
| 7240 | taccactactatgacgatgccgg | W50352 | 49844 | cctcatctacgaagtggatatat | Z22649 | 92448 | taagttttcacattctaat | AA117646 |
| 7241 | cactatgacgatgccgcgacgatg | W50352 | 49845 | tcagtcccacaaacaagctacta | AA032836 | 92449 | gttttcacattctaatttgccatct | AA117646 |
| 7242 | actatgacgatgccgcgacgatga | W50352 | 49846 | atgcccacaaacaagtctatt | AA032836 | 92450 | ttcacattctaattgccatctgac | AA117646 |
| 7243 | tatgacgatgccgcgacgatgtacc | W50352 | 49847 | atatgcccgaggacatagccaaag | AA032836 | 92451 | atcgaccagagttcaggccattag | AA117646 |
| 7244 | acgaggtcgggacgatgtaccaggt | W50352 | 49848 | tgccgaggacatagccaagctgg | AA032836 | 92452 | tgaccagagttcaggccattaggg | AA117646 |
| 7245 | gatgccggacgatgtaccaggtgt | W50352 | 49849 | gacatagccaagctggtgcagtt | AA032836 | 92453 | ttcaccattagggaaaggccag | AA117646 |
| 7246 | tgccggacgatgtaccaggtgtc | W50352 | 49850 | gaacctggccgttcactgagtcag | AA032836 | 92454 | aaggccagttgtgtaggaggattat | AA117646 |
| 7247 | gccaactccatcagccagatgacag | M12130 | 49851 | ggtccacgatatgatccatgaagca | AA032836 | 92455 | agatgccctctgcctcagttcatt | AA117646 |
| 7248 | tcccccagatgacagcgatgagga | M12130 | 49852 | tgaagcagagaccttcacgcttact | AA032836 | 92456 | tgcctctgcctcagttcatttgt | AA117646 |
| 7249 | ggactcactcagccactgcaggt | M12130 | 49853 | actgttccgatggccactcccaag | AA032836 | 92457 | tctgcctcacttgcttcatga | AA117646 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 7250 | actgaccagctgcaggtttgtt | M12130 | 49854 | tgttccgatgccactgcccaagaa | AA032836 | 92458 | tcagttcattgcttcatgattctgc | AA117646 |
| 7251 | ccagctgcaggtttgtacctg | M12130 | 49855 | gccactgcccaagaagccatagaaa | AA032836 | 92459 | cattgcttcatgattctgtttga | AA117646 |
| 7252 | tccaacatgaaggtctctgcttcc | M12130 | 49856 | cactgcccaagaagccatagaaatg | AA032836 | 92460 | tgcttcatgattctgctgttgaagg | AA117646 |
| 7253 | accatgaaggtctctgcttcctgt | M12130 | 49857 | cacaaacaagtctactaattcggaca | AA032836 | 92461 | attctgctgaaggtttgctgga | AA117646 |
| 7254 | atgaaggtctctgcttcctgtgac | M12130 | 49858 | caagtctactattcggacaaatacg | AA032836 | 92462 | tagacaatctggcaactaggtgt | AA117646 |
| 7255 | gcttctgtgacttgattgggata | M12130 | 49859 | tctactattcggacaaatacgacga | AA032836 | 92463 | tttctaccagagagactgaaaat | AA117646 |
| 7256 | gtgcctgctctgggtcatacacctg | M12130 | 49860 | tactattcggacaaatacgacga | AA032836 | 92464 | agaacagaccagctgacacaaaac | U03723 |
| 7257 | cctgctgcagtcatacacctgatc | M12130 | 49861 | agttcgaataccggcagtcatatt | AA032836 | 92465 | ataccaccttctaattgctcaag | U03723 |
| 7258 | catacacctgatctggaagtaacaa | M12130 | 49862 | ttcgaataccggcagtcatattgc | AA032836 | 92466 | gaaatttcgagctcactctct | U03723 |
| 7259 | cagacaacctcggtgcctgtgtgt | M12130 | 49863 | aataccggcatgtcatattgcccga | AA032836 | 92467 | tcggagctcactctctcttccctg | U03723 |
| 7260 | acaacctcggtggcctgtgtgtcac | M12130 | 49864 | taccggcatgtcatattgcccgagg | AA032836 | 92468 | ttctcccggggacaagtcagag | U03723 |
| 7261 | tcggtggccgtgtgcactccct | M12130 | 49865 | ttcactacacagttctagaggatg | AA032836 | 92469 | ttccctggacaagtcagagtat | U03723 |
| 7262 | tcccttgtacataactcctgtgac | M12130 | 49866 | ggctgtactaaacacactggaaat | X52046 | 92470 | caactgttctaatgcaaaggctgtg | U03723 |
| 7263 | tgacaaaacctctggaagttctgg | M12130 | 49867 | gccaaactctgaaacccagcaa | X52046 | 92471 | ctgttctaatgcaaaggtggag | U03723 |
| 7264 | ctgtcctcactcatgctgtctg | M12130 | 49868 | aaaccacactcatgttcatctg | X52046 | 92472 | ttctaatgcaaaggctggagact | U03723 |
| 7265 | ctctactgctgtctggactca | M12130 | 49869 | catcatgttcatctgttttaa | X52046 | 92473 | caaaagatgcactgcatacagtaa | U03723 |
| 7266 | tactcatgctgtctggactcactg | M12130 | 49870 | gtttaatcttatcaaccagtgaa | X52046 | 92474 | acgatgcactgcatacagtaatat | U03723 |
| 7267 | cttacttcacaatatgctacgaa | M12130 | 49871 | atctatcaaccagtgcaagtgaac | X52046 | 92475 | acagaccccagctgacacaaaagca | U03723 |
| 7268 | atatgctacagaacatctaggctga | J03776 | 49872 | tcaaccagtgcaagtgaccaactaa | X52046 | 92476 | ccagctgacacaaaacagcagtcagt | U03723 |
| 7269 | ctgcgccaagactattctaatgtg | J03776 | 49873 | tttgcgttcaaccaccaataca | X52046 | 92477 | gctgacaaaacgcagtcagttgt | U03723 |
| 7270 | ctatttctaatggtgtgatatat | J03776 | 49874 | accaccaataccaggtcaaatgctt | X52046 | 92478 | gacacaaaacgcagtcagttgtcca | U03723 |
| 7271 | ctatgattttctcattcacaataat | J03776 | 49875 | caattccaacttcaaaatgtctcaa | X52046 | 92479 | aaacgacagtcagttgtccatactta | U03723 |
| 7272 | caatgataccatatcaactgaaccttc | J03776 | 49876 | caacttcaaaatgtctcaatgctgc | X52046 | 92480 | agtcagttgtccatactaccttct | U03723 |
| 7273 | tacccataaactgaacctctgttat | J03776 | 49877 | actaaacacactggggaatgtggca | X52046 | 92481 | ttgtccatactactctcaattg | U03723 |
| 7274 | taactgaacctctgttatgttgtg | J03776 | 49878 | gaatatcaaacacgcaaggcaatga | X52046 | 92482 | tccatactacctctaattgctc | U03723 |
| 7275 | aacttctgttatgttgtgaaatgt | J03776 | 49879 | caaacacgcaaggcaatgagactac | X52046 | 92483 | tcttaaagattctcggcaggtgc | AA117715 |
| 7276 | ctctatttgcttctagcagatagaa | J03776 | 49880 | gcaatgagactaccatcatagata | AA032912 | 92484 | cttaaagattctgcagctggcagtggca | AA117715 |
| 7277 | ttgcttctagcagatagaaggatc | J03776 | 49881 | agactaccacatagatatctgcac | AA032912 | 92485 | cagagtattccctttcaggag | AA117715 |
| 7278 | ttctaccctttgttgaccacacat | J03766 | 49882 | cccatatgcagcagtccacccatg | AA032912 | 92486 | cagagctattccctttcaggag | AA117715 |
| 7279 | aacatcaggctgaaactcatacaa | J03766 | 49883 | atagatatctgcacctatgcacattg | AA032912 | 92487 | ttactgaccacgtgatctgggaat | AA117715 |
| 7280 | atgtgcaggcacactctgtaag | J03766 | 49884 | ccctatgacatttgggggtccgatc | AA032912 | 92488 | tacttgaccacgtgatcgggaatt | AA117715 |
| 7281 | ccagtgcaactctgtaagttgggga | J03766 | 49885 | cgcacctactatagatatctggga | AA032912 | 92489 | tgaccacgtgatctgggaattaca | AA117715 |
| 7282 | cacactctgtaagttgggatggtgc | J03766 | 49886 | cacctcactatagatatctgggaa | AA032912 | 92490 | tgaccacgtgatcgggaattacac | AA117715 |
| 7283 | tgctgctgattgctatgtggca | J03766 | 49887 | taggagccatagcagcacatctat | AA032912 | 92491 | gccttaaagaccaggtccaggggat | AA117715 |
| 7284 | gttctatggcactgaggaaacta | J03766 | 49888 | ggagccccatagcagcagcatctatag | AA032912 | 92492 | gaccaggtccaggcgatttctag | AA117715 |
| 7285 | tagatcttcatgctggatatta | J03766 | 49889 | cccatagcagcagcatctatagaaga | AA032912 | 92493 | ttaaaagattcctggcaggtggcat | AA117715 |
| 7286 | ttctcagtctggatatagatccc | J03766 | 49890 | catagcagcacatctatagaaagaca | AA032912 | 92494 | aagattctgcaggtgggcatcgcg | AA117715 |
| 7287 | acacactggaatgcactgctgcagaa | W50513 | 49891 | tagcagcacatctatagaagacacc | AA032912 | 92495 | agtgaaatccccaaggcaggcagagct | AA117715 |
| 7288 | tgaatgcactgctgcagaagttac | W50513 | 49892 | catctataaagacacctagcggaa | AA032912 | 92496 | gtgaaaatccccaaggcagagagcta | AA117715 |
| 7289 | cgaactatctataccgaagatcga | W50513 | 49893 | tctatagaagacacctagcggaagc | AA032912 | 92497 | gaaaatcccaaggcagaggtctat | AA117715 |
| 7290 | actatctataccgaagatcgaga | W50513 | 49894 | tatagaagacacctagcggaagtt | AA032912 | 92498 | tcccaaggcagagctatttccct | AA117715 |
| 7291 | atctataccgaagatcgagaagac | W50513 | 49895 | agacacctagcggaagcttagagt | AA032912 | 92499 | gggcagcagtattccccttcagga | AA117715 |
| 7292 | tataccgaagatcgagaagacgtt | W50513 | 49896 | acaacctagcggaagcttagagtga | AA032912 | 92500 | ggcagagctattccccttcagaa | AA117715 |
| 7293 | agaagacgtttcccagctgtatgc | W50513 | 49897 | tgggaaactcacattccagagat | AA032912 | 92501 | aatgctccgcttaaggtacggcagtg | AA117721 |
| 7294 | agagtttcccagctgtatgcct | W50513 | 49898 | ggaaaactcacatttcagagatgt | AA032912 | 92502 | gctccgcttaaggtacggcagtgg | AA117721 |
| 7295 | cgttcccagctgtatgccttac | W50513 | 49899 | ctcacattccagagatgctcg | AA032912 | 92503 | gcatgtaatcaccgttttgcaca | AA117721 |
| 7296 | ttcccagctgtatgccttcaccat | W50513 | 49900 | cacatttccagagatgctctggcgg | AA032912 | 92504 | atagtaatcacctgtttgcacatg | AA117721 |
| 7297 | cccagctgtatgccttcaccatctg | W50513 | 49901 | actgaagctaactgtgtggaggt | AA032912 | 92505 | tagtaatcacctgtttgcacatgg | AA117721 |
| 7298 | agctgatgccttcacactctgcct | W50513 | 49902 | agtcctaggagccccatagcagc | AA032912 | 92506 | gtaatcacctgtttgcacatgtt | AA117721 |
| 7299 | atgcactgcgagaagttactga | W50513 | 49903 | ctactagagcccatagcagcacat | AA032912 | 92507 | atcacctgtttgcacatgttctg | AA117721 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 7300 | tgccttcaccatctgcctggctg | W50513 | 49904 | actaggagcccatagcagcacatct | AA032912 | 92508 | tcacctgttttgcacatggttctga | AA117721 |
| 7301 | agtttactgagctcgagaggcaaa | W50513 | 49905 | gcagccatgcgacactacatcgt | AA032956 | 92509 | cctgtttgcacatggtctgaacca | AA117721 |
| 7302 | ttactgagctcgagaggcaacaa | W50513 | 49906 | cgacactacatcggttcatcgata | AA032956 | 92510 | tgttttgcacatggtctgaacaca | AA117721 |
| 7303 | acaatgcattcaagtcaccagatgc | W50513 | 49907 | caatcgctataaggttccacctg | AA032956 | 92511 | gttttgcacatggttctgaacacag | AA117721 |
| 7304 | atgcattcaagtcaccagatgatt | W50513 | 49908 | gttcacctgtcacagaatcactgc | AA032956 | 92512 | ttgcacatggttctgaacacagtc | AA117721 |
| 7305 | tcaagtcaccagatgcattcgaagt | W50513 | 49909 | gtcacagaatcactgcgaagtcat | AA032956 | 92513 | ccgcttaaggtacggcagtggagag | AA117721 |
| 7306 | tcctacgaactatctataccgcaa | W50513 | 49910 | gaatcactgcgaagtcatgtgcaa | AA032956 | 92514 | cacatggttcgaacacagtcactt | AA117721 |
| 7307 | ctacgaactatctataccgccaagat | W50513 | 49911 | ttacacgccataacggtactgaagg | AA032956 | 92515 | tggagagttcgcctgcatagtaat | AA117721 |
| 7308 | cctgcattttgtcagcacggccac | W50513 | 49912 | ataacggtactgaaggcaggactat | AA032956 | 92516 | gagagttcgcctgcatagtaatca | AA117721 |
| 7309 | cggccacagttgtcatgactcagg | U00678 | 49913 | gcaggatctatcagccatagacatc | AA032956 | 92517 | agagttcgcctgcatagtaatcac | AA117721 |
| 7310 | gatatggcttcaaatgggtaga | U00678 | 49914 | tctagccatagacatctgataata | AA032956 | 92518 | agttccgctgcatagtaatcacct | AA117721 |
| 7311 | gctcttcaaatgggtagagggtga | U00678 | 49915 | ataataacttatcctagagcataca | AA032956 | 92519 | tccgcctgcatagtaatcacctgtt | AA117721 |
| 7312 | gtgcagagcctgagctccttgatt | U00678 | 49916 | acttatcctagagcataacatgtcct | AA032956 | 92520 | ccgcctgcatagtaatcacctgtt | AA117721 |
| 7313 | agcgcctgattgcagcaggggtagcc | U00678 | 49917 | tacatcggtcatcgatatcacgg | AA032956 | 92521 | cctgcatagtaatcacctgttttgc | AA117721 |
| 7314 | ctgtgtccctcgctgtcagttgagt | U00678 | 49918 | gtgtcatcgatatcacggaagatg | AA032956 | 92522 | aggggttccggactgtagaccag | AA117730 |
| 7315 | tcaggcctctcgctgtcagttcaga | U00678 | 49919 | gaagatccgatgacgcatctcct | AA032956 | 92523 | tgtccggactgtagaccagtctt | AA117730 |
| 7316 | ctcctgctctgtcagactaaca | U00678 | 49920 | cgcatgacgcgatcctcctgaa | AA032956 | 92524 | aatgctctactttgtcggaatgt | AA117730 |
| 7317 | agtcagactaacagtaccagaggc | U00678 | 49921 | cgcatctcctcgatgctgtgac | AA032956 | 92525 | tgtcgtcactttgtcggaatgtgg | AA117730 |
| 7318 | tcttaacctgagataggttccatc | U00678 | 49922 | aatgaaactacagcaatctgagcac | AA032956 | 92526 | tcgtcactttgtcggaatgtggga | AA117730 |
| 7319 | gataggttcatcctgatacatct | U00678 | 49923 | actacagcaatctgagcactgaga | AA032956 | 92527 | aggaattcatggcagtggggcacta | AA117730 |
| 7320 | catgtgtcagactcaggtaagt | U00678 | 49924 | gagataaatcactgcctataaggg | AA032956 | 92528 | cgaattcatggcagtggggcactacg | AA117730 |
| 7321 | tccatcctgatacatcttcaactc | U00678 | 49925 | gcatggagccctgagcgtggcactg | AA032956 | 92529 | aattcatgcagtggggcactacggg | AA117730 |
| 7322 | ctgaagacatcctgttgttttct | U00678 | 49926 | tggagccctgagcgtggcactgagc | AA139256 | 92530 | tcatgcagtggggcactacgggtg | AA117730 |
| 7323 | tctgaaacactcactataaaaacct | U00678 | 49927 | ccctactctgctgagttaggcctg | AA139256 | 92531 | tggcagtgggcactaccgggtgtcc | AA117730 |
| 7324 | aacacttcactaataaacctcaagat | U00678 | 49928 | tactgcctgagttaggcctgtcca | AA139256 | 92532 | ggcactacggtgctccattccgac | AA117730 |
| 7325 | ttaatatctgatatctcagagt | U00678 | 49929 | tgagttaggcctgccagacagccct | AA139256 | 92533 | cactacgggtgctccattccgactg | AA117730 |
| 7326 | tctgatatctctgagagttcta | U00678 | 49930 | aggcctgccagacagccctgcaat | AA139256 | 92534 | ttccgactgtatgaccagtctgt | AA117730 |
| 7327 | aacagctctcagttctagttctc | U00678 | 49931 | agacagccctgcaatcgtgcgc | AA139256 | 92535 | tacgggtccatccgactgagt | AA117730 |
| 7328 | gtctctagatttctcggagtgtac | U00678 | 49932 | caatctgcgcttcatccaccagga | AA139256 | 92536 | actgtatgaccagtctgtctgt | AA117730 |
| 7329 | cactggcattgtctgctccctgg | U00678 | 49933 | gcatgcacatattgcaccaggca | AA139256 | 92537 | tgtatgaccagtctgtctgcggtga | AA117730 |
| 7330 | catgtctgctcctgctgcccaag | M20632 | 49934 | acatattgcaccagcgacccctgc | AA139256 | 92538 | tatgaccagtctgtctgtgtgaat | AA117730 |
| 7331 | ctttgctaaggcaccttgatgcc | M20632 | 49935 | ttattgcaccagcgacccctgcac | AA139256 | 92539 | tgaccagtctgtgctggtgaatgt | AA117730 |
| 7332 | taaggccacttgatgccatcctcc | M20632 | 49936 | acccctgcacacacctgcgta | AA139256 | 92540 | accagtctgtgctggtgaatgtcg | AA117730 |
| 7333 | tgagccatcttcaagacttacagc | M20632 | 49937 | cagtatttctactatgagaccat | AA139256 | 92541 | cagtctgtgctggtgaatgtctg | AA117730 |
| 7334 | catctcaagactttcagcttacatg | M20632 | 49938 | gcacacactatttgtgaccatg | AA139256 | 92542 | tgaatgtctactttgtcggaat | AA117730 |
| 7335 | caccaagtctcccttatcaggaattc | M20632 | 49939 | tatctactacgagaccatgtg | AA139256 | 92543 | attgttaacgcatctagttaagt | AA117730 |
| 7336 | gtctcctttacaggaatctcggat | M20632 | 49940 | tactgagccagtgagtcgagtg | AA139256 | 92544 | ttgttaacgcatctagttaagtg | AA117663 |
| 7337 | ggaattctcggatcatctgtgaaa | M20632 | 49941 | ccagtgagcgagtgcagttg | AA139256 | 92545 | gttcccaagctgatgtgaatagga | AA117663 |
| 7338 | caccagatctctgtcagaggacc | M20632 | 49942 | gtccggatcagagcctccaagcgc | AA139256 | 92546 | aatgctttcgtcatttgatcatga | AA117663 |
| 7339 | agtctgctcaggaccaggcct | M20632 | 49943 | tccagactcaagcgtcctctgttg | AA139256 | 92547 | tgatcttttgtcatgattaggctca | AA117663 |
| 7340 | tccaggtggctaccacaataagg | M20632 | 49944 | gagcctcaagcgtctcttgtcac | AA139256 | 92548 | gatctttgtcatgattaggctcat | AA117663 |
| 7341 | ctctgctgtgcccaagaagtc | M20632 | 49945 | tcttgcacctccatttcctact | AA139256 | 92549 | tcttttgcatgattagctctat | AA117663 |
| 7342 | tcctgtgcccaagaagtctcgat | M20632 | 49946 | ggactgatccagccatctcgtctt | X66405 | 92550 | tcatgattagcctcatctccctaac | AA117663 |
| 7343 | gaagctcctgatgatggccgtata | M20632 | 49947 | ccgtgggtcttcacaccatcactg | X66405 | 92551 | taggtcatctcctaactgtgt | AA117663 |
| 7344 | cctgatgatggcggtatagatgac | M20632 | 49948 | agggtgctcagtgacctacaatgc | X66405 | 92552 | aggctcatctcctaactgttgtat | AA117663 |
| 7345 | ctgtacactttcagcagaggctgc | M20632 | 49949 | ttccatctgaaagcaaagtgcta | X66405 | 92553 | ggctcatctcctaactgttgtata | AA117663 |
| 7346 | cacttcagccagagctgtgcactgc | M20632 | 49950 | cacaccagaggcttagcttggaca | X66405 | 92554 | ctcatcccctaactgtgtatat | AA117663 |
| 7347 | agccagaggctgcactgccaccctg | M20632 | 49951 | ttggacagttccactcaagtgtcc | X66405 | 92555 | tgtttaacgcatctcagttaagtga | AA117663 |
| 7348 | aggctgcactgcacctgggac | M20632 | 49952 | ccaagttgctcgtcgaatcaa | X66405 | 92556 | tttaacgcatctcagttaagtgaac | AA117663 |
| 7349 | gcctggctcttcatcgtgggca | W50536 | 49953 | agtgtcctgcagaatcaatccaga | X66405 | 92557 | ttaacgcatctcagttaagtgaact | AA117663 |

TABLE 1-continued

| SEQ ID NO | sequence | DBAxnID | SEQ ID NO | sequence | DBAxnID |
|---|---|---|---|---|---|
| 7350 | cctggtgcttcatcgttgggcac | W50536 | 49954 | ctgtcagaatcaatccagagcttc | X66405 | 92558 | atatctgattgttcgttcctccaag | AA117663 |
| 7351 | cttcatcgttgggcactagccgtgc | W50536 | 49955 | gaatcaatccagagcttctccctc | X66405 | 92559 | tgttcgttctccaagctgatgtga | AA117663 |
| 7352 | ttcatcgttgggcactagccgtgcc | W50536 | 49956 | gtaatctgatccaagccagctatct | X66405 | 92560 | tgtcgttccaagctgatgtgaa | AA117663 |
| 7353 | tcatcgttgggcactagccgtgcg | W50536 | 49957 | tgatccaagccagctatctgcta | X66405 | 92561 | tccgttctccaagctgatgtgaata | AA117663 |
| 7354 | catcgttgggcactagccgtgccg | W50536 | 49958 | tgtcttcaccatcactgcagtt | X66405 | 92562 | tcgttctccaagctgatgtgaatag | AA117663 |
| 7355 | tcgttgggcactagccgtgccgcct | W50536 | 49959 | cacaccatcactgcagttccgtct | X66405 | 92563 | ctaactccgctgcagcattgtcat | AA124193 |
| 7356 | cggtgacgtctctggtcggcacaact | W50536 | 49960 | atcactgcagttccgtctgtgtc | X66405 | 92564 | ccgctgcagttgtcatctggga | AA124193 |
| 7357 | ggtgacgtctctggtcggcacaactg | W50536 | 49961 | tgtgttcttccatgctcaaca | X66405 | 92565 | tatatggatttgccaactgcctgg | AA124193 |
| 7358 | gtgacgtctctggtcggcacaactgc | W50536 | 49962 | tccatgctcaacatgaagcagacct | X66405 | 92566 | tgcctggacacctcacctcacagag | AA124193 |
| 7359 | tgacgtctctggtcggcacaactgg | W50536 | 49963 | cagacttctcatgagttcagcttg | X66405 | 92567 | gttctcacatcctctggatgcc | AA124193 |
| 7360 | gacgtctctggtcggcacaactgcgg | W50536 | 49964 | tgagttcagcttgctgattaggc | X66405 | 92568 | cacatcctctggatgcccagagg | AA124193 |
| 7361 | ctgtgctctcatcgttgggact | W50536 | 49965 | ttcacaggtgcttgtcagtgact | X66405 | 92569 | gatgcccagaggccagagttct | AA124193 |
| 7362 | tggtgctctcatcgttgggacta | W50536 | 49966 | caagagaccaggctagaaggagcagc | AA032900 | 92570 | ccagaggccagtctttagttggcgca | AA124193 |
| 7363 | ggtgctctcatcgttgggcactag | W50536 | 49967 | cagctgtaccagcaggcactgaggc | AA032900 | 92571 | gccagagttctaagttggccggacctg | AA124193 |
| 7364 | gtgctctcatcgttgggcactage | W50536 | 49968 | atccgacaatcaggcgcctgctcac | AA032900 | 92572 | tcctcgttaaccactggagactg | AA124193 |
| 7365 | tgctctcatcgttgggcactagcc | W50536 | 49969 | caatcagccggtctcaggtgct | AA032900 | 92573 | tgtgctaaccactggagactggag | AA124193 |
| 7366 | gctctcatcgttgggcactagccg | W50536 | 49970 | tcacgtctggccaccggtcctat | AA032900 | 92574 | tgctaaccactggagactggagttg | AA124193 |
| 7367 | ctctcatcgttgggcactagccgt | W50536 | 49971 | gtctggccaccgctctattacctg | AA032900 | 92575 | ctgcagcattgtcatctgggagtc | AA124193 |
| 7368 | tctctcatcgttgggcactagccgtg | W50536 | 49972 | tggccaccggtcctattacctgct | AA032900 | 92576 | caactggacctggagttgctgacc | AA124193 |
| 7369 | atccttaatattccagatgaaaagg | W50536 | 49973 | agccgtcttacgcaccggcctggtc | AA032900 | 92577 | cagcattgtcatctgggagtcac | AA124193 |
| 7370 | agtaacacattgagccactgatta | W50536 | 49974 | cgctctacaacggccggtcaac | AA032900 | 92578 | ttgtcatctggagtccaacagta | AA124193 |
| 7371 | ctataccaaggacaggggtagtga | W50536 | 49975 | cttacagacgcgctcggtcaactc | AA032900 | 92579 | agtcacacagtagaggggccgtc | AA124193 |
| 7372 | tctgctccaagtccccaggtgcat | W50536 | 49976 | cctggtcaactcacctcagcagag | AA032900 | 92580 | ccacactagaggggccgtcctt | AA124193 |
| 7373 | gctcctaagtcccccaggtgcatcca | W50536 | 49977 | cttcacctcagcagtctgcagc | AA032900 | 92581 | cctcccgctctttagtctatgg | AA124193 |
| 7374 | tcccccaggtgcatccaattttcaa | W50536 | 49978 | ctgtacagcagcagtgtcagc | AA032900 | 92582 | tccctgctctttagtctatgg | AA124193 |
| 7375 | ccaggtgcatccaattttcaactt | W50536 | 49979 | cacccccgcaagttgcagcagag | AA032900 | 92583 | ctgtcttagtctatatgggat | AA124193 |
| 7276 | tcaacttaccaaagatctctccct | W50538 | 49980 | taccagcagggcactgaggcgcca | AA032900 | 92584 | cggaatactgggcctccatctcgg | AA124193 |
| 7377 | ttaccaaagatctctcctcatct | W50538 | 49981 | caggaccactgaggctgccccaaccaga | AA032900 | 92585 | gaatactggcctccatcttcgga | AA120173 |
| 7378 | ccaaagatctctccttcatctat | W50538 | 49982 | cgaggccactggaaatggcgaga | AA032900 | 92586 | tgcacaataaccaaccttagcca | AA120173 |
| 7379 | aagatctctcctcatctat | W50538 | 49983 | aaacctgacatcccgacaatcag | AA032900 | 92587 | accttagccagaccaccttgccctct | AA120173 |
| 7380 | atctcctcatctatcaata | W50538 | 49984 | ctggacatccgacaatcagcgc | AA032900 | 92588 | cttagccagaccaatttgcctcttg | AA120173 |
| 7381 | aaacacattgagccactgattaagc | W50538 | 49985 | gacatcatccgacaatcagcgccg | AA032900 | 92589 | ttagccagaccaatttgccctctgaa | AA120173 |
| 7382 | tctcctcattcctatcaaataat | W50538 | 49986 | atcatccgacaatcagcgctgct | AA032900 | 92590 | agccagaccatttgccctctgaacta | AA120173 |
| 7383 | ccagtcagcacccatccaggatgccg | W50538 | 49987 | tgccccgatttggactcactgac | AA032900 | 92591 | agaccatttgccctctgaacatta | AA120173 |
| 7384 | gacagcagcaccatccaggatgccggc | W50538 | 49988 | gtactcactgaacagagcattct | U00674 | 92592 | cattgcccttctgaacattttacgt | AA120173 |
| 7385 | ageaccatccaggatgccggcctat | W50538 | 49989 | attcataccttctgtccaattaca | U00674 | 92593 | cctcaaaacttccagttctgctg | AA120173 |
| 7286 | atccaggatgccggctatataccaag | W50538 | 49990 | aattacactgtaattcaccagtt | U00674 | 92594 | tcaaaacttcccagttctgctgac | AA120173 |
| 7387 | caggatgccggctataccaaggaac | W50538 | 49991 | agctgtaattaccatgttaaaag | U00674 | 92595 | gttcgctgctgtgtggtgacgt | AA120173 |
| 7388 | gatgccggctataccaaggacagg | W50538 | 49992 | atgggccctccaaagctgcaacat | U00674 | 92596 | actggcctccatcttcggcaccga | AA120173 |
| 7389 | gccggctataccaaggacacagg | W50538 | 49993 | aaagtgcacaaatgccctcaatta | U00674 | 92597 | ttggcctccatcttcggcacgaaa | AA120173 |
| 7390 | gccggctataccaaggacacagagt | W50538 | 49994 | tgcccttcaaattacggaggctgga | U00674 | 92598 | tatttcaaaatggagcatgctgtc | AA120173 |
| 7391 | ctctctacacttgcagaattgatt | M12600 | 49995 | ataccttcaactgtgaaacatg | U00674 | 92599 | tcggaatgtcatggaggacag | AA120173 |
| 7392 | tctctacacttgcaggatgat | M12600 | 49996 | taacttgttgaatctatgccagg | U00674 | 92600 | catgtcatggagacgatgttc | AA120173 |
| 7393 | caggtccttgtttcctcatcga | M12600 | 49997 | gcttggaatctatgccaggagaaaaa | U00674 | 92601 | ccgatgttctgggttgcacataaa | AA120173 |
| 7394 | ggtccttgtttcctcatcgagga | M12600 | 49998 | tttgtcactgctgtaaagcaactatt | U00674 | 92602 | gatgttctgggttgcacaataaa | AA120173 |
| 7395 | ttgtttcctcatcgaggagagcg | M12600 | 49999 | agatccagctgttttccagcataaa | U00674 | 92603 | tgtctcggttgcacaataaccaa | AA120173 |
| 7396 | ttcctcatcgaggagagcgagc | M12600 | 50000 | ttggctactccgttgagccacctt | U00674 | 92604 | gatattccaaatgtcctccagtc | AA120173 |
| 7397 | ctccatcgaggatgcgagcgaga | M12600 | 50001 | tactcgttgagcaccttccctga | U00674 | 92605 | atttccaaatgctccagtctgg | U10355 |
| 7398 | gagcagacttgcctcagtttctg | M12600 | 50002 | gcaccttccctggtctgtcacga | U00674 | 92606 | tgaattattcactgcctgcagaag | U10355 |
| 7399 | tcgggctttgatcacagtaagg | M12600 | 50003 | tcccgagcttgtcagaaatcat | U00674 | 92607 | attcactgcctgcagaagccctcag | U10355 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 7400 | M12600 | ggatgtcatgtcgtcgctagaat | 50004 | M12600 | agctgtcacagaacacatttaaac | 92608 | U10355 | cactgctgtcagaagctccagtgt |
| 7401 | M12600 | catggtcgtcgcctagaatcaactt | 50005 | M12600 | aacactgaaacagtgctgtctg | 92609 | U10355 | ctgtcagaagctcagtgtggccta |
| 7402 | M12600 | tacacttctgcaggaattgatccg | 50006 | M12600 | gccttaattcatacctttctgcca | 92610 | U10355 | gcctcagtgtggcctaagatactcc |
| 7403 | M12600 | ttaaaaccaaatgacattcattttg | 50007 | M12600 | cacctactctgtcctgcatggc | 92611 | U10355 | cctcagatactcctatttaccattg |
| 7404 | M12600 | gattccgagatacctagtagtttg | 50008 | M12600 | acctactctgtcctagtcgatggt | 92612 | U10355 | aagatacctctatttaccattgtga |
| 7405 | M12600 | tgtgagagagactcccactgctccctg | 50009 | M12600 | gtcctagtcgatggctgctccaaaa | 92613 | U10355 | atactcctatttaccattgtgaagt |
| 7406 | M12600 | gagagatgcccactgctgtcctg | 50010 | M12600 | tcctagtcgatggctgctccaaaa | 92614 | U10355 | ctcctatttaccattgtgaagtgt |
| 7407 | M12600 | tccctggttagtcactttgcagttgca | 50011 | M12600 | cctagtcgatggctgctccaaaaag | 92615 | U10355 | aacctagctagcaattcagttagg |
| 7408 | M12600 | gtttggttagccattggcaggtgt | 50012 | M12600 | ctagtcgatggctgctccaaaaga | 92616 | U10355 | tcccaaatgcctccagtcgttt |
| 7409 | M12600 | ttaactctgtgccagcagggtcctt | 50013 | M12600 | tagtcagatggctgctccaaaagac | 92617 | U10355 | atttgtatacagtctcatcataagaa |
| 7410 | M12600 | acctctgccagcagggtccttgt | 50014 | M12600 | agtcagatggctgctccaaaagaca | 92618 | U10355 | tgatacagtctcatcataagaaggg |
| 7411 | L07296 | ghagctgtctgtacacagtgactaa | 50015 | L07296 | gtcagatggctgctccaaaaagacaa | 92619 | U10355 | ttcataaatacagcaaacaagttga |
| 7412 | L07296 | atcacaatgaggcaacgcctcgcc | 50016 | L07296 | tcagatggctgctccaaaaagacaaa | 92620 | U10355 | gttccatcacatgtgagtcatgtaa |
| 7413 | L07296 | acatacacaacacgtgccagtcacca | 50017 | L07296 | cctactctgtcctagtcgatggctg | 92621 | AA117906 | ccatcacatgtgagtcatgtaaaat |
| 7414 | L07296 | ctagaaccacacgctgctgttcga | 50018 | L07296 | ctactctgtcctagtcgatggctgc | 92622 | AA117906 | tcacctgaaccatggtctgtgaa |
| 7415 | L07296 | cctaagacacgctgctgttctga | 50019 | L07296 | tactctgtcctagtcgatggctgct | 92623 | AA117906 | tcttgaattattcactgcctgcag |
| 7416 | L07296 | cctcactgggtcttcctccctga | 50020 | L07296 | actctgtcctagtcgatggctgctc | 92624 | AA117906 | aaatctgcggcaatcatgaaacttac |
| 7417 | L07296 | tcttctctagaggcctggatctga | 50021 | L07296 | ctctgtcctagtcgatggctgctcc | 92625 | AA117906 | atctgcggcaatcatgaacttacta |
| 7418 | L07296 | ctctagagcctgatctgatctgat | 50022 | L07296 | tctgtcctagtcgatggctgctcca | 92626 | AA117906 | cagcaccttgagtgtgaaatggta |
| 7419 | L07296 | agcctgatctgatctgtggat | 50023 | L07296 | ctgtcctagtcgatggctgctccaa | 92627 | AA117906 | aagactgtatgccaccaatggtca |
| 7420 | L07296 | gatcgatctgtcgggatctgtc | 50024 | L07296 | tgtcctagtcgatggctgctccaaag | 92628 | AA117906 | gactgtatgccaccaatggtcaat |
| 7421 | L07296 | attgtctgagattcgtcaaggaa | 50025 | L07296 | agctgatctgttccactctgtga | 92629 | AA117906 | ctggatgtcaccaatggtcaatct |
| 7422 | L07296 | tcaaactctgtcctgaacgatccc | 50026 | L07296 | ttcgtttccattctgagtgtca | 92630 | AA117906 | tatgccacaatgcaatctgag |
| 7423 | L07296 | ctcgccctgagtgttgagaagaa | 50027 | L07296 | gtaaacactctacctctgcaatt | 92631 | AA117906 | tgcaccaatggcaatctgagc |
| 7424 | L07296 | cagaagatcgggcgctgttgtaaag | 50028 | L07296 | aacacttcactctgcagattcc | 92632 | AA117906 | caccaatggcaatctggagccca |
| 7425 | L07296 | gaattactcatcaaagatcatct | 50029 | L07296 | actcttcctctgcagattcctcc | 92633 | AA117906 | atggtcaatctggagcccaaccag |
| 7426 | L07296 | actcatcaaagatcatctgaaaa | 50030 | L07296 | ctcccagtagcaagtaagtagctg | 92634 | AA117906 | ggtcaatctggagcccaaccaggta |
| 7427 | L07296 | agaagcccaatcaataactgttcta | 50031 | L07296 | tcatgtatttcattttgttaagag | 92635 | AA117906 | tcaatctggagcccaaccaggtacc |
| 7428 | L07296 | ccaatcaataactgttctagatcct | 50032 | L07296 | tcgtattcattttgctaagagat | 92636 | AA117906 | caatcagaactaactaccacacga |
| 7429 | L07296 | tgttctagatcctgtcccaataa | 50033 | L07296 | gatctgaattctctttcctggaat | 92637 | AA117906 | atcatgaactactaccacagcacc |
| 7430 | L07296 | agatcctagtccccaataactgaag | 50034 | L07296 | tctagttctgtcaacaaatgcct | 92638 | AA117906 | catgaactactaccacagcacctt |
| 7431 | L07297 | ggtcacagctggcaggagacgatgaat | 50035 | L07297 | tcctccatggctgccattgatcc | 92639 | AA117906 | tgaacttactaccacacgacctga |
| 7432 | L07297 | tagctgcttgggaggcagagagcat | 50036 | L07297 | tcctcatggcctgcattgatcacc | 92640 | AA117906 | cttactaccacaggcacctttgagttg |
| 7433 | L07297 | agacatcttgccattcgcaaag | 50037 | L07297 | tgttccactctggagtgctagga | 92641 | AA117906 | tactaccacagcaccttgagttg |
| 7434 | L07297 | cttgtccattgccaaagctcttg | 50038 | L07297 | tcatgcctgcattgatccaccctgt | 92642 | AA117906 | ctaccacagcaccttgagttgtgaa |
| 7435 | L07297 | ccattgtcaaaagctctgtgcggct | 50039 | L07297 | ttccacttcgtagtgctaggacta | 92643 | AA117906 | accacagcaccttgagttgtgaaat |
| 7436 | L07297 | gcaaaagctgtctgggctgcagtg | 50040 | L07297 | cactgtggagtgctaggacatag | 92644 | AA117906 | gaggacctccagctcagcttcag |
| 7437 | L07297 | tgagaagctgggcagctgaggttct | 50041 | L07297 | acggttctgcactgcccctg | 92645 | AA117906 | cctattccagtctcaggaagcg |
| 7438 | L07297 | cagcagcctgagttttctcatccag | 50042 | L07297 | tctgctcactgctccctgtaaaca | 92646 | AA117906 | ccttttggctgccaacaagctga |
| 7439 | L07297 | cctgagttcttctcatccagatatcc | 50043 | L07297 | gtccactgccctgtaaacactctta | 92647 | AA117906 | ttttggctgccaacaagctgatt |
| 7440 | L07297 | cggattctctggttcgttaaag | 50044 | L07297 | cactgcctgccctgctaaacacactctta | 92648 | AA117953 | ttttggctgccaacaagctcgatta |
| 7441 | L07297 | tctctggttctgtaaagacttag | 50045 | L07297 | tctgtaaacactctttactctgcag | 92649 | AA117953 | ttggtgccaacaagctcgattaa |
| 7442 | L07297 | gactagtttggagctcatgcatgaaag | 50046 | L07297 | tttcagtgtattcccactctgtaag | 92650 | AA117953 | tggctgccaacaagctcgattaagg |
| 7443 | L07297 | agagcatgctagccacttaattc | 50047 | L07297 | cagcgtattcccactgctctaagga | 92651 | AA117953 | ggctgccaacaagctcgattaagga |
| 7444 | L07297 | ctgacgccagcagcatcatcatgggtac | 50048 | L07297 | tgaatcgatacaccctgccttcatg | 92652 | AA117953 | gctgccaacaagctcgattaaggaa |
| 7445 | L07297 | ttaagtttctgcttgatgaact | 50049 | L07297 | atcgatacacctgtccctctcatgaat | 92653 | AA117953 | tgccaacaagctcgattaaggaaagc |
| 7446 | L07297 | cccagtgccaatccccactgagacgag | 50050 | L07297 | gatacacctgctccttcatgaatggt | 92654 | AA117953 | aagctcaaggagccactctgagtctg |
| 7447 | L07297 | gaatccccactgagacgcctgca | 50051 | L07297 | cctgtcttcatgaatggttcgaga | 92655 | AA117953 | agctcaaggaggagcacctgagtctg |
| 7448 | L07297 | ctgtgctctggctgcactccaccag | 50052 | L07297 | ctgtggctctgtgctgagagtg | 92656 | AA117953 | tatcccagtcttcaggaagcgct |
| 7449 | L07297 | ctctggtgcactccaccagccagga | 50053 | L07297 | tcagaaccaggacacgcttgataag | 92657 | AA117953 | atttcccagctcttcaggagcgccta |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 7450 | L07297 | gtgactcaccaggcaggactagac | 50054 | X66223 | gaaccaggacacgcttgataaggt | 92658 | AA117953 |
| 7451 | X66223 | aggcaccacatccaaggccactaggc | 50055 | X66223 | taaggttcctgaaggtgtggact | 92659 | AA117953 |
| 7452 | X66223 | tgccttctgatgccgcggtgga | 50056 | X66223 | ggttcctgaagcgtgtggactgt | 92660 | AA117953 |
| 7453 | X66223 | acactggcacctcgtttggaatgcc | 50057 | X66223 | tccgtaagcgtgtggactgtgata | 92661 | AA117953 |
| 7454 | X66223 | cacctcgtttggagtgccccatct | 50058 | X66223 | cgtattccacttgctcaagagactc | 92662 | AA117953 |
| 7455 | X66223 | tgtttgagtgccccatctggcct | 50059 | X66223 | cccactgctaagagactccgaat | 92663 | AA117953 |
| 7456 | X66223 | ggagtgcccatctggcctgtcag | 50060 | X66223 | agatgctagtcctgttcagaact | 92664 | AA117980 |
| 7457 | X66223 | cccatctggcctgtcagagtcct | 50061 | X66223 | tgtctagtcctgttcagaactgc | 92665 | AA117980 |
| 7458 | X66223 | tgttcagagtcctggtaccagtta | 50062 | X66223 | ctagtcctgttcagaactggctga | 92666 | AA117980 |
| 7459 | X66223 | ggaatccaccggatcaagaagga | 50063 | X66223 | gtcgggttcagaactggctgaagc | 92667 | AA117980 |
| 7460 | X66223 | aggccgtatcctcctgggtcatagc | 50064 | X66223 | ctcctcaatggcatgaatcgata | 92668 | AA117980 |
| 7461 | X66223 | tatcctctgggtcatgatacct | 50065 | X66223 | ctcctaatggcatgaatcctgagga | 92669 | AA117980 |
| 7462 | X66223 | tcatagtccatataaggcgccg | 50066 | X66223 | gatcactcatgtcatcctgtggct | 92670 | AA117980 |
| 7463 | X66223 | cctatgggcccaaagatgcatca | 50067 | X66223 | cactcagtcatcctgtggctgaa | 92671 | AA117980 |
| 7464 | X66223 | ctgccatcttactcatgtgcc | 50068 | X66223 | gcaactgcgagaccgagaagta | 92672 | AA117980 |
| 7465 | X66223 | atcttactcatgcttgccttgc | 50069 | X66223 | actgctcgagaccgagaagtagga | 92673 | AA117980 |
| 7466 | X66223 | gctcaaggctagcgtgctgtacc | 50070 | X66223 | agaagtaggaatccctcagaggag | 92674 | AA117980 |
| 7467 | X66223 | aggctatgctgctgcatcccggag | 50071 | X66223 | aggaatccctctgagcagtcctg | 92675 | AA117980 |
| 7468 | X66223 | ttcagcaactggagtgcaagagt | 50072 | X66223 | aatccctctgagcagtcctggaa | 92676 | AA117980 |
| 7469 | X66223 | gctgggttctgacatcccacatgg | 50073 | X66223 | ccctcgagcagtcctggaaact | 92677 | AA117980 |
| 7470 | X66223 | catcccacatggccacctctgttgg | 50074 | X66223 | gcagtcctggaaactgcgaaacag | 92678 | AA117980 |
| 7471 | X66223 | ggttcgtccgaatgcatcctg | 50075 | X66223 | ctacagttatgtcgcccagatta | 92679 | AA117980 |
| 7472 | X66223 | ttccgtccaggatgccatcgctg | 50076 | X66223 | cagttatgtcgcccagattagta | 92680 | AA117980 |
| 7473 | X66223 | cccctcgagggagactcttcga | 50077 | X66223 | caagtagcaacgatgggtcaaag | 92681 | AA117980 |
| 7474 | X66223 | tgcaccctcgagccctataccaag | 50078 | X66223 | tcatgtcatttcctggctgaagga | 92682 | AA117980 |
| 7475 | X66223 | caccctcgagccctataccaagcag | 50079 | X66223 | tgacaccgatgggtcaaagtggatc | 92683 | AA117980 |
| 7476 | X66223 | ggcctataccaagcagaagtatccg | 50080 | X66223 | catccgtggctgaaggatagt | 92684 | W29730 |
| 7477 | X66223 | gaagtatccaggaacactgcaggcag | 50081 | X66223 | atatgttatcggcagctgattaaa | 92685 | W29730 |
| 7478 | X66223 | tccgaacagcctacctgaagttgcc | 50082 | X66223 | tattaacacattccaatccagga | 92686 | W29730 |
| 7479 | X66223 | caagctctgcgctcctcgct | 50083 | X66223 | taaacacattccaatccagagaga | 92687 | W29730 |
| 7480 | X66223 | cattggagacactcccatcgacacg | 50084 | X66223 | acacattccaatccaggaagagat | 92688 | W29730 |
| 7481 | X66223 | tggagacactcccatcgacagctc | 50085 | X66223 | ttttattcagcaactgctgcgagac | 92689 | W29730 |
| 7482 | X66223 | cctgccccaaagtgatgctgt | 50086 | X66223 | tattcagcaactgctgcgagac | 92690 | W29730 |
| 7483 | X66223 | ccagtgcacagagcagcgctcac | 50087 | X66223 | agtgtgccactacgcccagagaat | 92691 | W29730 |
| 7484 | X66225 | agtcggtccatcttgacagagtc | 50088 | X66225 | ccatacgcccagagaaatgacagg | 92692 | W29730 |
| 7485 | X66225 | cggtccatcttgacagagtcctt | 50089 | X66225 | gtgtccacgaacaggaggagtctc | 92693 | W29730 |
| 7486 | X66225 | cttcgacagagtcctttacagttg | 50090 | X66225 | tgggtactcattctgatgcacact | 92694 | W29730 |
| 7487 | X66225 | cgacagagtcctttacagagttggg | 50091 | X66225 | ctcattctgatgcacactggagct | 92695 | W29730 |
| 7488 | X66225 | agtcctttacagagttggtgccaag | 50092 | X66225 | tctgatgcacactggagctcgggac | 92696 | W29730 |
| 7489 | X66225 | catcgtgtgtttaaccagatgcc | 50093 | X66225 | gcaggcactgatgtcaactgcgagc | 92697 | W29730 |
| 7490 | X66225 | cggtcgtttaaccagttggccaag | 50094 | X66225 | tggcaggcctagaggactcaga | 92698 | W29730 |
| 7491 | X66225 | gggcattccagaagattaccaag | 50095 | X66225 | tcactttttgcaacgagtcagc | 92699 | W29730 |
| 7492 | X66225 | agtggtttcctatcgggttctg | 50096 | X66225 | gctgaccaccgtgaaccagacctg | 92700 | W29730 |
| 7493 | L06463 | taccaggatcatacaaagtacaac | 50097 | Z35167 | aatcaggcaggtgccaggttgcatg | 92701 | W29730 |
| 7494 | L06463 | gatcataccaaagtacaaaggccaag | 50098 | Z35167 | caggtgccaggttgcagttcgaagac | 92702 | W29730 |
| 7495 | L06463 | accaagtacacatgagctctgtg | 50099 | Z35167 | tgacaggtcctactgcgtcagt | 92703 | W29730 |
| 7496 | L06463 | gtacaccatgagctcgtgccatc | 50100 | Z35167 | gtcctactgcgtcagtgcggt | 92704 | AA117973 |
| 7497 | L06463 | catgagctcgtgccatcgattc | 50101 | Z35167 | ctggctcgcagtgcgcgctccct | 92705 | AA117973 |
| 7498 | L06463 | ctcgtgccatctgatctctgggt | 50102 | Z35167 | tcctatgatgccactctcagggaa | 92706 | AA117973 |
| 7499 | L06463 | ctgattccttgagccaagatgg | 50103 | Z35167 | gatgccactctcagaggaagagatc | 92707 | AA117973 |

| SEQ ID NO | sequence | DBAxnID | SEQ ID NO | sequence | DBAxnID | SEQ ID NO | sequence | DBAxnID |
|---|---|---|---|---|---|---|---|---|
| 7500 | aagggaccacgtgcatgaagaat | L06463 | 50104 | agagatcgctcttacatcagccgc | Z35167 | 92708 | agaatcatatcgcaaacgcctgca | AA117973 |
| 7501 | tagaaacactactcacctgataa | L06463 | 50105 | ccgttcatcacgccgctgtgcg | Z35167 | 92709 | atcatatctcgcaaacggctgcaagg | AA117973 |
| 7502 | acactactcacctgataaaatgt | L06463 | 50106 | ggtccacgttcaggaccaatccatc | Z35167 | 92710 | atatctgcaaacggctgcaaggtgg | AA117973 |
| 7503 | tcctatacgggtctcgatgaca | L06463 | 50107 | gctgccttcgcgttcagttaccat | Z35167 | 92711 | tctgcaaacggtgcaaggtgata | AA117973 |
| 7504 | actggttctctgatgacagaccca | L06463 | 50108 | tgccttcatgttcgcaacattaa | Z35167 | 92712 | gcaaacggcgtcaaggtggataact | AA117973 |
| 7505 | ttctgatgacagaccaaagtc | L06463 | 50109 | gccagactattcagattccacactg | Z35168 | 92713 | aactccttcactcactgctgaatcag | AA117973 |
| 7506 | gatgacagaccaaagtctctct | L06463 | 50110 | agattccacactgtcctcaggggtg | Z35168 | 92714 | tcctactcactggtgaatcagaac | AA117973 |
| 7507 | ctccgtcaccacatctcgcag | L06463 | 50111 | ccttcatgatgcatacaagtgcagg | Z35168 | 92715 | tcactcactggtgaatcagaacccc | AA117973 |
| 7508 | gttcaccaacatcttcagaactc | L06463 | 50112 | aaggtctggccaagccctaacctc | Z35168 | 92716 | atggaatcctcaagaacactggtcc | AA117973 |
| 7509 | caccatcttcagaacttcgtttc | L06463 | 50113 | gcaattactacgctttggctgcg | Z35168 | 92717 | ttcaagaacatgtcccttcagcaag | AA117973 |
| 7510 | tatcaatgagtccctaccaccagg | L06463 | 50114 | caattcgtacagctttggctggc | Z35168 | 92718 | gtccctcagccaagccctgtgattc | AA117973 |
| 7511 | tggagctgcctgacaaatactgagcg | | 50115 | gctttggctggccactgtgatat | Z35168 | 92719 | cctcagcaagccctttgatttcgaa | AA117973 |
| 7512 | ggactgctgacaaatactgagcgt | | 50116 | ggctggccactgttgatagtcaga | Z35168 | 92720 | cagcaagccctttgatttcgaaatg | AA117973 |
| 7513 | ctattagtcagtaggttgtgctgg | | 50117 | acatgtttcacaaacctcagtcaga | Z35168 | 92721 | caagccctgtgattcgaaatggag | AA117973 |
| 7514 | tattagtcagtaggtttgctgg | | 50118 | gtatagccgatgtcaagttagcat | Z35168 | 92722 | gccctttgattcgaaatggagaga | AA117973 |
| 7515 | ggcttctctactaggaaacactg | | 50119 | tcatgtctcaacattaacaacgt | Z35168 | 92723 | gaccggatctctgctgatcttagaa | AA117973 |
| 7516 | gcttctctactaggaaacactg | | 50120 | cagagcccatgcctggcaatgatga | Z35168 | 92724 | atgctggccagtctaatgaatttttg | AA117973 |
| 7517 | gacgtcctgacaaatactgagcgtc | | 50121 | ccatgccaatgaacatgaaccct | Z35168 | 92725 | tgctggccagtctaatgaatttggc | AA117973 |
| 7518 | actgcctgacaaatactgagcgtcc | | 50122 | caatgaacatgaaccccctgaaggg | Z35168 | 92726 | aggccttccagattggcccagacc | AA118029 |
| 7519 | gcgtctcctattagtcagtaggt | | 50123 | acatggaaccccctgaaggagacagag | Z35168 | 92727 | gccttccagattgcgggccagaccg | AA118029 |
| 7520 | cgtcctccattagtcagtaggtt | | 50124 | gacagaatccagccattcattgg | Z35168 | 92728 | ccttccagattgcggccagaccgg | AA118029 |
| 7521 | gtcctcctattagtcagtaggt | | 50125 | agccattcattagtcgatgtcagt | Z35168 | 92729 | cttccagattcgggccagaccggt | AA118029 |
| 7522 | ctcctattagtcagtaggttgtgc | | 50126 | tcgcttcagccagactatica | Z35168 | 92730 | ttccagattgcggccagaccggtg | AA118029 |
| 7523 | tcctattagtcagtaggttgct | | 50127 | ggtgctcaacctgctgggagctggtt | Z35168 | 92731 | tcctttggcgggacgcgaataatg | AA118029 |
| 7524 | ccttattagtcagtaggttgtgctg | | 50128 | caaccgctggagcgtcacctg | Z35168 | 92732 | tgaccccattgctaattcccccaat | AA118029 |
| 7525 | ctcacccagccaggatgaagcta | | 50129 | tgtacctggcctccgtctctggccg | Z35168 | 92733 | ggtaaccaaggccttccagattgcg | AA118029 |
| 7526 | tctcaccccagccaggatgaagctac | | 50130 | ctggcgtccactcctcaaaggcac | X57971 | 92734 | gtaaccaaggccttccagatgcgg | AA118029 |
| 7527 | ctattagtcagtaggttgct | | 50131 | tccttcaaaggcacctcagagacaac | X57971 | 92735 | taaccaaggccttccagattgcggc | AA118029 |
| 7528 | cctattagtcagtaggttgtctg | | 50132 | cattcgtcggcagggaacctggtc | X57971 | 92736 | accaaggccttccagattgcggcca | AA118029 |
| 7529 | ctattagtcagtaggttgtctgg | | 50133 | cctggtcacagatgttctggaata | X57971 | 92737 | ccaaggccttccagattgtgggccag | AA118029 |
| 7530 | tattagtcagtaggttgtgctggg | | 50134 | tggaatacctggagccttgtgatg | X57971 | 92738 | caaggccttccagattgcgggccaga | AA118029 |
| 7531 | gcttctctactaggaaacactg | | 50135 | aggacaccggtgcttaccagaaatg | X57971 | 92739 | aaggccttccagattgcgggccagac | AA118029 |
| 7532 | gcttctctactaggaaacactga | | 50136 | ctggcgcttaccagaatgtgacaac | X57971 | 92740 | ttctgacgcaggtgcatgagtta | AA123463 |
| 7533 | tggactgcctgacaaatactgagcg | | 50137 | cagaatggacataccagactg | X57971 | 92741 | tcatcaaaggatacatcggccaaa | AA123463 |
| 7534 | ggactgcctgacaaatactgagcgt | | 50138 | gtgacactaccagactgggtcaca | X57971 | 92742 | caaatccttgcagtactaccggt | AA123463 |
| 7535 | gactgcctgacaaatactgagcgt | | 50139 | cagtgcctcagactcctacccctga | X57971 | 92743 | tgcagtactaccggttcccgacat | AA123463 |
| 7536 | actgcctgacaaatactgagcgtcc | | 50140 | caacggctctcatccaccctgagcag | X57971 | 92744 | gcagtactaccggttcccgacatg | AA123463 |
| 7537 | gcgtcctcctattagtcagtaggt | | 50141 | atccagagcagaactgggccaac | X57971 | 92745 | actacctgttcccgacatggga | AA123463 |
| 7538 | cgtcctcctattagtcagtaggt | | 50142 | ggccaacttgaccacagagagaga | X57971 | 92746 | ctacctggtccgacatggatgat | AA123463 |
| 7539 | gtcctcctattagtcagtaggttg | | 50143 | caacagctcgatccaagaagcag | X57971 | 92747 | actggttcccgacatggatgatgaa | AA123463 |
| 7540 | ctcctattagtcagtaggttgc | | 50144 | ctctgcatccaagaagaagcatatgtg | X57971 | 92748 | cctgtccgacatgatgatgaa | AA123463 |
| 7541 | tctccaaggctgctcccacga | W50665 | 50145 | ggctaatgtcactcaacagctgc | X57971 | 92749 | tggttcccgacatgatgatgaaga | AA123463 |
| 7542 | ctggctcccgatcagactctatgctcag | W50665 | 50146 | tcaacagagctgcccgagggcac | X57971 | 92750 | ggttcccgacatgatgatgaagaa | AA123463 |
| 7543 | tgcacgctgcgattcagcggaaag | W50665 | 50147 | tggctggctgactgtctgtt | X61675 | 92751 | ttcccgacatgatgatgaagaagg | AA123463 |
| 7544 | tgttacacatcaccacgcctgcg | W50665 | 50148 | tggctggactgtctgtttccag | X61675 | 92752 | agatgacatccgccaatccttg | AA123463 |
| 7545 | caccagctgcgaattcagcgagg | W50665 | 50149 | acatggctccggaagaatccaga | X61675 | 92753 | tgacatcggccaatcccttgcag | AA123463 |
| 7546 | atgaggaccgctgtctaaaactaggt | W50665 | 50150 | atccagacgctcggccactggga | X61675 | 92754 | actacctgttcccgacatggata | AA123463 |
| 7547 | gaccagctgtctaaactgaact | W50665 | 50151 | aagttccaaacggcagattcc | X61675 | 92755 | catcggccgacatgatgat | AA123463 |
| 7548 | agccgctctctaaacttgaccttca | W50665 | 50152 | aaggttcatccacagcactatg | X61675 | 92756 | tctggccaaatccctgcagtacta | AA123463 |
| 7549 | ccgtcctaaactgaacttccaatg | W50665 | 50153 | tcatccacatgcactacccagaa | X61675 | 92757 | ctggccaaatccctgcagtactac | AA123463 |

| SEQ ID NO | DBAxnID | sequence | SEQ ID NO | DBAxnID | sequence | DBAxnID |
|---|---|---|---|---|---|---|
| 7550 | W50665 | gtcctaaacttgaccttcaatgact | 50154 | W50665 | acatgactatagccagaagccaga | 92758 | ggccaaatccctgcagtactacct | AA123463 |
| 7551 | W50665 | ctaaacttgaccttcaatgactgca | 50155 | W50665 | actatagccagaagccagaatgcc | 92759 | gccaaatccctgcagtactaccg | AA123463 |
| 7552 | W50665 | aacttgaccttcaatgactgcaagg | 50156 | W50665 | agccagagtacgccagtggagcctc | 92760 | agcctttcacatggtagttacta | AA118053 |
| 7553 | W50665 | cccagactactgctcagtgcagc | 50157 | W50665 | ttagtaaggccagcagcaagcaag | 92761 | gcctttcacatgtagttactaa | AA118053 |
| 7554 | W50665 | ttgacctcaatgactgcaagggca | 50158 | W50665 | tgtcagtgtgatcctccagcag | 92762 | agataagaaccctgcaaacatagtc | AA118053 |
| 7555 | W50665 | actctatgctcagtgcagccgctg | 50159 | W50665 | gactgtctgttctcagccggc | 92763 | ataagaaccctgcaaacatagtcag | AA118053 |
| 7556 | W50665 | tgtcagtgcagccgcgtgtgaa | 50160 | W50665 | gatccctcctttagggaggccag | 92764 | tagaaacctgcaaacatagtcgt | AA118053 |
| 7557 | W50665 | gtgcagccgcgtgtgaatgcaaa | 50161 | W50665 | gcctcagtgaactctaccacctggg | 92765 | aaacccctgcaaacatgtcagtgtg | AA118053 |
| 7558 | W50665 | ccagtctcttgctcgggcaaga | 50162 | W50665 | ctgaactctaccacctggcctggaa | 92766 | accctgcaaacatagtcagtgtggg | AA118053 |
| 7559 | W50665 | ctctcggtcacgtctgcagatgatc | 50163 | W50665 | agagatccgacgcgctttgccaa | 92767 | ggaagcctttcacaatagtagcct | AA118053 |
| 7560 | W50665 | gtcacgtctgcagatgatctggagt | 50164 | W50665 | cccctgacttcaatcagtgcctaaa | 92768 | agcctttcacaatagtagcctcta | AA118053 |
| 7561 | W50665 | ctggagtgcagccctggaactccagc | 50165 | W50665 | acttcaatcagtgcctaaagaacag | 92769 | gcctttcacaaatagtagcctctaa | AA118053 |
| 7562 | W50665 | gaaataccgcgcgtcgtcagtgt | 50166 | W50665 | gcctaaagaacagtccggagagga | 92770 | ctttcacaatagtagcctctaaat | AA118053 |
| 7563 | W50665 | atacgggccgtcagtgtacga | 50167 | W50665 | agaacagtccggagagaattctt | 92771 | tttcacaatagtagcctctaaatt | AA118053 |
| 7564 | W50670 | ttcgtccggttcacgcaactcga | 50168 | AA033161 | tgcctgctggttgccaattccag | 92772 | tttcacatgtagttatctataac | AA118053 |
| 7565 | W50670 | gttgcacgacaactgaccgaaga | 50169 | AA033161 | cctgctgttgccaattccaggag | 92773 | ataccttaaaaggacactcaccagat | AA118053 |
| 7566 | W50670 | ttgcacgacaactgaccgaagag | 50170 | AA033161 | ttcagcctgcctcagtcattccg | 92774 | cctaaaaggacactcaccagataga | AA118053 |
| 7567 | W50670 | tgcacgacaactgaccgaagagg | 50171 | AA033161 | agcctgagctccagtcattccggag | 92775 | aggacactcaccagatagaaacct | AA118053 |
| 7568 | W50670 | gcacgacaactgaccgaagaggc | 50172 | AA033161 | ctgagctcagtcattccggagacc | 92776 | acactcaccagatagaaaacctgc | AA118053 |
| 7569 | W50670 | cacgacaactgaccgaagaggca | 50173 | AA033161 | agcctcagtcattccggagacctg | 92777 | acactcaccagatagaaacctga | AA118053 |
| 7570 | W50670 | acgacaactgaccgaagaggcat | 50174 | AA033161 | ctcagtcattccggagaccctga | 92778 | ctcaccagatagaaacctgcaaac | AA118053 |
| 7571 | W50670 | cgcgtcacgtacattccgt | 50175 | AA033161 | agtcattccggagaccctgcctga | 92779 | caccagatagaaacctgcaaacat | AA118053 |
| 7572 | W50670 | gcgtcgtcacgtacattccgtg | 50176 | AA033161 | cattccggagacctgcctctgatgg | 92780 | attcatgacagattccactaaccga | AA118062 |
| 7573 | W50670 | cgtcacgtacattccgctgg | 50177 | AA033161 | ttgtgctttatcgtaaggcaca | 92781 | ttcatgacagattccactaaccgac | AA118062 |
| 7574 | W50670 | gcgtcacgtacattccgtga | 50178 | AA033161 | aaggcaaacatttgccaggagtc | 92782 | gccaacgtcgcttgtgagcgat | AA118062 |
| 7575 | W50670 | tcgtcacgtacattccggac | 50179 | AA033161 | acatttgctgagcgctagtgac | 92783 | ccaagctgctttgggagcgatt | AA118062 |
| 7576 | W50670 | gtcacgtacattccgctggaccg | 50180 | AA033161 | gctggttgccaattccaggagcta | 92784 | caacgtcgctttgtggagcgatg | AA118062 |
| 7577 | W50670 | tcacgtacattccggctggaccgc | 50181 | AA033161 | ttgccaattccaggagctaacctca | 92785 | agtctgctttgggagcgatgct | AA118062 |
| 7578 | W50670 | cacgtacattccggctggaccgct | 50182 | AA033161 | ccaattccaggagctaacctcaagg | 92786 | cgtctgcttttgggagcgatgctg | AA118062 |
| 7579 | W50670 | ctttccaaggagctgagaacatgt | 50183 | AA033161 | attccaggagctaacctcaaggaga | 92787 | gtctgctttgggagcgattgctga | AA118062 |
| 7580 | | ggcgagcctacactgacatgaagga | 50184 | AA033161 | ggagctaacctaaggagagaggctt | 92788 | ctgctttgggagcgattgcgaac | AA118062 |
| 7581 | | ccaattactacagacctctggact | 50185 | AA033161 | gcagcagtccaccctcagggaaca | 92789 | tatcacttagcctatgacgaatatt | AA118062 |
| 7582 | | actacagacctctggactgcctgc | 50186 | AA033161 | acttcaggaacacctgaccatgg | 92790 | atcacttagcctatgacgaatatt | AA118062 |
| 7583 | | actgagtgctctctattagttcag | 50187 | AA033161 | tcaggaacacctgaccatggccatg | 92791 | cacttagcctatgacgaatatt | AA118062 |
| 7584 | | tctggggtctctctattaggaacact | 50188 | AA033161 | gatgtcatgccattgggaggcag | 92792 | catgacagattccactaaccgagc | AA118062 |
| 7585 | | ctcctataggaacactgaacact | 50189 | AA033161 | tatgccatctgggagcagccacca | 92793 | atgacagattccactaaccgacgcc | AA118062 |
| 7586 | | tgaaatgctctggggcacaata | 50190 | AA033161 | agaatgaccacgctctctgcatta | 92794 | tgacagattccactaaccgacgccg | AA118062 |
| 7587 | | tgctctggggcacaagtatac | 50191 | AA033161 | accacgctctctgcattaatgac | 92795 | agcaagccaacgtctgcttgt | AA118062 |
| 7588 | | atgtgatccccaagggttca | 50192 | AA033161 | acgctctctgcattaatgacgt | 92796 | gcaagtggccaacgtcgctttgtg | AA118062 |
| 7589 | | gtatcccacaaggtttcgaatgg | 50193 | AA033161 | ctctctgcattaatgcactgctg | 92797 | caagtggccaagtgctgctttgg | AA118062 |
| 7590 | | taactgctgaggagagaggtaa | 50194 | AA033161 | tgcattaatgcactgctgaagcct | 92798 | gtggccaacgtcgctgttgggagc | AA118062 |
| 7591 | | cctacactgacatgaagaagctgg | 50195 | AA033161 | attaatgctgctgaagctgg | 92799 | tggccaacgtcgcttttgtggagcg | AA118062 |
| 7592 | | gagacaaatactccatgctcggg | 50196 | AA117582 | aatgcactgctgaagcctgtggta | 92800 | cggagtcccagctgacattctat | W08109 |
| 7593 | | gctttcaggaattctcaggcagag | 50197 | AA117582 | ctgtcgaagcctgtggtaaggaaa | 92801 | agtccccagctgacattctatatg | W08109 |
| 7594 | | tcttcgagaagaccatggctgaca | 50198 | AA117582 | tctgaagcctgtggtaaggaaataa | 92802 | caggctcctggcactttcggtca | W08109 |
| 7595 | | gacacggcatgctgaccatggctgacca | 50199 | AA117582 | ataaccactaagcaaaatgttgccca | 92803 | gctcctgcacttcggtcatttc | W08109 |
| 7596 | | aggacacatgctgaccaggagc | 50200 | AA117582 | gaggcagccaaccaaaccatga | 92804 | cctgcacttctggtcattctta | W08109 |
| 7597 | | ccaacagccatgccgcgaatgcaa | 50201 | AA117582 | gcagccaccaaaccaacctcatgaagt | 92805 | gtgcacttctggtcattctagga | W08109 |
| 7598 | | gtggcaagaccccaattactacag | 50202 | AA117582 | gaaatgacccctaactacttaaca | 92806 | cactttctggtcatttcctagaagc | W08109 |
| 7599 | | accctgactgcctgccaaatac | 50203 | AA117582 | gacctaactactacagatga | 92807 | ctggcaatttcctaggaagccattc | W08109 |

| SEQ ID NO | sequence | DBAxnID | SEQ ID NO | sequence | DBAxnID | SEQ ID NO | sequence | DBAxnID |
|---|---|---|---|---|---|---|---|---|
| 7600 | cctggactgcctgccaaatactgag | | 50204 | cctaactacttaccagaatgacca | AA117582 | 92808 | cccattcctcgaattagccaggctg | W08109 |
| 7601 | ctggactgcctgccaaatactgaga | | 50205 | aactacttacacagaatgaccacgc | AA117582 | 92809 | atcctgaattagccaggctgaag | W08109 |
| 7602 | tggactgcctgccaaatactgagag | | 50206 | ttaacagaatgaccacgctctct | AA117582 | 92810 | cgaattagccaggctgaagaggcg | W08109 |
| 7603 | ggactgcctgccaaatactgagagt | | 50207 | cacagaatgaccacgctctctgca | AA117582 | 92811 | attagccaggctgaagaggacgacc | W08109 |
| 7604 | gactgcctgccaaatactgagagtc | | 50208 | cccggacgaggtggtgcgatcatg | W83082 | 92812 | ctccagctgacattctatatgaag | W08109 |
| 7605 | actgcctgccaaatactgagagtca | | 50209 | tgcggatcatggtcacctgtagcct | W83082 | 92813 | ccagctgacattctatatgaagatc | W08109 |
| 7606 | ctgcctgccaaatactgagagtcag | | 50210 | tgcagtccactgtggcctgtggt | W83082 | 92814 | cagtgcctgtttcctgacgtag | W08109 |
| 7607 | tctcacccagcaggatgaagctac | | 50211 | ctgtggtcctgctggcttga | W83082 | 92815 | cttgttcctgacgtagtctctc | W08109 |
| 7608 | tcatttattgggagggcttccaag | | 50212 | ttcctgctctggctgaagctct | W83082 | 92816 | gtgttcctgacgtagctcctcagg | W08109 |
| 7609 | acctcctggactgcctgccaaatac | | 50213 | gctctgggcctgaagctctgagaac | W83082 | 92817 | ttccgttgacgtagctcctcaggctc | W08109 |
| 7610 | cctggactgcctgccaaatactgag | | 50214 | ctggcctgaagctctgagaacaga | W83082 | 92818 | gtagctcctcaggctctgtgcact | W08109 |
| 7611 | ctgactgcctgccaaatactgaga | | 50215 | aagctctgagaacagagactcacgc | W83082 | 92819 | cctcaggctctgtgcactttctgg | W08109 |
| 7612 | tggactgcctgccaaatactgagag | | 50216 | ctctgagaacagactcacatgctc | W83082 | 92820 | cacacagcaaggttcattgcagaaga | AA118100 |
| 7613 | ggactgcctgccaaatactgagagt | | 50217 | tgagaccagactcacatgctcatt | W83082 | 92821 | ccacagcccgggccaagtgtgt | AA118100 |
| 7614 | gactgcctgccaaatactgagagtc | | 50218 | cagactcacatgctcattgctct | W83082 | 92822 | ggttcccactggcagttagcat | AA118100 |
| 7615 | actgcctgccaaatactgagagtcc | | 50219 | cacatgctcattgctcagag | W83082 | 92823 | tccccactgggcagttagcatcgg | AA118100 |
| 7616 | gaccactaactggagctgagtcaagtt | X14961 | 50220 | gcagtcccaagctggagcatcagaa | W83082 | 92824 | ttagcaccggattgcttcacca | AA118100 |
| 7617 | gaaactcatcctgactctcaccat | X14961 | 50221 | ctccattgctctgacaggctccca | W83082 | 92825 | tcggatttgtgttcaccagaggct | AA118100 |
| 7618 | atgctcctcatggttttccctct | X14961 | 50222 | gtccaagctgggacatcgagaactg | W83082 | 92826 | ttgctgttcaccagagctggaatt | AA118100 |
| 7619 | cctcaggttttccctctgcactt | X14961 | 50223 | gaggaaccagctgccatcgagctggtgt | W83082 | 92827 | ctgttcaccagagctggaatttg | AA118100 |
| 7620 | gattttctgagatacgggggcatc | X14961 | 50224 | cccagctgcactgtgtgagttga | W83082 | 92828 | tgattcaccactgcacagaggagcg | AA118100 |
| 7621 | gggcatcagctgaccagttcct | X14961 | 50225 | agcatcgagctgtgtgagtgacc | W83082 | 92829 | ttcaccactgcacagaggagcggt | AA118100 |
| 7622 | catcagctgaccagttcctgcact | X14961 | 50226 | tgagtgaccctgcagtgccact | W83082 | 92830 | actgcacagagagagcggcgta | AA118100 |
| 7623 | cagcctgaccagttcctgcactag | X14961 | 50227 | accctgcagtgccactgggcc | W83082 | 92831 | cagccctgcaagtgtgtcacac | AA118100 |
| 7624 | ggaccagttcctgcactatgtgtg | X14961 | 50228 | ctctgcagtcccactgtggcc | W83082 | 92832 | cagccccaagtgtgtgcgtacgg | AA118100 |
| 7625 | cccagttcctgcactatgtgtggtt | X14961 | 50229 | cggatcatgcgatcatcgcgctctg | W83082 | 92833 | cctccgggccaagtgtgtctcac | AA118100 |
| 7626 | agttcctgcactatgtgtggttat | X14961 | 50230 | gatcatgcgatcatcgcgctctgca | W83082 | 92834 | ccatcgacgccacctgcaacttgt | AA118100 |
| 7627 | gatctcaaagggtgctccaaggtca | X14961 | 50231 | tctgcagacaaggtcgtgtagaaag | W83082 | 92835 | ttgctgcacctgcaacttgtgca | AA118100 |
| 7628 | gatctcacccagccagtggtgtg | X14961 | 50232 | gtcgcgcactatgaggatggg | W83082 | 92836 | acggcacctgcaactttgtgcaag | AA118100 |
| 7629 | cacccatgcgtgtggcgagcact | X14961 | 50233 | tcgcagccactatgaggatggtccg | W83082 | 92837 | gcacctgcaactttgcacagtt | AA118100 |
| 7630 | gagcactggactatgagaagag | X14961 | 50234 | cgcagccactatgaggatggtccgg | AA138107 | 92838 | gcaacttgtgcaggttcccac | AA118100 |
| 7631 | cactggactatgagaaggaggg | X14961 | 50235 | ccactagaggatggtccggggaag | AA138107 | 92839 | ttgtgcacaggtccccactgtggc | AA118100 |
| 7632 | gtgactgagctccgtcactgac | X14961 | 50236 | cactatgaatggtccggggaaga | AA138107 | 92840 | cttcgcaaggtccaggcagctatgaa | AA118151 |
| 7633 | actggcgtctccgtcactgaccgg | X14961 | 50237 | ctatgaggatggtccgggaagaat | AA138107 | 92841 | tcgcaagtccaggcagctatgaaag | AA118151 |
| 7634 | ctcagcaccatgcgtcctcatggtt | X14961 | 50238 | ttggatctggttgcctgcacttt | AA138107 | 92842 | tatgccaggcattaacagatcaac | AA118151 |
| 7635 | agcacctagcctcatggttttc | X14961 | 50239 | tgcccgtcactttttatagtaag | AA138107 | 92843 | tgccaggcattaacagatcaacaac | AA118151 |
| 7636 | catgctcatctttgtcatctg | X03505 | 50240 | tgccgcacctttataagtaaga | AA138107 | 92844 | cagatcaacactttgtaagc | AA118151 |
| 7637 | tgccatcatctttgtcatctgatc | X03505 | 50241 | tcatgcggatctggctgctgcgac | AA138107 | 92845 | gataatgctacaacttatgtcata | AA118151 |
| 7638 | ttttctctcctgtttgcatctg | X03505 | 50242 | catgccgggatctggctgctgcgagac | AA138107 | 92846 | taatgctacaacttatgtcataaa | AA118151 |
| 7639 | ctctcctgtttgccagtcatgc | X03505 | 50243 | atgccgggatcatgcgctctgcagaca | AA138107 | 92847 | atgctacaacttatcatgcataaagg | AA118151 |
| 7640 | ttcctgtttccccagtcatcc | X03505 | 50244 | tggatcgctctgcagacaaggtcc | AA138107 | 92848 | gttacttcaacttcaggtgaagca | AA118151 |
| 7641 | atctgatcctaaacatcccaatg | X03505 | 50245 | atcatcgcgctctcgacaaggtcg | AA138107 | 92849 | acttcaactttgggaagcaagat | AA118151 |
| 7642 | tggatctctaaacatccccaaggtgc | X03505 | 50246 | atgcgctctgcagacaaggtcgtgt | AA138107 | 92850 | ttcaacttcagtgggaagcaagattt | AA118151 |
| 7643 | catccaatgtctgcataaatact | X03505 | 50247 | tgcgctctgcagacaaggtcgtgta | AA138107 | 92851 | gcttatcagcaaggctattgaaatt | AA118151 |
| 7644 | aatgcactttgtcgctcactgtt | X03505 | 50248 | gcgctctgcagacaaggtcgtgtag | AA138107 | 92852 | aagccaggcagctatgaaaggttg | AA118151 |
| 7645 | gcacttcgctgctcactgtgt | X03505 | 50249 | tctgacccatcctccagattgc | AA138107 | 92853 | gtccaggcagctatgaaaggttg | AA118151 |
| 7646 | cgctgcactgttttgacaggca | X03505 | 50250 | gggaccatcatccccagattgcat | AA033333 | 92854 | gaaatttccaagatgctgaaggc | AA118151 |
| 7647 | tgtcacgtgtttgacaggcacag | X03505 | 50251 | tcaacgtccagaacttccatatcag | AA033333 | 92855 | aatttccaagatgctgaaggcta | AA118151 |
| 7648 | catctgatccggaagtgcagccg | X03505 | 50252 | ccagaacttccatatcagctg | AA033333 | 92856 | ttccaagatgctgaaggctatg | AA118151 |
| 7649 | tgtttgacaggcacagggactcac | X03505 | 50253 | actccatatcagctgaggaccgg | AA033333 | 92857 | ctatgcactttatgccaggcatta | AA118151 |

| SEQ ID NO | sequence | DBAxnID | SEQ ID NO | sequence | DBAxnID | SEQ ID NO | sequence | DBAxnID |
|---|---|---|---|---|---|---|---|---|
| 7650 | taaagtcatcagcgatgccagagag | X03505 | 50254 | tccatatcagctgcgaaggacgggct | AA033333 | 92858 | atgcactttatgccaaggcattaac | AA118151 |
| 7651 | agtcatcagcgatgccagagaggct | X03505 | 50255 | tcaatgcactcatccacggcacag | AA033333 | 92859 | tttatgccaggcattaacagatca | AA118151 |
| 7652 | caggatgccagaggctgttcag | X03505 | 50256 | ggcacaggcctgagctgattgagta | AA033333 | 92860 | tccggcaggcatgcaccttaccaga | AA120389 |
| 7653 | gaagtcacggaacatggagagagag | X03505 | 50257 | atgatcagtcaccaacctaacaca | AA033333 | 92861 | ggcaggcatgcaccttaccagacat | AA120389 |
| 7654 | gtcacgggaacatggagagcaggac | X03505 | 50258 | atccagtcaccaacctaaacaatgc | AA033333 | 92862 | aatcaggcaccagaggattcatcaca | AA120389 |
| 7655 | ctcaagagctgaccagttgccaat | X03505 | 50259 | ccaacctaaacaatgcattgaagt | AA033333 | 92863 | acctatccgtcacgagtgtgga | AA120389 |
| 7656 | aagagctgaccagttgccaatgag | X03505 | 50260 | acctaacactgcattgaagtggc | AA033333 | 92864 | ctatacctcacgagtgtgaggac | AA120389 |
| 7657 | tgactcggcttctgtgcccagatc | X03505 | 50261 | ccatcatctcagattgccatcca | AA033333 | 92865 | agacagttctccacagttccac | AA120389 |
| 7658 | ctcggcttctgtgcccagatcact | W50708 | 50262 | tcagatttgccatccaggacalctc | AA033333 | 92866 | ctctcacagttccaaccggatcgt | AA120389 |
| 7659 | ggcatcatggtcatcgagatggttg | W50708 | 50263 | gatttgccatccaggacatctcgt | AA033333 | 92867 | cagttccaaccggatcgtcacctg | AA120389 |
| 7660 | atcatggtcatcgagatggttgaag | W50708 | 50264 | ccatccaggacatctctgtggaaga | AA033333 | 92868 | ccggattcgtcacctgagaaccal | AA120389 |
| 7661 | tacctcaacgaaaatcctcgcggg | W50708 | 50265 | aggacatctgtggaagaagactc | AA033333 | 92869 | gattcgtcacctgagaaccctata | AA120389 |
| 7662 | aacgaaaatcctcgcgggcattat | W50708 | 50266 | agacctctgctaggaaggaagactct | AA033333 | 92870 | tcacctggaaccatacagaggaga | AA120389 |
| 7663 | aatcctcgcgggcattataccga | W50708 | 50267 | aggaaggactctcctcctgtgcca | AA033333 | 92871 | cctgaaccatcacagaggaggaaga | AA120389 |
| 7664 | cctcgcgggcattataccctgatag | W50708 | 50268 | acgtcaagctccagaaccttccatat | AA033333 | 92872 | aggcatgcacctaccagacatcag | AA120389 |
| 7665 | gcatataccgtagatagctacaaatg | W50708 | 50269 | aggagctgctcacacagagtgt | AA033333 | 92873 | cgacctaccagacatcagcgagaaca | AA120389 |
| 7666 | ttataacctgatagctacaaatggaa | W50708 | 50270 | gtgactccgtcgtgatcgatcct | AA033333 | 92874 | cctaacgacatcagagagaacacac | AA120389 |
| 7667 | tacctgatagctacaaatggaactc | W50708 | 50271 | acccacctggatattcacatgga | AA033333 | 92875 | ggaaaacttctctcatagatctaac | AA120389 |
| 7668 | gctacaaatggaactcgaactc | W50708 | 50272 | atattcacatgagagctaccgtatgg | AA168903 | 92876 | aaactctctcatagatctaactta | AA120389 |
| 7669 | cggctctgtcccagatcactcct | W50708 | 50273 | acatggagctaccgtatggggacatt | AA168903 | 92877 | ctctcatagatctaacttaatcag | AA120389 |
| 7670 | ctctgtgcccagatcactctgaa | W50708 | 50274 | agatgcgcaggctcaatataccagt | AA168903 | 92878 | taacttaatccgccaagaggatt | AA120389 |
| 7671 | ctgtgcccagatcactctgaacag | W50708 | 50275 | tggcaggctcaatataccagtgcta | AA168903 | 92879 | cttaatcaggcaccagaggttcat | AA120389 |
| 7672 | tgcccagatcactctgaacacagagc | W50708 | 50276 | gcaggctcaatataccagtgctaca | AA168903 | 92880 | gcccttgccgaaagcacagctgt | AA120463 |
| 7673 | caaacgagtactatggttggaaca | W50708 | 50277 | tcaatataccagtgctacaggatga | AA168903 | 92881 | ctgccgaaagcatcagctgtgaa | AA120463 |
| 7674 | ctgatgccaccgagggtgtgacac | W50708 | 50278 | atatataccagtctacaggatgacgg | AA168903 | 92882 | caaagaatgcgctccgtctgcgcg | AA120463 |
| 7675 | tctctgggcatcgctacgaga | W50708 | 50279 | tcctttcctctgggtcacaggaag | AA168903 | 92883 | agctcaagctcggcaggattgaga | AA120463 |
| 7676 | ctgcatcatggctcatcgagaga | W50708 | 50280 | tcctctgggtcacggaagggccat | AA168903 | 92884 | atggagctctggcatacaaact | AA120463 |
| 7677 | aatactccatgctcggggaactat |  | 50281 | ctgatcgactctttccacctcagtg | AA168903 | 92885 | ttgagagctctggcatacaaactg | AA120463 |
| 7678 | atactccatgctcggggaactatg |  | 50282 | atcgactctttccacctcagtgat | AA168903 | 92886 | gctcggcatacaaactggtggictta | AA120463 |
| 7679 | caggcattcttcagcagtggacaca |  | 50283 | gttgtatccgctacctgacgtat | AA168903 | 92887 | cctggcatacaaactgggtggictta | AA120463 |
| 7680 | aggcattcttcagcagtggacaca |  | 50284 | atatccgctacctgacgtcagtat | AA168903 | 92888 | cctctcacctagcctagcacaggg | AA120463 |
| 7681 | ggcattcttcagcagtggacacaag |  | 50285 | tccgtacctgacgtcagtatctt | AA168903 | 92889 | tctcacctagcctaatgaccaggtc | AA120463 |
| 7682 | gcattcttcagcagtggacacaagg |  | 50286 | gctacctgacgtcagtatcttggg | AA168903 | 92890 | ctcacctgacctaatgaccaggtc | AA120463 |
| 7683 | cattcttcagcagtggacacaagga |  | 50287 | acgtcagtatcttgggcaaattgc | AA168903 | 92891 | cacctagctaatgaccaagtccg | AA120463 |
| 7684 | tactccatgctcggggaactatga |  | 50288 | ctgaccacctgggatattcacat | AA168903 | 92892 | tgccgaaagcatcagctgtgaag | AA120463 |
| 7685 | actctcatgctcggggaactatgat |  | 50289 | cctccaagtatgatacgtgatgg |  | 92893 | aagcatcagctgaagcggcgccg | AA120463 |
| 7686 | atgctcggggaactatgatgtgatg |  | 50290 | gaaacctcagattatatcccattg |  | 92894 | agcatcagctgaagcggcgccgc | AA120463 |
| 7687 | gggcattcaggcattcttcagcagt |  | 50291 | tactctgccttggaatggaaccca |  | 92895 | tcttgttccgcctcgctgctaa | AA120463 |
| 7688 | ggcattcaggcattcttcagcagtg |  | 50292 | ggaccaggaactgccttgccatgatg |  | 92896 | tgtgttccgcctcgctaatcc | AA120463 |
| 7689 | gcattcaggcattcttcagcagtg |  | 50293 | aggttgctcatgaaatatgaaac |  | 92897 | tgttccgcctcgctcgctaatcca | AA120463 |
| 7690 | gcattcaggcattcttcagcagttg |  | 50294 | atgaactgtctcactaaaattag |  | 92898 | tccgtaatccaagaaatgcgcct | AA120463 |
| 7691 | tcaggcattcttcagcagttggacac |  | 50295 | ctgctccactaaaattacaga |  | 92899 | ccaaagaatggcctctcctgctggc | AA120463 |
| 7692 | aatacttccatgctcggggaactat |  | 50296 | cagtacctgcgaaattaagcagag |  | 92900 | acggctcgagctggggaagaact | W08125 |
| 7693 | atacttccatgctcggggaactag |  | 50297 | aaggtgccacggatgcagtca |  | 92901 | gggaagaactgccccttcgctgct | W08125 |
| 7694 | atccatgctcggggaactag |  | 50298 | ggagcatgctctccccaaggt |  | 92902 | catctggctgatgaccctggtct | W08125 |
| 7695 | ggcattcaggcattcttcagcagt |  | 50299 | tgagtccccaaggagttctct |  | 92903 | gacaagcagcgactcttatggaa | W08125 |
| 7696 | gcattcaggcattcttcagcagtgg |  | 50300 | ttctctgagttcttcagaaggca |  | 92904 | acagaagcagcgactcttatggaa | W08125 |
| 7697 | tcaggcattcttcagcagtgggacac |  | 50301 | ctcagatatatccccattgctaata |  | 92905 | agaagcagcgactcttatggaaac | W08125 |
| 7698 | ggcattcttcagcagtgggacaca |  | 50302 | ttatatcccattgctaatagactg |  | 92906 | gaacaggcagctcttatggaaact | W08125 |
| 7699 | aggcattcttcagcagtgggacaca |  | 50303 | gtgtatccccaaagggtcaacag |  | 92907 | aagcagcgactctttatgccaacg | W08125 |

| SEQ ID NO | sequence | DBAxnID | SEQ ID NO | sequence | DBAxnID | SEQ ID NO | sequence | DBAxnID |
|---|---|---|---|---|---|---|---|---|
| 7700 | ggcattcttcagcagtggacacaag | | 50304 | atccccaaagggtcaacagtgatga | | 92908 | agcagcgactcttatggaaactgg | W08125 |
| 7701 | gcattcttcagcagtggacacaagg | | 50305 | atccatcttatgctctttcaccatg | | 92909 | aactggacaacttctatcacgggca | W08125 |
| 7702 | cattcttcagcagtggaccaagga | | 50306 | tcttatgctcttcaccatgacccac | | 92910 | actggacaacttctatcacgggcat | W08125 |
| 7703 | tacttccatgctcgggaactatga | | 50307 | ttccaactgaaaggttcagcaagg | | 92911 | ctggacaacttctatcacgggcatg | W08125 |
| 7704 | actccatgctcggggaactatgat | | 50308 | agcattgatccttagtatatcgc | | 92912 | gaagaactgccctgcgtgtcgtc | W08125 |
| 7705 | cttccatgctcggggaactatgatg | W50767 | 50309 | ggagcatgagtccctcaaggagt | | 92913 | tggacaacttctatcacgggcatga | W08125 |
| 7706 | atgctcggggaactatgatgctgcc | W50767 | 50310 | gagcatgagtccctcaaggagtt | | 92914 | agaactgccctgcgtgtcgtcg | W08125 |
| 7707 | gatcaggaggctcgggcggctga | W50767 | 50311 | catgagtccctcaaggagttctt | | 92915 | aagatgcatcttggctgatgacc | W08125 |
| 7708 | tatcaggaggctgggcggctgaa | W50767 | 50312 | atgagtccctcaaggagttcttc | | 92916 | gatgcatcttggctgatgaccct | W08125 |
| 7709 | atcaggaggctcggccggctgaag | W50767 | 50313 | tgagtctcccaaggagttcttct | | 92917 | atgtgcatcttggctgatgaccctg | W08125 |
| 7710 | tcagggaggcctggccggctgaagt | W50767 | 50314 | cttctgagttcttcagaaagcgt | | 92918 | tggcatctggcgtgatgacctgg | W08125 |
| 7711 | gtcgtcaagatcttcaagacaca | W50767 | 50315 | ttctgagtcttcagaaaggcagtg | | 92919 | gtgcattcttggatgaccctggt | W08125 |
| 7712 | tcaagatcttcaagacacaagct | W50767 | 50316 | ttttagttcatcatgagtaaaat | | 92920 | gcatcttggctgatgacccctgcc | W08125 |
| 7713 | tacaaccactctgctggcatcaaa | W50767 | 50317 | ggagcatgagtctcccaaggagt | | 92921 | tgtctctattctccctctacagc | W07927 |
| 7714 | ccactctgtggcatcaaaccactg | W50767 | 50318 | gagcatgagtctcccaaggagtt | | 92922 | ctacagtcgctcaaccactcttga | W07927 |
| 7715 | tgctggcatcaaaaccactggggttg | W50767 | 50319 | catgagtctcccaaggagttctt | | 92923 | gccagatccagatacagataagacact | W07927 |
| 7716 | catcaaaccactgaggttgggatc | W50767 | 50320 | atgagtctcccaaggagttcttc | | 92924 | attccagatcaagacactgcaca | W07927 |
| 7717 | ctcatcgtgacaatggttccag | W50767 | 50321 | tgagtctcccaaggagttctct | | 92925 | cccagactaagacactgacagtt | W07927 |
| 7718 | caatgtccaggaagcagctgga | W50767 | 50322 | ctctgagtctcagaaaggcagt | | 92926 | tgtgacagttgctgcggtccact | W07927 |
| 7719 | ttcccaggaagcagctcgaaagca | W50767 | 50323 | ttctgagtcttcagaaaggcagtg | | 92927 | ctgtcgccactgtgttttagttgc | W07927 |
| 7720 | cagcagcgccatgctgccagcgcagtt | W50767 | 50324 | atttagttcatcatgagtaaaat | | 92928 | tcggtccactgtgttttagttgcaaa | W07927 |
| 7721 | catgctcagcttggagatgctc | W50767 | 50325 | ttttagttcatcatgagtaaaat | | 92929 | ggtccactgtgttttagttgcaaaga | W07927 |
| 7722 | gatgctcttcgtctaacatccat | W50767 | 50326 | ccgcttcaccatgtagaaaaggg | | 92930 | gtccactgtgtttttagttgcaaagat | W07927 |
| 7723 | tcttcaagacacaagttctagg | W50767 | 50327 | gttcaacatgaataacaaggggtc | | 92931 | tccactgtgtttagttgcaaagat | W07927 |
| 7724 | ctttctaacatcccattcccca | W50767 | 50328 | taccacagccctgggtggactaca | | 92932 | tgttactgtcttaaggggccaca | W07927 |
| 7725 | agacacacaagttctaggaccacaa | W50767 | 50329 | actacacatcaacatcctttgc | | 92933 | ctggccctaaccactccttgagctcggg | W07927 |
| 7726 | acaagctctaggaccacatcaagt | W50767 | 50330 | acaactcaacatccttttgctga | | 92934 | tgtgctttcatagggctttccctg | W07927 |
| 7727 | ttctaggaccacacagtccagga | W50767 | 50331 | acatctccttttgctgacac | | 92935 | ttgcctaaacctgaagatgtctc | W07927 |
| 7728 | gaccacatcagaaggtccaggaa | W50767 | 50332 | tcctttttgctgacacccacatcc | | 92936 | aacctgaagatgtctcccaagct | W07927 |
| 7729 | atcaagtccaggatcgcaaggat | W50767 | 50333 | tttttgctgacaccacatcctg | | 92937 | aagatgtctcccaagcctgtggc | W07927 |
| 7730 | aggattattgcctagccaaaggt | W50767 | 50334 | ttcctgatcccccattcaaggcca | | 92938 | atgtctcctcaagcctgtgggc | W07927 |
| 7731 | caaaggctgttaagcctgctgaagaa | W50767 | 50335 | cattcaaggcccatgtggctccttg | | 92939 | ccaagcctggggcagcatgccc | W07927 |
| 7732 | gtcaagcctagccctgcgaggaaa | W50767 | 50336 | tcaaggccatgtgcttgtcttt | | 92940 | caagcctggggcagccatgccccaga | W07927 |
| 7733 | cctagccctgccgagaaacacag | W50767 | 50337 | aggccatgctgctgcttgttga | | 92941 | cacattggctctgctcaccatt | W07927 |
| 7734 | aagctcaggtgctcgggttctag | M24086 | 50338 | gcctgggcctgacagtggaaggccc | | 92942 | ttgggctctgctcaccaattctcc | U12560 |
| 7735 | ctcacatccagtgaagttgctaccg | M24086 | 50339 | atgtgctctgtgtttgatgcatc | | 92943 | tctgctttcatgaagaattgcaa | U12560 |
| 7736 | gctaccgaggtgcgtctgcctca | M24086 | 50340 | cagtggaaggccctgtgaagcaca | | 92944 | ctgctctcatgaagaatcgcaaa | U12560 |
| 7737 | atgcaccgcagccgaggtgatccag | M24086 | 50341 | aaggccctgtgaagcacagttga | | 92945 | gcgtttttgaacctgcagaaatct | U12560 |
| 7738 | ccgcagccgaggtcgatccagcaaag | M24086 | 50342 | gccctgtgaagcacagttgagtg | | 92946 | tttaacttcgtatctgctagc | U12560 |
| 7739 | tttgctgccaaaatcgaaagata | M24086 | 50343 | cctgtgaagcacagttgagtgct | | 92947 | taactttcgtattctgctagctg | U12560 |
| 7740 | agactacgcctacgatctgaaac | M24086 | 50344 | atgtacatgctcgtgtcttatgt | | 92948 | aactttgtattctgctagctga | U12560 |
| 7741 | aagcatgactcccccagaaat | M24086 | 50345 | catgctcgctctattgtacccac | | 92949 | acttcgtattctgctagctgaa | U12560 |
| 7742 | gagcattcctcccagaaataaagtc | M24086 | 50346 | ctgtcttatattgcccactgccgc | | 92950 | tttcgtattctgctagctgaata | U12560 |
| 7743 | tcctccagaaataaagttcctggg | M24086 | 50347 | caccccagctcattcctgcagtgaa | X78545 | 92951 | ttcgtatctgctagctgaatat | U12560 |
| 7744 | gtgatgcaaacagcactttgacca | M24086 | 50348 | cattcctgctgaagccatacct | X78545 | 92952 | tattctgctagctgagatcag | U12560 |
| 7745 | agcactttgaccaagacacactggtgc | M24086 | 50349 | cagaattccagtctttatgcctg | X78545 | 92953 | tggctcctgctcaccaattctca | U12560 |
| 7746 | ttgaccaagacactggtggtgtc | M24086 | 50350 | cagctttatgcctttgattcgggaa | X78545 | 92954 | atctgctagctgaaatatcgaga | U12560 |
| 7747 | aagacactggtgctgctgccccta | M24086 | 50351 | actcctgcaacacctagaaacaca | X78545 | 92955 | gggctcctgctcaccaattctccag | U12560 |
| 7748 | ggcatcaggctgctggatggaagatca | M24086 | 50352 | ctgaaccaacctgtgctggg | X78545 | 92956 | ctcgctagctgaatatgcaga | U12560 |
| 7749 | ctgccaccgccatcatccagttg | M24086 | 50353 | gaacaaaaccgtgtcggggca | X78545 | 92957 | ctcctgctcaccaattccagttg | U12560 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 7750 | tccagcaccatcatcaaggagggca | M24086 | 50354 | gccagttgccagcatccggggtat | X78545 | 92958 | tcctgctcaccaattctccaggtga | U12560 |
| 7751 | tcataccatatcaaggtgaagctca | M24086 | 50355 | agtgtccagcatccgggtatggt | X78545 | 92959 | ctgtccaccaattctccaggtgacc | U12560 |
| 7752 | ccctcaactggtcagctggactcgg | AA013831 | 50356 | cagatcctggggtatggtgtctg | X78545 | 92960 | tgtccaccaattctccaggtgacce | U12560 |
| 7753 | tccaactggcagctgactcggtc | AA013831 | 50357 | tggttgtcgagccttaataagaa | X78545 | 92961 | gtcgtcttcatgaagaatgtca | U12560 |
| 7754 | actctgaattgcctgagagggatac | AA013831 | 50358 | tgtctgagccttaataagaaatc | X78545 | 92962 | tgcactctcaaagtctgaagtgatt | AA118584 |
| 7755 | ctctgacctcactgcagtcagtacca | AA013831 | 50359 | tgaagccatactccacgagagctt | X78545 | 92963 | cactctcaaagtctgaagtgattaa | AA118584 |
| 7756 | acctcactgcagtcagtaccaaggtgaa | AA013831 | 50360 | acctcacgagctgttgacaatgaa | X78545 | 92964 | gcaaccccatccattgcatgattata | AA118584 |
| 7757 | tcactgcagtaccaaggtgaagac | AA013831 | 50361 | aacactggtcaatgacatcatgctc | X78545 | 92965 | aaccccatccattgcatgattaatg | AA118584 |
| 7758 | cttgcagtaccaaggtgaagactct | AA013831 | 50362 | catcatgctctgaagctgaacgc | X78545 | 92966 | cccatccattgcatgattaatgct | AA118584 |
| 7759 | tgaagactctgctgctaaatgctgc | AA013831 | 50363 | cattgcagttgtgccttgtgtact | X78545 | 92967 | gtattaatgctgatcctatgactgt | AA118584 |
| 7760 | agactctgctgctaaatgctgctca | AA013831 | 50364 | tccaaatttacaagctctgtggctc | X78545 | 92968 | attaatgctgatcctatgactgtag | AA118584 |
| 7761 | tgctgctaaatgctgctcagaaccac | AA013831 | 50365 | atlccacagaatttccagctttatg | X78545 | 92969 | taatgctgatcctatgactgtagtg | AA118584 |
| 7762 | ctgctcagaacaacacgcgagcatg | AA013831 | 50366 | caccagaatttcagctttatgct | X78545 | 92970 | atgctgatcctatgactgtagtgt | AA118584 |
| 7763 | agaacacacgagccatgcctgc | AA013831 | 50367 | tcaaggctgcctggagatgagat | X78545 | 92971 | tgatcctatgactgtagtgtgggct | AA118584 |
| 7764 | tcctctaaaggctgggtctgacal | AA013831 | 50368 | ttgagactacccgcggctgctgga | X78545 | 92972 | atcctatgactgtagtgtgggctta | AA118584 |
| 7765 | ttctaaaggctgggtgactatcca | AA013831 | 50369 | ttttcctgattcctctatgcaggt | X78545 | 92973 | cctatgactgtagtgtgggcttaga | AA118584 |
| 7766 | ctggtgctgacatcatgcagaagaa | AA013831 | 50370 | tggattctctatgcaggttgggtc | X78545 | 92974 | tgattaatatccacgtgtagctga | AA118584 |
| 7767 | gtgctgacatccatgcagagaatga | AA013831 | 50371 | acaatatccaatttacaagtctg | X78545 | 92975 | attaatatccacgtgtagctgcaac | AA118584 |
| 7768 | ctgacatccatgcagagaatgagga | AA013831 | 50372 | tccaatttacaagtctctgtggctc | U02880 | 92976 | taatatccacgtgtagctgcaaccc | AA118584 |
| 7769 | gcgactccgactctgaatggcctga | AA013831 | 50373 | gtcttcattgaaccccagatcacc | U02880 | 92977 | atatccacgtgtagctgcaaccat | AA118584 |
| 7770 | actccgactcgaatggcctgagag | AA013831 | 50374 | tattgaaccccagatcaccttcaac | U02880 | 92978 | acgtgtagctgcaaccatccattg | AA118584 |
| 7771 | ccgactctgaatggcctgagaggga | AA013831 | 50375 | tccactaagttttctggtcgcctg | U02880 | 92979 | gtgtagctgcaaccatccatcgca | AA118584 |
| 7772 | cagaaaactcacagacagaggtgat | AA013831 | 50376 | ttcggtcgcctgacccattttctt | U02880 | 92980 | gtagctgcaaccatccatccatg | AA118584 |
| 7773 | aactcacagaccaggtgatgcagaa | AA013831 | 50377 | tttcttttaatccccaagctttgatg | U02880 | 92981 | ctgaaccatccattgcatgatt | AA118584 |
| 7774 | acgtctgaacagctctctcacact | W50655 | 50378 | taatccacaggctttgaatggaacg | U02880 | 92982 | tagatgccaggctgaagtaagcga | AA118546 |
| 7775 | gtcttgacaacgtctctcacactcc | W50655 | 50379 | agagtcatccttttccgtcctcaa | U02880 | 92983 | gattgaagcccaagctcattgatgt | AA118546 |
| 7776 | cttgacaacgtctctcacactcctt | W50655 | 50380 | agcaccatcagtcgattcctctaa | U02880 | 92984 | cgcctgagttctaccaagtatgcca | AA118546 |
| 7777 | tctcacactctctctactacat | W50655 | 50381 | catcagttcctctaaagaacc | U02880 | 92985 | agttctaccaagtatgccacaacca | AA118546 |
| 7778 | tcacactctctactagttacataga | W50655 | 50382 | tccaagacagtcgcagagataagt | U02880 | 92986 | tatgccaaccaaaaaggattatga | AA118546 |
| 7779 | gaattaagtccctgaagcagctcca | W50655 | 50383 | catcccaggttccaggaacctgaag | U02880 | 92987 | gccaacaccaaaaaggattatgaaga | AA118546 |
| 7780 | attaatgccctgaagcagctccagg | W50655 | 50384 | acacgggctcctctgggatgcgaag | U02880 | 92988 | aaattgacctagcattgctgtca | AA118546 |
| 7781 | taatgccctgaagcagctccagttg | W50655 | 50385 | tcggaagttccagcccaggagttac | U02880 | 92989 | ttggacctagcattgctgtcacaa | AA118546 |
| 7782 | atgccctgaagcagctccaggttg | W50655 | 50386 | ttgattcagcacctgtttggggccag | U02880 | 92990 | ctagcattgctgtcacaatccagt | AA118546 |
| 7783 | tgaagcagctccaggtgatggtgag | W50655 | 50387 | tgttgtccacacaggatgacaga | U02880 | 92991 | ttgtgctcacatccagttggag | AA118546 |
| 7784 | ctcacagacccaggtgatgcagaacc | W50655 | 50388 | ttgctcccacacagagacacgaagg | Z12302 | 92992 | gtcaaatccagtgttggagtcat | AA118546 |
| 7785 | gatgcagaacccacagtgctggca | W50655 | 50389 | agaagaaataccactgccaagaacg | Z12302 | 92993 | acaatccagtgttggagtcaglc | AA118546 |
| 7786 | cagaaccccacaagtgctggcagctt | W50655 | 50390 | aatacactgcaagaacgagttga | Z12302 | 92994 | tgaagccagcctattgatgtaca | AA118546 |
| 7787 | gaaccccacaagtgctggcagttg | W50655 | 50391 | agaagagctgacctatccagaagtg | Z12302 | 92995 | agcccaagcctattgatgtacaagt | AA118546 |
| 7788 | accccacaagtgctggcagcttgca | W50655 | 50392 | agagacctgacctatccagaagtg | Z12302 | 92996 | tacaagttattacacaccatatga | AA118546 |
| 7789 | aagtgctggcagcttgcaggaag | W50655 | 50393 | gagcactgaagcacactgcatgaagga | Z12302 | 92997 | ttattacacaccatatgcagcggta | AA118546 |
| 7790 | agctttgcaggaacgcttgacaac | W50655 | 50394 | tcgtccgcaaggcacagcccccagcag | Z12302 | 92998 | accatatgcaggatgcagtctg | AA118546 |
| 7791 | gaacgttcgacaacgtctctcaca | W50655 | 50395 | gcagcccctactcatgagccgtc | Z12302 | 92999 | atgcagtctgttggaggtcaat | AA118546 |
| 7792 | gcctatacatcggacaatcaaaagt | Y00426 | 50396 | tcctgcaagactccccatctc | Z12302 | 93000 | caatgctgcttcacgccgagtt | AA118546 |
| 7793 | tatacatcggacaatcaaaagtcac | Y00426 | 50397 | cctgtgacatcagcgaggatgaaga | Z12302 | 93001 | cttccacgcgagttcctaccaagt | AA120585 |
| 7794 | atgtctgaccccaccagagacattt | Y00426 | 50398 | cacctccagaagctctgtgaat | Z12302 | 93002 | aatgtgcaaatctcctgtgaattaa | AA120585 |
| 7795 | cccacacagcatctcattttgta | Y00426 | 50399 | aaggtattccacatcagacatcat | Z12302 | 93003 | tgtgcaaatcctttgaaattac | AA120585 |
| 7796 | cacaagacattctattttgtcacg | Y00426 | 50400 | acctccagaagctctctgtcaatt | Z12302 | 93004 | atctggctcacaaggatatgtac | AA120585 |
| 7797 | acatctattttgtacagagatc | Y00426 | 50401 | cagacatcatcaccgcattgctccg | Z12302 | 93005 | ctggctcacaaggatatgtacac | AA120585 |
| 7798 | tgtacagagatccctgtcaatcc | Y00426 | 50402 | tcatcaccgcattgctcgtgacta | Z12302 | 93006 | ggctcacaaggatatgtacacat | AA120585 |
| 7799 | acagagatccctgtcaatccttaa | Y00426 | 50403 | ttgtccgactatgtatgtgatgc | Z12302 | 93007 | cacagccgaaactaccatgggca | AA120585 |

| SEQ ID NO | sequence | DBAxnID | SEQ ID NO | sequence | DBAxnID | SEQ ID NO | sequence | DBAxnID |
|---|---|---|---|---|---|---|---|---|
| 7800 | atcttacaacaaaacctcatggaca | Y00426 | 50404 | ggggctacactgccaaggagtcaa | Z12302 | 93008 | gtatactacggagcagggaaaca | AA120585 |
| 7801 | caacaaaacctcatggacatcagat | Y00426 | 50405 | acactgccaaggagctcaatgtcag | Z12302 | 93009 | atactacggagcagcaggaaacagg | AA120585 |
| 7802 | cagagttcactctatctggagctt | Y00426 | 50406 | tcaaatgcagctttatcaacgagaa | Z12302 | 93010 | gagtcttcaagatacatcttcctcac | AA120585 |
| 7803 | agttcactctatctggagctttc | Y00426 | 50407 | atgtcagcttatcaacgagaagaa | Z12302 | 93011 | gtcttcaagatcatcttcctcacca | AA120585 |
| 7804 | tcacagtccgtggatggaagaata | Y00426 | 50408 | tggctatgggctgctgtagtagg | AA032366 | 93012 | cttcaagatcatcttcctcaccatc | AA120585 |
| 7805 | ctccagtacacctatgtaccactg | Y00426 | 50409 | cggaacaaagtgctggaagacag | AA032366 | 93013 | tcaagatcatcttcctcaccatcaa | AA120585 |
| 7806 | tacacctatgtaccactgggagtc | Y00426 | 50410 | atgatgttggctacctgggattctag | AA032366 | 93014 | cataaccgcggcttctacaaggca | AA120585 |
| 7807 | ccactggagtcctcctctggcat | Y00426 | 50411 | tgttggctacctgatttctagaga | AA032366 | 93015 | taaccgcggcttctacaaaggcatg | AA120585 |
| 7808 | caccagtatagtctgcgacagga | Y00426 | 50412 | ttggctacctgatttctagaagga | AA032366 | 93016 | accgcgggcttctacaaaggcatg | AA120585 |
| 7809 | gtatagtctgcgacaggagcagga | Y00426 | 50413 | tagatgtctgctctggccatgatt | AA032366 | 93017 | cgcgggcttctacaaaggcatgaact | AA120585 |
| 7810 | tctgcgacaggagcaggataacta | Y00426 | 50414 | gatgctgctccggccatgatttta | AA032366 | 93018 | aggcatgaactcccagatacctgaa | AA120585 |
| 7811 | actatgtgtgacccacaagacat | Y00426 | 50415 | ttgctgccatgattttactgaa | AA032366 | 93019 | gcatgaactcccagatacctgaagc | AA120585 |
| 7812 | taagagttcactctggataagg | Y00426 | 50416 | tgattaacgccatgttgga | AA032366 | 93020 | gaactccagatacctgaagctgca | AA120585 |
| 7813 | aatcagtcttactgaccccagctg | M26270 | 50417 | atttaactgaaccgattgttgatg | AA032366 | 93021 | acagtccaagaaatacagatctg | AA118294 |
| 7814 | tagtaactgccatcgtggactga | M26270 | 50418 | ttaactgaaccgattgttgatgta | AA032366 | 93022 | gatcatgacggacgacatataa | AA118294 |
| 7815 | ctgcatcgtggactgacatgtg | M26270 | 50419 | taactgaaccgattgttgatgtag | AA032366 | 93023 | aatccagaagcttctagataat | AA118294 |
| 7816 | gcctatgtcccagatgacgttgtta | M26270 | 50420 | gaacacagctggtggaagacagtg | AA032366 | 93024 | ctgccaagggtgcgagttcca | AA118294 |
| 7817 | gtcccagatgacgtgttaatctac | M26270 | 50421 | aactgaaccgattgttgatgtagt | AA032366 | 93025 | tgctgagtctcagacgaggaactg | AA118294 |
| 7818 | aatctacatctctcagagtttga | M26270 | 50422 | tgtagaaccgttctctatcgagga | AA032366 | 93026 | gccttttagagccttcaccgatgtc | AA118294 |
| 7819 | tgtatactactgctataaaacat | M26270 | 50423 | tagaaccgttcctctatcgagggc | AA032366 | 93027 | ctttagaccttcaccgatgcagg | AA118294 |
| 7820 | ctcactgctatgaaaacatgcagga | M26270 | 50424 | tatcgaggagcgctaacgaacagt | AA032366 | 93028 | agcctccaccgatgtcaggaaatgg | AA118294 |
| 7821 | tgcaggactccgttcctccttg | M26270 | 50425 | agccgttactgaacagtgttgctat | AA032366 | 93029 | cttgacttgcgagggcactagtgc | AA118294 |
| 7822 | cctttattgcaactgtagta | M26270 | 50426 | ggacatgcaaccgtagatgagcatg | AA032366 | 93030 | gcacttgcgagggcactagtgctat | AA118294 |
| 7823 | attctactcatctgaggtgtgt | M26270 | 50427 | aactgaaccgctagatgagcatgat | AA032366 | 93031 | gcactgtgctatgagcgtagagtg | AA118294 |
| 7824 | ctctctgaccacagctgccaaca | M26270 | 50428 | gcatgatgttggctacctggatct | AA032366 | 93032 | agccgtgagtacaccaaactgatc | AA118294 |
| 7825 | ctgaccccagctgtcaacactgtg | M26270 | 50429 | cttacgcaaaatcgccaactgctg | AA032366 | 93033 | cctgagtacaccaaactgatctca | AA118294 |
| 7826 | taagttctccaaccatgactatagg | M26270 | 50430 | cgccaacttgctgaagccagaacaa | X60367 | 93034 | ccagagcctctagatatcag | AA118294 |
| 7827 | atttcaaacgctagcactgggcatt | M26270 | 50431 | cgaccgaagtcgatgaccacgtg | X60367 | 93035 | gagtacaccaaacgtatctcaaga | AA118294 |
| 7828 | gcactgggcattgcctaacaata | M26270 | 50432 | cactgaggctggatgtgaacagt | X60367 | 93036 | gagagccttcctagataatcaggag | AA118294 |
| 7829 | ggcatttcgcctaacaatactgga | M26270 | 50433 | tgacaaactccagtggctgcagaag | X60367 | 93037 | agccttctagattaatcaggagtag | AA118294 |
| 7830 | gggatcctcgcagggagtattta | M26270 | 50434 | actccagtgtgcagaagggagag | X60367 | 93038 | agcaacatgacgacatgctaaggat | AA118274 |
| 7831 | gtattaagtctgcacatttgt | M26270 | 50435 | tgtaggactcacctggaaatgaga | X60367 | 93039 | aacatgacgacatgctaaggatcga | AA118274 |
| 7832 | ttgtcctaccacactctttcctg | W50792 | 50436 | acttcacctgaaatgagagctgag | X60367 | 93040 | tgctaaggatcgaccaccactctca | AA118274 |
| 7833 | tgtcctaccacatccttcgt | W50792 | 50437 | agtactacctgagccgccgaacagc | X60367 | 93041 | tcgaaccactgctcaagggggttgct | AA118274 |
| 7834 | acatcctttctgctgagtccat | W50792 | 50438 | tctgcctaacatgggggacgaaacg | X60367 | 93042 | ccactgctcaagggggtctgagttt | AA118274 |
| 7835 | tcctttctgctgagtccaatgag | W50792 | 50439 | tctgccagcgaagtctcctttg | X60367 | 93043 | ttcacggcagagtccacgacaac | AA118274 |
| 7836 | cctttctgctgagtccatcgagg | W50792 | 50440 | agtgacccaataaagtgatctct | X60367 | 93044 | ccaccggagagtcacagaagacct | AA118274 |
| 7837 | ctgcatcagctgctgattaccal | W50792 | 50441 | cttgctgaagccgaacaaagagatc | X60367 | 93045 | ccaccggagtctacaagatgtggg | AA118274 |
| 7838 | gtcatcagctgctgattaccatgc | W50792 | 50442 | agagatcgtcgaggatggcgaccact | X60367 | 93046 | gacatcctccgtggaaattccgag | AA118274 |
| 7839 | tcatcagctgctgattaccatgcg | W50792 | 50443 | catgatcatccgcacgtgagacact | X60367 | 93047 | atctccctgtggaaattccgaga | AA118274 |
| 7840 | catcagctgctgattaccatgcga | W50792 | 50444 | catcgcacgtgccgagcacttttgg | X60367 | 93048 | tctccctgtggaaattccgacag | AA118274 |
| 7841 | atcagctgctgattaccatgcgag | W50792 | 50445 | cacgctgagcacttttcggaactat | X60367 | 93049 | tctccctggaaattccgaagacag | AA118274 |
| 7842 | aatataagatccgctgctcctga | W50792 | 50446 | gagcacttttcggaactatatcatg | X60367 | 93050 | gcccagtacacagagacttcatgag | AA118274 |
| 7843 | atataagatccgctgctcctgat | W50792 | 50447 | tatcatggactccagttggaag | X60367 | 93051 | cagtacacagagacttcatgagag | AA118274 |
| 7844 | gtcctaccacattcctttctctg | W50792 | 50448 | agatcggaacatagacgaccgc | X60367 | 93052 | cagtacacagagacttcatgagaga | AA118274 |
| 7845 | tataagatccgttgcctcctgatg | W50792 | 50449 | atatattgaggccccatagcaaa | X60367 | 93053 | gtacaagagacttcatgagagaca | AA118274 |
| 7846 | tcctaccacattcctttcctga | W50792 | 50450 | gttgaggccatagggacaaagtgcc | X15842 | 93054 | tacaagactttcatgagagacat | AA118274 |
| 7847 | cctaccacattcctttctgag | W50792 | 50451 | tcatgtcagtaatttccctactga | X15842 | 93055 | acggcagagtccaccgacaacctgg | AA118274 |
| 7848 | ctccactttctctctgagc | W50792 | 50452 | taattcctccactgagctgtag | X15842 | 93056 | cggcagagtccaccgacaacctggc | AA118274 |
| 7849 | taccactctctttctctgagct | W50792 | 50453 | ctgcctgaactacatacagtaagttaa | X15842 | 93057 | gcagagtccaccgacaacctggca | AA118274 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 7850 | W50792 | accacattcctttctgtgagctc | 50454 | W50837 | aagttaatacacagcttgaacagt | 93058 | AA118274 |
| 7851 | W50792 | ccacattcctttctgtgagctcc | 50455 | W50837 | agcttgaacagcttatggaaatct | 93059 | AA118274 |
| 7852 | W50792 | cacattcctttctgtgagctcca | 50456 | W50837 | aaatctgtctcagaaatagaaaag | 93060 | AA118274 |
| 7853 | W50837 | gaaggtcctcggcatactgccatg | 50457 | W50837 | ggtaaccatttgtagccctgtg | 93061 | AA118274 |
| 7854 | W50837 | cctggtactggccatgatcgac | 50458 | W50837 | ccctgtcagccctagcctatg | 93062 | AA118274 |
| 7855 | W50837 | ggacgatccagacgcagcccaattac | 50459 | W50837 | tgtgttcagccctatggaagaaa | 93063 | AA118274 |
| 7856 | W50837 | cgatccagacgcagccaattaccat | 50460 | W50837 | gtcagcccatgaagaagaacaa | 93064 | AA169951 |
| 7857 | W50837 | tccagacgcagccaattaccatgat | 50461 | W50837 | tagatgttcattcggttgatct | 93065 | AA169951 |
| 7858 | W50837 | agacgcagccaattaccatgatatt | 50462 | W50837 | atgtctcattcggttgatctcc | 93066 | AA169951 |
| 7859 | W50837 | cgagccaattaccatgatatttct | 50463 | W50837 | tcattccggttgatctcctaaagcc | 93067 | AA169951 |
| 7860 | W50837 | agccaattaccatgatatttctgat | 50464 | W50837 | ttcggttgatctcctaaagcctgt | 93068 | AA169951 |
| 7861 | W50837 | caattaccatgatatttctgatgtg | 50465 | W50837 | ggttgatctcctaaagcctgctg | 93069 | AA169951 |
| 7862 | W50837 | ttaccatgatatttctgatgtggaa | 50466 | W50837 | tcctaaagcctgctgcttcactat | 93070 | AA169951 |
| 7863 | W50837 | tatttctgatgtggaacggctgaaa | 50467 | W50837 | taaagcctgctgcttcactcatataaa | 93071 | AA169951 |
| 7864 | W50837 | gctgaaaccggctacttagaagct | 50468 | W50837 | ctgtctgcttcactcataaagaatct | 93072 | AA169951 |
| 7865 | W50837 | gggcatactgccatgatcgacgag | 50469 | W50837 | cgctcgcgagccggtaacagaccct | 93073 | AA169951 |
| 7866 | W50837 | catactgccatgatcgacgaggt | 50470 | W50837 | gctcgcgagccggtaacagaccctc | 93074 | AA169951 |
| 7867 | W50837 | actggccatgatcgacgagggtgag | 50471 | W50837 | gacccagttactggcgacacaagc | 93075 | AA169951 |
| 7868 | W50837 | ggccatgatcgacgagggtgagacc | 50472 | W50837 | ccccagttactggcgacacacccca | 93076 | AA169951 |
| 7869 | W50837 | catgatcgacgagggtgagaccgac | 50473 | W50837 | cagttactggcgacacaagcccaag | 93077 | AA169951 |
| 7870 | W50837 | ggtcatcgcattaagtggacgat | 50474 | W50837 | gttactggcgacacaagcccaagag | 93078 | AA169951 |
| 7871 | W50837 | cattgccattaagtgtggacgatca | 50475 | W50837 | ttactggcgacacaagcccaagaga | 93079 | AA169951 |
| 7872 | W50837 | tgtggacgatccagacgcagccaat | 50476 | W50837 | tactggcgacacaagcccaagagac | 93080 | AA169951 |
| 7873 | W50837 | atccaagaacaatatcgtacaa | 50477 | U01530 | tgggacacaagcccaagagacctt | 93081 | AA169951 |
| 7874 | U01530 | atgaacataaccacgagagaatcc | 50478 | U01530 | ggcgacacaagcccaagagacctg | 93082 | AA169951 |
| 7875 | U01530 | tgcctcagtctgtgtgactgcacg | 50479 | U01530 | gcgacacaagcccaagagagaccttga | 93083 | AA169951 |
| 7876 | U01530 | tgtacatagcacgccatgctgtgg | 50480 | U01530 | cgacacaagcccaagagacccttgaa | 93084 | AA118397 |
| 7877 | U01530 | tagacgccatgctctggggccaagc | 50481 | U01530 | ttttagtactggccatggacctgc | 93085 | AA118397 |
| 7878 | U01530 | cccagcactttgcctcgtgta | 50482 | U01530 | tttagtactggccatgccacctgc | 93086 | AA118397 |
| 7879 | U01530 | actttgctcagtgtcagtctat | 50483 | U01530 | ttagtactggccatgccacctgct | 93087 | AA118397 |
| 7880 | U01530 | cgtcagtctcagtgtactgtatgaatg | 50484 | U01530 | tagtactggccatgccacctgcctt | 93088 | AA118397 |
| 7881 | U01530 | attgtacagtctataggccaacac | 50485 | U01530 | gtactggccatgccaccgacctgcttac | 93089 | AA118397 |
| 7882 | U01530 | acagcctataggccaacactgcggg | 50486 | U01530 | tactggccatgccacctgacctgcttacc | 93090 | AA118397 |
| 7883 | U01530 | tataggccaacactgcggggcgtgtg | 50487 | U01530 | actggccatgccacctgacctgcttacca | 93091 | AA118397 |
| 7884 | U01530 | ccaacacgcggggtgtgactctt | 50488 | U01530 | ctggccatcggacctgcttacca | 93092 | AA118397 |
| 7885 | U01530 | ccacctcaagaataatcatgt | 50489 | U01530 | tggtccatgcaggagagccgagat | 93093 | AA118397 |
| 7886 | U01530 | caaggcaacaacagaggagagc | 50490 | U01530 | atctctggagccagaccagggattcatc | 93094 | AA118397 |
| 7887 | U01530 | ctagcgtactgggatcccagtg | 50491 | U01530 | aggccaagccagttctgcactt | 93095 | AA118397 |
| 7888 | U01530 | gtactggccatccagctgacatg | 50492 | U01530 | agccagcttctgtcacttatccac | 93096 | AA118397 |
| 7889 | U01530 | gggatcctgccagttacatgacctc | 50493 | U01530 | gtcacttatccactgcagcaacgg | 93097 | AA118397 |
| 7890 | U01530 | gacctctgccgaaggctgcctca | 50494 | U01530 | tatccactgacacgcaaggtccct | 93098 | AA118397 |
| 7891 | U01530 | ctgcgaaggctgcctcagtcgt | 50495 | U01530 | acctggtgtctctaactg | 93099 | AA118397 |
| 7892 | U01530 | aaggttgcctcagtgtctgtacat | 50496 | U01530 | gttgcaggaaccagagtgggccca | 93100 | AA118397 |
| 7893 | W50841 | gaagaaccactgccagctgacc | 50497 | W50841 | aggaaccagagtgggccagcctat | 93101 | AA118397 |
| 7894 | W50841 | aaccatcacgcaactgcaagt | 50498 | W50841 | ggcctctgaacactgcaagct | 93102 | AA118397 |
| 7895 | W50841 | tgcaacattgagctgttta | 50499 | W50841 | ctattcaagtgcctgacgcgac | 93103 | AA118397 |
| 7896 | W50841 | ttaatagctgcggttgccatgaccg | 50500 | W50841 | tgctccaggtggaatgcccag | 93104 | AA118397 |
| 7897 | W50841 | aatagctcgttgccatgacggc | 50501 | X72305 | tttcatcagcactgggcactgcca | 93105 | AA120620 |
| 7898 | W50841 | aaaccattgatcatcaggtgca | 50502 | X72305 | tgtggcactgccactggaaagcct | 93106 | AA120620 |
| 7899 | W50841 | catttgatcatcaggcgtcaacaa | 50503 | X72305 | actgcactggaagcctgcctg | 93107 | AA120620 |

| SEQ ID NO | DBAxnID | sequence | SEQ ID NO | DBAxnID | sequence | SEQ ID NO | DBAxnID |
|---|---|---|---|---|---|---|---|
| 7900 | W50841 | ttttgatcatcaggcgtcaacaaca | 50504 | W50841 | gctgcttgctgccctgcacttta | 93108 | AA120620 |
| 7901 | W50841 | ttgatcatcaggcgtcaacaacaag | 50505 | W50841 | ttgctgcctgcaccttagacatt | 93109 | AA120620 |
| 7902 | W50841 | gatcatcaggcgtcaacaacaaggt | 50506 | W50841 | accttagacatttactattctgca | 93110 | AA120620 |
| 7903 | W50841 | tcatcaggcgtcaacaacaaggtgt | 50507 | W50841 | ttactattctgcaggccaagccaagc | 93111 | AA120620 |
| 7904 | W50841 | caggcgtcaacaacaaggtgtgag | 50508 | W50841 | ttctgcaggccaagccagcttctg | 93112 | AA120620 |
| 7905 | W50841 | agcgtcaccaggtctgaacacac | 50509 | W50841 | tatcagcgtctgaacagtataa | 93113 | AA120620 |
| 7906 | W50841 | cacacactccggtgccccagaagg | 50510 | W50841 | agtataactccgtccgacagaatca | 93114 | AA120620 |
| 7907 | W50841 | cacactaggtggccccagaggat | 50511 | W50841 | catcgcctccaataagccactagaa | 93115 | AA120620 |
| 7908 | W50841 | ggccccagaaggatcctctgact | 50512 | W50841 | cgcctcaataagccactagagcatt | 93116 | AA120620 |
| 7909 | W50841 | actgggacccgctgcagaataagc | 50513 | W50841 | ctcaataagccactagagcattcac | 93117 | AA120620 |
| 7910 | W50841 | ctgagaataagctcccgaactct | 50514 | W50841 | aagccactagcattcacagaaat | 93118 | AA120620 |
| 7911 | W50841 | cctcctacaatctcaagagttgc | 50515 | W50841 | ccactagagcatttcacagaaattag | 93119 | AA120620 |
| 7912 | W50841 | gttcagcacatttgagcagttgtt | 50516 | W50841 | ctttagtcagcgcaaagagcattg | 93120 | AA120620 |
| 7913 | W50841 | gggcctcagcatgtacgacctgga | 50517 | W50841 | tagctcaggcgaaagagcattgcca | 93121 | AA120620 |
| 7914 | W50841 | tgacgacctggacgctgcaacggcta | 50518 | W50841 | aagagcatgcatgcacctcac | 93122 | AA120620 |
| 7915 | W50841 | atgaagatgccgaggatgagtcca | 50519 | W50841 | atgcatgtttacagctgtccca | 93123 | AA120620 |
| 7916 | W50841 | aagatgccgaggatgatgccacac | 50520 | W50841 | gcatgttaccagcgttcccaact | 93124 | AA120620 |
| 7917 | W50848 | cgaacgacaagatctcaggcaga | 50521 | W50848 | ataactccgtccgacagaatcacca | 93125 | AA120620 |
| 7918 | W50848 | aagatctcaggcagatggacacaa | 50522 | W50848 | actccgtccgacagaataccagtg | 93126 | AA137795 |
| 7919 | W50848 | atcttcaggcagatggacacaaaca | 50523 | W50848 | tccgacagaatccacagtgcataag | 93127 | AA137795 |
| 7920 | W50848 | gatggcaaagtctccctgaagat | 50524 | W50848 | gacagaatccacagtgcataagtat | 93128 | AA137795 |
| 7921 | W50848 | aaactgcctgaagaattcatca | 50525 | W50848 | caggctttgtcttgtatgtatctc | 93129 | AA137795 |
| 7922 | W50848 | aggtgccaagagcgaaccgtccatt | 50526 | W50848 | tgtgatgatctcatcgcctcaata | 93130 | AA137795 |
| 7923 | W50848 | tgccaagagcgaccgtccattgtc | 50527 | W50848 | tatgatctcatcgcctcaataagc | 93131 | AA137795 |
| 7924 | W50848 | cagccgtccattgccgattgctg | 50528 | W50848 | gtatctccaatagccaccgcac | 93132 | AA137795 |
| 7925 | W50848 | acgacctggacgcaacgtacact | 50529 | W50848 | aggaccaacacggtcatctctctcat | 93133 | AA137795 |
| 7926 | W50848 | gcaacgctacatcagcgcagtga | 50530 | W50848 | acacagggtcatctcatctatgagaa | 93134 | AA137795 |
| 7927 | W50848 | acggctacatacgcgcagtgaat | 50531 | W50848 | gcgtcttggacatctcaattgga | 93135 | AA137795 |
| 7928 | W50848 | acatcagccgcagtgaaatgctgga | 50532 | W50848 | ttgacatctcaatttgatgcact | 93136 | AA137795 |
| 7929 | W50848 | tcagccgcagtgaaatgctgagt | 50533 | W50848 | actgacttggcaagcagaggtgga | 93137 | AA137795 |
| 7930 | W50848 | agattgcaggccattcactacaagt | 50534 | W50848 | tgcagctgcgtcatcgatggggtgaa | 93138 | AA137795 |
| 7931 | W50848 | tccaggccatctacaagatggtgtc | 50535 | W50848 | tccacagcaaacattaactccccat | 93139 | AA137795 |
| 7932 | W50849 | tgggtgctcccccgtgatgaagatgc | 50536 | W50849 | ccaggacttctgcatatttacagt | 93140 | AA137795 |
| 7933 | W50849 | tcggtatacgttttccagtcaag | 50537 | W50849 | catatttaacagtgcccagtcactactc | 93141 | AA137795 |
| 7934 | W50849 | tacgcttttccagtcaagagttt | 50538 | W50849 | taacagtgcccagtcactactgcc | 93142 | AA137795 |
| 7935 | W50849 | gggcctgtttaccacagactggct | 50539 | W50849 | ctgcctagtaaagactccacatta | 93143 | AA137795 |
| 7936 | W50849 | ctccgttaccacagactggctgg | 50540 | W50849 | tagtaaagactccacattagtgc | 93144 | AA137795 |
| 7937 | W50849 | cagactgtggaacctcaccact | 50541 | W50849 | ttgaaagatctgccggggcctcaa | 93145 | AA137795 |
| 7938 | W50849 | actggcttgaacctcaccactca | 50542 | W50849 | agtaaagactccacattatgtgca | 93146 | AA120675 |
| 7939 | W50849 | ttggaacctcaccactcacctggc | 50543 | W50849 | gatctgccgggggcctcaaagaggt | 93147 | AA120675 |
| 7940 | W50849 | cacttcactgaacctgatalggg | 50544 | W50849 | agctgccggaagagaggctggga | 93148 | AA120675 |
| 7941 | W50849 | ttcacctgcagccccgatggtca | 50545 | W50849 | tcttgacctgcctctaacctggg | 93149 | AA120675 |
| 7942 | W50849 | acctgcagccccgatatgtcacta | 50546 | W50849 | cctgtccatctaacctgggcactgg | 93150 | AA120675 |
| 7943 | W50849 | cagccagtatgtcactattccac | 50547 | W50849 | gagccacacaaacgccactgct | 93151 | AA120675 |
| 7944 | W50849 | agtatgtcactattccacagcaga | 50548 | W50849 | aacatcaaaactgccactgctgagcaa | 93152 | AA120675 |
| 7945 | W50849 | gctttccagtcaagaggtttca | 50549 | W50849 | agatctggagaaccaggctaggca | 93153 | AA120675 |
| 7946 | W50849 | tttccagtcaagaggtttcagta | 50550 | W50849 | tctcctccaaattcatgatgtctta | 93154 | AA120675 |
| 7947 | W50849 | aaatcagactcagagctacctgaa | 50551 | X13588 | atatgcataataacctatcatctac | 93155 | AA120675 |
| 7948 | W50849 | tcgaactcagagctacctggaaact | 50552 | X13588 | gattacttcagctcttcatataagg | 93156 | AA120675 |
| 7949 | W50849 | gactcagagctacctggaaacttct | 50553 | X13588 | ctctcatataggggttcctgttg | 93157 | AA120675 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 7950 | cctggaaacttctgtctctatgcat | W50849 | 50554 | ttttctctgtccatgttgcatgtca | X13588 | 93158 | acgacatggccgatacatgtggtac | AA120675 |
| 7951 | aacttcgtctctatgcataaagat | W50849 | 50555 | ctgccatgttgcagtcaattggt | X13588 | 93159 | acatgccgatacatgtgtaccat | AA120675 |
| 7952 | tgtctctatgcataaagatgtct | W50849 | 50556 | atgttgcagtcaattggtgtcagt | X13588 | 93160 | atacatgtaccatctgccatgc | AA120675 |
| 7953 | gaacctcagtcagccgggcaaa | M91458 | 50557 | tgtcagtatgcaggtctgttggg | X13588 | 93161 | catgtgtaccacatctgccatgctgc | AA120675 |
| 7954 | tcagcttcagtcagccgggcaaa | M91458 | 50558 | tatgcaggtctgttgggcaacct | X13588 | 93162 | gtaccatcgccatgctgcagataa | AA120675 |
| 7955 | taacatggcctcccgcctgcact | M91458 | 50559 | actacactgctcagaatcagttc | X13588 | 93163 | tctgccatgctgagataagtgatt | AA120675 |
| 7956 | ctgactgctgcttgaggactgc | M91458 | 50560 | tcagaatcagtlcttttctgaata | X13588 | 93164 | ttcgatgatcctggctgaagccatt | AA120675 |
| 7957 | tgctgctttgaggactgcatctg | M91458 | 50561 | tgtacctgaacttcccccagtccatg | X13588 | 93165 | gatgatcctggctgaagccattcga | AA120675 |
| 7958 | tttgaggactgcatlctgactgtg | M91458 | 50562 | atctatcatctatlcatcagtcatc | X13588 | 93166 | tatttagctctggaatgggtaccat | AA120675 |
| 7959 | cattctgactgtgctgatgaagct | M91458 | 50563 | tccccagtccatgagtcaataaagt | X13588 | 93167 | tttagctctggaatgggtaccatct | AA120690 |
| 7960 | ttgagcactggtgtggactttctc | M91458 | 50564 | catctatlcatcagtcatccatct | X13588 | 93168 | taccaagttccatattccatglaca | AA120690 |
| 7961 | tagtgcctcacactcatccctgc | M91458 | 50565 | ttccatcagtcatccatctactgt | X13588 | 93169 | caaagttccatattccatgtacatt | AA120690 |
| 7962 | ctcacactcaattacctgcatcagt | M91458 | 50566 | agtcatccatcttactgattacatt | X13588 | 93170 | aagttccatattccatgtacattaa | AA120690 |
| 7963 | tacctgcatcagttctcactaata | M91458 | 50567 | agactgattgtcctttctcagcag | X13588 | 93171 | tccatattccatgtacattaagagt | AA120690 |
| 7964 | catcagttctcactaatagctcct | M91458 | 50568 | ctttctcagcagccacatgattacc | X13588 | 93172 | catatlccatgtacattaagagtgt | AA120690 |
| 7965 | ccctttgccaacctcaggacatcaa | M91458 | 50569 | tcagcagccacatgattacctcagc | X13588 | 93173 | tgtgacattagttgcctcagctta | AA120690 |
| 7966 | ggcaacctcaggacatcaagatgag | M91458 | 50570 | gccacatgattacctcagctctca | X13588 | 93174 | tgacacttagttgcctcagtcttata | AA120690 |
| 7967 | gatccacgtctgtctcaggggctt | M91458 | 50571 | agactaacaaggtccatggcagcccg | AA032593 | 93175 | acttagttgcctcagcttatagctg | AA120690 |
| 7968 | cgtctctgcagggcttagactg | M91458 | 50572 | ctaacaaggtccatggcagcccgct | AA032593 | 93176 | agttgcctcagcttatagctggggt | AA120690 |
| 7969 | gtcgtcagggctltagactgcacacct | M91458 | 50573 | cctggcctatgtcgtcctgccaggaa | AA032593 | 93177 | ctcagttcatagctggggtaatttg | AA120690 |
| 7970 | gttgctaattgggctggtcaat | M91458 | 50574 | ctgctatgtcgtctgccaggga | AA032593 | 93178 | tttttccattaaagctcaaccag | AA120690 |
| 7971 | aattggctgtggctcaatgtgtt | M91458 | 50575 | gtgcctatgtcgtcctcaggaacctt | AA032593 | 93179 | ttcctcattaaaggctcaaccagca | AA120690 |
| 7972 | gtcaattgtgttcccgaaggctg | M91458 | 50576 | tgcctatgtctcctcaggaaacttt | AA032593 | 93180 | attaaaggctcaaccagcacact | AA120690 |
| 7973 | ctlctttgcagacagaagcactgt | W50853 | 50577 | ctatgtctcctcaggaaacttlg | AA032593 | 93181 | attaaggctcaaccagcacgtgt | AA120690 |
| 7974 | aagcaactgtgtcaaaatagaaac | W50853 | 50578 | ctatgtcttccatggaaacttlgt | AA032593 | 93182 | ggctcaaccagcactgtggctact | AA120690 |
| 7975 | ttctgctcgaactcagattccctg | W50853 | 50579 | tatgtgtcctcaggaaacttttgtgg | AA032593 | 93183 | caaccagcactgtgggctatgac | AA120690 |
| 7976 | tgcagaactcagattcctgaaca | W50853 | 50580 | atgtgtcctcaggaaacttttgtgcc | AA032593 | 93184 | accagcactgtgggctatgtacaa | AA120690 |
| 7977 | actcagattcctgaacatagttc | W50853 | 50581 | tgtcctcaggaaacttttggcccct | AA032593 | 93185 | cagcactgtgtgggccaacaagaagt | AA120690 |
| 7978 | cagatcctgaacatagttc | W50853 | 50582 | gtcctcaggaaacttlggccctg | AA032593 | 93186 | agttctcagagcacacaattgcc | AA120690 |
| 7979 | aacatagttcttcacacagcaagaa | W50853 | 50583 | taacaaggtccatggcagcccgccgtg | AA032593 | 93187 | tcagagcacacatatlgccattgac | AA120733 |
| 7980 | atagtlcttcacacagcaagaaga | W50853 | 50584 | aaggtccatggcagcccgccgtgt | AA032593 | 93188 | aggagctgcaccctgggagggcca | AA120733 |
| 7981 | cttcacacacgaagaagacaacaagt | W50853 | 50585 | gggtgaccctggcctatgtgtc | AA032593 | 93189 | agctgcacctgggagggccaca | AA120733 |
| 7982 | tagtaacttgccagagggtgagcca | W50853 | 50586 | ggtcatgacctgccatgtgtcc | AA032593 | 93190 | acacctgggagggccacaagaatgt | AA120733 |
| 7983 | taactgccagagggtgagccaga | W50853 | 50587 | gtcatgacctgccatgtgtcct | AA032593 | 93191 | atgccatagcctcacaatcctta | AA120733 |
| 7984 | ctlgccagagggtgagccaagaaga | W50853 | 50588 | catgacctgccatgtgtcctca | AA032593 | 93192 | tagccttcaacctcaacattctacggtgtga | AA120733 |
| 7985 | tccgaatccacagttaaacaagat | W50853 | 50589 | atgacctgccatgtgtccctcag | AA032593 | 93193 | ctlttgcaagaccgtaaactctg | AA120733 |
| 7986 | gaatccacacagttaaacaagatgtg | W50853 | 50590 | tgacctgccatgtgtcctcagg | AA032593 | 93194 | acaagacctgtaaactctggggtgc | AA120733 |
| 7987 | tcccacagttaaacaagatgtgcaa | W50853 | 50591 | cagatctcagattcaaccttcagt | AA032593 | 93195 | agacctgaaactctggagtgctga | AA120733 |
| 7988 | gcaaagttacgctgctgtctgccggc | W50853 | 50592 | atctcagattcaaccttcagtgaa | AA061550 | 93196 | cctgtaaactctggagtgctgagac | AA120733 |
| 7989 | aaggactggtcgtctgccggctc | W50853 | 50593 | tgccggattccaccaagacaa | AA061550 | 93197 | accatacctcagggccacacacagc | AA120733 |
| 7990 | cctgctcagagggcgtgccaaggatat | W50853 | 50594 | accaagacaatccctgaccctg | AA061550 | 93198 | agcaccacatattgcattgaccaa | AA120733 |
| 7991 | tgaaaatcgggattctgct | W50700 | 50595 | tccctgcagcctgtcctcacgt | AA061550 | 93199 | cctcagggcccaacaacaggagat | AA120733 |
| 7992 | atcggtcggattctgctgcagaa | W50700 | 50596 | ctgcagcctgtlccttcacagtcac | AA061550 | 93200 | cacacatatgccattgaccaactg | AA120733 |
| 7993 | ccgagcccaagccaagaacgacgcgaca | W50700 | 50597 | cctgttccttcacagtcacggacg | AA061550 | 93201 | tgccattgaccaacgtggcactcaa | AA120733 |
| 7994 | acgaagacgacaggacaggagactcc | W50700 | 50598 | cagtcaccgaacgtcacatcaac | AA061550 | 93202 | caatgaccaagtgcactcaacaa | AA120733 |
| 7995 | gacggaccgcacactagatagatcat | W50700 | 50599 | tcaccgaacgtcacatcaaccag | AA061550 | 93203 | ccaactgccactcaacaagcagg | AA120733 |
| 7996 | ggccggcacactagagatcatcg | W50700 | 50600 | gtccatcaaaaccagagggccacca | AA061550 | 93204 | tggcactcaacaaagcaggcctccg | AA120733 |
| 7997 | ccggcacactagagatcatcgtac | W50700 | 50601 | cacatcaaaaccaacgagggccacatca | AA061550 | 93205 | gcttlatccacggaagctatgatcg | AA120733 |
| 7998 | cacactagagatcatctgacgaa | W50700 | 50602 | gccacatcaaacgacgaaggaccaa | AA061550 | 93206 | tcaccggaagctatgatcggacctg | AA120733 |
| 7999 | agatcatctgacgaattggccctg | W50700 | 50603 | gattcaaccttlcagtgaaggccac | AA061550 | 93207 | tctagcacgtctcagtcgaatgagc | AA146194 |

TABLE 1-continued

| SEQ ID NO | DBAxnID | sequence | SEQ ID NO | DBAxnID | sequence | SEQ ID NO | DBAxnID | sequence |
|---|---|---|---|---|---|---|---|---|
| 8000 | W50700 | tcatctgtacgaattgccctgcgt | 50604 | AA061550 | accttcagtgaaagccacatttg | 93208 | AA146194 | atgatggcttcccagacgacattgc |
| 8001 | W50700 | tctgtacgaattggccctgcgttcc | 50605 | AA061550 | ttctccagaaagctccttgccagat | 93209 | AA146194 | gtaccgactgccagagagaagtgcc |
| 8002 | W50700 | cgaattggccctgcgcgttccgaatct | 50606 | AA061550 | tccagaaagctccttgccagatagt | 93210 | AA146194 | gagaagtgccctcgcatgtggaagc |
| 8003 | W50700 | attggccctgcgtccgaatctga | 50607 | AA061550 | ctccttgccagatagtaatggctgg | 93211 | AA146194 | aagtgccctcgcatgtggaagcata |
| 8004 | W50700 | ttccgaatctggaggagaatgcatg | 50608 | AA061550 | ttcctaggtcagagtcacctgc | 93212 | AA146194 | aagcataccctcgagactgcagacg |
| 8005 | W50700 | aggagactcctcattcagaaccag | 50609 | AA061550 | aggctcaggagtcacctgcgggat | 93213 | AA146194 | catacctctgagactgcagacgctc |
| 8006 | W50700 | ccagaagctccatgcaaccatgctg | 50610 | AA061550 | aggagtcacctgcgggattccacca | 93214 | AA146194 | acctctgagactgcagacgctcct |
| 8007 | W50700 | gctccatgcaaccatgctgcacacct | 50611 | AA061550 | ccgagagcctcttgtggaaaa | 93215 | AA146194 | actgcagacgctctgctcctcggt |
| 8008 | W50700 | aaccatgctgacacctcctggaac | 50612 | AA061550 | agcctcttgtgtggaaaacgacag | 93216 | AA146194 | aagtagcaacctgatgtcaacagac |
| 8009 | W50700 | tgccactcagacattgactccgcga | 50613 | AA032596 | taacttagttccctgccatgtgc | 93217 | AA146194 | tagcaacctgatgtcaacagacgac |
| 8010 | W50700 | cacctagacattgactccgcagcgc | 50614 | AA032596 | ttagttccctgccatgtgctgtg | 93218 | AA146194 | caacctgatgtcaacagacgacgac |
| 8011 | W50700 | ctagacattgactccgcagcgcatg | 50615 | AA032596 | agttccctgccatgtgctgtgga | 93219 | AA146194 | tccagacgcattgctggctcagg |
| 8012 | W50700 | gacattgactccgcagcgcatgacg | 50616 | AA032596 | ccctgccatgtgctgtggaagcgt | 93220 | AA146194 | cagacgacattgctggctcagagc |
| 8013 | M21285 | agccactgaattgctatgtatcct | 50617 | AA032596 | ctgccatgtgctgtggaggtat | 93221 | AA146194 | ggtgacattgagctcacgggacat |
| 8014 | M21285 | gtatctgacagtctcacatctcaac | 50618 | AA032596 | ccatgtgctgtggaggtatacta | 93222 | AA146194 | gacattgagctcacgggagacatcg |
| 8015 | M21285 | gtttagtctacatgtctctcccag | 50619 | AA032596 | agcgtatactaacaactacacctt | 93223 | AA146194 | attgagctcaggggacattgtca |
| 8016 | M21285 | tctacattgtcttccagactg | 50620 | AA032596 | tatactaacaactacacctagta | 93224 | AA146194 | gggacattgctcatcaatcagaag |
| 8017 | M21285 | ttgctcttcccagactgacagat | 50621 | AA032596 | tactaacaactacacctcagtagg | 93225 | AA146194 | ttcgtcaatctagaaggtgtg |
| 8018 | M21285 | ttcccagactgacagatatgacc | 50622 | AA032596 | tacacctcctagggtcttggaga | 93226 | AA146194 | gtcatttggtaccgactgccagag |
| 8019 | M21285 | aagtccaagactactactccactgc | 50623 | AA032596 | gaagagctagactaactgacctg | 93227 | AA120701 | cccggctccacggagcagcggagga |
| 8020 | M21285 | acctaccacggccatgaaaaccat | 50624 | AA032596 | gctagcactaactgacctggcctg | 93228 | AA120701 | gctccacggcggcagcggcgaagta |
| 8021 | M21285 | ccactgcatgaaaaccattgcagg | 50625 | AA032596 | gcctggtccttagacacatgctg | 93229 | AA120701 | tcatcaacaagaataacaccaaggag |
| 8022 | M21285 | ttaatatcaactctgaagcctact | 50626 | AA032596 | ttagacaccatgctgctgctgc | 93230 | AA120701 | catcaacaagaataacaccaaggagg |
| 8023 | M21285 | tcaactctgaagcctactgtact | 50627 | AA032596 | agacaccatgctgctgctgctg | 93231 | AA120701 | gagactgccatgaacaagaataaag |
| 8024 | M21285 | cttgaagcctactgtactgattga | 50628 | AA032596 | gctgctgcagacgctgctgctg | 93232 | AA120701 | acaagaataaccgccaggaggtagct |
| 8025 | M21285 | aggtccatagcatcagctcagctgg | 50629 | AA032596 | ctgctgagcacggtcgagctg | 93233 | AA120701 | ataacgccaggagtagttcgcag |
| 8026 | M21285 | taatactgactactcactcaaggg | 50630 | AA032596 | ggagccgcagttgctaacttagttc | 93234 | AA120701 | agctagctcgcagtgtaggagata |
| 8027 | M21285 | actactcaagggcagttctgaggt | 50631 | AA032596 | ctgaaccggagttccgaaggcat | 93235 | AA120701 | ggtagttccagtgtagagagag |
| 8028 | M21285 | tccaaggcagttgcgagtgattag | 50632 | AA032596 | cgaaggcacccggagcgttgct | 93236 | AA120701 | tagcttcgcagtgtaggagatagaa |
| 8029 | M21285 | atcctccagaagggtattcataacg | 50633 | AA032596 | gctatggtagctgctggctcataac | 93237 | AA120701 | agcttcgcagtgtaggagatagaaa |
| 8030 | M21285 | ggtattcatacagactcccaagaa | 50634 | AA032596 | ctatggtagctgctggtcataact | 93238 | AA120701 | ctcacaggacagcggagcgagtag |
| 8031 | M21285 | cataacagactcccaagaactatat | 50635 | AA032596 | tgtagctgctggtcataactaggag | 93239 | AA120701 | tccacaggacagcggagcgaagtagt |
| 8032 | M21285 | tatgttctgagacgtcacgtttagt | 50636 | AA032596 | tgatactgactcatgagatagt | 93240 | AA120701 | gtgacgtcacatcgcgggcgcgca |
| 8033 | M21285 | gcaactggctcatgggggacattcg | 50637 | AA032596 | atatcggtgactcatgagatggt | 93241 | AA120701 | cgccgagtcggggtacgaagaaggt |
| 8034 | M32032 | acatctggcagttgacatctcaa | 50638 | AA032596 | tactggtgactcatgagatgttgt | 93242 | AA120701 | ccgacgccggtacgaagaaggtca |
| 8035 | M32032 | cagcactgctcacgagttctgtta | 50639 | AA032596 | agacttggagactictcgtctat | 93243 | AA120701 | tacggttcatcaacaagaataacac |
| 8036 | M32032 | actgcagttctgacatctgaactg | 50640 | AA032596 | cttggagagacttctcgtctctcaa | 93244 | AA120701 | gttcatcaacaggaataacaccaag |
| 8037 | M32032 | gttctgcatctgatctgaaggct | 50641 | AA032596 | agactictcgtctctctctcaa | 93245 | AA120701 | ttcatcaacaggaataacaccaagga |
| 8038 | M32032 | acatctggatctgaaggctgcact | 50642 | AA032596 | tcttcgtctcatcaatcgctatctc | 93246 | AA120701 | actgccctgatggtgaaggagcaa |
| 8039 | M32032 | tccatctgagccctgcctgctt | 50643 | AA032596 | aaggcatccaggagcgtgttgctgc | 93247 | AA120701 | gtccctgatggtgaaggagcaagac |
| 8040 | M32032 | ttctgagccgccctggctcacct | 50644 | AA032596 | aggcaccccaatctgcgtcaactg | 93248 | AA118715 | aggcctctgaagctctatg |
| 8041 | M32032 | caactcccaaggcactctgagac | 50645 | AA032596 | gcaaccaatctgcgtcaactgct | 93249 | AA118715 | aaggcctctgagactctatg |
| 8042 | M32032 | tccaaggcactctgagaccagcaga | 50646 | AA032596 | cacccaatctgcgtcaactgctg | 93250 | AA118715 | ctcctgagactctatgaagcc |
| 8043 | M32032 | ctgagaccagctgagatctgtagagc | 50647 | AA032596 | aatctgctcaactgctgttct | 93251 | AA118715 | ttctatggaagcccgatttcgagtg |
| 8044 | M32032 | cagcatctgtaccgttgcgtt | 50648 | AA032596 | ctgggctaactgctgtttctgtc | 93252 | AA118715 | tatggaagcccgattccgagtct |
| 8045 | M32032 | atgactctctaaccacgaagcc | 50649 | AA032596 | tggctaactgctgtttctgtca | 93253 | AA118715 | ccgattccgattctcaactaagc |
| 8046 | M32032 | tcgctggagatctcctggggg | 50650 | AA032596 | ctgtaactgctgtttctgtcatg | 93254 | AA118715 | attccgagtgtccacttaagcttc |
| 8047 | M32032 | taacctgtcagccggagccctagt | 50651 | X15592 | acttgactccagaagaattcaggac | 93255 | AA118715 | ccgagtgtcttcacttaagcttctc |
| 8048 | M32032 | gtcagccggagccctagtggtcaa | 50652 | X15592 | ctgactatctgaccacctggtcaa | 93256 | AA118715 | ctctccaaacatcaattctgtcttcc |
| 8049 | M32032 | atggcaaggctttacgccactac | 50653 | X15592 | tcaaacactgtggggacctgaactga | 93257 | AA118715 | tcaaacattcaattctgtcttcctga |

| SEQ ID NO | DBAxnID | sequence | SEQ ID NO | DBAxnID | sequence | SEQ ID NO | DBAxnID |
|---|---|---|---|---|---|---|---|
| 8050 | M32032 | agcgtcttacgccactacatcact | 50654 | M32032 | tgtgaacctgaggcacagtcatac | 93258 | AA118715 |
| 8051 | M32032 | tttacgccactacactatacag | 50655 | M32032 | gaactctgaggcacagtcatactga | 93259 | AA118715 |
| 8052 | M32032 | ttggcgcacactggctcacagagt | 50656 | M32032 | cattgccaattttagctctgaagt | 93260 | AA118715 |
| 8053 | W50888 | ctcttgattaacgtgggatgatctc | 50657 | W50888 | tgccaattttagctctgaagttcc | 93261 | AA118715 |
| 8054 | W50888 | ttaacccaaatgtgagcgggcccag | 50658 | W50888 | ttccttaaatgattctcacaaggat | 93262 | AA118715 |
| 8055 | W50888 | agtgaccttggcacttgatcccga | 50659 | W50888 | cttaaatgattctcacaaggatctt | 93263 | AA118715 |
| 8056 | W50888 | gaccttcggcacttgatcccga | 50660 | W50888 | aaatgattctcacaaggatcttag | 93264 | AA118715 |
| 8057 | W50888 | gagccttcgccacttgatcccgagt | 50661 | W50888 | atatatgccatgatgtctcaaatt | 93265 | AA118715 |
| 8058 | W50888 | gagccgtcccagctctatatggc | 50662 | W50888 | tatgccatgatgtctcaaattaa | 93266 | AA118715 |
| 8059 | W50888 | agccgtcccagctctatatggccg | 50663 | W50888 | tgacacctggaagggctcagccaga | 93267 | AA118716 |
| 8060 | W50888 | gccgtcccagctctatatggccga | 50664 | W50888 | agtgtggtcgactggtaacaata | 93268 | AA118716 |
| 8061 | W50888 | ccggtctccagtctatatggcgag | 50665 | W50888 | gagctctgtctcctggtatggga | 93269 | AA118716 |
| 8062 | W50888 | cggtctccagtctatatggcgaga | 50666 | W50888 | tctgtctcctggtatgggaagg | 93270 | AA118716 |
| 8063 | W50888 | ggtctccagtctatatggcgagat | 50667 | W50888 | gtctcctggtatgggaaggaatgat | 93271 | AA118716 |
| 8064 | W50888 | tctccagtctatatggcgagatcc | 50668 | W50888 | gaagcagccatcacacagtgtccagc | 93272 | AA118716 |
| 8065 | W50888 | taaccccaaatgtgagcgggcccagt | 50669 | W50888 | gccatcacagtgtccagcatgtgc | 93273 | AA118716 |
| 8066 | W50888 | ctccagtctatatggcgagatcct | 50670 | W50888 | gtccagcatgtctgatatgc | 93274 | AA118716 |
| 8067 | W50888 | ccaaatgtgagcgggcccagtgacc | 50671 | W50888 | tatgtatcagtgtctgccacagtg | 93275 | AA118716 |
| 8068 | W50888 | caaatgtgagcgggcccagtgacct | 50672 | W50888 | cttaggacactaatccatccaggttg | 93276 | AA118716 |
| 8069 | W50888 | aatgtgagcgggcccagtgacctc | 50673 | W50888 | aaggaaatgcctcattcctgagacc | 93277 | AA118716 |
| 8070 | W50888 | ggcccagtgacctggcacttga | 50674 | W50888 | atgcctcattcctgagacctgagg | 93278 | AA118716 |
| 8071 | W50888 | gccagtgacctcggcactttgat | 50675 | W50888 | catcctgagacagtagttgttgt | 93279 | AA118716 |
| 8072 | W50888 | cccagtgacctcggcactttgatc | 50676 | W50888 | gtactatggctcctcgaaaacacaa | 93280 | AA118716 |
| 8073 | W50888 | cagtgacctcggcacttgatcc | 50677 | W50888 | ctatggctcctcgaaaacacaaagt | 93281 | AA118716 |
| 8074 | W50888 | atagagcgtcgcagcgccggatcg | 50678 | D84372 | ttaatgccacagaagcagcagatg | 93282 | AA118716 |
| 8075 | D84372 | tccttgtggaccagacaagggtg | 50679 | D84372 | atgccacaggaagcagcagatggta | 93283 | AA118716 |
| 8076 | D84372 | ctggctgactgcctctgagaagc | 50680 | D84372 | aactcaatatttcacgaaaatgc | 93284 | AA118716 |
| 8077 | D84372 | ctgcctctgagaagcgaagttgg | 50681 | D84372 | atattttcatgaaaatgcaaccac | 93285 | AA118716 |
| 8078 | D84372 | cacggccaattggcaaccccttt | 50682 | D84372 | atgaaaatgcaaccacatgtataat | 93286 | AA118716 |
| 8079 | D84372 | gtgccctaattgcacctcctt | 50683 | D84372 | ctaatccatcaggttgactcgagg | 93287 | AA118716 |
| 8080 | D84372 | gagagactgctctcgcgttctgaca | 50684 | D84372 | atccatcaggttgactcgagtgtcc | 93288 | AA118716 |
| 8081 | D84372 | ctctcgttctgacaatgctatttt | 50685 | D84372 | catcaggttgactcgaggccgtgc | 93289 | AA118716 |
| 8082 | D84372 | tgcgttctgacaatgctattttca | 50686 | D84372 | gttgactcgaggtcctgccaacaac | 93290 | AA118716 |
| 8083 | D84372 | atttctcacattaggaggactcaaat | 50687 | D84372 | ctcgaggtcctgcaccaactggtt | 93291 | AA118716 |
| 8084 | D84372 | tttcatactcatatgggagactcaaatct | 50688 | D84372 | ctgcaccaactggtctggaaactag | 93292 | X05719 |
| 8085 | D84372 | ttatgacctaaacagatctgattt | 50689 | D84372 | tgcataaacctgatggtgatggagtg | 93293 | X05719 |
| 8086 | D84372 | agcgcccaggttctaagaacgtgg | 50690 | D84372 | ttcttcaatgatttgcaggaaacc | 93294 | X05719 |
| 8087 | D84372 | cttcctcttctggaatcag | 50691 | D84372 | agctccttcctgcagaagagaga | 93295 | X05719 |
| 8088 | D84372 | ctcatgcagcagcagcggagagttca | 50692 | D84372 | cttcctcgagaagagaagaacgctg | 93296 | X05719 |
| 8089 | D84372 | ttcagatgagccccacgggacagaa | 50693 | D84372 | ttcatgaattctctctcacaatg | 93297 | X05719 |
| 8090 | D84372 | agatgagccccacggcgacagaac | 50694 | D84372 | ttaatgcacagtttagggccaatcta | 93298 | X05719 |
| 8091 | D84372 | tgagcccacgcgacgaacagaa | 50695 | D84372 | taactgtctctgatctcctcccgt | 93299 | X05719 |
| 8092 | D84372 | tagacgagcgttccagacccgtg | 50696 | D84372 | tgattctcccgttgctcatgtgta | 93300 | X05719 |
| 8093 | D84372 | gtcagaagccggcgactggctgac | 50697 | D84372 | gtactgtgcacacatagagtgcat | 93301 | X75013 |
| 8094 | D84372 | cagaagccggcgactggctggactgc | 50698 | D84372 | agtcattactgccactttttcaa | 93302 | X75013 |
| 8095 | D84372 | cctgagcgctagacgcggactgc | 50699 | W50891 | ttactgccaccttttcaataagct | 93303 | X75013 |
| 8096 | W50891 | gcagctctgtagcactgctgctac | 50700 | W50891 | ctaaatttagactctctattgccata | 93304 | X75013 |
| 8097 | W50891 | agattgccaggatctgcttcaa | 50701 | W50891 | tagactcctttattgccatctta | 93305 | X75013 |
| 8098 | W50891 | gatttgccagatctgcttcctcaa | 50702 | W50891 | ttatttatctgatttgaaggga | 93306 | X75013 |
| 8099 | W50891 | tttgccagatctgcttcctctcaaat | 50703 | W50891 | ccatcccgtagagatgccaaaac | 93307 | U12564 |

| SEQ ID NO | sequence | DBAxnID | SEQ ID NO | sequence | DBAxnID | SEQ ID NO | sequence | DBAxnID |
|---|---|---|---|---|---|---|---|---|
| 8100 | ttgccccagatcctgctccaaatcc | W50891 | 50704 | agatggcccaaactcaccaaaatgg | X75013 | 93308 | acattgaattcctgctctccaatca | U12564 |
| 8101 | ccagatcctgctccaaatccggta | W50891 | 50705 | gtgacactctcaatccagaccag | X75013 | 93309 | tgtctccaatcatccaggtgactc | U12564 |
| 8102 | agatcctgctccaaatccggtagc | W50891 | 50706 | ctcttcaattccagaccagaccatt | X75013 | 93310 | ctctccaatcatccaggtgactcgc | U12564 |
| 8103 | gatcctgctccaaatccggtagcc | W50891 | 50707 | aattccagaccagaccattggccct | X75013 | 93311 | tctccaatcatccaggtgactcgca | U12564 |
| 8104 | atcctgctccaaatccggtagccg | W50891 | 50708 | agaccagaccattggccctcatga | X75013 | 93312 | ctccaatcatccaggtgactgcgag | U12564 |
| 8105 | ctgctccaaatccggtagccgat | W50891 | 50709 | gaccattggccctcatgaatttct | X75013 | 93313 | tccaatcatccaggtgactgcagc | U12564 |
| 8106 | tgctccaaatccggtagccggatt | W50891 | 50710 | tggccctcatgaatttctctctc | X75013 | 93314 | ggtgccaccatgccgcgatgcag | U12564 |
| 8107 | cagcctgtagcactggctgctact | W50891 | 50711 | aatagcaaactcattcatgcactgt | X75013 | 93315 | accagccgagatgccgatgtgtgc | U12564 |
| 8108 | agcctgtagcactggctgctact | W50891 | 50712 | aaaactcattcatgcactgtggtact | AA034761 | 93316 | catgccgatgcagttgatggtgcc | U12564 |
| 8109 | gcctgtagcactggctgctactc | W50891 | 50713 | tactgcaacggccagctggagtgta | AA034761 | 93317 | atgccgagatgcagttgtgccca | U12564 |
| 8110 | ggtagcactggctgctactactt | W50891 | 50714 | aacggccagctggagtgtaatccat | AA034761 | 93318 | tgcccgagatgcagttggtgccaa | U12564 |
| 8111 | gtagcactggctgctactcagctt | W50891 | 50715 | aatccataagggccatgagagaagaa | AA034761 | 93319 | cattgaattcctgctctccaatcat | U12564 |
| 8112 | tagcactggctgctactcagttc | W50891 | 50716 | taaggcacttctccaggatcagg | AA034761 | 93320 | attgaattcctgctctccaatcatc | U12564 |
| 8113 | ccagattggccagatcctgctcc | W50891 | 50717 | cactctccagatcagcctatcag | AA034761 | 93321 | tgaattcctgctctccaatcatca | U12564 |
| 8114 | cagattggccagatcctgctcca | W50891 | 50718 | tccaggatcgctatccaggaaggg | AA034761 | 93322 | aattcctgctctccaatcatccagg | U12564 |
| 8115 | gacaatggccccgatggatggagcc | W50891 | 50719 | tctctagcattgggtctcattcat | AA034761 | 93323 | attcctgctccaatcatccaggt | U12564 |
| 8116 | acaatggccccgatggatggagccg | W50891 | 50720 | tgcattggtcattcatgccaat | AA034761 | 93324 | tcctgctccaatcatccaggtga | U12564 |
| 8117 | gctacaatttgccatatccaatct | W50891 | 50721 | gggtcattcatgccaatcaggt | AA034761 | 93325 | cctgctccaatcatccaggtgac | U12564 |
| 8118 | tacaaatttgccatatccaatctgg | W50891 | 50722 | cattcatgccaatcatggtggtgac | AA034761 | 93326 | ctgctccaatcatccaggtgact | U12564 |
| 8119 | acaatttgccatatccaatctgga | W50891 | 50723 | attcatgcacgtgggtactaccagt | AA034761 | 93327 | gcagacgacactcatgcagagg | AA118701 |
| 8120 | caatttgccatatccaatctggag | W50891 | 50724 | gcactgtactaccagtgaccag | AA034761 | 93328 | cacactcatgcaggacatgt | AA118701 |
| 8121 | aatttgccatatccaatctggagg | W50891 | 50725 | tggtactaccagtgaccagttctt | AA034761 | 93329 | gactcaggtccagccaacaggcagc | AA118701 |
| 8122 | attttgccatatccaatctggaggc | W50891 | 50726 | taccagtgaccagttcttagagat | AA034761 | 93330 | ggtccagccaacaggcagcagtcag | AA118701 |
| 8123 | gccatatccaatctgaggcaaga | W50891 | 50727 | gttggccagagccaccaactgggcc | AA034761 | 93331 | cagccaacaggcagcagtcagtgg | AA118701 |
| 8124 | ccatatccaatctggaggcaagat | W50891 | 50728 | cagagccaccaactgggccaaattt | AA034761 | 93332 | gccaacaggcagcagtcagtggga | AA118701 |
| 8125 | catatccaatctgggaggcaagatt | W50891 | 50729 | caccaactgggccaaattactgca | AA034761 | 93333 | agaagaagtcaccctggactgtca | AA118701 |
| 8126 | atatccaatctggaggcaagatta | W50891 | 50730 | caaatttactgcaacggccagttg | AA034761 | 93334 | agaagctcaccctggactgttcatat | AA118701 |
| 8127 | caatggcccccgatgatggaggagccgg | W50891 | 50731 | agaacaccaatctgaggaacaatgc | AA034761 | 93335 | acccctggactgttcatatgag | AA118701 |
| 8128 | aatggccccgatgatggaggagccgga | W50891 | 50732 | cctccagctcagaaggaccgctgc | AA034761 | 93336 | cacccgactgtcatatagagaca | AA118701 |
| 8129 | agccgacgcatcgagagtaactg | W50891 | 50733 | ttctggtatttgatccagggact | AA034761 | 93337 | gtacaggcagtttttagtggggag | AA118701 |
| 8130 | ttttgaagcctgccatccagc | W50891 | 50734 | attcaggccatcatgaataccctcat | AA034761 | 93338 | ttaccaacttctttgacactcag | AA118701 |
| 8131 | aacagctacaattgccatatccaa | W50891 | 50735 | ccatcatgaataacctcatgtgtta | U05265 | 93339 | gcctcctcagagcctgctgctgtg | AA118701 |
| 8132 | acagctacaattgccatatccaat | W50891 | 50736 | atgaatacccatcatgtgtatcagaa | U05265 | 93340 | accttctttgacactcagaaccag | AA118701 |
| 8133 | cagctacaattgccatatccaatc | W50891 | 50737 | acctcatgtgtacagaagtct | U05265 | 93341 | tcctcagagcctgctgctgtg | AA118701 |
| 8134 | agctacaattgccatatccaatct | W50891 | 50738 | atcagaagttctcagaattttggg | U05265 | 93342 | tcagagcctgctctgtgtggtg | AA118701 |
| 8135 | cgacgatgctacatccagctga | U08020 | 50739 | agctctcaagatttggaatata | U05265 | 93343 | ctgggtttctggatgcaatgtg | AA118701 |
| 8136 | acgatgctacatccagctgacct | U08020 | 50740 | aaatcctctccaataaacatcat | U05265 | 93344 | ggctttctggatgccaatgtggcc | AA118701 |
| 8137 | gctacatggacccagcagagactggca | U08020 | 50741 | tcctcaataaacatcatcaatg | U05265 | 93345 | ttctctggatgccaatgtggcccag | AA118701 |
| 8138 | tacatggaccagcagagactggcaacc | U08020 | 50742 | taaccagggcacactaatcaatgaa | U05265 | 93346 | atgcaatgtgcccagagtgact | AA118701 |
| 8139 | atggaccagcagagactggcaaccca | U08020 | 50743 | atgtaaccctagcccagttgtcat | U05265 | 93347 | atgactcaggtccagcaacagc | AA118701 |
| 8140 | ctgtctccagggaccagagcctcgcatcta | U08020 | 50744 | cccagttgtgcatcaggcatggcagca | U05265 | 93348 | tgatccaggacgcccgaggacaagg | AA118789 |
| 8141 | ctcctccaggagacaacgcagatcg | U08020 | 50745 | tgtgcatcaggagacaaggaacaag | U05265 | 93349 | cgatccaggcgccgaggaacaaggc | AA118789 |
| 8142 | ctccaggatccaacgagatcgagc | U08020 | 50746 | acaacgctgaaacgcaagcaagcc | U05265 | 93350 | atcgaccgcaacttgccgaggacgg | AA118789 |
| 8143 | gacatggcccccttggctggttgt | U08020 | 50747 | gctgaaaccacgcaaagcagccaacac | U05265 | 93351 | tcgaccgcaacttgccgaggaggg | AA118789 |
| 8144 | attggccccctgctggttgtaa | U08020 | 50748 | accgccaagcagccacaacagaag | U05265 | 93352 | ctcgccgtcggagaatctggtaaaa | AA118789 |
| 8145 | ggccccttgcttgtgtgtaaactc | U08020 | 50749 | gaagaaccccagtgaaacatg | U05265 | 93353 | aaagtaccacctgaaacagatgaa | AA118789 |
| 8146 | tcctttgcattcacctttcaaactt | U08020 | 50750 | cccaattccatgaatgaaaactag | U05265 | 93354 | aagtaccacctgaaacagatgaaa | AA118789 |
| 8147 | cagctgacctctgcgcctaatgt | U08020 | 50751 | gggcctgcctggctactcgtttt | X63099 | 93355 | agtaccacctgaaacatgaatgaat | AA118789 |
| 8148 | ctgacttctgcctaatgtcca | U08020 | 50752 | gcataacgaccccagttccgagag | X63099 | 93356 | aaatcattcatggacggctatc | AA118789 |
| 8149 | ttcctgggcctaatgtcaccgagg | U08020 | 50753 | tggcttggactgagcagccagc | X63099 | 93357 | aatcattcatgaggacggctattca | AA118789 |

TABLE 1-continued

| SEQ ID NO | sequence | DBAxnID | SEQ ID NO | sequence | DBAxnID |
|---|---|---|---|---|---|
| 8150 | ctgcgcctaatgtcaccgaggcct | U08020 | 50754 | ttggcacaaccttctgaggcaaa | X63099 | 93358 | atcattcatgagacggtctattcag | AA118789 |
| 8151 | tgcaagaacagcgtagcctacatgg | U08020 | 50755 | caacttctggaggccaaagagcaa | X63099 | 93359 | tcattcatgagagacggctattcaga | AA118789 |
| 8152 | aacacggtagcctacacagaccagc | U08020 | 50756 | actgctgttgagcacaccaccacg | X63099 | 93360 | gatccatggcgccgaggacaaggcg | AA118789 |
| 8153 | agcgtagcctacatggaccagcaga | U08020 | 50757 | gcttgagcacaccaccacggtccct | X63099 | 93361 | atccatggcgccgaggacaaggcgg | AA118789 |
| 8154 | gtagctacatggaccagcagactg | U08020 | 50758 | cacccctagccaggacttgggagg | X63099 | 93362 | aagatgatcgaccgcaactgcgga | AA118789 |
| 8155 | ctgctgcaggacagctgctgaagc | M37759 | 50759 | aggacttggaggcatgcgtatcct | X63099 | 93363 | agatgatcgaccgcaactgcggag | AA118789 |
| 8156 | ctgctgcaagttctgcatgtgtg | M37759 | 50760 | tgtcatatcccgcgtatatcctt | X63099 | 93364 | ggcagaacctacatactcttccatc | AA118789 |
| 8157 | ttatctccaggtctgtatatcct | M37759 | 50761 | atccccggctatatcctgacata | X63099 | 93365 | atgatgacccgcaactgcggagaa | AA118789 |
| 8158 | ggtcctgattatcctgctgtcc | M37759 | 50762 | tgacatatccaagtctgtcctta | X63099 | 93366 | tgatcgaccgcaactgcggaggac | AA118789 |
| 8159 | tcctgattatcctgctgttccctt | M37759 | 50763 | cagaccccagctcgagagacatttt | X63099 | 93367 | gatcgaccgcaactgcgaggacg | AA118789 |
| 8160 | ttatcctgctgttccctagcact | M37759 | 50764 | cagctccgagagacattagatta | X63099 | 93368 | atcaactacagtagcctcagtatag | AA118789 |
| 8161 | tgcttcccacagctcaactcagat | M37759 | 50765 | ttttactacacagcatgcaagggtca | X63099 | 93369 | aactacagtagcctcagtatagcta | AA118692 |
| 8162 | ttccacagctcaactcagattg | M37759 | 50766 | gcttctacctactgcaggcgactcg | X63099 | 93370 | ggtcctcaggcagaacctacaatt | AA118692 |
| 8163 | cttcaactcagattggctttcgt | M37759 | 50767 | accctacgcaggggacgtccccgct | X63099 | 93371 | gcctcaggcagaacctacaattctt | AA118692 |
| 8164 | ttggtttcgtcctcaaagaag | M37759 | 50768 | tgggcaccctcagaaaagcaca | X63099 | 93372 | ggcagaacctacatacttccatc | AA118692 |
| 8165 | tcgtcctcaagagaggccatctgc | M37759 | 50769 | ccctctcagaaaaagccatgaaa | X63099 | 93373 | ctatgactctatcactctggctac | AA118692 |
| 8166 | agagccatctgtcatctactactg | M37759 | 50770 | tccatcagacatagcaacagaaca | X63099 | 93374 | ttgtatcagattcacaatatcgt | AA118692 |
| 8167 | gcaatgtccatggttgccaagg | M37759 | 50771 | ttccagatatgtcttgaaccaga | X63099 | 93375 | tatcgcagaattcacaatatcgtatc | AA118692 |
| 8168 | ctcctgtcatcatgtacctctag | M37759 | 50772 | atatgtcttgaaccagataaaac | AA034569 | 93376 | agatttcacaatatgtatctagcgt | AA118692 |
| 8169 | atgtctccatgtgttgccaaggca | M37759 | 50773 | agagcgtccaagcactgttcgccgc | AA034569 | 93377 | ttcaaatatgtatctagcgtaga | AA118692 |
| 8170 | tgaactgctcctcagctgtcgt | M37759 | 50774 | tgttcgccgcctgtgtgacagat | AA034569 | 93378 | acaatatcgtatctagcgtagatct | AA118692 |
| 8171 | actgcttcctcagctgtgggccta | M37759 | 50775 | agatcaataagtttgcccagtactg | AA034569 | 93379 | agaccattgcacttgtcgaagagaa | AA118692 |
| 8172 | gctgttgcctccagtttatctccag | M37759 | 50776 | tccataagtttgcccagtactgag | AA034569 | 93380 | tacagtagcctcagtatagctatca | AA118692 |
| 8173 | gtggcctccagttattctccaggt | M37759 | 50777 | ggattgacccatctgatgcctgg | AA034569 | 93381 | agtagctatcatcatctcatcaa | AA118692 |
| 8174 | tccagttatctccaggtcctgat | M37759 | 50778 | tcctgatcgctcaataagaaac | AA034569 | 93382 | gctatcatcatctcatcctcac | AA118692 |
| 8175 | agtttatctccaggtcctgattat | M37759 | 50779 | tgatgctctggtcaataagaaaca | AA034569 | 93383 | atcatcatctcatcctcatcccacag | AA118692 |
| 8176 | cggccagctcctggggcttgcgaa | W50919 | 50780 | gggaagccactgctgtactaaa | AA034569 | 93384 | atcatctcatcaatcctcacaggtg | AA118692 |
| 8177 | gccagctctggccaaggcaa | W50919 | 50781 | gaagccactgctgtactaaagac | AA034569 | 93385 | tcatcaatccacaggtgcctcag | AA118692 |
| 8178 | gccagctcctcagcgttcgcagt | W50919 | 50782 | actacatcagagtctgatcgacga | AA034569 | 93386 | tcaatcacagggtgcctcaggcca | AA118692 |
| 8179 | cctcctagcagacaggaacgaggag | W50919 | 50783 | tcgacgagagcgtccaagcactgt | AA034569 | 93387 | atcctacagggtgcctcaggcagga | AA118692 |
| 8180 | cagggccagtcatggccagcagagc | W50919 | 50784 | acgagcgtccacgcactgttcgc | AA034569 | 93388 | acagcagagcctaattctgttctg | AA118692 |
| 8181 | tcttagcagcaagggccagagacgc | W50919 | 50785 | ctggagatctcagcgcggagatca | AA034569 | 93389 | catcatccaggtgaagtgtgacaag | AA118692 |
| 8182 | ttagcagcaagggcagacgggcag | W50919 | 50786 | ctggagatctcagcgcggagatca | AA034569 | 93390 | catcatccaggtgaagtgtgacaag | AA118621 |
| 8183 | cagcctgctgggctgcggaagtac | W50919 | 50787 | actctgcagcgggagatcagaatgg | X63100 | 93391 | cagagctcaattctgcttgtac | AA118621 |
| 8184 | cagcctgctgggctgcggaagtagc | W50919 | 50788 | gaaacacagtgtccaaggcacatg | X63100 | 93392 | tccaaggccatcatccaggtg | AA118621 |
| 8185 | gctgggctgcggaagtacta | W50919 | 50789 | cagtgtccacaggttctcagtctcta | X63100 | 93393 | caaggccatcatccaggtgaagt | AA118621 |
| 8186 | ctgggctgcggaagtactgcgg | W50919 | 50790 | tcccagccacaggttctcagcaata | X63100 | 93394 | gccatcatcaggtgaagtgtgaca | AA118621 |
| 8187 | gaagtactgcgagctctactg | W50919 | 50791 | gcacagttctcagcaataatgcag | X63100 | 93395 | catcatccaggtgaagttgacaag | AA118621 |
| 8188 | tactgcgagctctactgcgagctg | W50919 | 50792 | gtcctcagcaataatgcagtgcag | X63100 | 93396 | tgtgacaagccttctaagccaggag | AA118621 |
| 8189 | cagcctgcgtggccgaagtac | W50919 | 50793 | gaacttcagttgtcttccaga | X63100 | 93397 | tgacagccgtgtcttaacccag | AA118621 |
| 8190 | ctgctggggctggaagtacta | W50919 | 50794 | tgtactccagatcagagaagaa | X63100 | 93398 | gccctcaccttcctccaggttgc | AA118621 |
| 8191 | gaagtactgcactgctcactcg | W50919 | 50795 | acatggcgcacagttctcag | X63100 | 93399 | tcacttcctttctcaggtgctga | AA118621 |
| 8192 | tactagctactgctcactgatgc | W50919 | 50796 | gcacagttctcagcaataatgcag | X63100 | 93400 | acttcctttccagctcctggaga | AA118621 |
| 8193 | gctcactgcagctgcgcgggcttc | W50919 | 50797 | gttctcagcaatatagcagttcag | X63100 | 93401 | ttgctgtttactctatggtgagata | AA118621 |
| 8194 | tcactgcgatgctgcgcgggcttccc | W50919 | 50798 | gaactttcaggttgtcttccaga | X63100 | 93402 | gtttttcactgcgtcgtcgatgaa | AA118621 |
| 8195 | tcgatcgcgcggggcttcccacag | W50919 | 50799 | tgtgtcctcagatccagaagaga | X63100 | 93403 | ttttcactgcgtcgtcatgtgaagg | AA118621 |
| 8196 | tcccgaaaccgagctgcgagaggaa | W50919 | 50800 | atttgtacattggactgctgtgtt | X63100 | 93404 | cactgcgtcgtcatgtgaaggaggt | AA118621 |
| 8197 | acggagctgctgcagaaccagagat | AA145547 | 50801 | tgtacattggactgctagttaca | X63100 | 93405 | ctgcgtcgtcatgtcgtgaaggt | AA118621 |
| 8198 | ggccctcaggaagtcgtagttacctt | AA145547 | 50802 | acatgtgacgtctgtagttacactt | X63100 | 93406 | ttgtgtcgtcttgcttttcc | AA118621 |
| 8199 | gaatcgtttacactgccacacagc | AA145547 | 50803 | ttggacctagcaatccacaggctacc | X63100 | 93407 | ctgctttccaaggccatccaagg | AA118621 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 8200 | tcgttacatactgccacaagcga | AA145547 | 50804 | atccaggctaccatcaccaaaaca | X63100 | 93408 | cagctgaccggcgaccagcgtttg | AA051231 |
| 8201 | acatactgccacaagccgaaagagt | AA145547 | 50805 | gtaagcagcaacttgctgaataatg | X63100 | 93409 | caccagcgttttgtgcaccggctag | AA051231 |
| 8202 | tactgccacaagccgaaagagttac | AA145547 | 50806 | gtaaacatttggctctgttactt | X63100 | 93410 | catgtgcggaaccatctgctacac | AA051231 |
| 8203 | tgccacaagccgaaagagttaccag | AA145547 | 50807 | ttatcttcaggatgctgtggctc | X63100 | 93411 | cggaaccatcgtaccacacactg | AA051231 |
| 8204 | gagttaccagctggctccatcgag | AA145547 | 50808 | ttggctcatgatccaaactcagggg | X63100 | 93412 | aaccatctgtacacacactgggg | AA051231 |
| 8205 | gcctgctccatcgagccctgatg | AA145547 | 50809 | catgatccaaactcaggggactctg | X63100 | 93413 | cctgactgctaagccttcaact | AA051231 |
| 8206 | tggctccatcgagccctgatggag | AA145547 | 50810 | ccaaactcaggggatctgaaggtg | X63100 | 93414 | gactgctctaagccttcaactcac | AA051231 |
| 8207 | catcgagccctgatggagccctg | AA145547 | 50811 | tctggaccgaccctgagacagat | X63100 | 93415 | tctaagccttttcaactcaccagcca | AA051231 |
| 8208 | aactgtgccagctctctcatagct | AA145547 | 50812 | ccgaccctggagacagattgtcac | X63100 | 93416 | gccttcacgcagagctcactctga | AA051231 |
| 8209 | gccagctctcatagctctggattc | AA145547 | 50813 | tgctgtctctgccgaggtccagc | AA034595 | 93417 | ttcacgcagagctccactctgaggc | AA051231 |
| 8210 | agctctcatagctctggattctg | AA145547 | 50814 | tctctgccgaggtccagcacagaa | AA034595 | 93418 | agcgagctccactctgaggcagc | AA051231 |
| 8211 | tagctctggattctgggctctaag | AA145547 | 50815 | tccaagcacagaatcgggctttac | AA034595 | 93419 | cagagctccactctgaggcagcatc | AA051231 |
| 8212 | ctctggattctgggctctaagcct | AA145547 | 50816 | gggctttaccatgactctcctcg | AA034595 | 93420 | cgtttgtgcaccgctagacggc | AA051231 |
| 8213 | tggattctgggctctaagcctgag | AA145547 | 50817 | acggacagtccgcagcgcagagttg | AA034595 | 93421 | agctccactctgaggcagcatcgcc | AA051231 |
| 8214 | ctggggctctaagcctgaggtccca | AA145547 | 50818 | gacagtccgcagcgcagagttgccc | AA034595 | 93422 | ttgtgcaccggctagagcggcgc | AA051231 |
| 8215 | tgaggtcccaggcccctcaggaaga | AA145547 | 50819 | cagcgcagagttgccatttagag | AA034595 | 93423 | caccggctagagcgggccataagt | AA051231 |
| 8216 | ccagtcagcgtgtgccctgtg | M37760 | 50820 | cgcagagttgccatttagagcgg | AA034595 | 93424 | cggctagagcggcgccataagtgca | AA051231 |
| 8217 | ccctgtgtctgctgccagtgtaaaatc | M37760 | 50821 | agagttgccatttagagcgcgatt | AA034595 | 93425 | ctagagcggcgccataagtgcagca | AA051231 |
| 8218 | atcctcgtttctgggctctatg | M37760 | 50822 | tttagagcgatttgccaggagctc | AA034595 | 93426 | gccataagtgcagcatttgtgca | AA051231 |
| 8219 | ttctgggctctatggtgtttcacac | M37760 | 50823 | ttgtcaccctcagatttcgacattt | AA034595 | 93427 | cataagtgcagcatttgggcaaga | AA051231 |
| 8220 | atggttttcaacacacagttcacca | M37760 | 50824 | tcacctccagattctgacatttgat | AA034595 | 93428 | aagtctcatgtcgggaaccatctgc | AA051231 |
| 8221 | ttcacacacagttcaccaaagaca | M37760 | 50825 | cctcagatttctgacatttgattcc | AA034595 | 93429 | accacatggctcctatgaccggc | AA118886 |
| 8222 | cagttcaccaaagacacctccacca | M37760 | 50826 | atttctgacatttgattcccccagag | AA034595 | 93430 | tgggctcctatggaccggcctcta | AA118886 |
| 8223 | ttcaccaaagacacctccacactg | M37760 | 50827 | tctgacatttgattcccagaggc | AA034595 | 93431 | tgcccactccggacttcagagtg | AA118886 |
| 8224 | acctccaacatgcagttcactag | M37760 | 50828 | gacatttgattcccagagggcaaa | AA034595 | 93432 | actcagagtcgagagtggggcgat | AA118886 |
| 8225 | ctctaccaaatggactccactcct | M37760 | 50829 | gttcctgcacttctagtgccagt | AA034595 | 93433 | acttcagagtgggctgatggcat | AA118886 |
| 8226 | ttaccaaatggactccactcctgcc | M37760 | 50830 | ctggcactccagtgcagtgttctg | AA034595 | 93434 | ttttcatgatcaaagctcatctgaa | AA118886 |
| 8227 | catgtcacctcctcttggtaggt | M37760 | 50831 | ttagacgtacctgatggggctga | AA034595 | 93435 | tgatcaaagctcatctgacatctt | AA118886 |
| 8228 | tgtgtgctcagtgtaaaatctga | M37760 | 50833 | gagctgacgtctcgactatgca | X66032 | 93436 | acatcttgggaacgctccaaccg | AA118886 |
| 8229 | tctggccacagatctcaggcagca | M37760 | 50834 | agcagcagatcctcgtgaatatcagc | X66032 | 93437 | tggtggaacgtccaacgaaccag | AA118886 |
| 8230 | ccacagatctcaggcagcagagctg | M37760 | 50835 | atcaagcacgatcctgcttgaact | X66032 | 93438 | aacgctccaacgaaccagagctgt | AA118886 |
| 8231 | cagatctcaggcagcagagctgatt | M37760 | 50836 | tccaaaatcaataagacctggtct | X66032 | 93439 | gtccaaccgaaccagagctgtcag | AA118886 |
| 8232 | ctttacagccctgtcattcctctgt | M37760 | 50837 | gggcagccctagcactgagctccg | X66032 | 93440 | ccaaccgaaccagagctcagcgt | AA118886 |
| 8233 | tacagcctgtctattcctctgt | M37760 | 50838 | gactcctagtgccgttcctcagat | X66032 | 93441 | tctaccaatctacgacgcttcgg | AA118886 |
| 8234 | agcctgtctattcctctgttctctgg | M37760 | 50839 | gatcctgccgttctcagatcctgta | X66032 | 93442 | gaaccagagctgcagctgcctcc | AA118886 |
| 8235 | tctatctctgttctggggctcta | M37760 | 50840 | gcgcttctcagatcctgatgtatt | X66032 | 93443 | accaatctacgacgcttctgaaca | AA118886 |
| 8236 | cctcaagctcgcgggcatggactgt | W50924 | 50841 | tcagactcatttctaattgtgtat | X66032 | 93444 | cttacgacgttctggacagtcac | AA118886 |
| 8237 | caagctcgcgggcatggactggtgac | W50924 | 50842 | acaataactctgctctgtattgaag | X66032 | 93445 | acgacgttctggacagttcacaca | AA118886 |
| 8238 | ctccaacctcgagtctgtggaga | W50924 | 50843 | actctgctctgtattgaagaaaat | X66032 | 93446 | acgttctgacagttcacacacga | AA118886 |
| 8239 | caacctcgagtctgtggaagagt | W50924 | 50844 | acgctgactacatacatgtggc | X66032 | 93447 | tttttccgtggatctgaagaacga | AA118886 |
| 8240 | ccttgagtcgggagagtggg | W50924 | 50845 | atgtgcactaccactcctcagg | X66032 | 93448 | gggtgtccgtcgagtttggagact | AA118886 |
| 8241 | agcatacactgtatctgacgccgtgc | W50924 | 50846 | tctccagttgggacgctcctgccctt | X66032 | 93449 | ttggagactgcccactctgaact | AA118886 |
| 8242 | atcactgtatctgacgcgtgcgcgat | W50924 | 50847 | tgcctgctcagaaggtgctgggc | X66032 | 93450 | gttgcttactcttcttaagccagat | AA118886 |
| 8243 | gtatctgacgcgcgtgcgatagtagt | W50924 | 50848 | tacacaggctacatggagagtgaag | X66032 | 93451 | tgccttaatctcttaagcagatg | AA118925 |
| 8244 | tctgacgccgtcgcgatagtagca | W50924 | 50849 | cacatgccaagaaacgttgtgaag | X66032 | 93452 | cagaacatccttaactcttcatgga | AA118925 |
| 8245 | cgatagtacgtcgagcgggatc | W50924 | 50850 | gacaaccgtaccaagttcactgac | X66032 | 93453 | ggacaatccttaactcttcatggagc | AA118925 |
| 8246 | tacgtgcagtcgagatcctgagg | W50924 | 50851 | aagttcactcgtcaagaacaagt | X66032 | 93454 | ccttaactctcatggagcatctta | AA118925 |
| 8247 | cagcagggatcctgagatggatgcta | W50924 | 50852 | caacttctccgagcagtcacag | AA034638 | 93455 | gtacacttgacagcagatgccaaag | AA118925 |
| 8248 | gctcagcggcatgagctgagggacag | W50924 | 50853 | ctctccggagcagtcacagtgaaga | AA034638 | 93456 | acttgacagcagatgccaaaggc | AA118925 |
| 8249 | cagctacagagcatctgtgtga | W50924 | 50854 | gacccatgctgactagtgactctgcg | AA034638 | 93457 | tatctaccacgagaaccccagaga | AA118925 |

| SEQ ID NO | sequence | DBAxnID | SEQ ID NO | sequence | DBAxnID | SEQ ID NO | sequence | DBAxnID |
|---|---|---|---|---|---|---|---|---|
| 8250 | ctacatgagcatcctgctgtgaagc | W50924 | 50854 | cccatgctagtgtactctgcgta | AA034638 | 93458 | cccagagaactcaagtggggtgt | AA118925 |
| 8251 | catgaccatcctgctgtgaagcaca | W50924 | 50855 | ccatgctagtgtactctgcgtatc | AA034638 | 93459 | agaacttcaagtgggctgtgattt | AA118925 |
| 8252 | gagcatcctgctgtgaagcacagtg | W50924 | 50856 | gctagtgtactctgcgtatcgct | AA034638 | 93460 | aacttcaagtgggctgtgttttcg | AA118925 |
| 8253 | attacgcagcgaagtcccaacctt | W50924 | 50857 | tagtgtacctctgcgtatcgcctga | AA034638 | 93461 | cttcaagtgggctgtgattttcga | AA118925 |
| 8254 | cagcgaagtcccaacctcgagtc | W50924 | 50858 | tctgcgtatcgccgagtgcacac | AA034638 | 93462 | ttgaaaaatccaactcatccagga | AA118925 |
| 8255 | agtctccaacctgagtctgcgtgg | W50924 | 50859 | gtatcgcctgagtgcacacttacag | AA034638 | 93463 | aatccaactcatccaggacatcct | AA118925 |
| 8256 | tcccaacataaccaggaatagagga | W50924 | 50860 | gcgagatcaccatacggtactt | AA034638 | 93464 | tccaactcatccaggacatctta | AA118925 |
| 8257 | ttgaacatagcaaggccccagatcta | W50926 | 50861 | ggtactttcgaggcctgtgccaga | AA034638 | 93465 | caactctatccaggacatccttaac | AA118925 |
| 8258 | gtacaacctggattgccctccg | W50926 | 50862 | tactttcgaggcctgtgccagat | AA034638 | 93466 | actctatccaggacatccttaactc | AA118925 |
| 8259 | ccttcctgggagctctgatgcg | W50926 | 50863 | ctccggagcagtcacagtgaagatc | AA034638 | 93467 | tctatccaggacatccttaactctt | AA118925 |
| 8260 | agcttcgtgatgcgatctgcagatg | W50926 | 50864 | tctcggtgctcactcggtgata | AA034638 | 93468 | tatccaggacatccttaactcttca | AA118925 |
| 8261 | tgatgccgatctgcagatgtlggtc | W50926 | 50865 | tcggtgctcactcggtgatatacg | AA034638 | 93469 | tccaggacatccttaactcttcaa | AA118925 |
| 8262 | gatgttggatctgtaccctgtatcatc | W50926 | 50866 | ggtgctcactcggtgatatacgct | AA034638 | 93470 | cacatttgagcctgctcaccaatc | AA118925 |
| 8263 | gttggtctgtaccctgatcatctc | W50926 | 50867 | tgctcactcggtgatatacgctca | AA034638 | 93471 | acatttgagcctgctcaccaatca | U12565 |
| 8264 | cttaccctgatcatctccagtctt | W50926 | 50868 | tcactcggtgatatacgctcactcc | AA034638 | 93472 | gtctgtcttcaagatgcagccgt | U12565 |
| 8265 | accctgatcatctccagtctgtc | W50926 | 50869 | ggtgatatacgctcactccaggtgt | AA034638 | 93473 | ttctgtcttcaagatgcagccgta | U12565 |
| 8266 | cagtctgtcacaggaatggcgggcc | W50926 | 50870 | tggaacccatcgctagtgtactcttg | AA034638 | 93474 | ctgctctcaagatgcagccgtagg | U12565 |
| 8267 | cacaggaatggcgggccctagaatgt | W50926 | 50871 | acctggagcaagttcaggtcac | AA034638 | 93475 | tgtctctcaagatgcagccgtagga | U12565 |
| 8268 | aacataggcaaggccccagatctacac | W50926 | 50872 | gtgttcaggtcacacagctggagc | AA034638 | 93476 | tctcttcaagatgcagccgtaggaat | U12565 |
| 8269 | aggcccagatctacacagcacctga | W50926 | 50873 | tgttcccaaggtgcaatgatatccc | AA034638 | 93477 | tcttcaagatgcagccgtaggaatg | U12565 |
| 8270 | cccagatctacacagcacctgatgt | W50926 | 50874 | gcaatgatatccccatcaaagtag | AA034638 | 93478 | ttcaagatgcagccgtaggaatggc | U12565 |
| 8271 | agatcacacagcacctgatgttg | W50926 | 50875 | atgatatccccatcaaagtagttg | AA034638 | 93479 | tcaagatgcagccgtaggaatggct | U12565 |
| 8272 | acacagcacctgatgttgacctg | W50926 | 50876 | atatccccatcaaagtagttgaagg | AA034638 | 93480 | aagatgcagccgtaggaatggctcg | U12565 |
| 8273 | cacctgatgttgacctgtggagt | W50926 | 50877 | gctatcagcaagcgcctccaaggga | AA034638 | 93481 | agatgcagccgtaggaatggctcgg | U12565 |
| 8274 | gagttccacagagtacaatcctgg | W50926 | 50878 | agcaagcgcctccaaggaggtca | AA034638 | 93482 | atttgagccctgctcaccaatcatc | U12565 |
| 8275 | ttccacagtacaatcctggatt | W50926 | 50879 | cgcctccaaggaggtcatgagcg | AA034638 | 93483 | tttgagccctgctcaccaatcatcc | U12565 |
| 8276 | gttgtatcattcctttgcatataa | X63963 | 50880 | atgcaggccattgaactgacacag | AA034646 | 93484 | gagccctgctcaccaatcatccagg | U12565 |
| 8277 | tgtatcattcctttgcatataa | X63963 | 50881 | gcaggccattgaactgacacagcaa | AA034646 | 93485 | ccctgctcaccaatcatccaggta | U12565 |
| 8278 | tcatttgttctttctttggccagca | X63963 | 50882 | aactgacgcaattgcatcaag | AA034646 | 93486 | ctgctcaccaatcatccaggtgatt | U12565 |
| 8279 | ttctttggcagcaaaagttaatgt | X63963 | 50883 | aggtcacacagctgtagcgaccac | AA034646 | 93487 | ctcaccaatcatccaggtgatccc | U12565 |
| 8280 | ttactgttcacagtccaaatcattt | X63963 | 50884 | tcacacagctggatgcgaccaccca | AA034646 | 93488 | tcaccaatcatccaggtgattccca | U12565 |
| 8281 | ttcacagtccaatcatttgcat | X63963 | 50885 | tcaaccgcctctcattgctct | AA034646 | 93489 | cccagctcaagaaactgtctt | U12565 |
| 8282 | acagtccaatcatttgtgcatcta | X63963 | 50886 | tctattgctcttgaccgagagc | AA034646 | 93490 | atcgccatgtgtgaggcctcaga | W53351 |
| 8283 | gtccaatcatttgtgcatctagaa | X63963 | 50887 | tgtcttgaccgaggagcctttat | AA034646 | 93491 | gtgcctatgtggggcctcagatc | W53351 |
| 8284 | tcatttgtcatctagaatcatt | X63963 | 50888 | ttgaccgaaggcctttatgagata | AA034646 | 93492 | gaccatgtatacctcgaaggga | W53351 |
| 8285 | tctagaatcctccataatta | X63963 | 50889 | ttatgaataccttgcctgt | AA034646 | 93493 | catcatgtatacctcgaaggatc | W53351 |
| 8286 | attcctccataattcatcaatta | X63963 | 50890 | tgagataccttgcagcctgtcc | AA034646 | 93494 | tacctcgaaggactctgtgcagc | W53351 |
| 8287 | tacattccttttcagaatttgtg | X63963 | 50891 | tctcttggttgcaacttctgt | AA034646 | 93495 | actctgctcaagatccaaatatggtga | W53351 |
| 8288 | atcattcctttgcatataatgaac | X63963 | 50892 | tcaactttcagatctgaaacccaagt | AA034646 | 93496 | ctgctcaagccaatatggtgaccc | W53351 |
| 8289 | attgaactgggacaacacaacacta | X63963 | 50893 | caatgctatattgcatctcctagt | X64713 | 93497 | ggcatgcctgtccatcaagtata | W53351 |
| 8290 | gaacctgggacaacacaccacagt | X63963 | 50894 | ctatattgcatctcctagtgtgaac | X64713 | 93498 | gcctgccatcaagtatagccag | W53351 |
| 8291 | cctggacaacacacactagatata | X63963 | 50895 | tgcatcctagtgtgaacaaactg | X64713 | 93499 | tgtccccatcaagtataggccagaag | W53351 |
| 8292 | tgtctccctagaaatcctcagaat | X63963 | 50896 | atccaagtgatctctccagtccggc | X64713 | 93500 | gcaactgtcactgcctgcgtcgta | W53351 |
| 8293 | ccctagaaatcctcagaatgattc | X63963 | 50897 | ctccacagttctttaaatgatgt | X64713 | 93501 | actgtcactgcctgcgtctg | W53351 |
| 8294 | tttataacattttcagaatcat | X63963 | 50898 | tctgctggctcaacttcagat | X64713 | 93502 | cctattggtgggctcagattcgc | W53351 |
| 8295 | atacacattttcatgcaatcattg | X63963 | 50899 | cattcaatagtcttccaggagt | X64713 | 93503 | gagcctcagatcttcctgacgagg | W53351 |
| 8296 | taccggctcgggcttgtatcacga | X63963 | 50900 | gaattcgacagcagcagatgggtg | X64713 | 93504 | cctcagattcctgcctgacgggagacc | W53351 |
| 8297 | ctcggcctgtatcacgatcctct | X63963 | 50901 | ctcctgtcttgaattgccacctgga | X64713 | 93505 | ctgccctgacggagaccatgacctca | W53351 |
| 8298 | accagtacatagacaccgacactga | M64228 | 50902 | aatgcacctgaaaagaatccttctt | X64713 | 93506 | gggaccatgtccctcaaagttgcc | W53351 |
| 8299 | acatagacacgacctgatgacga | M64228 | 50903 | ttcagatctgaaaccaagtatctt | X64713 | 93507 | ctcaaagttgccagtagttacag | W53351 |

| SEQ ID NO | sequence | DBAxnID | SEQ ID NO | sequence | DBAxnID | SEQ ID NO | sequence | DBAxnID |
|---|---|---|---|---|---|---|---|---|
| 8300 | acaccgacactgatgacgagggtca | M64228 | 50904 | ccccaagtctcactcactcaacagat | X64713 | 93508 | gtatacaagccctgatgatgaccatc | W53351 |
| 8301 | acactgatgacgaggggtcagctgct | M64228 | 50905 | tgtatctgtatatcctgtataqaa | X64713 | 93509 | aaggcctgagtgacttgaccatcatgtat | W53351 |
| 8302 | agctgtcttacagcgtggaactcag | M64228 | 50906 | catgcatatactccaaggatgatat | X64713 | 93510 | tgttgctctagacttgagcaagag | AA119014 |
| 8303 | tctacagctggactccagtctccc | M64228 | 50907 | catcaacagtattcctacagcatt | X64713 | 93511 | ttgctcagactgagcaagagat | AA119014 |
| 8304 | ccaagagtctccacgggagtaccag | M64228 | 50908 | cagtattcctatcagcattcttac | X64713 | 93512 | atacactggactatcattcaatcc | AA119014 |
| 8305 | agttcagcctggagctagaaacaga | M64228 | 50909 | tcctatcagcattcctaacaatgcc | X64713 | 93513 | acactggactatcattcaatccat | AA119014 |
| 8306 | ccgatgtgcacatgtgcctgggggg | M64228 | 50910 | cagcattcctaccaatgcctatatt | X64713 | 93514 | tggactatcattctaatccatcatg | AA119014 |
| 8307 | cacacggaggcaactcgggatcagag | M64228 | 50911 | ccaaacctgccattgcctccaaaga | X64713 | 93515 | gactatcattctaatccatcatgta | AA119014 |
| 8308 | gctgtatacagatcctcttaggaa | M64228 | 50912 | ttgcctccaaagacagtggtggtgga | X64713 | 93516 | ctatcattctaatccatcatgtagt | AA119014 |
| 8309 | atcctcttaggaacagagaggcgc | M64228 | 50913 | ttcacacagatgacacaagcttgaa | X64713 | 93517 | atcattctaatccatcatgtagtgt | AA119014 |
| 8310 | tcgccgactggagtggctcctcct | M64228 | 50914 | tgalaggctggaccagtgttgtg | X64713 | 93518 | cattctaatccatcatgtagtgtga | AA119014 |
| 8311 | tcttagacaagccgtgctgagccc | M64228 | 50915 | gctgtgaccagtgttgtgagcaaa | X64713 | 93519 | ttctaatccatcatgtagtgtgacg | AA119014 |
| 8312 | acaagccctgtctgagccctgagtc | M64228 | 50916 | gagcccaagcgtgcctaggctgc | X64713 | 93520 | ctaatccatcatgtagtgtgacgtt | AA119014 |
| 8313 | tgagccctggagctcctcatctacac | M64228 | 50917 | acagctgcctaggctgccttct | X64713 | 93521 | cacagtgctgtgtggtggtacacaa | AA119014 |
| 8314 | tctacaccagcaagtgccaggac | M64228 | 50918 | tccactgtcagccaacagcatgcc | X64713 | 93522 | gctctagactcgagcaagagatgt | AA119014 |
| 8315 | cccagaaaacacaacagcaatagc | M64228 | 50919 | glcagccaacagccatgcctcctt | X64713 | 93523 | tctagacttgagcaagagatgtgc | AA119014 |
| 8316 | atcatctactatggattaccaggag | M64228 | 50920 | catgtctgcctcatgactgcta | X64713 | 93524 | atggcggaatctcctccttcctgga | AA119014 |
| 8317 | tcatctactatggattaccaggagt | | 50921 | ctgcctcatgaactctattttg | X64713 | 93525 | tcctcctgaggagaactcatgagc | AA119014 |
| 8318 | agtgctttctgtcctctgcta | | 50922 | tcatgaactctattttgtaaggtg | X75888 | 93526 | gaactatgagctggctgaaggcaa | AA119014 |
| 8319 | gtgctttctgtcctctgcta | | 50923 | agccccctgcagatgctgtgctcat | X75888 | 93527 | gaatctgtggatacactggacta | AA119014 |
| 8320 | ttctgtcctctgctactctag | | 50924 | ggtgcatctctcaggagccgcag | X75888 | 93528 | atcctgtgtacactgggactac | AA119014 |
| 8321 | tctgtcctctgctactctagc | | 50925 | acctcagaaccaccactgcagtgctc | X75888 | 93529 | tgatacactggactatcattctaat | AA119014 |
| 8322 | ctgtcctctgctactctagcc | | 50926 | agaaccacactgcagtgctccagaag | X75888 | 93530 | agatccatgcgccgaccccggatgt | AA119014 |
| 8323 | calctactatggattaccaggagt | | 50927 | ccagtggtctccagaagctgta | X75888 | 93531 | aagttggctgactcttgccaagg | AA119035 |
| 8324 | atctactatggattaccaggagtt | | 50928 | ggtgctactgaccccactgagct | X75888 | 93532 | gctaccgcacagtgaagcagcagca | AA119035 |
| 8325 | tctactatggattaccaggagtga | | 50929 | acttgaccccactggactcttcac | X75888 | 93533 | tgaagcagcagcagcagttcat | AA119035 |
| 8326 | acaagccaacagtatttgaggaat | | 50930 | aggcttcacacagatgacacaag | X75888 | 93534 | actcctctcttgaacaacagccac | AA119035 |
| 8327 | caagccaacagtatttgaggaatt | | 50931 | acggttccaggacctgtttgcat | X75888 | 93535 | tctttgaacaacgccacgctgtt | AA119035 |
| 8328 | aacacagtctttctgtccctg | | 50932 | ggtcttccagaactgtttgctccc | X75888 | 93536 | cacgctggtgtcctactgaccatgagt | AA119035 |
| 8329 | cacagtctttctgtccctg | | 50933 | tctcaaacccacagacaagcataag | X75888 | 93537 | gctggtgtctactgaccatgagct | AA119035 |
| 8330 | acagtctttctgtccctgc | | 50934 | tcaaacccacagacaagcataagac | AA034827 | 93538 | gctggttctactgaccatgagcttgt | AA119035 |
| 8331 | calctactatggattaccaggagt | | 50935 | aaaaccacagacaagcataagaccg | AA034827 | 93539 | tgtctaccatgagctgtcttgac | AA119035 |
| 8332 | atctactatggattaccaggagtt | | 50936 | acaagcataagaccgacctcaacca | AA034827 | 93540 | tctaccatgagctgtcttgaccac | AA119035 |
| 8333 | acagtgtttctgtcctctgc | | 50937 | gcataagaccgacctcaaccacag | AA034827 | 93541 | agctgtctgaccacaaaggaatt | AA119035 |
| 8334 | aggtgctttctgtcctctgcta | | 50938 | gacctcaaccacagaccgacctcaagg | AA034827 | 93542 | gctgacttctgccaaggtgactact | AA119035 |
| 8335 | ggtgctttctgtcctctgctac | | 50939 | tcaaccacagaccgaccctcaagggttgg | AA034827 | 93543 | tgactcttgccaaggtgactact | AA119035 |
| 8336 | tgctttctgtcctctgctact | | 50940 | gacgacctggaccccaaccatgtgc | AA034827 | 93544 | tttaccactgcgaggctgactcg | AA119035 |
| 8337 | gctttctgtcctctgctactt | | 50941 | caccaaacatgtgtgagcagccgcg | AA034827 | 93545 | accaactgcgaggctgactcggag | AA119035 |
| 8338 | ctttctgtcctctgctactlc | | 50942 | cccaaacatgtgctgagcagccgcg | AA034827 | 93546 | acactgcgaggctgactcggagcgg | AA119035 |
| 8339 | ttttctgtcctctgctactct | | 50943 | tcttccaggacctgttgcatccat | AA034827 | 93547 | ggctgactcggagcggctaccgcac | AA119035 |
| 8340 | tttctgtcctctgctactcta | | 50944 | ccaggacctgtttgcatccatatc | AA034827 | 93548 | tgactcggagcggctaccgcacagt | AA119035 |
| 8341 | ttctgtcctctgctactctca | | 50945 | aggacctgttgcatccatcatcca | AA034827 | 93549 | gcggctaccgcacagtgaagcagca | AA119035 |
| 8342 | tctgtcctctgctactctagc | | 50946 | gacctgttgcatccatcatccagg | AA034827 | 93550 | tgcaggcctgtctccacaagctcc | AA119035 |
| 8343 | tctactatggattaccaggagtga | | 50947 | cctgttgcatccatcatccaggac | AA034827 | 93551 | ggccggtctccacaagctcagt | AA119035 |
| 8344 | ctgtcctctgctactctagcc | | 50948 | tttgcatccatcatccaggaccgc | AA034827 | 93552 | tcccattccaactgccagtcaggg | AA119036 |
| 8345 | taaaacaagccaacagtatttgag | | 50949 | tgcctccaaaccaacagtatttgag | AA034827 | 93553 | cccattccaagtccagttcaggt | AA119036 |
| 8346 | acaagccaacagtatttgaggaat | | 50950 | gctctcaaaaccacagacaagcata | AA034827 | 93554 | cattccaactgccagtcaggttat | AA119036 |
| 8347 | caagccaacagtatttgaggaatt | | 50951 | tgatctgctggaattaagaagaa | X01756 | 93555 | caactgccagtcaggttatgtca | AA119036 |
| 8348 | taaaacagtctttctgtgtc | | 50952 | atctctggaattaagaagaagg | X01756 | 93556 | actgccaagtcaggttatgtcaac | AA119036 |
| 8349 | aaacacagtctttctgtgtcct | | 50953 | ttaagcaacagtccagttgtata | X01756 | 93557 | aatgggcaacatgtgccttgcggaa | AA119036 |

TABLE 1-continued

| SEQ ID NO | DBAxnID | sequence | SEQ ID NO | sequence | DBAxnID | SEQ ID NO | sequence | DBAxnID |
|---|---|---|---|---|---|---|---|---|
| 8350 | | aaacacgtgctttctgttgcctc | 50954 | caacagttccagttgtatacatgct | X01756 | 93558 | tgggcacatgcgctttgggaaac | AA119036 |
| 8351 | | cacagtgctttctgttgtcctctg | 50955 | acagttccagttgtatacatgctac | X01756 | 93559 | tcaaggaattggcctccaagtagag | AA119036 |
| 8352 | W50969 | ttgaacgtccaagccaatgatgg | 50956 | agttcagttgtatacatgctacca | X01756 | 93560 | aaggaattggcctccaagtagagct | AA119036 |
| 8353 | W50969 | gtctcaaagccaatgatgggctgc | 50957 | ttgtatacatgctaccacgctctc | X01756 | 93561 | ggaattggcctccaagtagagctti | AA119036 |
| 8354 | W50969 | ccattgatggtgtcctgggatgtga | 50958 | gtatacatgctaccacggctctccc | X01756 | 93562 | gtcccacaagtcccatgccctggg | AA119036 |
| 8355 | W50969 | gtgttcctggagtgactacatcaa | 50959 | atacatgctaccacggctctccctt | X01756 | 93563 | ctccacaagtccatgtcctgggc | AA119036 |
| 8356 | W50969 | ccaactacacatgatggctacgaaa | 50960 | ggctccctttccaagataagat | X01756 | 93564 | ccacaagtccatcgtcctggggcaa | AA119036 |
| 8357 | W50969 | actacattgatggctacgaaagcc | 50961 | ctctccctttccaagataagatg | X01756 | 93565 | gctccatgtcctggggcaagtctcc | AA119036 |
| 8358 | W50969 | ttgatggctacgaaagccgaatgg | 50962 | ccctttccaagataagatggatct | X01756 | 93566 | tccatgtcctggggcaagtctccc | AA119036 |
| 8359 | W50969 | gctaccgaaagccgaatggctacat | 50963 | aatgagtaattccactgcctatt | X01756 | 93567 | catgtcctggggcaagtctcccat | AA119036 |
| 8360 | W50969 | agccgaatggctacatcggcacaca | 50964 | tgagtaattccactgccttattat | X01756 | 93568 | tgtccctggggcaagtctcccatic | AA119036 |
| 8361 | W50969 | gctacatcggcacacaggtggctgcgt | 50965 | tgtctcatggctttaatgtaccac | X01756 | 93569 | tctcccatccaactgccaagtcag | AA119036 |
| 8362 | W50969 | acatcggcacacaggtggcgctgcc | 50966 | aattcaacaccaaattcagatcat | X01756 | 93570 | gtccctgtcatccacagtcgcgccta | AA119168 |
| 8363 | W50969 | cacagggtgcgctgcctgagaccat | 50967 | ttcacacaccaaattcagatcaga | X01756 | 93571 | cctgtgcatccagagctcgcgccta | AA119168 |
| 8364 | W50969 | atgggctcaagttctcccagagta | 50968 | cacacaccaaattcagatcatgaat | X01756 | 93572 | tcgacgcgctgacaggcgcgaagc | AA119168 |
| 8365 | W50969 | tgcctgagaccatggggtgatttcg | 50969 | tttgttggacagtcgatttaagt | X01756 | 93573 | accgggtcgacaggccgaaagccag | AA119168 |
| 8366 | W50969 | ggctcaagttctcccagagtatga | 50970 | tattaagcaacagttccagttgta | X01756 | 93574 | ccgtgcagggcgaagcagcaaa | AA119168 |
| 8367 | W50969 | ctggacagcagttcacgtgggagaa | 50971 | atcatcttcacagccgcgaggaagaga | AA120740 | 93575 | gctgacagggcgaagccagcaaaa | AA119168 |
| 8368 | W50969 | agcagttcagtgggagaattccaa | 50972 | catcttcacagccgcgaggaagaaa | AA120740 | 93576 | aacgggccgaagccagcagcaaaaagca | AA119168 |
| 8369 | W50969 | agaattccaactcagaggtgaacaa | 50973 | agaccagtatatgtcgtcctcagc | AA120740 | 93577 | gaaggtgccgagtccgtgaacgat | AA119168 |
| 8370 | W50969 | attccaactcagaggtgaacaagcc | 50974 | ccagtatatgtcgtcctcagcgtgc | AA120740 | 93578 | aaggtgccgagtccgtgaacgatg | AA119168 |
| 8371 | W50969 | tcctcaactccattgatgtgttcc | 50975 | agtatatgtcgtctcagctccgt | AA120740 | 93579 | aggttgccgagtccgtgaacgattg | AA119168 |
| 8372 | W50969 | actccattgatgtgttcctgggag | 50976 | tatgtcgtctcagctgcgtcggt | AA120740 | 93580 | ggttgccgagtccgtgaacgatgc | AA119168 |
| 8373 | W50969 | ccaagcactgtctctagggcaagg | 50977 | tgtgctctcagctgccgtcgct | AA120740 | 93581 | atccagcgtcgcgctagccagt | AA119168 |
| 8374 | W50969 | actgctctagggcaagccctca | 50978 | tgctgctctcagctgccgtcgt | AA120740 | 93582 | agagctccgcagtccccagtctac | AA119168 |
| 8375 | W50969 | aacgccaaacactgccgcgagatcg | 50979 | ctgctcagctgccgtcggtgtag | AA120740 | 93583 | agaatgccatcgaccgcgctgacag | AA119168 |
| 8376 | W50969 | acgccaaacactgccgcgagatcgt | 50980 | tgtaggctgcagttgccaagcaa | AA120740 | 93584 | gaatgccatcgaccgcgctgacagg | AA119168 |
| 8377 | W50969 | tactacaatgaagctgctgcaaca | 50981 | ctgcaggtgccaagcaacacgtg | AA120740 | 93585 | ccatcgaccgcgctgacagggcg | AA119168 |
| 8378 | W50969 | tacaatgaagctgctgcaaat | 50982 | caggtgccaagcaacacgcagg | AA120740 | 93586 | ccatcgaccgcgctgacagggcga | AA119168 |
| 8379 | W50969 | cgggccatccatgggacctgggagc | 50983 | ctccgcagaattgctgctgct | AA120740 | 93587 | catcgaccgcgctgacagggccga | AA119168 |
| 8380 | W50969 | atcctagtgggacctgggagccagga | 50984 | ggttgccaagcaacacgtgcaggac | AA120740 | 93588 | atcgaccgcgctgacagggccgaag | AA119168 |
| 8381 | W50969 | gagccaggcaccatggactcagtga | 50985 | tcagaattgcgtctgtggga | AA120740 | 93589 | gcatccattatacgtccagaggc | AA119168 |
| 8382 | W50969 | agccaggcaccatggactcagtgag | 50986 | gaatttgcgtctgtggcacaga | AA120740 | 93590 | attatactcggccacgaggcgcaaat | AA119175 |
| 8383 | W50969 | ccaggcaccatggactcagtgagg | 50987 | atttgctgcgtggcacagt | AA120740 | 93591 | tgaccatcgtggccgacagcctcaa | AA119175 |
| 8384 | W50969 | caggcaccatggactcagtgaggtc | 50988 | ttgctgctgctgtggcacagagtac | AA120740 | 93592 | ccatcgtggccgacagcctcaatt | AA119175 |
| 8385 | W50969 | aggcaagagcctcacctcttcta | 50989 | gctgctgtcgtggcacagagtacct | AA120740 | 93593 | tcgtggccgacagcctcaaattccg | AA119175 |
| 8386 | W50969 | gcaagagcctcacctcttctaa | 50990 | acagagcctgtgtccctcctctgg | AA120740 | 93594 | ccgagagcctcaaattccgtggcca | AA119175 |
| 8387 | W50969 | caagagcctcacctcttctaacg | 50991 | tgcgtgcggaggagttgttact | AA120740 | 93595 | acagcctcaaattccgtggccacaa | AA119175 |
| 8388 | W50969 | caagagcctcacctcttctaagc | 50992 | aagattcctgccatggagtccta | AA120740 | 93596 | gcctcaaattccgtggccacaagt | AA119175 |
| 8389 | W50969 | agagcctcacctcttctaacgca | 50993 | atcctgcatggagtcctacga | AA034697 | 93597 | aattccgtggccacaaggtcatcct | AA119175 |
| 8390 | W50969 | tctctaacgccaacatgccgcg | 50994 | atcagttttcggttgcattgcattgcag | AA034697 | 93598 | tccgtggccacaaggtcatccgg | AA119175 |
| 8391 | W50969 | ctctaacgccaacatgccgccga | 50995 | agtttgcttggcattagcag | AA034697 | 93599 | gtggccacaaggtcatcctgccgc | AA119175 |
| 8392 | W50969 | tctaacgccaacatgccgccgaga | 50996 | tttgcgttggcattagcagttgcaga | AA034697 | 93600 | agtctctgtcgaacccagtctga | AA119175 |
| 8393 | K02296 | ttctgactctccaatatgaaaggt | 50997 | gagcctccagtgaggagatgctaggga | AA034697 | 93601 | tactggccagagccgaaatgtt | AA119175 |
| 8394 | K02296 | gaagggtctctcaattcacattcagt | 50998 | cctccagtgaggatgctaggaaac | AA034697 | 93602 | cgaaatgtctggtcacatgaacca | AA119175 |
| 8395 | K02296 | atcaaagctaccttgtaagtaatg | 50999 | aggaacctgactccctcccaca | AA034697 | 93603 | tgttcgtcacatgaaccagctccg | AA119175 |
| 8396 | K02296 | ttcaactgtacaaacccgctgc | 51000 | ccagcctccagaagaacagcaagtaca | AA034697 | 93604 | tgtcacatgaaccagctccgcgcc | AA119175 |
| 8397 | K02296 | ctctgaatgatcatcctattagat | 51001 | gccctccagaagaacagcaagtaca | AA034697 | 93605 | gtcatgaaccagctccgcgaga | AA119175 |
| 8398 | K02296 | aatgatcatccattagatttct | 51002 | aacgcaaggatccgtgtgattaa | AA034697 | 93606 | agtctgcagaggagcggtcgt | AA119175 |
| 8399 | K02296 | atctgtccattgatatggcagtgg | 51003 | agcaaggatccgtgtgattaagc | AA034697 | 93607 | aggagggtctgtgatgtgaccat | AA119175 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 8400 | atcacgcaaacgctactatactt | K02296 | 51004 | cctctgccattggagtcctacgatgt | AA034697 | 93608 | tctgtgatgaccatgtgtggcga | AA119175 |
| 8401 | tatactatactgctgtggaatga | K02296 | 51005 | ctgccattggagtcctacgatgtgat | AA034697 | 93609 | aacatgcactgtgagcggccagag | W08228 |
| 8402 | ctcttatgcgtctttcaaaaccat | K02296 | 51006 | ccatggagtcctacgatgtgatcgc | AA034697 | 93610 | acatgcacgttgagcgggccagaga | W08228 |
| 8403 | atgcgtcttcaaaaccattatcat | K02296 | 51007 | cctacgatgtgatcgccaaccagcc | AA034697 | 93611 | ccctgcagacacaaggctctcgt | W08228 |
| 8404 | tttctccaagtacaacattgactgga | K02296 | 51008 | tgatcgccaaccagcgctgtgtgat | AA034697 | 93612 | ccctgcagacacaaggctctcgt | W08228 |
| 8405 | attcacattcagtgctgtgacactc | K02296 | 51009 | ccaacagcctgtgtgatcgacaca | AA034697 | 93613 | gagcagacacaaggctctcgtgggg | W08228 |
| 8406 | attcagtgctgtgacactcttctg | K02296 | 51010 | tgatcgacacagtatcagtttg | AA034697 | 93614 | agcagacacaaggctctcgtgggga | W08228 |
| 8407 | tgctgtgacactcttctggtccta | K02296 | 51011 | gttatcagtttgcgttggcattag | AA034697 | 93615 | cagacacaaggctctcgtgggaac | W08228 |
| 8408 | gacacactcttctggtcctagtctg | K02296 | 51012 | tccgcactgatctgtgaacgcgagg | AA034706 | 93616 | agacacaaggctctcgtgggaaca | W08228 |
| 8409 | ggtcctatgtctgcagctggatca | K02296 | 51013 | gcactgatctgtgaacgcgagaac | AA034706 | 93617 | gacacaaggctctcgtgtggggaacag | W08228 |
| 8410 | atagatgtccatcaacagccacagg | K02296 | 51014 | gaagctgcacctgacaagagct | AA034706 | 93618 | cacaaggctctcgtgtggaacagct | W08228 |
| 8411 | gttcatcaacagcagcaggaaaatc | K02296 | 51015 | acctgcacagagctgtggagtct | AA034706 | 93619 | aggctctgtggggaacagctgcat | W08228 |
| 8412 | atcactgtgcaagttacagttgaaa | K02296 | 51016 | agctacgaaccctgaacacagcaacg | AA034706 | 93620 | ctttcctgtatgaatacattgca | W08228 |
| 8413 | cttttccactgagatcaacaggg | M96163 | 51017 | tacgaaccctgaacacagcacgaaa | AA034706 | 93621 | catgactgttgagcggccagagaa | W08228 |
| 8414 | gaatacaattcctctgtggctgct | M96163 | 51018 | gaacctgaacacagcacgaaatc | AA034706 | 93622 | tgcactgtgagcggccagagaagg | W08228 |
| 8415 | agagcgtctcagttggaagactg | M96163 | 51019 | tgaacacacagaaatccaccaca | AA034706 | 93623 | tggtatgtccctgcagacacaa | W08228 |
| 8416 | ttgtccctgctttaaaggcta | M96163 | 51020 | acacacagaaatccaccacaagc | AA034706 | 93624 | ggtatgtccctgcagacacaag | W08228 |
| 8417 | acaatcagaagcagtttggctgct | M96163 | 51021 | ggcccagactgacctgatgctaact | AA034706 | 93625 | gtatgtccctgcagacacaagg | W08228 |
| 8418 | agagcagtttttgctgcttaactg | M96163 | 51022 | gccagactgacctgatgctaactc | AA034706 | 93626 | atgtccctgagcagacacaaggt | W08228 |
| 8419 | gaatacactgtgttggtggaaagtg | M96163 | 51023 | cccagactgacctgatgctaactcc | AA034706 | 93627 | tgtccctgagcagacacaaggtc | W08228 |
| 8420 | attattacagccccaagcagta | M96163 | 51024 | ctgatctgaacgcgaggaactc | AA034706 | 93628 | gtccctgagcagacacaaggtct | W08228 |
| 8421 | tacagcccaagacgtatttatt | M96163 | 51025 | ccagactgacctgatgctaactcc | AA034706 | 93629 | cttgaagccagcatgctcagacgt | AA119287 |
| 8422 | gttgaccattcaaactctggcaa | M96163 | 51026 | gaggaacttccgagcatgaatgt | AA034706 | 93630 | aagcccagcatgctcagacagtgtc | AA119287 |
| 8423 | catttcaaactctggcaataaaga | M96163 | 51027 | gaacttccgagcatgaatgtgcc | AA034706 | 93631 | aggtgactctgtcattctccaaga | AA119287 |
| 8424 | aaacttggcataaagatgtatga | M96163 | 51028 | cttctccgagcatgaatgtgccag | AA034706 | 93632 | tcatttccaaagcaataacaga | AA119287 |
| 8425 | aattcctctggcctgctgactg | M96163 | 51029 | tgaatgtcgagcgagttcaca | AA034706 | 93633 | ttctccaagaagcatacacagta | AA119287 |
| 8426 | gctggaaccagacagccagcctaaggtg | M96163 | 51030 | accaagtgcgcgtggaagacgaca | AA034706 | 93634 | atgcaacgttaaaccgcttctgt | AA119287 |
| 8427 | accagacagccagcctaaggtgagt | M96163 | 51031 | aagtcagaagtgccacctgtcaa | AA034706 | 93635 | accgtctctgtgaacttccaaga | AA119287 |
| 8428 | aatcctgagtggggccgagtgca | M96163 | 51032 | tcagaagtgccacctgtacaagga | AA034706 | 93636 | tctctgaacttccagaaagcagc | AA119287 |
| 8429 | ccctgagtacctgcgtgaaaagg | M96163 | 51033 | taacctattcagtgactgactcct | AA034706 | 93637 | ctgaacttccagaaagcagctaa | AA119287 |
| 8430 | ttgactctgaagtctctctgttga | M96163 | 51034 | atctcagtactgacctcctgccaag | X67677 | 93638 | tgaacttccagaaagcagctaagtc | AA119287 |
| 8431 | ctgaagtctctctgtgagagcgt | M96163 | 51035 | tctactctgacatgagtgttta | X67677 | 93639 | aagcagtaagtccttcagcctgga | AA119287 |
| 8432 | ctgtgagagcgtcttcagtgaa | M96163 | 51036 | atggagcgctctctctataataacaa | X67677 | 96940 | ctaagcctcagcctgagatctc | AA119287 |
| 8433 | ggaccccacagtcagaaccccacag | M96163 | 51037 | cagctcctataatacaaattgtat | X67677 | 93641 | agcatgctcagacagtgtctcagc | AA119287 |
| 8434 | accagtcagaaccccacatggccagt | X04017 | 51038 | tttcaacagctttcatctgtatgt | X67677 | 93642 | ctcagcagtgtctcagcctcagaa | AA119287 |
| 8435 | cctaggcactggagggtttca | X04017 | 51039 | cagcttcatctgtagtttaacgtg | X67677 | 93643 | aatcagcaacctgactgaccta | AA119287 |
| 8436 | gcactggaggtgtttcaggaaag | X04017 | 51040 | cttcatctgtattgcttaacgtg | X67677 | 93644 | tggactgcacctagacacagtga | AA119287 |
| 8437 | ttcacatcatggctgtcataaa | X04017 | 51041 | tcatcgtattgcttaacggtgaa | X67677 | 93645 | gcacctagacaagtgatactaa | AA119287 |
| 8438 | ttccaagccaaccgaagatcgagat | X04017 | 51042 | tgttaaaagcagcctttctagcaca | X67677 | 93646 | gtgatactaattacctcttgttctg | AA119287 |
| 8439 | gtcagatctcacagctgagaaatt | X04017 | 51043 | aaagcagccttctagcacaaaacact | X67677 | 93647 | acctcttgtttcttgctacaaacaga | AA119287 |
| 8440 | tctccaggctgagaaatgttccc | X04017 | 51044 | ggacctctgagaaatgttccc | X67677 | 93648 | tcttgttcgtacaaacgcaagg | AA119287 |
| 8441 | cctccaagcattttcagaaaagct | X04017 | 51045 | cagtactgactcctgccaagg | X67677 | 93649 | agtcagaaggccttcttcttcagg | AA119287 |
| 8442 | tgctctcattaaccatgcaaactc | X04017 | 51046 | tactgactcctctgccaaggggctc | X67677 | 93650 | atggccctttctcaggaaagcaa | W33440 |
| 8443 | tcattaaccatgcaaactctcacag | X04017 | 51047 | ctctcctgccaaggggtcctga | X67677 | 93651 | tacactgatgtctatccagaaatca | W33440 |
| 8444 | accatgcaaactctcacgccgatgt | X04017 | 51048 | ctctgccaagggggtctcctgagaa | X67677 | 93652 | gtctatccagaaatcattgagcg | W33440 |
| 8445 | cagaacccacatggcaagtcttagt | X04017 | 51049 | ggtcctcgaagactgcctc | X67677 | 93653 | gaaatcattgagcgcgcatgcttg | W33440 |
| 8446 | ccacatggccagtcttagtagcta | X04017 | 51050 | cttgccctgtctactctgac | X67677 | 93654 | attgagcgcatgctttgtcctgg | W33440 |
| 8447 | tcttagtagccaaggcaaggaaag | X04017 | 51051 | acctctgtactctgtcactg | X67677 | 93655 | acctctatatctcatcagtacccg | W33440 |
| 8448 | ataatccagctgtgtgacacatg | X04017 | 51052 | atgtcactctgtgacatgatgtt | X67677 | 93656 | atctcatcagtacccgctgagtccc | W33440 |
| 8449 | ccgaacatcactcaactgcaatg | X04017 | 51053 | gatatctctgtgttccagcatcga | AA034721 | 93657 | ctcatcagtacccgctgagtcctgg | W33440 |

TABLE 1-continued

| SEQ ID NO | DBAxnID | sequence | SEQ ID NO | DBAxnID | sequence | SEQ ID NO | DBAxnID |
|---|---|---|---|---|---|---|---|
| 8450 | X04017 | catcactcaactgcaattggctt | 51054 | AA034721 | tgcttccagcatcgcaggtgctat | 93658 | W33440 |
| 8451 | X04017 | tcaactgcaattggcttcagtt | 51055 | AA034721 | accaacaaacagatcacatgtagt | 93659 | W33440 |
| 8452 | X04017 | tcttgccgggagctcaggcactgg | 51056 | AA034721 | cagatcacatgtgagtccgaggat | 93660 | W33440 |
| 8453 | M64085 | cagctcccatgcagagaaagaagc | 51057 | AA034721 | atcacatgtgagtccgaggatccct | 93661 | W33440 |
| 8454 | M64085 | tatgtcagatctctgcatgatg | 51058 | AA034721 | tccgaggatcccgtgagcgtcac | 93662 | W33440 |
| 8455 | M64085 | tgcctggtctatctgcagcatct | 51059 | AA034721 | cctgtgagcgtctactgtgtact | 93663 | W33440 |
| 8456 | M64085 | agcatctgaaatgctggtgccag | 51060 | AA034721 | gagcgtctactgtgtactgtgaca | 93664 | W33440 |
| 8457 | M64085 | gatctgctatgcctgccttctcc | 51061 | AA034721 | ctactgtgtactgtgtgcaaggctg | 93665 | W33440 |
| 8458 | M64085 | ccctgagcactcctactcagaaca | 51062 | AA034721 | tgtgacaaggctgctgtgggtgcc | 93666 | W33440 |
| 8459 | M64085 | gtctttctcaatgtctctgtgac | 51063 | AA034721 | ctgaactcctggatgctcctttct | 93667 | W33440 |
| 8460 | M64085 | tcaatgtctctgtgaccaacta | 51064 | AA034721 | aactcctgatgctcctctgcc | 93668 | W33440 |
| 8461 | M64085 | gtctctgttgaccaactagtagg | 51065 | AA034721 | ttccaggcaccgcaggtgcatgagg | 93669 | W33440 |
| 8462 | M64085 | tgtttgaccaactagtaggactggt | 51066 | AA034721 | cagactccagagacaactagtggga | 93670 | W33440 |
| 8463 | M64085 | tggacacctgcgattactcacaca | 51067 | AA034721 | cagcatgccaggtgctagaggaag | 93671 | W33440 |
| 8464 | M64085 | cctcgcattactcacacaaatga | 51068 | AA034721 | atggactgtccaagacccctgcca | 93672 | W33440 |
| 8465 | M64085 | tcaggttcctgactcaaatttgtg | 51069 | AA034721 | gaccctgccaagctcagtgcagatg | 93673 | W33440 |
| 8466 | M64085 | tcctgactgaaatttgtattc | 51070 | AA034721 | gccaagctcagtgcagatgcagatt | 93674 | W33440 |
| 8467 | M64085 | ccaaagctcgggccccagcagtgag | 51071 | AA034721 | aagctcagtgcagatgcagatgatgca | 93675 | W33440 |
| 8468 | M64085 | cagtgaggctctctccaactagg | 51072 | AA034721 | gtggattgcaaccaaacaacagatca | 93676 | L18888 |
| 8469 | M64085 | ctctaacttaggctcttagt | 51073 | AA034721 | tgcaccacaaaacacagatcacatgt | 93677 | L18888 |
| 8470 | M64085 | gctcgttagtctgcttcacca | 51074 | AA034721 | cttccaggttcaccagactctc | 93678 | L18888 |
| 8471 | M64085 | cttatgtctgcctttcatcctttg | 51075 | AA034721 | tcctgccctttcaggagagccag | 93679 | L18888 |
| 8472 | M64085 | ttcatcttcagtcatgatgggac | 51076 | X69296 | agaagctccactgatttctgtgtgg | 93680 | L18888 |
| 8473 | M64085 | cagtcgtccccagactctttg | 51077 | X69296 | gattctgtggagctccaatgtc | 93681 | L18888 |
| 8474 | M64085 | actagccccatgtccgagcctgaa | 51078 | X69296 | gagctccaatgtcgagaagagtt | 93682 | L18888 |
| 8475 | M64085 | tggtgcccagtccgcctcacctt | 51079 | X69296 | agtctctcaacctcgtcagtata | 93683 | L18888 |
| 8476 | M64085 | actcttcatttctccaggcttgc | 51080 | X69296 | tcaacctcgtcagtatagatcaa | 93684 | L18888 |
| 8477 | M64085 | ctccaggcttgcctccaggcactg | 51081 | X69296 | agatacattcctcggcactggaa | 93685 | L18888 |
| 8478 | M64085 | ctcagagatcctccacttgtcca | 51082 | X69296 | acatcctgccactggaatatcc | 93686 | L18888 |
| 8479 | M64086 | gatcctccacttgtccacatcg | 51083 | X69296 | actggaatattcccctgcttcaaag | 93687 | L18888 |
| 8480 | M64086 | ttgccacactggcacagagttag | 51084 | X69296 | ccctactaaagttactctattgag | 93688 | L18888 |
| 8481 | M64086 | gagttagccccctcacactctgcagc | 51085 | X69296 | attacaattgtcatagggctcca | 93689 | AA119538 |
| 8482 | M64086 | tcactctgcagctgcatggggtct | 51086 | X69296 | gagccaggaactgcattggaaaca | 93690 | AA119538 |
| 8483 | M64086 | tcaggagagatcttccccctggca | 51087 | X69296 | tttgccataggggtccaaatcaca | 93691 | AA119538 |
| 8484 | M64086 | cctggcactccttagaacaaag | 51088 | X69296 | tgacactgctccgcttcgaactact | 93692 | AA119538 |
| 8485 | M64086 | ccagtctcgagcctgaaattgt | 51089 | X69296 | tgctccgttcgaactactgccaga | 93693 | AA119538 |
| 8486 | M64086 | gccccatcaagtaagtcagtccca | 51090 | X69296 | gcttgaactactgctgcagactac | 93694 | AA119538 |
| 8487 | M64086 | tcaagtaagtcagtcccagttag | 51091 | X69296 | tagcccagctgctgaagtccaa | 93695 | AA119538 |
| 8488 | M64086 | aagctcagtcccagttagactctg | 51092 | X69296 | ggatctacctcactcaagaagt | 93696 | AA119538 |
| 8489 | M64086 | gtcccctagcctctgctctg | 51093 | X69296 | acctacatccaagaagctccactg | 93697 | AA119538 |
| 8490 | M64086 | ccgtgtctatccgcagcatctagga | 51094 | X69296 | atctcaagaagctccactgatttctg | 93698 | AA119538 |
| 8491 | M64086 | ctatccagcagcatctaggactact | 51095 | X69296 | agctggcagctcatatgaggctga | 93699 | AA119538 |
| 8492 | M64086 | actactggtgccagtctgcctca | 51096 | AA035834 | cagctgcatatgagcctgatactc | 93700 | AA119538 |
| 8493 | L11739 | ctctgaaccttacgagaccccaggt | 51097 | L11739 | tcgagcccattggaaaggatccta | 93701 | AA119538 |
| 8494 | L11739 | tggctgccaagctatgctgccctc | 51098 | L11739 | gatctatctagctactgctaactac | 93702 | AA119538 |
| 8495 | L11739 | atgaccagactccaggatggatgc | 51099 | L11739 | cctatctagctactgctaactactcc | 93703 | AA119538 |
| 8496 | L11739 | gggtccaactctgctctcctgaatgg | 51100 | L11739 | atctagtactgctaactactccaac | 93704 | AA119538 |
| 8497 | L11739 | gctctgaatgcgagcctgcattg | 51101 | L11739 | tactgctaactactccaacgcgt | 93705 | AA119538 |
| 8498 | L11739 | gaatgcgagcctgcattgcaccc | 51102 | L11739 | tgctaactactccaaacggctgtcaa | 93706 | AA119538 |
| 8499 | L11739 | gagcctgcattgtcacctaagcg | 51103 | L11739 | taactactccaacgcgtgcaagt | 93707 | AA119538 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 8500 | tgcattgtcacctaagcgacagg | L11739 | 51104 | gaattgctgcctgatacatgctc | AA035834 | 93708 | cctgtcatgcaccagagaactac | AA119538 |
| 8501 | ctaagcgacagggccactgataca | L11739 | 51105 | ggatacatgcctcacatgatgaagcc | AA035834 | 93709 | aaacgctacatccaagcaaacaa | AA119571 |
| 8502 | gacagggccactgatacagagtga | L11739 | 51106 | tctgaaggcccaggctacggagaa | AA035834 | 93710 | aagcgtacatccaagcaaacaact | AA119571 |
| 8503 | tcctccacaatattggctctgct | L11739 | 51107 | catatgagcctgatactcctaagac | AA035834 | 93711 | cagcgtatccaacgaaactgget | AA119571 |
| 8504 | cacaaatattggctctagtttt | L11739 | 51108 | cggagaaccctgaaagtgaagt | AA035834 | 93712 | gcgtatccaacgaaactggctc | AA119571 |
| 8505 | tgccctcaggctcagtctgccctt | L11739 | 51109 | ctgatactcctaagacatcgcatca | AA035834 | 93713 | gtatccaacggaaactggctctgc | AA119571 |
| 8506 | cacccctgcaagcagcatccatata | L11739 | 51110 | atactcctaagacatcgcatcagt | AA035834 | 93714 | atctcaacggaaactggctctg | AA119571 |
| 8507 | tgcaagcagcatccatatacgcgc | L11739 | 51111 | ctaagacatcgcatcagtcgaggt | AA035834 | 93715 | ctcaacggaaactggctctgtgcc | AA119571 |
| 8508 | cagcatccatatacggcgcalccta | L11739 | 51112 | gagatlcattcactgatgaggcaaca | AA035834 | 93716 | caacggaaactggctctgctgccag | AA119571 |
| 8509 | ccatccgcctgtlgactctatgc | L11739 | 51113 | tctacgtgaggcaaacatcgtgccca | AA035834 | 93717 | acggaaactggctctgctgccagga | AA119571 |
| 8510 | cgcctgtlgactctatgccacgc | L11739 | 51114 | tgaggcaaacatcgtgcccagagett | AA035834 | 93718 | aaactggctctgtcgcaggagacg | AA119571 |
| 8511 | ttggadctalgccagcgcggttgg | L11739 | 51115 | agaggtcgagcccatlggaaagg | AA035834 | 93719 | actgctctgctgccggagacgag | AA119571 |
| 8512 | gcatgtaaccatcatccataagaag | J04596 | 51116 | agtggccactaaggggctgtct | AA146437 | 93720 | gtgaaagcaaccaggctcaacgt | AA119571 |
| 8513 | gaagacagactgctcgatggcacc | J04596 | 51117 | tgggcatgacgcgccagccattcctc | AA146437 | 93721 | tgtccgtgcagggtgagcagatgc | AA119571 |
| 8514 | ctctgatggcaacgtctggtgaacg | J04596 | 51118 | tgtlctgtggttggctatgggact | AA146437 | 93722 | tcctgtgcagggtgagcagatgcaa | AA119571 |
| 8515 | ccactaagtgtcaacacggtctgcta | J04596 | 51119 | ttctlggttggctatgggactct | AA146437 | 93723 | agagatgcaaccaccaacaggctca | AA119571 |
| 8516 | agtgtcaaccacggtctagtagaa | J04596 | 51120 | tgggcctaactllgtlgatcaag | AA146437 | 93724 | cagatgcaaccaccaacaggctcagc | AA119571 |
| 8517 | gtcaaccacgtgtcgtagaaggg | J04596 | 51121 | ggatacattcggatggcaagaaata | AA146437 | 93725 | gatgcaaccaccaacaggctcagctc | AA119571 |
| 8518 | aagtgctcttcatatatgtatggc | J04596 | 51122 | aaatcactgcggaattgctagtlat | AA146437 | 93726 | tgcaaccacaaggctcagtctctt | AA119571 |
| 8519 | cgtgttgacgttccctggacatt | J04596 | 51123 | gctagttatlgctcttaccagaaa | AA146437 | 93727 | caaccacacaggctcagctcttc | AA119571 |
| 8520 | gttgacgctcccctgaacatttg | J04596 | 51124 | tagttatlgtcttaccagaaatc | AA146437 | 93728 | ccctcagcgtatccacgaacact | AA119571 |
| 8521 | gcttccctgacatttgtgtcta | J04596 | 51125 | agttattgtctctlaccagaaatct | AA146437 | 93729 | gtgtaagcttacacctggctcagt | AA119571 |
| 8522 | tccctlgacatttgtgtctagt | J04596 | 51126 | gttattgtcttlaccagaaatcta | AA146437 | 93730 | gcttacactggctcatgtactaccag | AA119473 |
| 8523 | cattttggtctagtlggtagccca | J04596 | 51127 | tatlgctcttaccagaaatctaa | AA146437 | 93731 | gtacctcctgacaacactcaatat | AA119473 |
| 8524 | tagcccataaggcttlacatlc | J04596 | 51128 | ttctctctacaaaagcggtatct | AA146437 | 93732 | cctgacaaccatcaatatgacatt | AA119473 |
| 8525 | cacgtctggtgaagctggcttct | J04596 | 51129 | cttctctctacaaagcgggtgtctat | AA146437 | 93733 | caacactcaatatgacattgtatc | AA119473 |
| 8526 | cgtctgtgaagctgggcttctgac | J04596 | 51130 | ttctctacaaagcgggtgtctatg | AA146437 | 93734 | tgtlatccgtgtlctgaagcagc | AA119473 |
| 8527 | ggaagctgggcttctgacaacact | J04596 | 51131 | tctctacaaagcgggtgtctatga | AA146437 | 93735 | aggcagcgtctlgttgttaaggc | AA119473 |
| 8528 | gctggcttcgcacaactacacaa | J04596 | 51132 | ttctacaaagcgggtgtctacg | AA146437 | 93736 | tgcttlaaggctggggcgccccag | AA119473 |
| 8529 | ttctgacaacactacacaattct | J04596 | 51133 | cctcctgacgggcaatgaatca | AA146437 | 93737 | gccccagaatlccatccatcata | AA119473 |
| 8530 | acatltcatcgatlggtagtlcgtl | J04596 | 51134 | ctccgtacgggcaatgaatcat | AA146437 | 93738 | gaatlccalccatlcatccaagg | AA119473 |
| 8531 | tctgcttgttcagtltaagatggl | J04596 | 51135 | tcctgcacgggcaatggaatcatg | AA146437 | 93739 | catccatccatccaaggagact | AA119473 |
| 8532 | agaccactcaagtgtcaaccactgtg | J04596 | 51136 | tcaggacgccatcaatccttacatg | X63023 | 93740 | tctcatcaaggagacctcatcca | AA119473 |
| 8533 | gctgacgtccgggttgaagctccacg | J04596 | 51137 | ggacagcatcaatccttacatgtac | X63023 | 93741 | acctggctcatgtaccagcctgc | AA119473 |
| 8534 | aagctccacgagagctcttctccgg | W51056 | 51138 | atcctgtlgaccagaaaccaaltca | X63023 | 93742 | taccagcctgctgtgtltgacat | AA119473 |
| 8535 | cctlcagagaggtlggcvtgtactt | W51056 | 51139 | accagaaaccaatlccatlcatatlgtgaa | X63023 | 93743 | ctgtgttgcacctgctlctg | AA119473 |
| 8536 | tggclgtgtactlgcagggaaga | W51056 | 51140 | tttgaactlgctcagtcctgtgaa | X63023 | 93744 | ttgacactlgctcctgctlgggca | AA119473 |
| 8537 | ctgtgtactlgcagggaagagga | W51056 | 51141 | ctlgctcagtctctgaaagttat | X63023 | 93745 | cttcctlgggaggactggtcact | AA119473 |
| 8538 | tgtactlcagggaagaatggga | W51056 | 51142 | ttatcttctgtgaacataaggggtg | X63023 | 93746 | aggactgtccactcgaagtltcg | AA119473 |
| 8539 | aglgctcagtttagccagaggac | W51056 | 51143 | tatatccaactccctggtttctgt | X63023 | 93747 | gtccactgtccctgaagtttgtacctc | AA119473 |
| 8540 | gctcagttltagccagaggacct | W51056 | 51144 | gctgcagtlcacttcattgtta | X63023 | 93748 | gttctgtacctcctgacaacact | AA119473 |
| 8541 | caagcctattctcgctgaaca | W51056 | 51145 | gtlcactlcattgtlactactat | X63023 | 93749 | aatglactlcacaggactgcetlag | AA119665 |
| 8542 | gccttatlctcgctgaacaatg | W51056 | 51146 | actactaaalaccccagattlctgat | X63023 | 93750 | tacaggacigcctlagataatltc | AA119665 |
| 8543 | ttlctgcetgaacaatggatga | W51056 | 51147 | taccccagattlctgatlgagaaacg | X63023 | 93751 | tagtgcacctgaaccgatlttccta | AA119665 |
| 8544 | ctgctgaacaatggatgatgagcc | W51056 | 51148 | caatcctacatgtacctgccclt | X63023 | 93752 | tgcacctgaaacgatlttctatga | AA119665 |
| 8545 | ctccacgagagctctcctggact | W51056 | 51149 | tcctlacatgtacctgccttlggg | X63023 | 93753 | aacgattttctatgacgccaggtg | AA119665 |
| 8546 | cacgagagctctcgactcaggcg | W51056 | 51150 | ttacatgtacctgccttlgggtt | X63023 | 93754 | gattttctatgacggcaggtggaa | AA119665 |
| 8547 | gagagctctctcggactcagcag | W51056 | 51151 | gaaagtltgctctlgtcagagtcctg | X63023 | 93755 | tttcctatgacggcagggtgaagca | AA119665 |
| 8548 | tgctccgcagtcgcggtgacctt | W51056 | 51152 | tctgcagagtcctgcagaactlc | X63023 | 93756 | agaagcgaaacatccgtggattg | AA119665 |
| 8549 | tctccgcagtcgcggtgacttcag | W51056 | 51153 | cctgcagaacttcactgtccagct | X63023 | 93757 | tgcaaacatccggtggatttcccatt | AA119665 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 8550 | ccgcagtgccggtgaccttcagaga | W51056 | 51154 | cactgtccagccttgtaaggaaact | X63023 | 93758 | tggatttccattgtgaaaatcttga | AA119665 |
| 8551 | cagtgccggtgaccttcagagagt | W51056 | 51155 | tgtcagccttgtaaggaaactgag | X63023 | 93759 | atcttgacctgtcacagtacgttat | AA119665 |
| 8552 | tgaccttcagagaggtggctgtgta | W51056 | 51156 | gtcaacttagaggcgtccggtcg | AA036584 | 93760 | tgtcaagtacgttattggtccaaa | AA119665 |
| 8553 | gggaactttgcctgtggacaaagc | W51059 | 51157 | cgtccggtcgagactccctttcgag | AA036584 | 93761 | acagattttacgcagccattgccg | AA119665 |
| 8554 | gactctgcctgtgggcaaagctg | W51059 | 51158 | ctgaagcgcggccatatgcgcctt | AA036584 | 93762 | gatttttactgcagccattgccgagc | AA119665 |
| 8555 | accctgagggggctcagctcagagtc | W51059 | 51159 | ggcccatgtgcctgtcgatgccgg | AA036584 | 93763 | tctggaaattacctcctgctgctgtt | AA119665 |
| 8556 | gggacgacctgtgctgtaggcgct | W51059 | 51160 | gtgactctggagctcagtcagactcag | AA036584 | 93764 | ggaaattacctcctgctgctagt | AA119665 |
| 8557 | gacgacgtgtgtaggcgcctgg | W51059 | 51161 | cagctcgactcagtcaagtgca | AA036584 | 93765 | aattacctcctgctgctagtgca | AA119665 |
| 8558 | cgacctgtgctgtaggcgcctgcg | W51059 | 51162 | gctccagctcagtgcaagtgcaga | AA036584 | 93766 | ctcctgctgctagtgcaactgaa | AA119665 |
| 8559 | gccaagctgcatctcctgctaggcg | W51059 | 51163 | gtcagagactcagcatggttctg | AA036584 | 93767 | ctgtgctgtagtgcaactgaaacg | AA119665 |
| 8560 | caagctgcatctcctgctaggcgg | W51059 | 51164 | agagactcagcatggttctgcaga | AA036584 | 93768 | tgctgtagtgcaactgaaacgatt | AA119665 |
| 8561 | agcctgcatctcctgctaggcggtt | W51059 | 51165 | agactcagcatggttctgcagatg | AA036584 | 93769 | atcccttaatatcagatccccaagc | AA119665 |
| 8562 | cctgcatctcctgctaggcggttgg | W51059 | 51166 | tcagccatggttctgcagatgatt | AA036584 | 93770 | ttaatatcagatccccaagcgacca | AA119665 |
| 8563 | catctcctgctaggcggttggatat | W51059 | 51167 | ccatggtctgcagatgatttca | AA036584 | 93771 | cattttctgccaggcagcaggatttgag | D21252 |
| 8564 | tctcctgctaggcggttggatattc | W51059 | 51168 | cgggtcgcagactcctcgaggcgc | AA036584 | 93772 | aactcttgactctactcgtgctta | D21252 |
| 8565 | cttctgcctgtgacaagctgg | W51059 | 51169 | gtgcagactcctcgaggcgcat | AA036584 | 93773 | ctactcgtcttaaacacatgt | D21252 |
| 8566 | ctcctgcctgtggattgatatcg | W51059 | 51170 | ggcgcatcctgcggttgacgtcg | AA036584 | 93774 | gattccagataagccttcctactag | D21252 |
| 8567 | gttagcggaactcaccatcccagac | W51059 | 51171 | tcctgtccggtgagcgtcgaacgac | AA036584 | 93775 | agataagccttcctacaggggctgg | D21252 |
| 8568 | tagcggaactcaccatcccagact | W51059 | 51172 | ctgtccggtgagcgtcgaacgactg | AA036584 | 93776 | gatagccttctccactatgggta | D21252 |
| 8569 | gcggaactcaccatcccagacctg | W51059 | 51173 | tcgaacgactgaagccggccccat | AA036584 | 93777 | aatggtcgagctgtgttgagca | D21252 |
| 8570 | cctcccgaccgatgtttgcatgg | W51059 | 51174 | acgactgaagccggccccataagt | AA036584 | 93778 | ctgagctgtgttttggcagaccaa | D21252 |
| 8571 | tccacgaccgatgtttgcatggt | W51059 | 51175 | gactgaagccgggccccatagtgcc | AA036584 | 93779 | ttgggcagcaatctctcatcagt | D21252 |
| 8572 | cacgaccgatgtttgcatggctga | W51059 | 51176 | aatgtatcacctgactgcttcg | AA036584 | 93780 | tcacagaaacaaccgttaattct | D21252 |
| 8573 | tgacctgcgagggggtcagtcagcag | W51059 | 51177 | tatcacctgactgcttcgcctgcc | AA036584 | 93781 | tcagatccccaaggcgcaccattgctc | D21252 |
| 8574 | accaacactgctaatgaggcctctg | M33975 | 51178 | gagagacaaatcttctgaagaaca | AA036584 | 93782 | cgcaccatgctcaggattatggag | D21252 |
| 8575 | actgctaatgaggcctctgggggg | M33975 | 51179 | gacaaaatcttctgaagaacaacaa | AA036584 | 93783 | ggccgctcgtgggatgagattatac | D21252 |
| 8576 | gttttgcatctctactgacttctgc | M33975 | 51180 | aaaattcttcctgaagaacaacatga | AA036584 | 93784 | gatacatcaagcctgatgtcaata | D21252 |
| 8577 | atctctactactgactttctgac | M33975 | 51181 | ttctcctgaagaacaacaacatgatct | AA036584 | 93785 | atcaagctgatgcaataagagca | D21252 |
| 8578 | tactactgacttctgcacacagac | M33975 | 51182 | gggcatccatgctgcaccttgaat | AA036584 | 93786 | tatttctcttaagcagaggagcac | D21252 |
| 8579 | tgacttctgcacacagactagaac | M33975 | 51183 | catcctaatggcaccttgaatccc | AA036584 | 93787 | tgagcactggaccattttctgcca | D21252 |
| 8580 | cacagactgacacaatcctgatttg | M33975 | 51184 | ctcaatgcccaccttgaatccagg | AA036584 | 93788 | ctggaccattttctgccaggcagc | D21252 |
| 8581 | ctagaacacctgattgatttcc | M33975 | 51185 | ccatctgcctccaggtccatcgt | AA036592 | 93789 | gaagctaacatgcttcgctactgg | AA103356 |
| 8582 | catcctgatttgatttcctccagt | M33975 | 51186 | cactctgcctgcggcgcgtccatcgt | AA036592 | 93790 | gctaacatgcttcgctactggagg | AA103356 |
| 8583 | ttatttaccctgactatctgctc | M33975 | 51187 | gccgtttcctacaagttagaacct | AA036592 | 93791 | gctgcatcggccatgtcgccgatc | AA103356 |
| 8584 | ctctctcattgctactttatcaa | M33975 | 51188 | ctttgactgctcgctgccagctct | AA036592 | 93792 | gtcatcggccatgctgccgatcata | AA103356 |
| 8585 | cattgctaacttttatcaataaat | M33975 | 51189 | gactgctgcgctgccagctctgaa | AA036592 | 93793 | ggccatgctgccgatcatatactgcc | AA103356 |
| 8586 | gatactctaatcgaccaaatgg | M33975 | 51190 | tgctcctgccagctctgcaatc | AA036592 | 93794 | tccaagcatgcccgcgtctgta | AA103356 |
| 8587 | gggtcacctccatcagaaggaag | M33975 | 51191 | ttcgcctgcagctctgcaatcaga | AA036592 | 93795 | catgcccgcgtctgtaaatacc | AA103356 |
| 8588 | acctcatcaatcagaacaatgtgaatg | M33975 | 51192 | gcctgcagctctgcaatcagagat | AA036592 | 93796 | gtcccgctgtctgtaaataccgg | AA103356 |
| 8589 | gtgaatgatacccatcagagaaac | M33975 | 51193 | tgccagctgcaatcagatttt | AA036592 | 93797 | tacctgctaacatcccatgcg | AA103356 |
| 8590 | gataatccctcaatgagaaacaagg | M33975 | 51194 | cagctgcaatcagagatttgcg | AA036592 | 93798 | gccatgtcaggcgcaggaatgg | AA103356 |
| 8591 | gataatcctcataagaaagaagaag | M33975 | 51195 | ctctcgaatcagagatttgctgg | AA036592 | 93799 | cagttcaggcgctcccaggaatgg | AA103356 |
| 8592 | acctcataagaaagaaggcaatg | M33975 | 51196 | ctcatttttcgaggtccatgag | U06948 | 93700 | ttcaggcgctcgtcaggaatgatg | AA103356 |
| 8593 | ttgaatacaattcattggtagatag | W50866 | 51197 | gtccttaatgcctgcatcatgagcc | U06948 | 93801 | tgccgctgtcttcgaaaccatcggc | AA103356 |
| 8594 | gagttctgtggctgtaggtggc | W50866 | 51198 | ctgtaccttaatgttctgagccg | U06948 | 93802 | cgctgtcttcgaaaccatcggctgg | AA103356 |
| 8595 | tgtgctgtggggcctagata | W50866 | 51199 | gtttctgtaggcgacctttgatcct | U06948 | 93803 | tgtctgaaaccatcctggcgtgcct | AA103356 |
| 8596 | aagacgctccagaatgctcctgtg | W50866 | 51200 | ttctgagccgacctttgatcctaac | U06948 | 93804 | ctgaaccatctgctggctttct | AA103356 |
| 8597 | aatgctctcgtgtgtaaatgga | W50866 | 51201 | cattctctacatagcatgcatacct | U06948 | 93805 | gaaaccatctggctgctttctgag | AA103356 |
| 8598 | aagtattttctgaagccaca | W50866 | 51202 | tctcacatagacatgcatacctcca | U06948 | 93806 | accatctggctggttctgaagtc | AA103356 |
| 8599 | ctgtgaagccacattccaactg | W50866 | 51203 | agcacatacctccagtgcaatga | U06948 | 93807 | tggcttgaaggctcttgagggtcaggcg | AA103356 |

TABLE 1-continued

| SEQ ID NO | sequence | DBAxnID | SEQ ID NO | sequence | DBAxnID | SEQ ID NO | sequence | DBAxnID |
|---|---|---|---|---|---|---|---|---|
| 8600 | agccacatttccaacatgagcctc | W50866 | 51204 | catacctccagtcgcaatgatgtctg | U06948 | 93808 | ctggctttctgaggtcaggctggt | AA103356 |
| 8601 | atttccaacatgagcctcatgaag | W50866 | 51205 | gaaacctgttacatttgatgctaga | U06948 | 93809 | gttttccatgcatgaaagaactca | AA119762 |
| 8602 | caacatgagcctcatgaagccaacg | W50866 | 51206 | acctgttacatttgatgctagatat | U06948 | 93810 | tttttcacatgcatgaagaactcat | AA119762 |
| 8603 | gagcctcatgaagccaacgaagtgt | W50866 | 51207 | atatctgaatgtttctggcaataa | U06948 | 93811 | ttgcatatgcgccatctcaaag | AA119762 |
| 8604 | ctaccctccataactcagtgtag | W50866 | 51208 | cttaatgctgcatcatgagccaga | U06948 | 93812 | gcatattgctgccatcttcaaagc | AA119762 |
| 8605 | tctcaataactcagtgtgcactt | W50866 | 51209 | gcctgcatcatgagccagatggaag | U06948 | 93813 | catattgctgccatcttcaaagca | AA119762 |
| 8606 | ctagatatccacaaaagatggtgg | W50866 | 51210 | atcatgagccagatgaaggaggcc | U06948 | 93814 | atattgctgccatcttcaaaggcat | AA119762 |
| 8607 | taactcagtgtagcacttcaagt | W50866 | 51211 | tgggtctacttactactccacgag | U06948 | 93815 | attgctgccatcttcaaaggcatga | AA119762 |
| 8608 | gtgtgactttgatcaactagtcac | W50866 | 51212 | ctacctcacagaggccgtttttgag | U06948 | 93816 | ctgccatcttcaaaggcatgaaagg | AA119762 |
| 8609 | gatcactagtcaccagcacttttg | W50866 | 51213 | cacagaggccgtttttgagacatag | U06948 | 93817 | tgccatcttcaaaggcatgaaaggt | AA119762 |
| 8610 | tagtcaccgacttttgctttct | W50866 | 51214 | agtgtcattggcaccactcttac | U06948 | 93818 | gccatcttcaaaggcatgaaaggtg | AA119762 |
| 8611 | cccagcactttgctttctctcca | W50866 | 51215 | gtctcattggcaccatctttactgt | U06948 | 93819 | catctcaaaggcatgaaaggtgtc | AA119762 |
| 8612 | gctttctccatctgaagatc | W50866 | 51216 | cacccaactctagtgtgaatccct | U06948 | 93820 | atcttcaaaggcatgaaaggtgtca | AA119762 |
| 8613 | ttctccatctgaagatcgctca | W50866 | 51217 | tactttccatagcagtgggtattgc | X55674 | 93821 | ggtaaagccttgcatattgctgcc | AA119762 |
| 8614 | ctgctcaagacgtccagcaatgctc | W50866 | 51218 | ccaagtctctctgccagtgcct | X55674 | 93822 | gtaaagccttgcatattgctgcca | AA119762 |
| 8615 | gtctcttaggctacaggcccgacta | U22465 | 51219 | tctgccagtgcctctgccttagag | X55674 | 93823 | taaagccttgcatattgctgccat | AA119762 |
| 8616 | caggcccgactactgcctgaacg | U22465 | 51220 | tctgccttagaggctgtggatg | X55674 | 93824 | aagccttgcatattgctgccatct | AA119762 |
| 8617 | ccattagtcgggtaatgtgagt | U22465 | 51221 | gctgctgataccattgggtctggcc | X55674 | 93825 | agccttgcatattgctgccatctt | AA119762 |
| 8618 | tccaaactttctgaaagagtcag | U22465 | 51222 | gataccattgggtctggccctgagt | X55674 | 93826 | gccttgcatattgctgccatcttc | AA119762 |
| 8619 | gagtcgctacacctctcatctc | U22465 | 51223 | tctgggctccaactctgtaacatca | X55674 | 93827 | ccttgcatattgctgccatcttcaa | AA119762 |
| 8620 | catctctcacaactctgtaccaa | U22465 | 51224 | ctccaactctgtaacatccaccatac | X55674 | 93828 | tttgcatattgctgccatctcaaa | AA119762 |
| 8621 | actctgtaccaacagagaggacag | U22465 | 51225 | ctctgtaacatcaccatacatgcac | X55674 | 93829 | agccacaatccctccagagcagc | AA119824 |
| 8622 | cagtcgcctctgtatacatgggc | U22465 | 51226 | catgcaaccaatcaataaaacctig | X55674 | 93830 | ccatgcaatccccagcagagcagcaa | AA119824 |
| 8623 | gccttcgtatacatgggccttact | U22465 | 51227 | caataaaacctigacaagagtcatt | X55674 | 93831 | ttgtatgtccgaagaacagccagt | AA119824 |
| 8624 | tgtatacatgggccttactctgcc | U22465 | 51228 | gtattgctatgttcccactgtat | X55674 | 93832 | agacagccagtgggtatatgctaca | AA119824 |
| 8625 | catgggcctactctgccaattct | U22465 | 51229 | ctcaagggccccaagagagactgta | X55674 | 93833 | tatatgctacagtgtgagctctaga | AA119824 |
| 8626 | caattctgctaactgtcatagaaa | U22465 | 51230 | ccgccacttctgacatacattgga | X55674 | 93834 | tatgctacagtgtgagctctagaaa | AA119824 |
| 8627 | aatgcccacagtagaagacagagc | U22465 | 51231 | cttctgacatacattggacatagc | X55674 | 93835 | agacggttccataacagctgtgtt | AA119824 |
| 8628 | tgtgcaacatgtagatgcgtgt | U22465 | 51232 | acatagccttcccacacagatg | X55674 | 93836 | actggttccataacagctgtgttcc | AA119824 |
| 8629 | catgcttgtgcaccctgggtgt | U22465 | 51233 | cccacagatgctggacagcctg | X55674 | 93837 | tggttccataacagctgtgtccc | AA119824 |
| 8630 | catattaagggccacagtggcatgg | U22465 | 51234 | ttgagcctgaccagtgttggagc | X55674 | 93838 | gttccataacagctgtgttccctt | AA119824 |
| 8631 | aagggccacagtggcatgggtctt | U22465 | 51235 | cctggaccagtgttggactgaagt | X55674 | 93839 | ggatccagtcgtggcaggctaaagat | AA119824 |
| 8632 | tgcaaaatacatgtttaggtactg | U22465 | 51236 | acaactggtgagctacacgccaa | AA036546 | 93840 | gatccagtcgtggcaggctaaagatgt | AA119824 |
| 8633 | aatacatgcttaggtactgagcctg | U22465 | 51237 | caaactggtgagctacacgccaac | AA036546 | 93841 | gcattccctgagctagcagccaacta | AA119824 |
| 8634 | gtgtgaccatttagtgcgggtaat | U22465 | 51238 | ccattgagctcctcgtggagactg | AA036546 | 93842 | attccctcagagcagccaacctagc | AA119824 |
| 8635 | tcaaccaactgtgttgaaggaactg | W51025 | 51239 | cattgagctcctcgtgggactgg | AA036546 | 93843 | cctcagcagccaacctagccaag | AA119824 |
| 8636 | ggaactgcacgtgggcatgttgt | W51025 | 51240 | attgagctcctcgtgggactgga | AA036546 | 93844 | agagcagccaacctagccaagatga | AA119824 |

SEQUENCE LISTING (127806 sequences)

SEQ ID NO: 1 - DNA, 25 bp, Mus musculus
gacattgtcgcaagtcacagaatta

SEQ ID NO: 2 - DNA, 25 bp, Mus musculus
attgtcgcaagtcacagaattattt

SEQ ID NO: 3 - DNA, 25 bp, Mus musculus
gttgctggatctgctgtttgaagcg

SEQ ID NO: 4 - DNA, 25 bp, Mus musculus
ggatctgctgtttgaagcgcagcag

SEQ ID NO: 5 - DNA, 25 bp, Mus musculus
gcgcagcaggtgcatcgccagcatt

SEQ ID NO: 6 - DNA, 25 bp, Mus musculus
gcaggtgcatcgccagcatttcgat

SEQ ID NO: 7 - DNA, 25 bp, Mus musculus
gcatcgccagcatttcgatcctcgt

SEQ ID NO: 8 - DNA, 25 bp, Mus musculus
gcatttcgatcctcgtcaggtgcag

SEQ ID NO: 9 - DNA, 25 bp, Mus musculus
cgatcctcgtcaggtgcaggtcagc

SEQ ID NO: 10 - DNA, 25 bp, Mus musculus
tcgtcaggtgcaggtcagcacgttg

SEQ ID NO: 11 - DNA, 25 bp, Mus musculus
gcaggtcagcacgttgctgtcgatt

SEQ ID NO: 12 - DNA, 25 bp, Mus musculus
cagcacgttgctgtcgattaagacc

SEQ ID NO: 13 - DNA, 25 bp, Mus musculus
gctgtcgattaagaccggagcttgt

SEQ ID NO: 14 - DNA, 25 bp, Mus musculus
agcttgtccggaagattgcaaatac

SEQ ID NO: 15 - DNA, 25 bp, Mus musculus
agattgcaaatactgcccgcaaacg

SEQ ID NO: 16 - DNA, 25 bp, Mus musculus
caaatactgcccgcaaacgtcgcgc

SEQ ID NO: 17 - DNA, 25 bp, Mus musculus
tgaacaggtgctggagtcggcgcgc

SEQ ID NO: 18 - DNA, 25 bp, Mus musculus
ggagtcggcgcgcaaagcgaaagcg

SEQ ID NO: 19 - DNA, 25 bp, Mus musculus
caaagcgaaagcggcaggatcgacg

SEQ ID NO: 20 - DNA, 25 bp, Mus musculus
ggcaggatcgacgcgcttctgtatg

SEQ ID NO: 21 - DNA, 25 bp, Mus musculus
gccggagttttacggcaatatcatc

SEQ ID NO: 22 - DNA, 25 bp, Mus musculus
gttttacggcaatatcatcaccaca

SEQ ID NO: 23 - DNA, 25 bp, Mus musculus
gcaatatcatcaccacacgcactta

SEQ ID NO: 24 - DNA, 25 bp, Mus musculus
atcaccacacgcacttatcaggaac

SEQ ID NO: 25 - DNA, 25 bp, Mus musculus
acgcacttatcaggaacgcctcgat

SEQ ID NO: 26 - DNA, 25 bp, Mus musculus
atacgctggaaaaagtgcgcgatgc

SEQ ID NO: 27 - DNA, 25 bp, Mus musculus
ggaaaaagtgcgcgatgccgggatc

SEQ ID NO: 28 - DNA, 25 bp, Mus musculus
agtgcgcgatgccgggatcaaagtc

SEQ ID NO: 29 - DNA, 25 bp, Mus musculus
gccgggatcaaagtctgttctggcg

SEQ ID NO: 30 - DNA, 25 bp, Mus musculus
aagtctgttctggcggcattgtggg

SEQ ID NO: 31 - DNA, 25 bp, Mus musculus
aagatcgcgccggattattgctgca

SEQ ID NO: 32 - DNA, 25 bp, Mus musculus
gccggattattgctgcaactggcaa

SEQ ID NO: 33 - DNA, 25 bp, Mus musculus
attgctgcaactggcaaacctgccg

SEQ ID NO: 34 - DNA, 25 bp, Mus musculus
cgccggaaagcgtgccaatcaacat

SEQ ID NO: 35 - DNA, 25 bp, Mus musculus
aagcgtgccaatcaacatgctggtg

SEQ ID NO: 36 - DNA, 25 bp, Mus musculus
caatcaacatgctggtgaaggtgaa

SEQ ID NO: 37 - DNA, 25 bp, Mus musculus
tggtgaaggtgaaaggcacgccgct

SEQ ID NO: 38 - DNA, 25 bp, Mus musculus
acgccgcttgccgataacgatgatg

SEQ ID NO: 39 - DNA, 25 bp, Mus musculus
ttgccgataacgatgatgtcgatgc

SEQ ID NO: 40 - DNA, 25 bp, Mus musculus
acgatgatgtcgatgcctttgattt

SEQ ID NO: 41 - DNA, 25 bp, Mus musculus
ggtcgcgcggatcatgatgccaacc

SEQ ID NO: 42 - DNA, 25 bp, Mus musculus
ggatcatgatgccaacctcttacgt

SEQ ID NO: 43 - DNA, 25 bp, Mus musculus
tgccaacctcttacgtgcgcctttc

SEQ ID NO: 44 - DNA, 25 bp, Mus musculus
gcgcctttctgccggacgcgagcag

SEQ ID NO: 45 - DNA, 25 bp, Mus musculus
gccggacgcgagcagatgaacgaac

SEQ ID NO: 46 - DNA, 25 bp, Mus musculus
cgagcagatgaacgaacagactcag

SEQ ID NO: 47 - DNA, 25 bp, Mus musculus
gatgaacgaacagactcaggcgatg

SEQ ID NO: 48 - DNA, 25 bp, Mus musculus
aacagactcaggcgatgtgctttat

SEQ ID NO: 49 - DNA, 25 bp, Mus musculus
tcaggcgatgtgctttatggcaggc

SEQ ID NO: 50 - DNA, 25 bp, Mus musculus
gtgctttatggcaggcgcaaactcg

SEQ ID NO: 51 - DNA, 25 bp, Mus musculus
atggcaggcgcaaactcgattttct

SEQ ID NO: 52 - DNA, 25 bp, Mus musculus
tacggttgcaaactgctgaccacgc

SEQ ID NO: 53 - DNA, 25 bp, Mus musculus
caaactgctgaccacgccgaatccg

SEQ ID NO: 54 - DNA, 25 bp, Mus musculus
gacctgcaactgttccgcaaactgg

SEQ ID NO: 55 - DNA, 25 bp, Mus musculus
gggctaaatccgcagcaaactgccg

SEQ ID NO: 56 - DNA, 25 bp, Mus musculus
cgcagcaaactgccgtgctggcagg

SEQ ID NO: 57 - DNA, 25 bp, Mus musculus
acagcaacgtcttgaacaggcgctg

SEQ ID NO: 58 - DNA, 25 bp, Mus musculus
cgtcttgaacaggcgctgatgaccc

SEQ ID NO: 59 - DNA, 25 bp, Mus musculus
acaggcgctgatgaccccggacacc

SEQ ID NO: 60 - DNA, 25 bp, Mus musculus
atattacaacgcggcagcattatga

SEQ ID NO: 61 - DNA, 25 bp, Mus musculus
cagcggcatttggtcgggcagccgc

SEQ ID NO: 62 - DNA, 25 bp, Mus musculus
gtcgggcagccgcacactatgagca

SEQ ID NO: 63 - DNA, 25 bp, Mus musculus
cgcacactatgagcaacatgcagat

SEQ ID NO: 64 - DNA, 25 bp, Mus musculus
aacatgcagatctacagcgccagag

SEQ ID NO: 65 - DNA, 25 bp, Mus musculus
tacagcgccagagtgctgacgcctt

SEQ ID NO: 66 - DNA, 25 bp, Mus musculus
gagtgctgacgccttactggcaatg

SEQ ID NO: 67 - DNA, 25 bp, Mus musculus
tactggcaatgcttccacagcgtaa

SEQ ID NO: 68 - DNA, 25 bp, Mus musculus
gggttgtggacctggctggatgagc

SEQ ID NO: 69 - DNA, 25 bp, Mus musculus
tgagccgccactggcgggaacgtca

SEQ ID NO: 70 - DNA, 25 bp, Mus musculus
gcgcaggtgacggccttagatctct

SEQ ID NO: 71 - DNA, 25 bp, Mus musculus
gccttagatctctcgccgccaatgc

SEQ ID NO: 72 - DNA, 25 bp, Mus musculus
gccgccaatgcttgttcaggcacgc

SEQ ID NO: 73 - DNA, 25 bp, Mus musculus
tgttcaggcacgccagaaggatgcc

SEQ ID NO: 74 - DNA, 25 bp, Mus musculus
agaaggatgccgcagaccattatct

SEQ ID NO: 75 - DNA, 25 bp, Mus musculus
gccgcagaccattatctggcgggag

SEQ ID NO: 76 - DNA, 25 bp, Mus musculus
cgttagcgactgcgacgttcgatct

SEQ ID NO: 77 - DNA, 25 bp, Mus musculus
cgacgttcgatcttgcatggagcaa

SEQ ID NO: 78 - DNA, 25 bp, Mus musculus
gatcttgcatggagcaatctcgcag

SEQ ID NO: 79 - DNA, 25 bp, Mus musculus
caatctcgcagtgcagtggtgcggt

SEQ ID NO: 80 - DNA, 25 bp, Mus musculus
atttatccacggcactccgcgagct

SEQ ID NO: 81 - DNA, 25 bp, Mus musculus
tacccgaacgtcatcaggcgtggca

SEQ ID NO: 82 - DNA, 25 bp, Mus musculus
ggtggacgagcgtccgcatgctaat

SEQ ID NO: 83 - DNA, 25 bp, Mus musculus
cgtccgcatgctaatcgctttttac

SEQ ID NO: 84 - DNA, 25 bp, Mus musculus
tttaccgccagatgaaatcgaacag

SEQ ID NO: 85 - DNA, 25 bp, Mus musculus
gatgaaatcgaacagtcgctgaacg

SEQ ID NO: 86 - DNA, 25 bp, Mus musculus
aacagtcgctgaacggcgtgcatta

SEQ ID NO: 87 - DNA, 25 bp, Mus musculus
acatcatattcagcccatcacgctg

SEQ ID NO: 88 - DNA, 25 bp, Mus musculus
ttcagcccatcacgctgtggtttga

SEQ ID NO: 89 - DNA, 25 bp, Mus musculus
atcacgctgtggtttgatgatgcgc

SEQ ID NO: 90 - DNA, 25 bp, Mus musculus
ggtttgatgatgcgctcagtgccat

SEQ ID NO: 91 - DNA, 25 bp, Mus musculus
atgatgcgctcagtgccatgcgttc

SEQ ID NO: 92 - DNA, 25 bp, Mus musculus
ctcagtgccatgcgttcgctgaaag

SEQ ID NO: 93 - DNA, 25 bp, Mus musculus
catgcgttcgctgaaaggcatcggt

SEQ ID NO: 94 - DNA, 25 bp, Mus musculus
ctgaaaggcatcggtgccacgcatc

SEQ ID NO: 95 - DNA, 25 bp, Mus musculus
ggcatcggtgccacgcatcttcatg

SEQ ID NO: 96 - DNA, 25 bp, Mus musculus
tgccacgcatcttcatgaagggcgc

SEQ ID NO: 97 - DNA, 25 bp, Mus musculus
atcttcatgaagggcgcgacccgcg

SEQ ID NO: 98 - DNA, 25 bp, Mus musculus
attaacgcgttcgcagttgcagcga

SEQ ID NO: 99 - DNA, 25 bp, Mus musculus
gcgttcgcagttgcagcgattgcaa

SEQ ID NO: 100 - DNA, 25 bp, Mus musculus
agttgcagcgattgcaactggcctg

SEQ ID NO: 101 - DNA, 25 bp, Mus musculus
gggaaaactgtcgccagttgtgcac

SEQ ID NO: 102 - DNA, 25 bp, Mus musculus
cgccagttgtgcacttttacaagcc

SEQ ID NO: 103 - DNA, 25 bp, Mus musculus
cacttttacaagccgcaaaggcagc

SEQ ID NO: 104 - DNA, 25 bp, Mus musculus
caagccgcaaaggcagcaggctacc

SEQ ID NO: 105 - DNA, 25 bp, Mus musculus
gcaaaggcagcaggctaccggacgg

SEQ ID NO: 106 - DNA, 25 bp, Mus musculus
aggtttacgcaatagcgacgcgctg

SEQ ID NO: 107 - DNA, 25 bp, Mus musculus
cgcaatagcgacgcgctggcgttac

SEQ ID NO: 108 - DNA, 25 bp, Mus musculus
gcgacgcgctggcgttacagcgcaa

SEQ ID NO: 109 - DNA, 25 bp, Mus musculus
gcgctggcgttacagcgcaacagca

SEQ ID NO: 110 - DNA, 25 bp, Mus musculus
cgttacagcgcaacagcagcctgca

SEQ ID NO: 111 - DNA, 25 bp, Mus musculus
agcgcaacagcagcctgcagctgga

SEQ ID NO: 112 - DNA, 25 bp, Mus musculus
cagcagcctgcagctggattacgca

SEQ ID NO: 113 - DNA, 25 bp, Mus musculus
ctgcagctggattacgcaacagtaa

SEQ ID NO: 114 - DNA, 25 bp, Mus musculus
catcagcgcgcaagagggcagaccg

SEQ ID NO: 115 - DNA, 25 bp, Mus musculus
cgcaagagggcagaccgatagaatc

SEQ ID NO: 116 - DNA, 25 bp, Mus musculus
gggcagaccgatagaatcattggta

SEQ ID NO: 117 - DNA, 25 bp, Mus musculus
gaccgatagaatcattggtaatgag

SEQ ID NO: 118 - DNA, 25 bp, Mus musculus
agaatcattggtaatgagcgccgga

SEQ ID NO: 119 - DNA, 25 bp, Mus musculus
ttggtaatgagcgccggattacgcg

SEQ ID NO: 120 - DNA, 25 bp, Mus musculus
atgagcgccggattacgcgcgcttg

SEQ ID NO: 121 - DNA, 25 bp, Mus musculus
ggtgctggcggctggtttacgccgc

SEQ ID NO: 122 - DNA, 25 bp, Mus musculus
ctttctgacactttcacttttgcag

SEQ ID NO: 123 - DNA, 25 bp, Mus musculus
tgacactttcacttttgcagattgg

SEQ ID NO: 124 - DNA, 25 bp, Mus musculus
tttgcagattgggtaacacaggaac

SEQ ID NO: 125 - DNA, 25 bp, Mus musculus
gaaaacgtcacgctgaatatatgac

SEQ ID NO: 126 - DNA, 25 bp, Mus musculus
aaacgtcacgctgaatatatgacca

SEQ ID NO: 127 - DNA, 25 bp, Mus musculus
cgtcacgctgaatatatgaccacgc

SEQ ID NO: 128 - DNA, 25 bp, Mus musculus
acgctgaatatatgaccacgctcac

SEQ ID NO: 129 - DNA, 25 bp, Mus musculus
ctgaatatatgaccacgctcacccg

SEQ ID NO: 130 - DNA, 25 bp, Mus musculus
gaatatatgaccacgctcacccgca

SEQ ID NO: 131 - DNA, 25 bp, Mus musculus
cccgcatgattcccgcgccgctgct

SEQ ID NO: 132 - DNA, 25 bp, Mus musculus
catgattcccgcgccgctgctggga

SEQ ID NO: 133 - DNA, 25 bp, Mus musculus
gattcccgcgccgctgctgggagag

SEQ ID NO: 134 - DNA, 25 bp, Mus musculus
cgcgccgctgctgggagagatcccc

SEQ ID NO: 135 - DNA, 25 bp, Mus musculus
ccgctgctgggagagatcccctggc

SEQ ID NO: 136 - DNA, 25 bp, Mus musculus
ctgctgggagagatcccctggcttg

SEQ ID NO: 137 - DNA, 25 bp, Mus musculus
gctgggagagatcccctggcttgca

SEQ ID NO: 138 - DNA, 25 bp, Mus musculus
ggagagatcccctggcttgcagaaa

SEQ ID NO: 139 - DNA, 25 bp, Mus musculus
gagatcccctggcttgcagaaaatc

SEQ ID NO: 140 - DNA, 25 bp, Mus musculus
atcccctggcttgcagaaaatccag

SEQ ID NO: 141 - DNA, 25 bp, Mus musculus
atttgcctgcattaccggtcgatgc

SEQ ID NO: 142 - DNA, 25 bp, Mus musculus
taccggtcgatgcaacgagtgatga

SEQ ID NO: 143 - DNA, 25 bp, Mus musculus
gagtgatgaggttcgcaagaacctg

SEQ ID NO: 144 - DNA, 25 bp, Mus musculus
gcaagaacctgatggacatgttcag

SEQ ID NO: 145 - DNA, 25 bp, Mus musculus
gacatgttcagggatcgccaggcgt

SEQ ID NO: 146 - DNA, 25 bp, Mus musculus
gccaggcgttttctgagcatacctg

SEQ ID NO: 147 - DNA, 25 bp, Mus musculus
gcggcatggtgcaagttgaataacc

SEQ ID NO: 148 - DNA, 25 bp, Mus musculus
gaagatgttcgcgattatcttctat

SEQ ID NO: 149 - DNA, 25 bp, Mus musculus
tctatatcttcaggcgcgcggtctg

SEQ ID NO: 150 - DNA, 25 bp, Mus musculus
gcaacatttgggccagctaaacatg

SEQ ID NO: 151 - DNA, 25 bp, Mus musculus
ccagctaaacatgcttcatcgtcgg

SEQ ID NO: 152 - DNA, 25 bp, Mus musculus
ccgggctgccacgaccaagtgacag

SEQ ID NO: 153 - DNA, 25 bp, Mus musculus
gaccaagtgacagcaatgctgtttc

SEQ ID NO: 154 - DNA, 25 bp, Mus musculus
aatgctgtttcactggttatgcggc

SEQ ID NO: 155 - DNA, 25 bp, Mus musculus
atgccggtgaacgtgcaaaacaggc

SEQ ID NO: 156 - DNA, 25 bp, Mus musculus
acgtgcaaaacaggctctagcgttc

SEQ ID NO: 157 - DNA, 25 bp, Mus musculus
ctctagcgttcgaacgcactgattt

SEQ ID NO: 158 - DNA, 25 bp, Mus musculus
tcgttcactcatggaaaatagcgat

SEQ ID NO: 159 - DNA, 25 bp, Mus musculus
atggaaaatagcgatcgctgccagg

SEQ ID NO: 160 - DNA, 25 bp, Mus musculus
tcagggttaaagatatctcacgtac

SEQ ID NO: 161 - DNA, 25 bp, Mus musculus
cgctggttagcaccgcaggtgtaga

SEQ ID NO: 162 - DNA, 25 bp, Mus musculus
caccgcaggtgtagagaaggcactt

SEQ ID NO: 163 - DNA, 25 bp, Mus musculus
tggtcgagcgatggatttccgtctc

SEQ ID NO: 164 - DNA, 25 bp, Mus musculus
atggatttccgtctctggtgtagct

SEQ ID NO: 165 - DNA, 25 bp, Mus musculus
gtctctggtgtagctgatgatccga

SEQ ID NO: 166 - DNA, 25 bp, Mus musculus
tgtagctgatgatccgaataactac

SEQ ID NO: 167 - DNA, 25 bp, Mus musculus
accagccagctatcaactcgcgccc

SEQ ID NO: 168 - DNA, 25 bp, Mus musculus
gcaactcatcgattgatttacggcg

SEQ ID NO: 169 - DNA, 25 bp, Mus musculus
gattgatttacggcgctaaggatga

SEQ ID NO: 170 - DNA, 25 bp, Mus musculus
taaggatgactctggtcagagatac

SEQ ID NO: 171 - DNA, 25 bp, Mus musculus
tggtcagagatacctggcctggtct

SEQ ID NO: 172 - DNA, 25 bp, Mus musculus
ctggtctggacacagtgcccgtgtc

SEQ ID NO: 173 - DNA, 25 bp, Mus musculus
gtgcccgtgtcggagccgcgcgaga

SEQ ID NO: 174 - DNA, 25 bp, Mus musculus
cgagatatggcccgcgctggagttt

SEQ ID NO: 175 - DNA, 25 bp, Mus musculus
ggagtttcaataccggagatcatgc

SEQ ID NO: 176 - DNA, 25 bp, Mus musculus
ggagatcatgcaagctggtggctgg

SEQ ID NO: 177 - DNA, 25 bp, Mus musculus
ctggtggctggaccaatgtaaatat

SEQ ID NO: 178 - DNA, 25 bp, Mus musculus
ccaatgtaaatattgtcatgaacta

SEQ ID NO: 179 - DNA, 25 bp, Mus musculus
ttgtcatgaactatatccgtaacct

SEQ ID NO: 180 - DNA, 25 bp, Mus musculus
tagtgaaacaggggcaatggtgcgc

SEQ ID NO: 181 - DNA, 25 bp, Mus musculus
tggcagaacgaacaccacattttga

SEQ ID NO: 182 - DNA, 25 bp, Mus musculus
tatctgatgtgatgcctgttgagtc

SEQ ID NO: 183 - DNA, 25 bp, Mus musculus
gtgatgcctgttgagtcagatgctt

SEQ ID NO: 184 - DNA, 25 bp, Mus musculus
ttgagtcagatgctttcatttacac

SEQ ID NO: 185 - DNA, 25 bp, Mus musculus
tgctttcatttacacagatatccat

SEQ ID NO: 186 - DNA, 25 bp, Mus musculus
tacacagatatccatgcctgtttta

SEQ ID NO: 187 - DNA, 25 bp, Mus musculus
gatatccatgcctgttttacagaaa

SEQ ID NO: 188 - DNA, 25 bp, Mus musculus
aaaaattgcattagagcacggagtc

SEQ ID NO: 189 - DNA, 25 bp, Mus musculus
agggatcggagccatcatcgcgcca

SEQ ID NO: 190 - DNA, 25 bp, Mus musculus
gagccatcatcgcgccaaattttgc

SEQ ID NO: 191 - DNA, 25 bp, Mus musculus
tcatcgcgccaaattttgcgctcgg

SEQ ID NO: 192 - DNA, 25 bp, Mus musculus
aaattttgcgctcggtgcgatactg

SEQ ID NO: 193 - DNA, 25 bp, Mus musculus
cgctcggtgcgatactgatgatgaa

SEQ ID NO: 194 - DNA, 25 bp, Mus musculus
tgccaactattttgaggatgttgag

SEQ ID NO: 195 - DNA, 25 bp, Mus musculus
gagattattgagcttcatcatgacc

SEQ ID NO: 196 - DNA, 25 bp, Mus musculus
agcttcatcatgaccagaagcttga

SEQ ID NO: 197 - DNA, 25 bp, Mus musculus
catgaccagaagcttgacgcaccaa

SEQ ID NO: 198 - DNA, 25 bp, Mus musculus
gaagcttgacgcaccaagcggaact

SEQ ID NO: 199 - DNA, 25 bp, Mus musculus
caagcggaactgcgcttaaaacagc

SEQ ID NO: 200 - DNA, 25 bp, Mus musculus
agcagcaaggacatccggatgaaaa

SEQ ID NO: 201 - DNA, 25 bp, Mus musculus
catgtcaggcgttaaactgtcagtc

SEQ ID NO: 202 - DNA, 25 bp, Mus musculus
atgaagattgatcagcttgtgtatg

SEQ ID NO: 203 - DNA, 25 bp, Mus musculus
tgaaaattgctttgatcgcgcatga

SEQ ID NO: 204 - DNA, 25 bp, Mus musculus
aggatatggttcaatttacgactgc

SEQ ID NO: 205 - DNA, 25 bp, Mus musculus
tcaatttacgactgcctatcgggat

SEQ ID NO: 206 - DNA, 25 bp, Mus musculus
tcatgatctatacgcaaccggaacc

SEQ ID NO: 207 - DNA, 25 bp, Mus musculus
ttcatgaggcgacaggtcttcaaat

SEQ ID NO: 208 - DNA, 25 bp, Mus musculus
agcaaatcggtgcactgatcgctgc

SEQ ID NO: 209 - DNA, 25 bp, Mus musculus
tgcactgatcgctgccaatgcactc

SEQ ID NO: 210 - DNA, 25 bp, Mus musculus
gctgccaatgcactcgatcttgtca

SEQ ID NO: 211 - DNA, 25 bp, Mus musculus
cccgctgaccgcgcagccgcatgaa

SEQ ID NO: 212 - DNA, 25 bp, Mus musculus
gatgtctcggcattaatccgtttat

SEQ ID NO: 213 - DNA, 25 bp, Mus musculus
cattaatccgtttatgtgatgtgta

SEQ ID NO: 214 - DNA, 25 bp, Mus musculus
tgatgtgtattccattccgctcgcc

SEQ ID NO: 215 - DNA, 25 bp, Mus musculus
gctcgccacaaatatgggtactgcg

SEQ ID NO: 216 - DNA, 25 bp, Mus musculus
aaattcttgtgcgcacacttgatga

SEQ ID NO: 217 - DNA, 25 bp, Mus musculus
gcgcacacttgatgaaggtgttttc

SEQ ID NO: 218 - DNA, 25 bp, Mus musculus
atgctgacgttcttgcttttggcgc

SEQ ID NO: 219 - DNA, 25 bp, Mus musculus
gcttttggcgcccacagtgatgatg

SEQ ID NO: 220 - DNA, 25 bp, Mus musculus
cacagtgatgatgtcgagatcggaa

SEQ ID NO: 221 - DNA, 25 bp, Mus musculus
agaagaagcagctgaagcagcccgc

SEQ ID NO: 222 - DNA, 25 bp, Mus musculus
gaagcagctgaagcagcccgcatat

SEQ ID NO: 223 - DNA, 25 bp, Mus musculus
gctgaagcagcccgcatattaggcg

SEQ ID NO: 224 - DNA, 25 bp, Mus musculus
gcagcccgcatattaggcgcagata

SEQ ID NO: 225 - DNA, 25 bp, Mus musculus
aagaattcagctaacgcttccagac

SEQ ID NO: 226 - DNA, 25 bp, Mus musculus
aatgagtgatcaggcaattcggtca

SEQ ID NO: 227 - DNA, 25 bp, Mus musculus
tgatcaggcaattcggtcaattgtc

SEQ ID NO: 228 - DNA, 25 bp, Mus musculus
attcggtcaattgtcactgtcatca

SEQ ID NO: 229 - DNA, 25 bp, Mus musculus
tcaattgtcactgtcatcagaatct

SEQ ID NO: 230 - DNA, 25 bp, Mus musculus
gtcactgtcatcagaatctgtcggc

SEQ ID NO: 231 - DNA, 25 bp, Mus musculus
catcagaatctgtcggccaaaagcg

SEQ ID NO: 232 - DNA, 25 bp, Mus musculus
aggatcgccatccggatcacggcaa

SEQ ID NO: 233 - DNA, 25 bp, Mus musculus
tccggatcacggcaatgcggctgca

SEQ ID NO: 234 - DNA, 25 bp, Mus musculus
ggcaatgcggctgcactggtggaag

SEQ ID NO: 235 - DNA, 25 bp, Mus musculus
gccttccggcgcataaagtcagcaa

SEQ ID NO: 236 - DNA, 25 bp, Mus musculus
gataaatggttttcatcagccggat

SEQ ID NO: 237 - DNA, 25 bp, Mus musculus
ttttgttattgatatctcggataca

SEQ ID NO: 238 - DNA, 25 bp, Mus musculus
ttgatatctcggatacaatagaggc

SEQ ID NO: 239 - DNA, 25 bp, Mus musculus
ctactcctctgacgaatgggtatat

SEQ ID NO: 240 - DNA, 25 bp, Mus musculus
ggtatattgaaatcgttgaagcgag

SEQ ID NO: 241 - DNA, 25 bp, Mus musculus
gcagacaaaatcaacatggtcattt

SEQ ID NO: 242 - DNA, 25 bp, Mus musculus
tagaaatcggaggtgtggatgctct

SEQ ID NO: 243 - DNA, 25 bp, Mus musculus
aggtgtggatgctctctatttagcg

SEQ ID NO: 244 - DNA, 25 bp, Mus musculus
tggatgctctctatttagcggagaa

SEQ ID NO: 245 - DNA, 25 bp, Mus musculus
tggtacacctctttacgtatatgat

SEQ ID NO: 246 - DNA, 25 bp, Mus musculus
cacctctttacgtatatgatgtggc

SEQ ID NO: 247 - DNA, 25 bp, Mus musculus
gtatatgatgtggctttaatacgtg

SEQ ID NO: 248 - DNA, 25 bp, Mus musculus
tttaagcaggcgtttatttctgcag

SEQ ID NO: 249 - DNA, 25 bp, Mus musculus
gcaggcgtttatttctgcagggctg

SEQ ID NO: 250 - DNA, 25 bp, Mus musculus
tttatttctgcagggctgaaagcac

SEQ ID NO: 251 - DNA, 25 bp, Mus musculus
gggctgaaagcacaggtggcatatg

SEQ ID NO: 252 - DNA, 25 bp, Mus musculus
ggcatatgcgagcaaagcattctca

SEQ ID NO: 253 - DNA, 25 bp, Mus musculus
atgcgagcaaagcattctcatcagt

SEQ ID NO: 254 - DNA, 25 bp, Mus musculus
gcaaagcattctcatcagtcgcaat

SEQ ID NO: 255 - DNA, 25 bp, Mus musculus
cattctcatcagtcgcaatgattca

SEQ ID NO: 256 - DNA, 25 bp, Mus musculus
catcagtcgcaatgattcagctcgc

SEQ ID NO: 257 - DNA, 25 bp, Mus musculus
tcgcaatgattcagctcgctgagga

SEQ ID NO: 258 - DNA, 25 bp, Mus musculus
tctttagatgtcgtatccggaggag

SEQ ID NO: 259 - DNA, 25 bp, Mus musculus
atgtcgtatccggaggagagctata

SEQ ID NO: 260 - DNA, 25 bp, Mus musculus
ggagagctatatacggctgttgcag

SEQ ID NO: 261 - DNA, 25 bp, Mus musculus
gatggcgcttgagcaccgcatcggc

SEQ ID NO: 262 - DNA, 25 bp, Mus musculus
cgcttgagcaccgcatcggctgcat

SEQ ID NO: 263 - DNA, 25 bp, Mus musculus
gcaccgcatcggctgcattgtggtg

SEQ ID NO: 264 - DNA, 25 bp, Mus musculus
gcatcggctgcattgtggtggataa

SEQ ID NO: 265 - DNA, 25 bp, Mus musculus
ggataatttctatgaaatcgcgctt

SEQ ID NO: 266 - DNA, 25 bp, Mus musculus
atttctatgaaatcgcgcttcttga

SEQ ID NO: 267 - DNA, 25 bp, Mus musculus
ctatgaaatcgcgcttcttgaagac

SEQ ID NO: 268 - DNA, 25 bp, Mus musculus
aatcgcgcttcttgaagacctatgt

SEQ ID NO: 269 - DNA, 25 bp, Mus musculus
gtcactccatcgatgttcttcttcg

SEQ ID NO: 270 - DNA, 25 bp, Mus musculus
ttcggatcacgcccggagtagaagc

SEQ ID NO: 271 - DNA, 25 bp, Mus musculus
gatcacgcccggagtagaagcgcat

SEQ ID NO: 272 - DNA, 25 bp, Mus musculus
tagaagcgcatacgcatgactacat

SEQ ID NO: 273 - DNA, 25 bp, Mus musculus
agcgcatacgcatgactacattaca

SEQ ID NO: 274 - DNA, 25 bp, Mus musculus
atacgcatgactacattacaacggg

SEQ ID NO: 275 - DNA, 25 bp, Mus musculus
tcgatcttcataacggacaaactga

SEQ ID NO: 276 - DNA, 25 bp, Mus musculus
attacaatcggaacacattcagctg

SEQ ID NO: 277 - DNA, 25 bp, Mus musculus
aatcggaacacattcagctgctggg

SEQ ID NO: 278 - DNA, 25 bp, Mus musculus
aacacattcagctgctgggtgtcca

SEQ ID NO: 279 - DNA, 25 bp, Mus musculus
cattcagctgctgggtgtccattgc

SEQ ID NO: 280 - DNA, 25 bp, Mus musculus
agctgctgggtgtccattgccatat

SEQ ID NO: 281 - DNA, 25 bp, Mus musculus
tggagagattcatattcatttgtat

SEQ ID NO: 282 - DNA, 25 bp, Mus musculus
attcatattcatttgtatccaaggt

SEQ ID NO: 283 - DNA, 25 bp, Mus musculus
catattcatttgtatccaaggtgct

SEQ ID NO: 284 - DNA, 25 bp, Mus musculus
catttgtatccaaggtgctgaatct

SEQ ID NO: 285 - DNA, 25 bp, Mus musculus
tttgtatccaaggtgctgaatcttg

SEQ ID NO: 286 - DNA, 25 bp, Mus musculus
tatccaaggtgctgaatcttggagg

SEQ ID NO: 287 - DNA, 25 bp, Mus musculus
tattcgttatacggaagatgatgaa

SEQ ID NO: 288 - DNA, 25 bp, Mus musculus
aagatgatgaaccgcttcatgccac

SEQ ID NO: 289 - DNA, 25 bp, Mus musculus
atgatgaaccgcttcatgccactga

SEQ ID NO: 290 - DNA, 25 bp, Mus musculus
tgaaccgcttcatgccactgaatac

SEQ ID NO: 291 - DNA, 25 bp, Mus musculus
accgcttcatgccactgaatacgtt

SEQ ID NO: 292 - DNA, 25 bp, Mus musculus
tgggagacgcaggcacaactcttta

SEQ ID NO: 293 - DNA, 25 bp, Mus musculus
gagacgcaggcacaactctttatac

SEQ ID NO: 294 - DNA, 25 bp, Mus musculus
gcacaactctttatacggttggctc

SEQ ID NO: 295 - DNA, 25 bp, Mus musculus
ataagctgtacaatcgtttcatcat

SEQ ID NO: 296 - DNA, 25 bp, Mus musculus
agctgtacaatcgtttcatcattcg

SEQ ID NO: 297 - DNA, 25 bp, Mus musculus
ctgtacaatcgtttcatcattcggc

SEQ ID NO: 298 - DNA, 25 bp, Mus musculus
tacaatcgtttcatcattcggcgtg

SEQ ID NO: 299 - DNA, 25 bp, Mus musculus
aatcgtttcatcattcggcgtgcga

SEQ ID NO: 300 - DNA, 25 bp, Mus musculus
cgtttcatcattcggcgtgcgaatt

SEQ ID NO: 301 - DNA, 25 bp, Mus musculus
gacattttatcttgtccgtgaagat

SEQ ID NO: 302 - DNA, 25 bp, Mus musculus
atcttgtccgtgaagatgtattgcc

SEQ ID NO: 303 - DNA, 25 bp, Mus musculus
aagatgtattgcccgatgcaatgag

SEQ ID NO: 304 - DNA, 25 bp, Mus musculus
gtattgcccgatgcaatgagaaaaa

SEQ ID NO: 305 - DNA, 25 bp, Mus musculus
agcagattcagtagcagatgccgtt

SEQ ID NO: 306 - DNA, 25 bp, Mus musculus
cagtagcagatgccgttcaaaaggt

SEQ ID NO: 307 - DNA, 25 bp, Mus musculus
tacagggatgctgtttttccattct

SEQ ID NO: 308 - DNA, 25 bp, Mus musculus
ggaggataggtcaggtgcgttatct

SEQ ID NO: 309 - DNA, 25 bp, Mus musculus
taggtcaggtgcgttatctcagctt

SEQ ID NO: 310 - DNA, 25 bp, Mus musculus
gcgttatctcagcttcttcaggcgg

SEQ ID NO: 311 - DNA, 25 bp, Mus musculus
ctcagcttcttcaggcggtagctga

SEQ ID NO: 312 - DNA, 25 bp, Mus musculus
tcttcaggcggtagctgattctgga

SEQ ID NO: 313 - DNA, 25 bp, Mus musculus
ggcggtagctgattctggaagcaac

SEQ ID NO: 314 - DNA, 25 bp, Mus musculus
ctgattctggaagcaacgttctttc

SEQ ID NO: 315 - DNA, 25 bp, Mus musculus
tctttccattcaccagaccattccg

SEQ ID NO: 316 - DNA, 25 bp, Mus musculus
accagaccattccgcttcaaggcag

SEQ ID NO: 317 - DNA, 25 bp, Mus musculus
ccattccgcttcaaggcagagcaaa

SEQ ID NO: 318 - DNA, 25 bp, Mus musculus
cgcttcaaggcagagcaaatgtgac

SEQ ID NO: 319 - DNA, 25 bp, Mus musculus
gcaaatgtgacactgtctatcagta

SEQ ID NO: 320 - DNA, 25 bp, Mus musculus
cactgtctatcagtacgtcggcaat

SEQ ID NO: 321 - DNA, 25 bp, Mus musculus
gaaatattaggttcaggtgcataag

SEQ ID NO: 322 - DNA, 25 bp, Mus musculus
ttatttaggtccagcagctacattt

SEQ ID NO: 323 - DNA, 25 bp, Mus musculus
aggtccagcagctacatttacacat

SEQ ID NO: 324 - DNA, 25 bp, Mus musculus
gctacatttacacatctagcagtca

SEQ ID NO: 325 - DNA, 25 bp, Mus musculus
tacacatctagcagtcagttcttgt

SEQ ID NO: 326 - DNA, 25 bp, Mus musculus
tcaaaacggcgccgaacatgttgct

SEQ ID NO: 327 - DNA, 25 bp, Mus musculus
cgaacatgttgcttaccgcaccatt

SEQ ID NO: 328 - DNA, 25 bp, Mus musculus
ccgcaccattccggagtgtatagat

SEQ ID NO: 329 - DNA, 25 bp, Mus musculus
gtgtatagatgcagccgttgcaggc

SEQ ID NO: 330 - DNA, 25 bp, Mus musculus
gatgcagccgttgcaggcgaagttg

SEQ ID NO: 331 - DNA, 25 bp, Mus musculus
ctatttaatacatgaacagcctttg

SEQ ID NO: 332 - DNA, 25 bp, Mus musculus
catgaacagcctttgccaatcgtgg

SEQ ID NO: 333 - DNA, 25 bp, Mus musculus
gggtgaaatgacgttgccgattcac

SEQ ID NO: 334 - DNA, 25 bp, Mus musculus
gacgttgccgattcaccagcacttg

SEQ ID NO: 335 - DNA, 25 bp, Mus musculus
cacttgctcgtccatccctcaagag

SEQ ID NO: 336 - DNA, 25 bp, Mus musculus
gagctcgacaaaatttactcacatt

SEQ ID NO: 337 - DNA, 25 bp, Mus musculus
aatttactcacattcacacgcgatt

SEQ ID NO: 338 - DNA, 25 bp, Mus musculus
tcacattcacacgcgattgcgcaat

SEQ ID NO: 339 - DNA, 25 bp, Mus musculus
acacgcgattgcgcaatgccataaa

SEQ ID NO: 340 - DNA, 25 bp, Mus musculus
attgcgcaatgccataaatttcttc

SEQ ID NO: 341 - DNA, 25 bp, Mus musculus
aagtttgtcagtgaccatcccgagc

SEQ ID NO: 342 - DNA, 25 bp, Mus musculus
gtcagtgaccatcccgagctgaata

SEQ ID NO: 343 - DNA, 25 bp, Mus musculus
ccatcccgagctgaatatcggggtc

SEQ ID NO: 344 - DNA, 25 bp, Mus musculus
gagctgaatatcggggtcattgcca

SEQ ID NO: 345 - DNA, 25 bp, Mus musculus
tatcggggtcattgccaatgatatg

SEQ ID NO: 346 - DNA, 25 bp, Mus musculus
gccaatgatatggcagcttctacat

SEQ ID NO: 347 - DNA, 25 bp, Mus musculus
atggcagcttctacatacgaattaa

SEQ ID NO: 348 - DNA, 25 bp, Mus musculus
ctgtctcccgatgaaaacatatctt

SEQ ID NO: 349 - DNA, 25 bp, Mus musculus
gaattcaaaattgagctctaggccc

SEQ ID NO: 350 - DNA, 25 bp, Mus musculus
ttaatggtcatgctgccgcaggatg

SEQ ID NO: 351 - DNA, 25 bp, Mus musculus
catgctgccgcaggatgatcagtcc

SEQ ID NO: 352 - DNA, 25 bp, Mus musculus
ggatgatcagtccggggcgctgcat

SEQ ID NO: 353 - DNA, 25 bp, Mus musculus
cggggcgctgcatagagtgctgtct

SEQ ID NO: 354 - DNA, 25 bp, Mus musculus
ctgcatagagtgctgtctgcatttt

SEQ ID NO: 355 - DNA, 25 bp, Mus musculus
gtgctgtctgcattttcttggagaa

SEQ ID NO: 356 - DNA, 25 bp, Mus musculus
tgatgatgtattgattccaggggcc

SEQ ID NO: 357 - DNA, 25 bp, Mus musculus
gtattgattccaggggccatgcagg

SEQ ID NO: 358 - DNA, 25 bp, Mus musculus
aggggccatgcaggagcttgaagca

SEQ ID NO: 359 - DNA, 25 bp, Mus musculus
agtgaggcttctgggtgcataccag

SEQ ID NO: 360 - DNA, 25 bp, Mus musculus
cttctgggtgcataccagtcttacc

SEQ ID NO: 361 - DNA, 25 bp, Mus musculus
ctgtaacagatcaaacaccggcgct

SEQ ID NO: 362 - DNA, 25 bp, Mus musculus
acacctcttattcacctgccgaagc

SEQ ID NO: 363 - DNA, 25 bp, Mus musculus
gaattgagcttcatgtcaaaacgga

SEQ ID NO: 364 - DNA, 25 bp, Mus musculus
gggatcatttaaagatcgcggaatg

SEQ ID NO: 365 - DNA, 25 bp, Mus musculus
gaaggcaatgacacgattatgtgcg

SEQ ID NO: 366 - DNA, 25 bp, Mus musculus
acacgattatgtgcgcgtcaacagg

SEQ ID NO: 367 - DNA, 25 bp, Mus musculus
gcgtcaacaggtaacacttccgctg

SEQ ID NO: 368 - DNA, 25 bp, Mus musculus
cacttccgctgctgcggcagcatat

SEQ ID NO: 369 - DNA, 25 bp, Mus musculus
cggcagcatatgcagcccgtgctaa

SEQ ID NO: 370 - DNA, 25 bp, Mus musculus
cagcccgtgctaacatgaaatgcat

SEQ ID NO: 371 - DNA, 25 bp, Mus musculus
tgcattgtcatcatcccgaacggaa

SEQ ID NO: 372 - DNA, 25 bp, Mus musculus
ggaaaactcgctcaagctgtcatgt

SEQ ID NO: 373 - DNA, 25 bp, Mus musculus
gtccgttccatctgtgagaaatcac

SEQ ID NO: 374 - DNA, 25 bp, Mus musculus
tgtgagaaatcaccgattgcccttg

SEQ ID NO: 375 - DNA, 25 bp, Mus musculus
tcagtcaacccttaccgcattgaag

SEQ ID NO: 376 - DNA, 25 bp, Mus musculus
ctgctgccttcgaagtgtgcgaaca

SEQ ID NO: 377 - DNA, 25 bp, Mus musculus
gctggaaacatcactgcgtactgga

SEQ ID NO: 378 - DNA, 25 bp, Mus musculus
catgagaaaaacggcacaggccttc

SEQ ID NO: 379 - DNA, 25 bp, Mus musculus
gcggcggcaatcgtgcgcaatgaag

SEQ ID NO: 380 - DNA, 25 bp, Mus musculus
gcaatcgtgcgcaatgaagtgattg

SEQ ID NO: 381 - DNA, 25 bp, Mus musculus
gtaaaggcagccgaggaatccaatg

SEQ ID NO: 382 - DNA, 25 bp, Mus musculus
actgatgatgaaatccttcacgcat

SEQ ID NO: 383 - DNA, 25 bp, Mus musculus
atccttcacgcatatcagctgatcg

SEQ ID NO: 384 - DNA, 25 bp, Mus musculus
tatcagctgatcgcccgtgtagaag

SEQ ID NO: 385 - DNA, 25 bp, Mus musculus
cagaaccaggttcttgcgcgtctat

SEQ ID NO: 386 - DNA, 25 bp, Mus musculus
tgcgcgtctatcgcaggagtgctga

SEQ ID NO: 387 - DNA, 25 bp, Mus musculus
aaggcagcaaggtcgtagctgtgtt

SEQ ID NO: 388 - DNA, 25 bp, Mus musculus
aagatccgaacacagcggtcgacat

SEQ ID NO: 389 - DNA, 25 bp, Mus musculus
gcggtcgacatttcagaaatcaagc

SEQ ID NO: 390 - DNA, 25 bp, Mus musculus
tcagaaatcaagcctgtcacattgc

SEQ ID NO: 391 - DNA, 25 bp, Mus musculus
cctgtcacattgccgactgatgaag

SEQ ID NO: 392 - DNA, 25 bp, Mus musculus
gacagcatccttgaatatgtaaaag

SEQ ID NO: 393 - DNA, 25 bp, Mus musculus
acgaagccgacatgctgttctctgt

SEQ ID NO: 394 - DNA, 25 bp, Mus musculus
tgctgttctctgtcactgttcccgg

SEQ ID NO: 395 - DNA, 25 bp, Mus musculus
gctttgattcagtcggaatggcgct

SEQ ID NO: 396 - DNA, 25 bp, Mus musculus
tcggaatggcgctcagcagatattt

SEQ ID NO: 397 - DNA, 25 bp, Mus musculus
cagatatttgaagctgaccgtcttt

SEQ ID NO: 398 - DNA, 25 bp, Mus musculus
tgaccgtctttgaaagcgacaaatg

SEQ ID NO: 399 - DNA, 25 bp, Mus musculus
cagataacctgatctaccaagtggc

SEQ ID NO: 400 - DNA, 25 bp, Mus musculus
ctcctgtccatgtgaaggtgtggag

SEQ ID NO: 401 - DNA, 25 bp, Mus musculus
agaaggacacccggacaatgctggc

SEQ ID NO: 402 - DNA, 25 bp, Mus musculus
cgcttctctcgtcggcggacttgtg

SEQ ID NO: 403 - DNA, 25 bp, Mus musculus
cggcggacttgtgatcggcctgcat

SEQ ID NO: 404 - DNA, 25 bp, Mus musculus
cggcctgcatgaggatgacgagacc

SEQ ID NO: 405 - DNA, 25 bp, Mus musculus
ccaaatgatccgcgtcccgaatgct

SEQ ID NO: 406 - DNA, 25 bp, Mus musculus
cccgaatgctgacattgacgtagtc

SEQ ID NO: 407 - DNA, 25 bp, Mus musculus
tgtcattcctttttatgaagtgctg

SEQ ID NO: 408 - DNA, 25 bp, Mus musculus
tgaagtgctgacaagagacgcgaga

SEQ ID NO: 409 - DNA, 25 bp, Mus musculus
agacgcgagagacgtgcttccgaag

SEQ ID NO: 410 - DNA, 25 bp, Mus musculus
gaaggagtttccatatgccgatgcc

SEQ ID NO: 411 - DNA, 25 bp, Mus musculus
tgccgatgccgtaaaagcaagtgct

SEQ ID NO: 412 - DNA, 25 bp, Mus musculus
tgctgtcagcaatatcctcattgct

SEQ ID NO: 413 - DNA, 25 bp, Mus musculus
cctcattgctgcgatcatgtccaag

SEQ ID NO: 414 - DNA, 25 bp, Mus musculus
catgtccaaggattggccgcttgtc

SEQ ID NO: 415 - DNA, 25 bp, Mus musculus
gttccatcagccgtaccgggcgatg

SEQ ID NO: 416 - DNA, 25 bp, Mus musculus
gtaccgggcgatgcttgtgcctgag

SEQ ID NO: 417 - DNA, 25 bp, Mus musculus
agtagagcacgtcgccgagatgaag

SEQ ID NO: 418 - DNA, 25 bp, Mus musculus
atatggaacggctctcagcggagca

SEQ ID NO: 419 - DNA, 25 bp, Mus musculus
cggagcaggcccaacgattctcgtc

SEQ ID NO: 420 - DNA, 25 bp, Mus musculus
gctcgcgcttcatttccctcattgt

SEQ ID NO: 421 - DNA, 25 bp, Mus musculus
cttgtattacgattcgcacgatgag

SEQ ID NO: 422 - DNA, 25 bp, Mus musculus
gattcgcacgatgagtgtaaagaac

SEQ ID NO: 423 - DNA, 25 bp, Mus musculus
cggtgttgcatcgatacaggcaggt

SEQ ID NO: 424 - DNA, 25 bp, Mus musculus
tacaggcaggtgctggcattgttgc

SEQ ID NO: 425 - DNA, 25 bp, Mus musculus
cattgttgctgattctgttccggaa

SEQ ID NO: 426 - DNA, 25 bp, Mus musculus
aagccggtgcgctgctgaaaacgat

SEQ ID NO: 427 - DNA, 25 bp, Mus musculus
gaaaacgattcatattgcagaagac

SEQ ID NO: 428 - DNA, 25 bp, Mus musculus
ctgatgaacagatttctacaattgt

SEQ ID NO: 429 - DNA, 25 bp, Mus musculus
tactgccggtgaggctgaaacgctg

SEQ ID NO: 430 - DNA, 25 bp, Mus musculus
tatgatgatggcagcggaaatgact

SEQ ID NO: 431 - DNA, 25 bp, Mus musculus
gatattgtcaattcttgctcatcgg

SEQ ID NO: 432 - DNA, 25 bp, Mus musculus
gttttgtgaaggcaatgcgggcaca

SEQ ID NO: 433 - DNA, 25 bp, Mus musculus
caatgcgggcacacgctcttacagt

SEQ ID NO: 434 - DNA, 25 bp, Mus musculus
acacgctcttacagtcgatggactt

SEQ ID NO: 435 - DNA, 25 bp, Mus musculus
tggacttcctgatattgttgataca

SEQ ID NO: 436 - DNA, 25 bp, Mus musculus
tatctcaacggcctcggcaattgtt

SEQ ID NO: 437 - DNA, 25 bp, Mus musculus
ctcggcaattgttgcctcggcagct

SEQ ID NO: 438 - DNA, 25 bp, Mus musculus
gttgcctcggcagctggtgcgaaaa

SEQ ID NO: 439 - DNA, 25 bp, Mus musculus
cgctaagcatggcaatcgctctgtc

SEQ ID NO: 440 - DNA, 25 bp, Mus musculus
caatcgctctgtctcttctaaaagc

SEQ ID NO: 441 - DNA, 25 bp, Mus musculus
gatttcggtttcacaaatggcagac

SEQ ID NO: 442 - DNA, 25 bp, Mus musculus
tttcacaaatggcagacttgaagat

SEQ ID NO: 443 - DNA, 25 bp, Mus musculus
tttacaggtgcagtcaccgaaagag

SEQ ID NO: 444 - DNA, 25 bp, Mus musculus
caccgaaagagagcgcctatctcat

SEQ ID NO: 445 - DNA, 25 bp, Mus musculus
aagagagcgcctatctcattcagaa

SEQ ID NO: 446 - DNA, 25 bp, Mus musculus
gagcgcctatctcattcagaatatt

SEQ ID NO: 447 - DNA, 25 bp, Mus musculus
gcagcagttccgctttatctattac

SEQ ID NO: 448 - DNA, 25 bp, Mus musculus
gcttttaatgcgggagctgcgattt

SEQ ID NO: 449 - DNA, 25 bp, Mus musculus
ttagagacgattacaagcggaggcg

SEQ ID NO: 450 - DNA, 25 bp, Mus musculus
agacgattacaagcggaggcgctgc

SEQ ID NO: 451 - DNA, 25 bp, Mus musculus
gattacaagcggaggcgctgccgcg

SEQ ID NO: 452 - DNA, 25 bp, Mus musculus
ccgcgcagcttgaacgactaaagca

SEQ ID NO: 453 - DNA, 25 bp, Mus musculus
gcagcttgaacgactaaagcagaaa

SEQ ID NO: 454 - DNA, 25 bp, Mus musculus
gagcagcctttcgagaaacgttcat

SEQ ID NO: 455 - DNA, 25 bp, Mus musculus
gaggcgctggcaagcccgaatcggt

SEQ ID NO: 456 - DNA, 25 bp, Mus musculus
ttaaagaggattttgtgcctgtgca

SEQ ID NO: 457 - DNA, 25 bp, Mus musculus
ttttgtgcctgtgcagattgcaata

SEQ ID NO: 458 - DNA, 25 bp, Mus musculus
gcagattgcaatagactatgaggct

SEQ ID NO: 459 - DNA, 25 bp, Mus musculus
atagactatgaggctgcgaaggcag

SEQ ID NO: 460 - DNA, 25 bp, Mus musculus
actatgaggctgcgaaggcagatgc

SEQ ID NO: 461 - DNA, 25 bp, Mus musculus
ttaacatttgtcaatgaacatgggg

SEQ ID NO: 462 - DNA, 25 bp, Mus musculus
gcgagctgtacttatcggtgaatca

SEQ ID NO: 463 - DNA, 25 bp, Mus musculus
atgagacaaacttctcagcgtaaag

SEQ ID NO: 464 - DNA, 25 bp, Mus musculus
tctcagcgtaaagcaatccatgctt

SEQ ID NO: 465 - DNA, 25 bp, Mus musculus
gtcactaaaggatttgcagcttgcg

SEQ ID NO: 466 - DNA, 25 bp, Mus musculus
tttgcagcttgcggcggaatcacag

SEQ ID NO: 467 - DNA, 25 bp, Mus musculus
gcggcggaatcacaggctgattacc

SEQ ID NO: 468 - DNA, 25 bp, Mus musculus
atcaatagagacgatgtcacgtatt

SEQ ID NO: 469 - DNA, 25 bp, Mus musculus
acgatgtcacgtattgccaagagct

SEQ ID NO: 470 - DNA, 25 bp, Mus musculus
gtattgccaagagcttgaagctcga

SEQ ID NO: 471 - DNA, 25 bp, Mus musculus
gagcttgaagctcgacgtcattcag

SEQ ID NO: 472 - DNA, 25 bp, Mus musculus
ctcgacgtcattcagcttcacggtg

SEQ ID NO: 473 - DNA, 25 bp, Mus musculus
ttcagcttcacggtgatgaaaaacc

SEQ ID NO: 474 - DNA, 25 bp, Mus musculus
ggatgctgctgctcttcgcaagctg

SEQ ID NO: 475 - DNA, 25 bp, Mus musculus
agctgacaggctgtgaaatatggaa

SEQ ID NO: 476 - DNA, 25 bp, Mus musculus
gcgcttcaccatcaagataacacaa

SEQ ID NO: 477 - DNA, 25 bp, Mus musculus
atgttgacggctttgtgattgattc

SEQ ID NO: 478 - DNA, 25 bp, Mus musculus
ttgattcatctgtaaaagggtctag

SEQ ID NO: 479 - DNA, 25 bp, Mus musculus
tgggaatgtgtgccggaatatcagc

SEQ ID NO: 480 - DNA, 25 bp, Mus musculus
tgccggaatatcagcaggcggctat

SEQ ID NO: 481 - DNA, 25 bp, Mus musculus
aatgggtcagaaggactcctatgtg

SEQ ID NO: 482 - DNA, 25 bp, Mus musculus
gaaggactcctatgtgggtgacgag

SEQ ID NO: 483 - DNA, 25 bp, Mus musculus
tgggtgacgaggcccagagcaagag

SEQ ID NO: 484 - DNA, 25 bp, Mus musculus
gagaggtatcctgaccctgaagtac

SEQ ID NO: 485 - DNA, 25 bp, Mus musculus
agtaccccattgaacatggcattgt

SEQ ID NO: 486 - DNA, 25 bp, Mus musculus
ttgaacatggcattgttaccaactg

SEQ ID NO: 487 - DNA, 25 bp, Mus musculus
tgttaccaactgggacgacatggag

SEQ ID NO: 488 - DNA, 25 bp, Mus musculus
ggagaagatctggcaccacaccttc

SEQ ID NO: 489 - DNA, 25 bp, Mus musculus
accacaccttctacaatgagctgcg

SEQ ID NO: 490 - DNA, 25 bp, Mus musculus
ccttctacaatgagctgcgtgtggc

SEQ ID NO: 491 - DNA, 25 bp, Mus musculus
acaatgagctgcgtgtggcccctga

SEQ ID NO: 492 - DNA, 25 bp, Mus musculus
cccctgaggagcaccctgtgctgct

SEQ ID NO: 493 - DNA, 25 bp, Mus musculus
accctgtgctgctcaccgaggcccc

SEQ ID NO: 494 - DNA, 25 bp, Mus musculus
tgacccagatcatgtttgagacctt

SEQ ID NO: 495 - DNA, 25 bp, Mus musculus
agatcatgtttgagaccttcaacac

SEQ ID NO: 496 - DNA, 25 bp, Mus musculus
cccagccatgtacgtagccatccag

SEQ ID NO: 497 - DNA, 25 bp, Mus musculus
gtacgtagccatccaggctgtgctg

SEQ ID NO: 498 - DNA, 25 bp, Mus musculus
ccatccaggctgtgctgtccctgta

SEQ ID NO: 499 - DNA, 25 bp, Mus musculus
gctgtccctgtatgcctctggtcgt

SEQ ID NO: 500 - DNA, 25 bp, Mus musculus
gtatgcctctggtcgtaccacgggc

SEQ ID NO: 501 - DNA, 25 bp, Mus musculus
gtcgtaccacgggcattgtgatgga

SEQ ID NO: 502 - DNA, 25 bp, Mus musculus
tgcccatctacgagggctatgctct

SEQ ID NO: 503 - DNA, 25 bp, Mus musculus
cctcacgccatcctgcgtctggact

SEQ ID NO: 504 - DNA, 25 bp, Mus musculus
ccatcctgcgtctggacttggctgg

SEQ ID NO: 505 - DNA, 25 bp, Mus musculus
ctgacggactacctcatgaagatcc

SEQ ID NO: 506 - DNA, 25 bp, Mus musculus
actacctcatgaagatcctgaccga

SEQ ID NO: 507 - DNA, 25 bp, Mus musculus
tcatgaagatcctgaccgagcgtgg

SEQ ID NO: 508 - DNA, 25 bp, Mus musculus
tcctgaccgagcgtggctacagctt

SEQ ID NO: 509 - DNA, 25 bp, Mus musculus
gcttcaccaccacagctgagaggga

SEQ ID NO: 510 - DNA, 25 bp, Mus musculus
gaaatcgtgcgtgacatcaaagaga

SEQ ID NO: 511 - DNA, 25 bp, Mus musculus
agctgtgctatgttgctctagactt

SEQ ID NO: 512 - DNA, 25 bp, Mus musculus
gctatgttgctctagacttcgagca

SEQ ID NO: 513 - DNA, 25 bp, Mus musculus
ctctagacttcgagcaggagatggc

SEQ ID NO: 514 - DNA, 25 bp, Mus musculus
caggagatggccactgccgcatcct

SEQ ID NO: 515 - DNA, 25 bp, Mus musculus
agaagagctatgagctgcctgacgg

SEQ ID NO: 516 - DNA, 25 bp, Mus musculus
atgagctgcctgacggccaagtcat

SEQ ID NO: 517 - DNA, 25 bp, Mus musculus
tgcctgacggccaagtcatcactat

SEQ ID NO: 518 - DNA, 25 bp, Mus musculus
gccaagtcatcactattggcaacga

SEQ ID NO: 519 - DNA, 25 bp, Mus musculus
atcactattggcaacgagcggttcc

SEQ ID NO: 520 - DNA, 25 bp, Mus musculus
ggcaacgagcggttccgatgccctg

SEQ ID NO: 521 - DNA, 25 bp, Mus musculus
ttccgatgccctgaggctcttttcc

SEQ ID NO: 522 - DNA, 25 bp, Mus musculus
tgccctgaggctcttttccagcctt

SEQ ID NO: 523 - DNA, 25 bp, Mus musculus
aactacattcaattccatcatgaag

SEQ ID NO: 524 - DNA, 25 bp, Mus musculus
ttccatcatgaagtgtgacgttgac

SEQ ID NO: 525 - DNA, 25 bp, Mus musculus
tgacatccgtaaagacctctatgcc

SEQ ID NO: 526 - DNA, 25 bp, Mus musculus
gacctctatgccaacacagtgttgt

SEQ ID NO: 527 - DNA, 25 bp, Mus musculus
cacagtgttgtctggtggtaccacc

SEQ ID NO: 528 - DNA, 25 bp, Mus musculus
accatgtacccaggcattgctgaca

SEQ ID NO: 529 - DNA, 25 bp, Mus musculus
aggcattgctgacaggatgcagaag

SEQ ID NO: 530 - DNA, 25 bp, Mus musculus
aaggagattactgctctggctccta

SEQ ID NO: 531 - DNA, 25 bp, Mus musculus
actgctctggctcctagcaccatga

SEQ ID NO: 532 - DNA, 25 bp, Mus musculus
tcctagcaccatgaagatcaagatc

SEQ ID NO: 533 - DNA, 25 bp, Mus musculus
gatcaagatcattgctcctcctgag

SEQ ID NO: 534 - DNA, 25 bp, Mus musculus
tgctcctcctgagcgcaagtactct

SEQ ID NO: 535 - DNA, 25 bp, Mus musculus
cctgagcgcaagtactctgtgtgga

SEQ ID NO: 536 - DNA, 25 bp, Mus musculus
gtactctgtgtggatcggtggctcc

SEQ ID NO: 537 - DNA, 25 bp, Mus musculus
gtggatcggtggctccatcttggcc

SEQ ID NO: 538 - DNA, 25 bp, Mus musculus
ggctccatcttggcctcactgtcca

SEQ ID NO: 539 - DNA, 25 bp, Mus musculus
cttccagcagatgtggatcagcaag

SEQ ID NO: 540 - DNA, 25 bp, Mus musculus
tggatcagcaagcaggagtacgatg

SEQ ID NO: 541 - DNA, 25 bp, Mus musculus
catcgtgcaccgcaagtgcttctag

SEQ ID NO: 542 - DNA, 25 bp, Mus musculus
cgcaagtgcttctaggcggactgtt

SEQ ID NO: 543 - DNA, 25 bp, Mus musculus
ggcggactgttactgagctgcgttt

SEQ ID NO: 544 - DNA, 25 bp, Mus musculus
tggccgtattgggcgcctggtcacc

SEQ ID NO: 545 - DNA, 25 bp, Mus musculus
tggtcaccagggctgccatttgcag

SEQ ID NO: 546 - DNA, 25 bp, Mus musculus
ccatttgcagtggcaaagtggagat

SEQ ID NO: 547 - DNA, 25 bp, Mus musculus
ccttcattgacctcaactacatggt

SEQ ID NO: 548 - DNA, 25 bp, Mus musculus
tgacctcaactacatggtctacatg

SEQ ID NO: 549 - DNA, 25 bp, Mus musculus
actacatggtctacatgttccagta

SEQ ID NO: 550 - DNA, 25 bp, Mus musculus
ctacatgttccagtatgactccact

SEQ ID NO: 551 - DNA, 25 bp, Mus musculus
tccagtatgactccactcacggcaa

SEQ ID NO: 552 - DNA, 25 bp, Mus musculus
ctccactcacggcaaattcaacggc

SEQ ID NO: 553 - DNA, 25 bp, Mus musculus
tcacggcaaattcaacggcacagtc

SEQ ID NO: 554 - DNA, 25 bp, Mus musculus
caacggcacagtcaaggccgagaat

SEQ ID NO: 555 - DNA, 25 bp, Mus musculus
tgggaagcttgtcatcaacgggaag

SEQ ID NO: 556 - DNA, 25 bp, Mus musculus
gcttgtcatcaacgggaagcccatc

SEQ ID NO: 557 - DNA, 25 bp, Mus musculus
agcccatcaccatcttccaggagcg

SEQ ID NO: 558 - DNA, 25 bp, Mus musculus
caccatcttccaggagcgagacccc

SEQ ID NO: 559 - DNA, 25 bp, Mus musculus
gcgagaccccactaacatcaaatgg

SEQ ID NO: 560 - DNA, 25 bp, Mus musculus
ctgagtatgtcgtggagtctactgg

SEQ ID NO: 561 - DNA, 25 bp, Mus musculus
tgtcgtggagtctactggtgtcttc

SEQ ID NO: 562 - DNA, 25 bp, Mus musculus
agtctactggtgtcttcaccaccat

SEQ ID NO: 563 - DNA, 25 bp, Mus musculus
gggtggagccaaacgggtcatcatc

SEQ ID NO: 564 - DNA, 25 bp, Mus musculus
agccaaacgggtcatcatctccgcc

SEQ ID NO: 565 - DNA, 25 bp, Mus musculus
ggtgtgaaccacgagaaatatgaca

SEQ ID NO: 566 - DNA, 25 bp, Mus musculus
tatgacaactcactcaagattgtca

SEQ ID NO: 567 - DNA, 25 bp, Mus musculus
ctcactcaagattgtcagcaatgca

SEQ ID NO: 568 - DNA, 25 bp, Mus musculus
aagattgtcagcaatgcatcctgca

SEQ ID NO: 569 - DNA, 25 bp, Mus musculus
cccctggccaaggtcatccatgaca

SEQ ID NO: 570 - DNA, 25 bp, Mus musculus
catccatgacaactttggcattgtg

SEQ ID NO: 571 - DNA, 25 bp, Mus musculus
caactttggcattgtggaagggctc

SEQ ID NO: 572 - DNA, 25 bp, Mus musculus
gaagggctcatgaccacagtccatg

SEQ ID NO: 573 - DNA, 25 bp, Mus musculus
catgaccacagtccatgccatcact

SEQ ID NO: 574 - DNA, 25 bp, Mus musculus
atcactgccacccagaagactgtgg

SEQ ID NO: 575 - DNA, 25 bp, Mus musculus
gactgtggatggcccctctggaaag

SEQ ID NO: 576 - DNA, 25 bp, Mus musculus
ggcccctctggaaagctgtggcgtg

SEQ ID NO: 577 - DNA, 25 bp, Mus musculus
ccgtggggctgcccagaacatcatc

SEQ ID NO: 578 - DNA, 25 bp, Mus musculus
gcccagaacatcatccctgcatcca

SEQ ID NO: 579 - DNA, 25 bp, Mus musculus
tgcatccactggtgctgccaaggct

SEQ ID NO: 580 - DNA, 25 bp, Mus musculus
ggcaaggtcatcccagagctgaacg

SEQ ID NO: 581 - DNA, 25 bp, Mus musculus
cccagagctgaacgggaagctcact

SEQ ID NO: 582 - DNA, 25 bp, Mus musculus
gaacgggaagctcactggcatggcc

SEQ ID NO: 583 - DNA, 25 bp, Mus musculus
tggcatggccttccgtgttcctacc

SEQ ID NO: 584 - DNA, 25 bp, Mus musculus
tctgacgtgccgcctggagaaacct

SEQ ID NO: 585 - DNA, 25 bp, Mus musculus
gagaaacctgccaagtatgatgaca

SEQ ID NO: 586 - DNA, 25 bp, Mus musculus
ggcatctgagggcccactgaagggc

SEQ ID NO: 587 - DNA, 25 bp, Mus musculus
gggcccactgaagggcatcttgggc

SEQ ID NO: 588 - DNA, 25 bp, Mus musculus
cactgaagggcatcttgggctacac

SEQ ID NO: 589 - DNA, 25 bp, Mus musculus
tgggctacactgaggaccaggttgt

SEQ ID NO: 590 - DNA, 25 bp, Mus musculus
actgaggaccaggttgtctcctgcg

SEQ ID NO: 591 - DNA, 25 bp, Mus musculus
ccaggttgtctcctgcgacttcaac

SEQ ID NO: 592 - DNA, 25 bp, Mus musculus
ttgtctcctgcgacttcaacagcaa

SEQ ID NO: 593 - DNA, 25 bp, Mus musculus
tgcgacttcaacagcaactcccact

SEQ ID NO: 594 - DNA, 25 bp, Mus musculus
cggggctggcattgctctcaatgac

SEQ ID NO: 595 - DNA, 25 bp, Mus musculus
gcattgctctcaatgacaactttgt

SEQ ID NO: 596 - DNA, 25 bp, Mus musculus
caatgacaactttgtcaagctcatt

SEQ ID NO: 597 - DNA, 25 bp, Mus musculus
caactttgtcaagctcatttcctgg

SEQ ID NO: 598 - DNA, 25 bp, Mus musculus
aagctcatttcctggtatgacaatg

SEQ ID NO: 599 - DNA, 25 bp, Mus musculus
tgacaatgaatacggctacagcaac

SEQ ID NO: 600 - DNA, 25 bp, Mus musculus
atacggctacagcaacagggtggtg

SEQ ID NO: 601 - DNA, 25 bp, Mus musculus
ggtggacctcatggcctacatggcc

SEQ ID NO: 602 - DNA, 25 bp, Mus musculus
acctcatggcctacatggcctccaa

SEQ ID NO: 603 - DNA, 25 bp, Mus musculus
acccaccccagcaaggacactgagc

SEQ ID NO: 604 - DNA, 25 bp, Mus musculus
ccccagcaaggacactgagcaagag

SEQ ID NO: 605 - DNA, 25 bp, Mus musculus
ggacactgagcaagagaggccctat

SEQ ID NO: 606 - DNA, 25 bp, Mus musculus
tccctcacaatttccatcccagacc

SEQ ID NO: 607 - DNA, 25 bp, Mus musculus
tcaagccagatcagcattctctaac

SEQ ID NO: 608 - DNA, 25 bp, Mus musculus
tttagccttgctcggcaagtagatg

SEQ ID NO: 609 - DNA, 25 bp, Mus musculus
agataacagtcatgtggagatgaaa

SEQ ID NO: 610 - DNA, 25 bp, Mus musculus
aatggaagactctgctttgcagcta

SEQ ID NO: 611 - DNA, 25 bp, Mus musculus
actctgctttgcagctattgcacta

SEQ ID NO: 612 - DNA, 25 bp, Mus musculus
tcttcttgattggattcatgagtgg

SEQ ID NO: 613 - DNA, 25 bp, Mus musculus
ttcatgagtggctacctgggctatt

SEQ ID NO: 614 - DNA, 25 bp, Mus musculus
tggctacctgggctattgtaagcgt

SEQ ID NO: 615 - DNA, 25 bp, Mus musculus
aaacagaggatgttcctacatcatc

SEQ ID NO: 616 - DNA, 25 bp, Mus musculus
cctacatcatctcgcttatattggg

SEQ ID NO: 617 - DNA, 25 bp, Mus musculus
atctcgcttatattgggcagacctc

SEQ ID NO: 618 - DNA, 25 bp, Mus musculus
agacctcaaaacactgttgtcagag

SEQ ID NO: 619 - DNA, 25 bp, Mus musculus
gaagttgaactccatagagtttgct

SEQ ID NO: 620 - DNA, 25 bp, Mus musculus
catagagtttgctgacaccatcaag

SEQ ID NO: 621 - DNA, 25 bp, Mus musculus
tgacaccatcaagcagctgagccag

SEQ ID NO: 622 - DNA, 25 bp, Mus musculus
aagcagctgagccagaatacataca

SEQ ID NO: 623 - DNA, 25 bp, Mus musculus
gaatacatacactcctcgtgaggct

SEQ ID NO: 624 - DNA, 25 bp, Mus musculus
acactcctcgtgaggctggatctca

SEQ ID NO: 625 - DNA, 25 bp, Mus musculus
atgaatttaaattcagcaaagtctg

SEQ ID NO: 626 - DNA, 25 bp, Mus musculus
tcagcaaagtctggcgagatgaaca

SEQ ID NO: 627 - DNA, 25 bp, Mus musculus
gcagcattggtcaaaacatggtgac

SEQ ID NO: 628 - DNA, 25 bp, Mus musculus
catgctcatctaggaactggtgatc

SEQ ID NO: 629 - DNA, 25 bp, Mus musculus
ggtgatccatacacacctggctttc

SEQ ID NO: 630 - DNA, 25 bp, Mus musculus
ttccttctttcaatcatactcagtt

SEQ ID NO: 631 - DNA, 25 bp, Mus musculus
atcatactcagtttccgccatctca

SEQ ID NO: 632 - DNA, 25 bp, Mus musculus
gtttccgccatctcagtcatcaggg

SEQ ID NO: 633 - DNA, 25 bp, Mus musculus
tctcagtcatcagggttgcctaata

SEQ ID NO: 634 - DNA, 25 bp, Mus musculus
cctaatatacctgtgcaaacaatct

SEQ ID NO: 635 - DNA, 25 bp, Mus musculus
ctgtgcaaacaatctcaagagctgc

SEQ ID NO: 636 - DNA, 25 bp, Mus musculus
aagagctgctgcagaaaagctattt

SEQ ID NO: 637 - DNA, 25 bp, Mus musculus
ctgtcctgctagatggaacatagat

SEQ ID NO: 638 - DNA, 25 bp, Mus musculus
catagattcttcatgtaagctggaa

SEQ ID NO: 639 - DNA, 25 bp, Mus musculus
gtaagctggaactttcacagaatca

SEQ ID NO: 640 - DNA, 25 bp, Mus musculus
tatgttgtagtaggagcccagagag

SEQ ID NO: 641 - DNA, 25 bp, Mus musculus
ggagcccagagagacgctttgggtg

SEQ ID NO: 642 - DNA, 25 bp, Mus musculus
gtgttgcggcgaagtccagtgtggg

SEQ ID NO: 643 - DNA, 25 bp, Mus musculus
gaaacttgcccaagtattctcagat

SEQ ID NO: 644 - DNA, 25 bp, Mus musculus
agtattctcagatatgatttcaaaa

SEQ ID NO: 645 - DNA, 25 bp, Mus musculus
cagaagtataatctttgccagctgg

SEQ ID NO: 646 - DNA, 25 bp, Mus musculus
ctttgccagctggactgcaggcgac

SEQ ID NO: 647 - DNA, 25 bp, Mus musculus
ctgcaggcgactttggagctgttgg

SEQ ID NO: 648 - DNA, 25 bp, Mus musculus
ttcatctttgcatttaaaagctttc

SEQ ID NO: 649 - DNA, 25 bp, Mus musculus
tcagaaagttcctcagctcaaccaa

SEQ ID NO: 650 - DNA, 25 bp, Mus musculus
aatggttcgtacagcagcggaagtg

SEQ ID NO: 651 - DNA, 25 bp, Mus musculus
ggaagtggctggtcagctcattatt

SEQ ID NO: 652 - DNA, 25 bp, Mus musculus
tcagctcattattaaacttacccat

SEQ ID NO: 653 - DNA, 25 bp, Mus musculus
tgaattgaacctggactatgagatg

SEQ ID NO: 654 - DNA, 25 bp, Mus musculus
taacagcaaactactgtcatttatg

SEQ ID NO: 655 - DNA, 25 bp, Mus musculus
gaaccagttcaaaacagatatcagg

SEQ ID NO: 656 - DNA, 25 bp, Mus musculus
tatgggtctaagtctacagtggctg

SEQ ID NO: 657 - DNA, 25 bp, Mus musculus
tctacagtggctgtattccgctcgt

SEQ ID NO: 658 - DNA, 25 bp, Mus musculus
gtattccgctcgtggagactacttc

SEQ ID NO: 659 - DNA, 25 bp, Mus musculus
tgctacttctagactaacaactgat

SEQ ID NO: 660 - DNA, 25 bp, Mus musculus
tgattttcataatgctgagaaaaca

SEQ ID NO: 661 - DNA, 25 bp, Mus musculus
agtggagtatcacttcctgtcgccc

SEQ ID NO: 662 - DNA, 25 bp, Mus musculus
cttcctgtcgccctatgtatctcca

SEQ ID NO: 663 - DNA, 25 bp, Mus musculus
ctatgtatctccaagagagtctcct

SEQ ID NO: 664 - DNA, 25 bp, Mus musculus
agagtctcctttccgacatatcttc

SEQ ID NO: 665 - DNA, 25 bp, Mus musculus
ctggggctctggctctcacactctc

SEQ ID NO: 666 - DNA, 25 bp, Mus musculus
tctctcagctttagtggagaacttg

SEQ ID NO: 667 - DNA, 25 bp, Mus musculus
tacttggactattcagggagtcgca

SEQ ID NO: 668 - DNA, 25 bp, Mus musculus
gggagtcgcaaatgccctctctggt

SEQ ID NO: 669 - DNA, 25 bp, Mus musculus
cctctctggtgacatttggaatatt

SEQ ID NO: 670 - DNA, 25 bp, Mus musculus
ctaggtgcttggctggtacaagatg

SEQ ID NO: 671 - DNA, 25 bp, Mus musculus
gaggctcctgggtgtccgccgatcc

SEQ ID NO: 672 - DNA, 25 bp, Mus musculus
agaggtgagattgccatccgagtgt

SEQ ID NO: 673 - DNA, 25 bp, Mus musculus
catccgagtgtttcgtgcgtgcaca

SEQ ID NO: 674 - DNA, 25 bp, Mus musculus
gtgcacagagctgggtatccgcaca

SEQ ID NO: 675 - DNA, 25 bp, Mus musculus
ccgcacagtggctgtctactcggag

SEQ ID NO: 676 - DNA, 25 bp, Mus musculus
gctgtctactcggagcaggacacag

SEQ ID NO: 677 - DNA, 25 bp, Mus musculus
gagcaggacacagggcagatgcaca

SEQ ID NO: 678 - DNA, 25 bp, Mus musculus
cagggcagatgcacaggcagaaagc

SEQ ID NO: 679 - DNA, 25 bp, Mus musculus
ctgatgaagcctaccttattggccg

SEQ ID NO: 680 - DNA, 25 bp, Mus musculus
tattggccgtggcctggcacctgtg

SEQ ID NO: 681 - DNA, 25 bp, Mus musculus
gcacctgtgcaggcctacctgcaca

SEQ ID NO: 682 - DNA, 25 bp, Mus musculus
attccagacatcatcaaggtggcca

SEQ ID NO: 683 - DNA, 25 bp, Mus musculus
ggtgcatcctggctatgggttcctc

SEQ ID NO: 684 - DNA, 25 bp, Mus musculus
ctctcagagcgagcagactttgccc

SEQ ID NO: 685 - DNA, 25 bp, Mus musculus
ccgggccattgccatcgctgcaggc

SEQ ID NO: 686 - DNA, 25 bp, Mus musculus
tcagctccctgcacgaggcgcatga

SEQ ID NO: 687 - DNA, 25 bp, Mus musculus
acgaggcgcatgagttctccaacac

SEQ ID NO: 688 - DNA, 25 bp, Mus musculus
gcttccctattatcttcaaggccgc

SEQ ID NO: 689 - DNA, 25 bp, Mus musculus
tgcgggtcgtgcatagctatgagga

SEQ ID NO: 690 - DNA, 25 bp, Mus musculus
gcatagctatgaggagttggaagag

SEQ ID NO: 691 - DNA, 25 bp, Mus musculus
ccgcatcaatggctgtgccattcag

SEQ ID NO: 692 - DNA, 25 bp, Mus musculus
gccattcagtgtcgggtcaccaccg

SEQ ID NO: 693 - DNA, 25 bp, Mus musculus
ccgcctggacaacgcctctgcattc

SEQ ID NO: 694 - DNA, 25 bp, Mus musculus
cgcctctgcattccagggcgctgtc

SEQ ID NO: 695 - DNA, 25 bp, Mus musculus
ctctctgctcgtcaaggtcattgca

SEQ ID NO: 696 - DNA, 25 bp, Mus musculus
caaggtcattgcacacggcaaagac

SEQ ID NO: 697 - DNA, 25 bp, Mus musculus
ccaccaagatgagcagagccctggc

SEQ ID NO: 698 - DNA, 25 bp, Mus musculus
atccccttcctgcagaatgttctca

SEQ ID NO: 699 - DNA, 25 bp, Mus musculus
tctcaacaaccagcagttcctggca

SEQ ID NO: 700 - DNA, 25 bp, Mus musculus
ttcctggcaggcacagtggacaccc

SEQ ID NO: 701 - DNA, 25 bp, Mus musculus
gacacccagttcatcgatgagaacc

SEQ ID NO: 702 - DNA, 25 bp, Mus musculus
atgagaaccctgagctgttccagct

SEQ ID NO: 703 - DNA, 25 bp, Mus musculus
gttccagcttcggcctgcacagaac

SEQ ID NO: 704 - DNA, 25 bp, Mus musculus
cctcggacatgtcatggtgaatggc

SEQ ID NO: 705 - DNA, 25 bp, Mus musculus
aatccctgtcaatgtgagccccagt

SEQ ID NO: 706 - DNA, 25 bp, Mus musculus
tgagccccagtcctgtggatcctgc

SEQ ID NO: 707 - DNA, 25 bp, Mus musculus
cctgctgttcctgtggtgcccatag

SEQ ID NO: 708 - DNA, 25 bp, Mus musculus
gctggtttcagggacatccttctgc

SEQ ID NO: 709 - DNA, 25 bp, Mus musculus
tccttctgcgagaagggccagaggg

SEQ ID NO: 710 - DNA, 25 bp, Mus musculus
tgcccgagctgtgcggaatcaccag

SEQ ID NO: 711 - DNA, 25 bp, Mus musculus
aatcaccaggggctgctgttgatgg

SEQ ID NO: 712 - DNA, 25 bp, Mus musculus
aaatactcactggagtactacatgg

SEQ ID NO: 713 - DNA, 25 bp, Mus musculus
tggagtactacatgggcttagctga

SEQ ID NO: 714 - DNA, 25 bp, Mus musculus
tagctgaagaactggtgcgagctgg

SEQ ID NO: 715 - DNA, 25 bp, Mus musculus
gcactcacatcctgtgcattaagga

SEQ ID NO: 716 - DNA, 25 bp, Mus musculus
cattaaggacatggcgggcctgctg

SEQ ID NO: 717 - DNA, 25 bp, Mus musculus
cctgctgaagcctgccgcctgcacc

SEQ ID NO: 718 - DNA, 25 bp, Mus musculus
actgcacatccatacccatgataca

SEQ ID NO: 719 - DNA, 25 bp, Mus musculus
tgtggcagccatgctggcctgtgca

SEQ ID NO: 720 - DNA, 25 bp, Mus musculus
gggctgatgttgtggacgtggcagt

SEQ ID NO: 721 - DNA, 25 bp, Mus musculus
gactccatgtctgggatgacctcac

SEQ ID NO: 722 - DNA, 25 bp, Mus musculus
gatgacctcacagccaagcatgggg

SEQ ID NO: 723 - DNA, 25 bp, Mus musculus
gtgtttgactacagtgagtactggg

SEQ ID NO: 724 - DNA, 25 bp, Mus musculus
ggactgtacgcagccttcgattgca

SEQ ID NO: 725 - DNA, 25 bp, Mus musculus
gccttcgattgcacggctaccatga

SEQ ID NO: 726 - DNA, 25 bp, Mus musculus
gcacggctaccatgaagtctggcaa

SEQ ID NO: 727 - DNA, 25 bp, Mus musculus
gtctggcaactccgacgtgtatgag

SEQ ID NO: 728 - DNA, 25 bp, Mus musculus
ggccagtacaccaacctgcacttcc

SEQ ID NO: 729 - DNA, 25 bp, Mus musculus
caggcccatagcatggggcttggct

SEQ ID NO: 730 - DNA, 25 bp, Mus musculus
gaggtcaagaaggcctatgtggagg

SEQ ID NO: 731 - DNA, 25 bp, Mus musculus
aggtgacaccatcctccaagattgt

SEQ ID NO: 732 - DNA, 25 bp, Mus musculus
cagttcatggtgcagaatgggttga

SEQ ID NO: 733 - DNA, 25 bp, Mus musculus
ttcgatccattctggttaaagacac

SEQ ID NO: 734 - DNA, 25 bp, Mus musculus
aagacacccaggccatgaaggagat

SEQ ID NO: 735 - DNA, 25 bp, Mus musculus
gatgcacttccatcccaaggctttg

SEQ ID NO: 736 - DNA, 25 bp, Mus musculus
ggtcatagacatcaaggtggcagca

SEQ ID NO: 737 - DNA, 25 bp, Mus musculus
gccagcccctctgtgtgctcagcgc

SEQ ID NO: 738 - DNA, 25 bp, Mus musculus
gtgctcagcgccatgaagatggaga

SEQ ID NO: 739 - DNA, 25 bp, Mus musculus
ggagactgtggtgacttcgcccatg

SEQ ID NO: 740 - DNA, 25 bp, Mus musculus
gacttcgcccatggagggcactatc

SEQ ID NO: 741 - DNA, 25 bp, Mus musculus
catgttaccaaggacatgactctgg

SEQ ID NO: 742 - DNA, 25 bp, Mus musculus
tgactctggaaggcgacgacctcat

SEQ ID NO: 743 - DNA, 25 bp, Mus musculus
aggcgacgacctcatcctagagatt

SEQ ID NO: 744 - DNA, 25 bp, Mus musculus
ccaggccagccagtacctgagagta

SEQ ID NO: 745 - DNA, 25 bp, Mus musculus
cttgaggtcctgtcccatgggacag

SEQ ID NO: 746 - DNA, 25 bp, Mus musculus
tcccatgggacagcacacacactac

SEQ ID NO: 747 - DNA, 25 bp, Mus musculus
acacactacctgcaatggcctgccc

SEQ ID NO: 748 - DNA, 25 bp, Mus musculus
tgcccattcccttcagctatttgtc

SEQ ID NO: 749 - DNA, 25 bp, Mus musculus
tagttgctcacatattcatctcttg

SEQ ID NO: 750 - DNA, 25 bp, Mus musculus
cacatattcatctcttgccaaataa

SEQ ID NO: 751 - DNA, 25 bp, Mus musculus
catctcttgccaaataagggcctgc

SEQ ID NO: 752 - DNA, 25 bp, Mus musculus
ttgccaaataagggcctgctcctcg

SEQ ID NO: 753 - DNA, 25 bp, Mus musculus
tcacaggtcctgggaaatttgctca

SEQ ID NO: 754 - DNA, 25 bp, Mus musculus
agtagcatatgcttgtctcaaagat

SEQ ID NO: 755 - DNA, 25 bp, Mus musculus
atgcttgtctcaaagattaagccat

SEQ ID NO: 756 - DNA, 25 bp, Mus musculus
aagccatgcatgtctaagtacgcac

SEQ ID NO: 757 - DNA, 25 bp, Mus musculus
tgcatgtctaagtacgcacggccgg

SEQ ID NO: 758 - DNA, 25 bp, Mus musculus
agtgaaactgcgaatggctcattaa

SEQ ID NO: 759 - DNA, 25 bp, Mus musculus
cgaatggctcattaaatcagttatg

SEQ ID NO: 760 - DNA, 25 bp, Mus musculus
ttatggttcctttggtcgctcgctc

SEQ ID NO: 761 - DNA, 25 bp, Mus musculus
ggataactgtggtaattctagagct

SEQ ID NO: 762 - DNA, 25 bp, Mus musculus
tctagagctaatacatgccgacggg

SEQ ID NO: 763 - DNA, 25 bp, Mus musculus
atacatgccgacgggcgctgacccc

SEQ ID NO: 764 - DNA, 25 bp, Mus musculus
gcatttatcagatcaaaaccaaccc

SEQ ID NO: 765 - DNA, 25 bp, Mus musculus
gcttggtgactctagataacctcgg

SEQ ID NO: 766 - DNA, 25 bp, Mus musculus
tagataacctcgggccgatcgcacg

SEQ ID NO: 767 - DNA, 25 bp, Mus musculus
ctatcaactttcgatggtagtcgcc

SEQ ID NO: 768 - DNA, 25 bp, Mus musculus
gtagtcgccgtgcctaccatggtga

SEQ ID NO: 769 - DNA, 25 bp, Mus musculus
tgcctaccatggtgaccacgggtga

SEQ ID NO: 770 - DNA, 25 bp, Mus musculus
cggctaccacatccaaggaaggcag

SEQ ID NO: 771 - DNA, 25 bp, Mus musculus
acatccaaggaaggcagcaggcgcg

SEQ ID NO: 772 - DNA, 25 bp, Mus musculus
aaggcagcaggcgcgcaaattaccc

SEQ ID NO: 773 - DNA, 25 bp, Mus musculus
taacaatacaggactctttcgaggc

SEQ ID NO: 774 - DNA, 25 bp, Mus musculus
aggatccattggagggcaagtctgg

SEQ ID NO: 775 - DNA, 25 bp, Mus musculus
agctcgtagttggatcttgggagcg

SEQ ID NO: 776 - DNA, 25 bp, Mus musculus
gccccctcgatgctcttagctgagt

SEQ ID NO: 777 - DNA, 25 bp, Mus musculus
gatgctcttagctgagtgtcccgcg

SEQ ID NO: 778 - DNA, 25 bp, Mus musculus
ttagagtgttcaaagcaggcccgag

SEQ ID NO: 779 - DNA, 25 bp, Mus musculus
agtgttcaaagcaggcccgagccgc

SEQ ID NO: 780 - DNA, 25 bp, Mus musculus
caaagcaggcccgagccgcctggat

SEQ ID NO: 781 - DNA, 25 bp, Mus musculus
ccgagccgcctggataccgcagcta

SEQ ID NO: 782 - DNA, 25 bp, Mus musculus
cgcctggataccgcagctaggaata

SEQ ID NO: 783 - DNA, 25 bp, Mus musculus
tggataccgcagctaggaataatgg

SEQ ID NO: 784 - DNA, 25 bp, Mus musculus
cggaactgaggccatgattaagagg

SEQ ID NO: 785 - DNA, 25 bp, Mus musculus
gggcattcgtattgcgccgctagag

SEQ ID NO: 786 - DNA, 25 bp, Mus musculus
tcgtattgcgccgctagaggtgaaa

SEQ ID NO: 787 - DNA, 25 bp, Mus musculus
attgcgccgctagaggtgaaattct

SEQ ID NO: 788 - DNA, 25 bp, Mus musculus
gcgcaagacggaccagagcgaaagc

SEQ ID NO: 789 - DNA, 25 bp, Mus musculus
agcatttgccaagaatgttttcatt

SEQ ID NO: 790 - DNA, 25 bp, Mus musculus
agacgatcagataccgtcgtagttc

SEQ ID NO: 791 - DNA, 25 bp, Mus musculus
tcgtagttccgaccataaacgatgc

SEQ ID NO: 792 - DNA, 25 bp, Mus musculus
gaccataaacgatgccgactggcga

SEQ ID NO: 793 - DNA, 25 bp, Mus musculus
acgatgccgactggcgatgcggcgg

SEQ ID NO: 794 - DNA, 25 bp, Mus musculus
cgatgcggcggcgttattcccatga

SEQ ID NO: 795 - DNA, 25 bp, Mus musculus
tgacggaagggcaccaccaggagtg

SEQ ID NO: 796 - DNA, 25 bp, Mus musculus
acagattgatagctctttctcgatt

SEQ ID NO: 797 - DNA, 25 bp, Mus musculus
ggtggtggtgcatggccgttcttag

SEQ ID NO: 798 - DNA, 25 bp, Mus musculus
tgcatggccgttcttagttggtgga

SEQ ID NO: 799 - DNA, 25 bp, Mus musculus
tggtggagcgatttgtctggttaat

SEQ ID NO: 800 - DNA, 25 bp, Mus musculus
taacgaacgagactctggcatgcta

SEQ ID NO: 801 - DNA, 25 bp, Mus musculus
gagactctggcatgctaactagtta

SEQ ID NO: 802 - DNA, 25 bp, Mus musculus
tagagggacaagtggcgttcagcca

SEQ ID NO: 803 - DNA, 25 bp, Mus musculus
agtggcgttcagccacccgagattg

SEQ ID NO: 804 - DNA, 25 bp, Mus musculus
gttcagccacccgagattgagcaat

SEQ ID NO: 805 - DNA, 25 bp, Mus musculus
ttgagcaataacaggtctgtgatgc

SEQ ID NO: 806 - DNA, 25 bp, Mus musculus
taacaggtctgtgatgcccttagat

SEQ ID NO: 807 - DNA, 25 bp, Mus musculus
gtgatgcccttagatgtccggggct

SEQ ID NO: 808 - DNA, 25 bp, Mus musculus
cccttagatgtccggggctgcacgc

SEQ ID NO: 809 - DNA, 25 bp, Mus musculus
gctgcacgcgcgctacactgactgg

SEQ ID NO: 810 - DNA, 25 bp, Mus musculus
cgcgctacactgactggctcagcgt

SEQ ID NO: 811 - DNA, 25 bp, Mus musculus
actggctcagcgtgtgcctaccctg

SEQ ID NO: 812 - DNA, 25 bp, Mus musculus
agcgtgtgcctaccctgcgccggca

SEQ ID NO: 813 - DNA, 25 bp, Mus musculus
ccagtaagtgcgggtcataagcttg

SEQ ID NO: 814 - DNA, 25 bp, Mus musculus
agtgcgggtcataagcttgcgttga

SEQ ID NO: 815 - DNA, 25 bp, Mus musculus
gcttgcgttgattaagtccctgccc

SEQ ID NO: 816 - DNA, 25 bp, Mus musculus
tcgaacttgactatctagaggaagt

SEQ ID NO: 817 - DNA, 25 bp, Mus musculus
gcggtgagatggcttcgccggtaag

SEQ ID NO: 818 - DNA, 25 bp, Mus musculus
gtgagatggcttcgccggtaagagc

SEQ ID NO: 819 - DNA, 25 bp, Mus musculus
gagatggcttcgccggtaagagcac

SEQ ID NO: 820 - DNA, 25 bp, Mus musculus
cgagttcaaacccagcaaccacatg

SEQ ID NO: 821 - DNA, 25 bp, Mus musculus
tcaaacccagcaaccacatggtagc

SEQ ID NO: 822 - DNA, 25 bp, Mus musculus
ccagcaaccacatggtagcttcaac

SEQ ID NO: 823 - DNA, 25 bp, Mus musculus
gcaaccacatggtagcttcaacaac

SEQ ID NO: 824 - DNA, 25 bp, Mus musculus
accacatggtagcttcaacaaccat

SEQ ID NO: 825 - DNA, 25 bp, Mus musculus
catggtagcttcaacaaccatctcg

SEQ ID NO: 826 - DNA, 25 bp, Mus musculus
tggtagcttcaacaaccatctcgta

SEQ ID NO: 827 - DNA, 25 bp, Mus musculus
tagcttcaacaaccatctcgtaaca

SEQ ID NO: 828 - DNA, 25 bp, Mus musculus
aaaatctgatgccctggtctggagt

SEQ ID NO: 829 - DNA, 25 bp, Mus musculus
aatctgatgccctggtctggagtgt

SEQ ID NO: 830 - DNA, 25 bp, Mus musculus
ctgatgccctggtctggagtgtctg

SEQ ID NO: 831 - DNA, 25 bp, Mus musculus
gatgccctggtctggagtgtctgaa

SEQ ID NO: 832 - DNA, 25 bp, Mus musculus
tgccctggtctggagtgtctgaaga

SEQ ID NO: 833 - DNA, 25 bp, Mus musculus
cctggtctggagtgtctgaagacag

SEQ ID NO: 834 - DNA, 25 bp, Mus musculus
ggagtgtctgaagacagctacagtg

SEQ ID NO: 835 - DNA, 25 bp, Mus musculus
gtgtctgaagacagctacagtgtct

SEQ ID NO: 836 - DNA, 25 bp, Mus musculus
gaagacagctacagtgtctaaataa

SEQ ID NO: 837 - DNA, 25 bp, Mus musculus
gacagctacagtgtctaaataaata

SEQ ID NO: 838 - DNA, 25 bp, Mus musculus
ttggggatttagctcagtggtagag

SEQ ID NO: 839 - DNA, 25 bp, Mus musculus
tggggatttagctcagtggtagagc

SEQ ID NO: 840 - DNA, 25 bp, Mus musculus
ggggatttagctcagtggtagagcg

SEQ ID NO: 841 - DNA, 25 bp, Mus musculus
ggatttagctcagtggtagagcgct

SEQ ID NO: 842 - DNA, 25 bp, Mus musculus
gatttagctcagtggtagagcgctt

SEQ ID NO: 843 - DNA, 25 bp, Mus musculus
atttagctcagtggtagagcgcttg

SEQ ID NO: 844 - DNA, 25 bp, Mus musculus
ttagctcagtggtagagcgcttgcc

SEQ ID NO: 845 - DNA, 25 bp, Mus musculus
tagctcagtggtagagcgcttgcct

SEQ ID NO: 846 - DNA, 25 bp, Mus musculus
gctcagtggtagagcgcttgcctag

SEQ ID NO: 847 - DNA, 25 bp, Mus musculus
ctcagtggtagagcgcttgcctagc

SEQ ID NO: 848 - DNA, 25 bp, Mus musculus
tcagtggtagagcgcttgcctagca

SEQ ID NO: 849 - DNA, 25 bp, Mus musculus
agtggtagagcgcttgcctagcaag

SEQ ID NO: 850 - DNA, 25 bp, Mus musculus
gtggtagagcgcttgcctagcaagc

SEQ ID NO: 851 - DNA, 25 bp, Mus musculus
ggtagagcgcttgcctagcaagcgc

SEQ ID NO: 852 - DNA, 25 bp, Mus musculus
cgcttgcctagcaagcgcaaggccc

SEQ ID NO: 853 - DNA, 25 bp, Mus musculus
gcttgcctagcaagcgcaaggccct

SEQ ID NO: 854 - DNA, 25 bp, Mus musculus
ttgcctagcaagcgcaaggccctgg

SEQ ID NO: 855 - DNA, 25 bp, Mus musculus
tgcctagcaagcgcaaggccctggg

SEQ ID NO: 856 - DNA, 25 bp, Mus musculus
ctagcaagcgcaaggccctgggttc

SEQ ID NO: 857 - DNA, 25 bp, Mus musculus
tagcaagcgcaaggccctgggttcg

SEQ ID NO: 858 - DNA, 25 bp, Mus musculus
gccctgggttcggtcctcagctctg

SEQ ID NO: 859 - DNA, 25 bp, Mus musculus
tggtgagatggctcagtgggtaaga

SEQ ID NO: 860 - DNA, 25 bp, Mus musculus
gagatggctcagtgggtaagagcac

SEQ ID NO: 861 - DNA, 25 bp, Mus musculus
cagtgggtaagagcacccgactgct

SEQ ID NO: 862 - DNA, 25 bp, Mus musculus
tgggtaagagcacccgactgctctt

SEQ ID NO: 863 - DNA, 25 bp, Mus musculus
cgactgctcttccgaaggtccagag

SEQ ID NO: 864 - DNA, 25 bp, Mus musculus
ctgctcttccgaaggtccagagttc

SEQ ID NO: 865 - DNA, 25 bp, Mus musculus
ggtccagagttcaaatcccagcaac

SEQ ID NO: 866 - DNA, 25 bp, Mus musculus
tccagagttcaaatcccagcaacca

SEQ ID NO: 867 - DNA, 25 bp, Mus musculus
cagagttcaaatcccagcaaccaca

SEQ ID NO: 868 - DNA, 25 bp, Mus musculus
agttcaaatcccagcaaccacatgg

SEQ ID NO: 869 - DNA, 25 bp, Mus musculus
tcaaatcccagcaaccacatggtgg

SEQ ID NO: 870 - DNA, 25 bp, Mus musculus
aaatcccagcaaccacatggtggct

SEQ ID NO: 871 - DNA, 25 bp, Mus musculus
cagcaaccacatggtggctcacaac

SEQ ID NO: 872 - DNA, 25 bp, Mus musculus
gcaaccacatggtggctcacaacca

SEQ ID NO: 873 - DNA, 25 bp, Mus musculus
aaccacatggtggctcacaaccatc

SEQ ID NO: 874 - DNA, 25 bp, Mus musculus
ctcttctggtgtgtctgaagacagc

SEQ ID NO: 875 - DNA, 25 bp, Mus musculus
cttctggtgtgtctgaagacagcta

SEQ ID NO: 876 - DNA, 25 bp, Mus musculus
gtgtgtctgaagacagctacagtgt

SEQ ID NO: 877 - DNA, 25 bp, Mus musculus
tgtctgaagacagctacagtgtact

SEQ ID NO: 878 - DNA, 25 bp, Mus musculus
acagctacagtgtacttacatataa

SEQ ID NO: 879 - DNA, 25 bp, Mus musculus
agctacagtgtacttacatataata

SEQ ID NO: 880 - DNA, 25 bp, Mus musculus
catctccatatattctattttaacc

SEQ ID NO: 881 - DNA, 25 bp, Mus musculus
tctccatatattctattttaaccgc

SEQ ID NO: 882 - DNA, 25 bp, Mus musculus
ttaagctatcccgtttcagtggcca

SEQ ID NO: 883 - DNA, 25 bp, Mus musculus
gctatcccgtttcagtggccaaaag

SEQ ID NO: 884 - DNA, 25 bp, Mus musculus
tatcccgtttcagtggccaaaagtg

SEQ ID NO: 885 - DNA, 25 bp, Mus musculus
ccgtttcagtggccaaaagtgtgca

SEQ ID NO: 886 - DNA, 25 bp, Mus musculus
ttcctacgccgatcttaccgggatg

SEQ ID NO: 887 - DNA, 25 bp, Mus musculus
tcctacgccgatcttaccgggatgg

SEQ ID NO: 888 - DNA, 25 bp, Mus musculus
tacgccgatcttaccgggatggtgt

SEQ ID NO: 889 - DNA, 25 bp, Mus musculus
cgccgatcttaccgggatggtgtga

SEQ ID NO: 890 - DNA, 25 bp, Mus musculus
cgatcttaccgggatggtgtgagat

SEQ ID NO: 891 - DNA, 25 bp, Mus musculus
gatcttaccgggatggtgtgagatg

SEQ ID NO: 892 - DNA, 25 bp, Mus musculus
catatattctattttaaccgcttgg

SEQ ID NO: 893 - DNA, 25 bp, Mus musculus
atcttaccgggatggtgtgagatgc

SEQ ID NO: 894 - DNA, 25 bp, Mus musculus
taaccgcttgggtatccctttcatg

SEQ ID NO: 895 - DNA, 25 bp, Mus musculus
tttattccatttctatccttaagag

SEQ ID NO: 896 - DNA, 25 bp, Mus musculus
ttattccatttctatccttaagagg

SEQ ID NO: 897 - DNA, 25 bp, Mus musculus
ttccatttctatccttaagaggaag

SEQ ID NO: 898 - DNA, 25 bp, Mus musculus
catttctatccttaagaggaagaga

SEQ ID NO: 899 - DNA, 25 bp, Mus musculus
tttctatccttaagaggaagagact

SEQ ID NO: 900 - DNA, 25 bp, Mus musculus
gaagagactatctcctgaagaggaa

SEQ ID NO: 901 - DNA, 25 bp, Mus musculus
tctcagtgcttcagactgacccttc

SEQ ID NO: 902 - DNA, 25 bp, Mus musculus
caccaccacatttaaacagctgcta

SEQ ID NO: 903 - DNA, 25 bp, Mus musculus
gggaccagcttcattatccaggagg

SEQ ID NO: 904 - DNA, 25 bp, Mus musculus
aagctgtactcaactcatccctagc

SEQ ID NO: 905 - DNA, 25 bp, Mus musculus
gtatttactccaatagtcacacagg

SEQ ID NO: 906 - DNA, 25 bp, Mus musculus
actccaatagtcacacaggagagtt

SEQ ID NO: 907 - DNA, 25 bp, Mus musculus
tttcctagcagcactacggtgtgaa

SEQ ID NO: 908 - DNA, 25 bp, Mus musculus
aactcacacttggcttccttaatgc

SEQ ID NO: 909 - DNA, 25 bp, Mus musculus
cacttggcttccttaatgctctcca

SEQ ID NO: 910 - DNA, 25 bp, Mus musculus
gcttccttaatgctctccaagcaga

SEQ ID NO: 911 - DNA, 25 bp, Mus musculus
ctctccaagcagacaataaagcttc

SEQ ID NO: 912 - DNA, 25 bp, Mus musculus
aagcttctaagatcgcatctaatta

SEQ ID NO: 913 - DNA, 25 bp, Mus musculus
cacatttaaacagctgctaacaaaa

SEQ ID NO: 914 - DNA, 25 bp, Mus musculus
taagatcgcatctaattattctcca

SEQ ID NO: 915 - DNA, 25 bp, Mus musculus
taaacagctgctaacaaaaccagct

SEQ ID NO: 916 - DNA, 25 bp, Mus musculus
accagcttttctgtgacagcaacaa

SEQ ID NO: 917 - DNA, 25 bp, Mus musculus
ttttctgtgacagcaacaagcctag

SEQ ID NO: 918 - DNA, 25 bp, Mus musculus
gtgacagcaacaagcctagctaatc

SEQ ID NO: 919 - DNA, 25 bp, Mus musculus
agcctagctaatcctccagtctaga

SEQ ID NO: 920 - DNA, 25 bp, Mus musculus
gctaatcctccagtctagaagaaaa

SEQ ID NO: 921 - DNA, 25 bp, Mus musculus
tcatttacccagaactaggaagtgg

SEQ ID NO: 922 - DNA, 25 bp, Mus musculus
tgatctacttggccatcatcagctt

SEQ ID NO: 923 - DNA, 25 bp, Mus musculus
ccatcatcagcttctctctgcttag

SEQ ID NO: 924 - DNA, 25 bp, Mus musculus
attctagtacccatagcctacagct

SEQ ID NO: 925 - DNA, 25 bp, Mus musculus
atagcctacagcttttacccatggc

SEQ ID NO: 926 - DNA, 25 bp, Mus musculus
tacagcttttacccatggcccttgt

SEQ ID NO: 927 - DNA, 25 bp, Mus musculus
cccttgttgctcttgaaccagctaa

SEQ ID NO: 928 - DNA, 25 bp, Mus musculus
ttgctcttgaaccagctaactccat

SEQ ID NO: 929 - DNA, 25 bp, Mus musculus
ttgaaccagctaactccatgaagac

SEQ ID NO: 930 - DNA, 25 bp, Mus musculus
ctctagacaacctgaagagccttct

SEQ ID NO: 931 - DNA, 25 bp, Mus musculus
acaacctgaagagccttctttactg

SEQ ID NO: 932 - DNA, 25 bp, Mus musculus
gccttgtatttcacattattgacaa

SEQ ID NO: 933 - DNA, 25 bp, Mus musculus
tatttcacattattgacaataaatt

SEQ ID NO: 934 - DNA, 25 bp, Mus musculus
tcagcttctctctgcttagaagaac

SEQ ID NO: 935 - DNA, 25 bp, Mus musculus
catctgtctgtggcaatgagaagaa

SEQ ID NO: 936 - DNA, 25 bp, Mus musculus
ttcatcctcactgccataaaggtgc

SEQ ID NO: 937 - DNA, 25 bp, Mus musculus
ctcttgttggctttcacttctataa

SEQ ID NO: 938 - DNA, 25 bp, Mus musculus
ttcacttctataaagtccctcactc

SEQ ID NO: 939 - DNA, 25 bp, Mus musculus
ctcactcatgttgcataaacatttt

SEQ ID NO: 940 - DNA, 25 bp, Mus musculus
aaactgaactcaccttcttcctgat

SEQ ID NO: 941 - DNA, 25 bp, Mus musculus
tcctgattccatccactccagaagt

SEQ ID NO: 942 - DNA, 25 bp, Mus musculus
atagctctcagaccattcgtactct

SEQ ID NO: 943 - DNA, 25 bp, Mus musculus
ctcagaccattcgtactctctttac

SEQ ID NO: 944 - DNA, 25 bp, Mus musculus
ctctgctaccttctggcacaatcct

SEQ ID NO: 945 - DNA, 25 bp, Mus musculus
taccttctggcacaatcctcgcaac

SEQ ID NO: 946 - DNA, 25 bp, Mus musculus
ccacttccgctgccaagtgcagttc

SEQ ID NO: 947 - DNA, 25 bp, Mus musculus
gcagttccatgggctttcagaggag

SEQ ID NO: 948 - DNA, 25 bp, Mus musculus
agagggctcacccaaacctgtcaca

SEQ ID NO: 949 - DNA, 25 bp, Mus musculus
tgtcacacagaacatcagtgcagag

SEQ ID NO: 950 - DNA, 25 bp, Mus musculus
acagaacatcagtgcagaggcctgg

SEQ ID NO: 951 - DNA, 25 bp, Mus musculus
catcagtgcagaggcctggggccga

SEQ ID NO: 952 - DNA, 25 bp, Mus musculus
ataagcatcagtcgtgccaatgaaa

SEQ ID NO: 953 - DNA, 25 bp, Mus musculus
atcagtcgtgccaatgaaaaaatgg

SEQ ID NO: 954 - DNA, 25 bp, Mus musculus
ggtctccttgtttgagccatcaaaa

SEQ ID NO: 955 - DNA, 25 bp, Mus musculus
gtgcttggccaggggcttcttccct

SEQ ID NO: 956 - DNA, 25 bp, Mus musculus
ccacagtggggtcagcacggaccct

SEQ ID NO: 957 - DNA, 25 bp, Mus musculus
cagcacggaccctcaggcctacaag

SEQ ID NO: 958 - DNA, 25 bp, Mus musculus
caattatagctactgcctgagcagc

SEQ ID NO: 959 - DNA, 25 bp, Mus musculus
tagctactgcctgagcagccgcctg

SEQ ID NO: 960 - DNA, 25 bp, Mus musculus
ctgcctgagcagccgcctgagggtc

SEQ ID NO: 961 - DNA, 25 bp, Mus musculus
ccgcctgagggtctctgctaccttc

SEQ ID NO: 962 - DNA, 25 bp, Mus musculus
ttctcctggaacaaaacacatgaag

SEQ ID NO: 963 - DNA, 25 bp, Mus musculus
ggctgcagtcacccaaagcccaaga

SEQ ID NO: 964 - DNA, 25 bp, Mus musculus
agatatccctgatggatacaaggcc

SEQ ID NO: 965 - DNA, 25 bp, Mus musculus
caaggcctccagaccaagccaagag

SEQ ID NO: 966 - DNA, 25 bp, Mus musculus
ggcctccagaccaagccaagagaac

SEQ ID NO: 967 - DNA, 25 bp, Mus musculus
ctccagaccaagccaagagaacttc

SEQ ID NO: 968 - DNA, 25 bp, Mus musculus
ccaagagaacttctccctcattctg

SEQ ID NO: 969 - DNA, 25 bp, Mus musculus
ctccctcattctggagttggctacc

SEQ ID NO: 970 - DNA, 25 bp, Mus musculus
tcagacatcagtgtacttctgtgcc

SEQ ID NO: 971 - DNA, 25 bp, Mus musculus
gacatcagtgtacttctgtgccagc

SEQ ID NO: 972 - DNA, 25 bp, Mus musculus
atcagtgtacttctgtgccagcggt

SEQ ID NO: 973 - DNA, 25 bp, Mus musculus
gtacttctgtgccagcggtgaatcg

SEQ ID NO: 974 - DNA, 25 bp, Mus musculus
tcagactaataaccacaacaacatg

SEQ ID NO: 975 - DNA, 25 bp, Mus musculus
gactaataaccacaacaacatgtac

SEQ ID NO: 976 - DNA, 25 bp, Mus musculus
taataaccacaacaacatgtactgg

SEQ ID NO: 977 - DNA, 25 bp, Mus musculus
ccacaacaacatgtactggtatcgg

SEQ ID NO: 978 - DNA, 25 bp, Mus musculus
caacatgtactggtatcggcaggac

SEQ ID NO: 979 - DNA, 25 bp, Mus musculus
gctgatccattattcatatggtgct

SEQ ID NO: 980 - DNA, 25 bp, Mus musculus
gatccattattcatatggtgctggc

SEQ ID NO: 981 - DNA, 25 bp, Mus musculus
ccattattcatatggtgctggcagc

SEQ ID NO: 982 - DNA, 25 bp, Mus musculus
cctgtctgtgactccaggaaatagc

SEQ ID NO: 983 - DNA, 25 bp, Mus musculus
tctttcctgcagggccagccaaagt

SEQ ID NO: 984 - DNA, 25 bp, Mus musculus
tctcatcaagtatgcttcccagtcc

SEQ ID NO: 985 - DNA, 25 bp, Mus musculus
caagtatgcttcccagtccatctct

SEQ ID NO: 986 - DNA, 25 bp, Mus musculus
gtatgcttcccagtccatctctggg

SEQ ID NO: 987 - DNA, 25 bp, Mus musculus
tgcttcccagtccatctctgggatc

SEQ ID NO: 988 - DNA, 25 bp, Mus musculus
gacagatttcactctcagtatcaac

SEQ ID NO: 989 - DNA, 25 bp, Mus musculus
agatttcactctcagtatcaacagt

SEQ ID NO: 990 - DNA, 25 bp, Mus musculus
tttcactctcagtatcaacagtgtg

SEQ ID NO: 991 - DNA, 25 bp, Mus musculus
aatgtatttctgtcaacagagtaac

SEQ ID NO: 992 - DNA, 25 bp, Mus musculus
gtatttctgtcaacagagtaacagc

SEQ ID NO: 993 - DNA, 25 bp, Mus musculus
gagtaacagctggccgtacacgttc

SEQ ID NO: 994 - DNA, 25 bp, Mus musculus
ttcctgcagggccagccaaagtatt

SEQ ID NO: 995 - DNA, 25 bp, Mus musculus
tattggcaacaacctacactggtat

SEQ ID NO: 996 - DNA, 25 bp, Mus musculus
tggcaacaacctacactggtatcaa

SEQ ID NO: 997 - DNA, 25 bp, Mus musculus
caacaacctacactggtatcaacaa

SEQ ID NO: 998 - DNA, 25 bp, Mus musculus
acatgagtctccaaggcttctcatc

SEQ ID NO: 999 - DNA, 25 bp, Mus musculus
tgagtctccaaggcttctcatcaag

SEQ ID NO: 1000 - DNA, 25 bp, Mus musculus
aaggcttctcatcaagtatgcttcc

SEQ ID NO: 1001 - DNA, 25 bp, Mus musculus
gcttctcatcaagtatgcttcccag

SEQ ID NO: 1002 - DNA, 25 bp, Mus musculus
agcactttccgctcagtcagtgaac

SEQ ID NO: 1003 - DNA, 25 bp, Mus musculus
ttccgctcagtcagtgaacttccca

SEQ ID NO: 1004 - DNA, 25 bp, Mus musculus
actacaagaacactcagcccatcat

SEQ ID NO: 1005 - DNA, 25 bp, Mus musculus
cagatggctcttacttcgtctacag

SEQ ID NO: 1006 - DNA, 25 bp, Mus musculus
tctacagcaagctcaatgtgcagaa

SEQ ID NO: 1007 - DNA, 25 bp, Mus musculus
gaaatactttcacctgctctgtgtt

SEQ ID NO: 1008 - DNA, 25 bp, Mus musculus
ctttcacctgctctgtgttacatga

SEQ ID NO: 1009 - DNA, 25 bp, Mus musculus
ctgtgttacatgagggcctgcacaa

SEQ ID NO: 1010 - DNA, 25 bp, Mus musculus
cccactctcctggtaaatgatctca

SEQ ID NO: 1011 - DNA, 25 bp, Mus musculus
gatctcagtgtccttggagccctct

SEQ ID NO: 1012 - DNA, 25 bp, Mus musculus
agtgtccttggagccctctggtcct

SEQ ID NO: 1013 - DNA, 25 bp, Mus musculus
tggtcctacaggactctgacaccta

SEQ ID NO: 1014 - DNA, 25 bp, Mus musculus
cttcccatcatgcaccaggactggc

SEQ ID NO: 1015 - DNA, 25 bp, Mus musculus
aaggcaggcccacaggcagaccgaa

SEQ ID NO: 1016 - DNA, 25 bp, Mus musculus
ggcccacaggcagaccgaaggctcc

SEQ ID NO: 1017 - DNA, 25 bp, Mus musculus
gaccgaaggctccacaggtgtacac

SEQ ID NO: 1018 - DNA, 25 bp, Mus musculus
tgataacagacttcttccctgaaga

SEQ ID NO: 1019 - DNA, 25 bp, Mus musculus
cagacttcttccctgaagacattac

SEQ ID NO: 1020 - DNA, 25 bp, Mus musculus
tcttccctgaagacattactgtgga

SEQ ID NO: 1021 - DNA, 25 bp, Mus musculus
acattactgtggagtggcagtggaa

SEQ ID NO: 1022 - DNA, 25 bp, Mus musculus
tacccgccatccgatggtctctttt

SEQ ID NO: 1023 - DNA, 25 bp, Mus musculus
ccatccgatggtctcttttcaccct

SEQ ID NO: 1024 - DNA, 25 bp, Mus musculus
gtcttttgctcggcgtctccagcgc

SEQ ID NO: 1025 - DNA, 25 bp, Mus musculus
cctcatagaggccctgaagatgaga

SEQ ID NO: 1026 - DNA, 25 bp, Mus musculus
gatgagaacttaccctatgaaacat

SEQ ID NO: 1027 - DNA, 25 bp, Mus musculus
tcctcccagtacagtggacaaggaa

SEQ ID NO: 1028 - DNA, 25 bp, Mus musculus
tgtacactcgaggacatgaacttct

SEQ ID NO: 1029 - DNA, 25 bp, Mus musculus
gacatgaacttctgttttcttcaac

SEQ ID NO: 1030 - DNA, 25 bp, Mus musculus
cttcctccaatcaaatttacatcct

SEQ ID NO: 1031 - DNA, 25 bp, Mus musculus
ccaatcaaatttacatcctccctgc

SEQ ID NO: 1032 - DNA, 25 bp, Mus musculus
aaatttacatcctccctgctcagct

SEQ ID NO: 1033 - DNA, 25 bp, Mus musculus
tccctgctcagctccaataaaatgg

SEQ ID NO: 1034 - DNA, 25 bp, Mus musculus
gccttctcgaccgctttacctgcga

SEQ ID NO: 1035 - DNA, 25 bp, Mus musculus
gctttacctgcgaccactacggcct

SEQ ID NO: 1036 - DNA, 25 bp, Mus musculus
ccagcctgcatcctttaccattgct

SEQ ID NO: 1037 - DNA, 25 bp, Mus musculus
tgcatcctttaccattgctacacaa

SEQ ID NO: 1038 - DNA, 25 bp, Mus musculus
ctttaccattgctacacaacacatg

SEQ ID NO: 1039 - DNA, 25 bp, Mus musculus
cattgctacacaacacatgaggcac

SEQ ID NO: 1040 - DNA, 25 bp, Mus musculus
acacatgaggcaccgcacaacgctg

SEQ ID NO: 1041 - DNA, 25 bp, Mus musculus
ccgcacaacgctgtcttttgctcgg

SEQ ID NO: 1042 - DNA, 25 bp, Mus musculus
acacgtctggtctcctgctagagtt

SEQ ID NO: 1043 - DNA, 25 bp, Mus musculus
ctggtctcctgctagagttctacag

SEQ ID NO: 1044 - DNA, 25 bp, Mus musculus
tgtgccatgtacgtatgcaagtctg

SEQ ID NO: 1045 - DNA, 25 bp, Mus musculus
gtacttgtgcatgcatgaatacata

SEQ ID NO: 1046 - DNA, 25 bp, Mus musculus
tctttctacattaaacccagttgct

SEQ ID NO: 1047 - DNA, 25 bp, Mus musculus
agttgcttacggtggatccacatgt

SEQ ID NO: 1048 - DNA, 25 bp, Mus musculus
tggatccacatgtaaactgtttggg

SEQ ID NO: 1049 - DNA, 25 bp, Mus musculus
cgtttcttactctcaatttgtgctc

SEQ ID NO: 1050 - DNA, 25 bp, Mus musculus
ttactctcaatttgtgctcccagga

SEQ ID NO: 1051 - DNA, 25 bp, Mus musculus
tcaatttgtgctcccaggagtgtag

SEQ ID NO: 1052 - DNA, 25 bp, Mus musculus
tgtgctcccaggagtgtagttagac

SEQ ID NO: 1053 - DNA, 25 bp, Mus musculus
agctaggactctatgtgtggtgtag

SEQ ID NO: 1054 - DNA, 25 bp, Mus musculus
tcctgctagagttctacagctgttg

SEQ ID NO: 1055 - DNA, 25 bp, Mus musculus
tagagttctacagctgttgtcagca

SEQ ID NO: 1056 - DNA, 25 bp, Mus musculus
gctgttgtcagcacatcgaaatgac

SEQ ID NO: 1057 - DNA, 25 bp, Mus musculus
acatcgaaatgactctggcagaagt

SEQ ID NO: 1058 - DNA, 25 bp, Mus musculus
aaatgactctggcagaagtacttaa

SEQ ID NO: 1059 - DNA, 25 bp, Mus musculus
gtcaacatcccagcatgtgggccag

SEQ ID NO: 1060 - DNA, 25 bp, Mus musculus
atcccagcatgtgggccaggcataa

SEQ ID NO: 1061 - DNA, 25 bp, Mus musculus
agtgcgcgcccacaagcatgtgcca

SEQ ID NO: 1062 - DNA, 25 bp, Mus musculus
aacacaagtctcacctcaaggacca

SEQ ID NO: 1063 - DNA, 25 bp, Mus musculus
agtctcacctcaaggaccacgagag

SEQ ID NO: 1064 - DNA, 25 bp, Mus musculus
acacctttgaccgctttgtggcaat

SEQ ID NO: 1065 - DNA, 25 bp, Mus musculus
tttacagcgttgtgctggctggacc

SEQ ID NO: 1066 - DNA, 25 bp, Mus musculus
gcgttgtgctggctggacctaagac

SEQ ID NO: 1067 - DNA, 25 bp, Mus musculus
cagtgcgcactccggttaggtgatt

SEQ ID NO: 1068 - DNA, 25 bp, Mus musculus
gcactccggttaggtgattctcaaa

SEQ ID NO: 1069 - DNA, 25 bp, Mus musculus
tctcaaatttctcaaggcagttatg

SEQ ID NO: 1070 - DNA, 25 bp, Mus musculus
atttctcaaggcagttatgttccta

SEQ ID NO: 1071 - DNA, 25 bp, Mus musculus
gtctagtattcatattcccatgaag

SEQ ID NO: 1072 - DNA, 25 bp, Mus musculus
tattcatattcccatgaagctcccc

SEQ ID NO: 1073 - DNA, 25 bp, Mus musculus
ttaatttgaaatctcctttgtctgg

SEQ ID NO: 1074 - DNA, 25 bp, Mus musculus
acctcaaggaccacgagagaagaca

SEQ ID NO: 1075 - DNA, 25 bp, Mus musculus
ccaaggccttcgccaaggcctcaga

SEQ ID NO: 1076 - DNA, 25 bp, Mus musculus
cctcagacctgaagaggcatgagaa

SEQ ID NO: 1077 - DNA, 25 bp, Mus musculus
acaatatgcacagtgagaggaaaca

SEQ ID NO: 1078 - DNA, 25 bp, Mus musculus
tggccgctgaggctgagcagcagct

SEQ ID NO: 1079 - DNA, 25 bp, Mus musculus
caattgcctgtagctagaggtgatg

SEQ ID NO: 1080 - DNA, 25 bp, Mus musculus
gattgcattggctgtagtcagtgaa

SEQ ID NO: 1081 - DNA, 25 bp, Mus musculus
cagtgaacacctttgaccgctttgt

SEQ ID NO: 1082 - DNA, 25 bp, Mus musculus
taacaaacaccaagtatgactcagc

SEQ ID NO: 1083 - DNA, 25 bp, Mus musculus
acaccaagtatgactcagcagctgc

SEQ ID NO: 1084 - DNA, 25 bp, Mus musculus
aaccattccatgcatgttgatagta

SEQ ID NO: 1085 - DNA, 25 bp, Mus musculus
gacagagcaaaccaagccaaggctc

SEQ ID NO: 1086 - DNA, 25 bp, Mus musculus
ctcatctccgactgtttgtgaggtc

SEQ ID NO: 1087 - DNA, 25 bp, Mus musculus
ccttcatcatgggtcctttcatgta

SEQ ID NO: 1088 - DNA, 25 bp, Mus musculus
gtcctttcatgtatttgcaatgtca

SEQ ID NO: 1089 - DNA, 25 bp, Mus musculus
atatgaaagcatcctttcagctgtg

SEQ ID NO: 1090 - DNA, 25 bp, Mus musculus
aagcatcctttcagctgtgtctgct

SEQ ID NO: 1091 - DNA, 25 bp, Mus musculus
agctgtgtctgcttcagggaaacat

SEQ ID NO: 1092 - DNA, 25 bp, Mus musculus
ttctttcatgtgtttgcttcagcaa

SEQ ID NO: 1093 - DNA, 25 bp, Mus musculus
tttgcttcagcaagacatcatttca

SEQ ID NO: 1094 - DNA, 25 bp, Mus musculus
agtatgactcagcagctgcagacca

SEQ ID NO: 1095 - DNA, 25 bp, Mus musculus
actcagcagctgcagaccagtcctc

SEQ ID NO: 1096 - DNA, 25 bp, Mus musculus
cagaccagtcctctaggcaggcaga

SEQ ID NO: 1097 - DNA, 25 bp, Mus musculus
agtcctctaggcaggcagacaccac

SEQ ID NO: 1098 - DNA, 25 bp, Mus musculus
aggcagacaccacatacaaccagca

SEQ ID NO: 1099 - DNA, 25 bp, Mus musculus
catacaaccagcagctatagtccag

SEQ ID NO: 1100 - DNA, 25 bp, Mus musculus
atgaaagcttgccatctagcctgag

SEQ ID NO: 1101 - DNA, 25 bp, Mus musculus
agctcaaccatgctatgtaaggcaa

SEQ ID NO: 1102 - DNA, 25 bp, Mus musculus
ctcagagtgctcgatacagtgactt

SEQ ID NO: 1103 - DNA, 25 bp, Mus musculus
taaccgtctgtacttcttcagcgat

SEQ ID NO: 1104 - DNA, 25 bp, Mus musculus
tcagtacttaccctgagacctccga

SEQ ID NO: 1105 - DNA, 25 bp, Mus musculus
ctgagacctccgaaaaccaggatct

SEQ ID NO: 1106 - DNA, 25 bp, Mus musculus
ttagctatgcttacactaacacact

SEQ ID NO: 1107 - DNA, 25 bp, Mus musculus
atgcttacactaacacactcgttac

SEQ ID NO: 1108 - DNA, 25 bp, Mus musculus
acacactcgttacagctgttcttga

SEQ ID NO: 1109 - DNA, 25 bp, Mus musculus
cagctgttcttgaccgcttgaatca

SEQ ID NO: 1110 - DNA, 25 bp, Mus musculus
ttcttgaccgcttgaatcagtatga

SEQ ID NO: 1111 - DNA, 25 bp, Mus musculus
agatcatcaatgttaagctgtcctt

SEQ ID NO: 1112 - DNA, 25 bp, Mus musculus
ttaagctgtcctttgtatggctgat

SEQ ID NO: 1113 - DNA, 25 bp, Mus musculus
tgtcctttgtatggctgattataca

SEQ ID NO: 1114 - DNA, 25 bp, Mus musculus
tctgtacttcttcagcgatctataa

SEQ ID NO: 1115 - DNA, 25 bp, Mus musculus
cttcttcagcgatctataacattca

SEQ ID NO: 1116 - DNA, 25 bp, Mus musculus
acattcaatctcaagaaatgtttat

SEQ ID NO: 1117 - DNA, 25 bp, Mus musculus
taacagacatcaaagcctttggtac

SEQ ID NO: 1118 - DNA, 25 bp, Mus musculus
acatcaaagcctttggtacagataa

SEQ ID NO: 1119 - DNA, 25 bp, Mus musculus
atcttgccattactcacatcagtac

SEQ ID NO: 1120 - DNA, 25 bp, Mus musculus
ccattactcacatcagtacttaccc

SEQ ID NO: 1121 - DNA, 25 bp, Mus musculus
ctcacatcagtacttaccctgagac

SEQ ID NO: 1122 - DNA, 25 bp, Mus musculus
tcggatccatgccaggagatcagga

SEQ ID NO: 1123 - DNA, 25 bp, Mus musculus
gatccatgccaggagatcaggagtg

SEQ ID NO: 1124 - DNA, 25 bp, Mus musculus
atcctggggctgatgacacccacag

SEQ ID NO: 1125 - DNA, 25 bp, Mus musculus
atgacacccacagtgctgtatgacg

SEQ ID NO: 1126 - DNA, 25 bp, Mus musculus
cccacagtgctgtatgacgtacagg

SEQ ID NO: 1127 - DNA, 25 bp, Mus musculus
gagatcctggcctctcgtacccctg

SEQ ID NO: 1128 - DNA, 25 bp, Mus musculus
tctcgtacccctgaggagatccgtc

SEQ ID NO: 1129 - DNA, 25 bp, Mus musculus
cgtcgaatcaaccagacataccagc

SEQ ID NO: 1130 - DNA, 25 bp, Mus musculus
cgaatcaaccagacataccagcagc

SEQ ID NO: 1131 - DNA, 25 bp, Mus musculus
atcaaccagacataccagcagcaat

SEQ ID NO: 1132 - DNA, 25 bp, Mus musculus
aaccagacataccagcagcaatatg

SEQ ID NO: 1133 - DNA, 25 bp, Mus musculus
cagacataccagcagcaatatggaa

SEQ ID NO: 1134 - DNA, 25 bp, Mus musculus
ccatgccaggagatcaggagtgcct

SEQ ID NO: 1135 - DNA, 25 bp, Mus musculus
atcaggagtgcctacaagagcacca

SEQ ID NO: 1136 - DNA, 25 bp, Mus musculus
gcctacaagagcaccattggcaggg

SEQ ID NO: 1137 - DNA, 25 bp, Mus musculus
tacaagagcaccattggcagggacc

SEQ ID NO: 1138 - DNA, 25 bp, Mus musculus
agcaccattggcagggacctgattg

SEQ ID NO: 1139 - DNA, 25 bp, Mus musculus
accattggcagggacctgattgagg

SEQ ID NO: 1140 - DNA, 25 bp, Mus musculus
agcagcaactttgagcaggtgatcc

SEQ ID NO: 1141 - DNA, 25 bp, Mus musculus
gtgatcctggggctgatgacaccca

SEQ ID NO: 1142 - DNA, 25 bp, Mus musculus
agtggctttctctatgttccagaag

SEQ ID NO: 1143 - DNA, 25 bp, Mus musculus
ctctatgttccagaagccatatttg

SEQ ID NO: 1144 - DNA, 25 bp, Mus musculus
tgacaatgcgtgctcgaagctgcag

SEQ ID NO: 1145 - DNA, 25 bp, Mus musculus
ctcgaagctgcagctgctgcctcta

SEQ ID NO: 1146 - DNA, 25 bp, Mus musculus
gctgcagctgctgcctctaatgcgt

SEQ ID NO: 1147 - DNA, 25 bp, Mus musculus
gcagctgctgcctctaatgcgtcac

SEQ ID NO: 1148 - DNA, 25 bp, Mus musculus
gctgctgcctctaatgcgtcacagt

SEQ ID NO: 1149 - DNA, 25 bp, Mus musculus
gcctctaatgcgtcacagtaagata

SEQ ID NO: 1150 - DNA, 25 bp, Mus musculus
tctaatgcgtcacagtaagataacc

SEQ ID NO: 1151 - DNA, 25 bp, Mus musculus
atttcttattgctatgccatttcac

SEQ ID NO: 1152 - DNA, 25 bp, Mus musculus
tcttattgctatgccatttcacagg

SEQ ID NO: 1153 - DNA, 25 bp, Mus musculus
tattgctatgccatttcacaggatc

SEQ ID NO: 1154 - DNA, 25 bp, Mus musculus
tatgttccagaagccatatttgatt

SEQ ID NO: 1155 - DNA, 25 bp, Mus musculus
tatgccatttcacaggatcgtgctg

SEQ ID NO: 1156 - DNA, 25 bp, Mus musculus
tgtgcagagggcctttgtgttttat

SEQ ID NO: 1157 - DNA, 25 bp, Mus musculus
tgcctggcccagtgcctgtcagaca

SEQ ID NO: 1158 - DNA, 25 bp, Mus musculus
gcccagtgcctgtcagacagtaggc

SEQ ID NO: 1159 - DNA, 25 bp, Mus musculus
cagtctgaagtccacacctgacaat

SEQ ID NO: 1160 - DNA, 25 bp, Mus musculus
tctgaagtccacacctgacaatgcg

SEQ ID NO: 1161 - DNA, 25 bp, Mus musculus
gaagtccacacctgacaatgcgtgc

SEQ ID NO: 1162 - DNA, 25 bp, Mus musculus
acctgacaatgcgtgctcgaagctg

SEQ ID NO: 1163 - DNA, 25 bp, Mus musculus
tggaaaccgcacaaacccagaagag

SEQ ID NO: 1164 - DNA, 25 bp, Mus musculus
cacaaacccagaagagtacgcaggg

SEQ ID NO: 1165 - DNA, 25 bp, Mus musculus
ggcccagtgccacacatctggagga

SEQ ID NO: 1166 - DNA, 25 bp, Mus musculus
gcccagtgccacacatctggaggat

SEQ ID NO: 1167 - DNA, 25 bp, Mus musculus
ccagtgccacacatctggaggatga

SEQ ID NO: 1168 - DNA, 25 bp, Mus musculus
cagtgccacacatctggaggatgag

SEQ ID NO: 1169 - DNA, 25 bp, Mus musculus
gtgccacacatctggaggatgagga

SEQ ID NO: 1170 - DNA, 25 bp, Mus musculus
ccacacatctggaggatgaggaagg

SEQ ID NO: 1171 - DNA, 25 bp, Mus musculus
cacacatctggaggatgaggaaggt

SEQ ID NO: 1172 - DNA, 25 bp, Mus musculus
aaggtgtcaggcactgatggccaaa

SEQ ID NO: 1173 - DNA, 25 bp, Mus musculus
gtgtcaggcactgatggccaaatgg

SEQ ID NO: 1174 - DNA, 25 bp, Mus musculus
tgtcaggcactgatggccaaatggg

SEQ ID NO: 1175 - DNA, 25 bp, Mus musculus
aagagtacgcagggcccaagactgc

SEQ ID NO: 1176 - DNA, 25 bp, Mus musculus
caggcactgatggccaaatgggata

SEQ ID NO: 1177 - DNA, 25 bp, Mus musculus
agtacgcagggcccaagactgctga

SEQ ID NO: 1178 - DNA, 25 bp, Mus musculus
gtacgcagggcccaagactgctgag

SEQ ID NO: 1179 - DNA, 25 bp, Mus musculus
acgcagggcccaagactgctgaggg

SEQ ID NO: 1180 - DNA, 25 bp, Mus musculus
cagggcccaagactgctgagggcat

SEQ ID NO: 1181 - DNA, 25 bp, Mus musculus
agggcccaagactgctgagggcatt

SEQ ID NO: 1182 - DNA, 25 bp, Mus musculus
gcccaagactgctgagggcattgct

SEQ ID NO: 1183 - DNA, 25 bp, Mus musculus
ctgctgagggcattgctgagtggct

SEQ ID NO: 1184 - DNA, 25 bp, Mus musculus
ttctggcgttcaagcaggattccat

SEQ ID NO: 1185 - DNA, 25 bp, Mus musculus
cgttcaagcaggattccattctgta

SEQ ID NO: 1186 - DNA, 25 bp, Mus musculus
tggtctcagtgtcatctcttaaaga

SEQ ID NO: 1187 - DNA, 25 bp, Mus musculus
cagtgtcatctcttaaagagattga

SEQ ID NO: 1188 - DNA, 25 bp, Mus musculus
agttccaatctgggaaacatgcaaa

SEQ ID NO: 1189 - DNA, 25 bp, Mus musculus
taaatgacatttcacgacttttgag

SEQ ID NO: 1190 - DNA, 25 bp, Mus musculus
acatttcacgacttttgagtatgaa

SEQ ID NO: 1191 - DNA, 25 bp, Mus musculus
actttgtatctattactttcacctg

SEQ ID NO: 1192 - DNA, 25 bp, Mus musculus
tatctattactttcacctgatctca

SEQ ID NO: 1193 - DNA, 25 bp, Mus musculus
ttactttcacctgatctcatattta

SEQ ID NO: 1194 - DNA, 25 bp, Mus musculus
tttaaatcacaattttgtcatagtt

SEQ ID NO: 1195 - DNA, 25 bp, Mus musculus
ttgatctcaaaggcacaaaacatga

SEQ ID NO: 1196 - DNA, 25 bp, Mus musculus
agcaggattccattctgtaaatacc

SEQ ID NO: 1197 - DNA, 25 bp, Mus musculus
attccattctgtaaatacctgtaat

SEQ ID NO: 1198 - DNA, 25 bp, Mus musculus
tgtagtctgttctgcatccatacta

SEQ ID NO: 1199 - DNA, 25 bp, Mus musculus
ctgttctgcatccatactacattat

SEQ ID NO: 1200 - DNA, 25 bp, Mus musculus
tgcatccatactacattattgctat

SEQ ID NO: 1201 - DNA, 25 bp, Mus musculus
catactacattattgctatggtctc

SEQ ID NO: 1202 - DNA, 25 bp, Mus musculus
acattattgctatggtctcagtgtc

SEQ ID NO: 1203 - DNA, 25 bp, Mus musculus
ttgctatggtctcagtgtcatctct

SEQ ID NO: 1204 - DNA, 25 bp, Mus musculus
ttcgctgctatggttttagcctgta

SEQ ID NO: 1205 - DNA, 25 bp, Mus musculus
gctgctatggttttagcctgtaggt

SEQ ID NO: 1206 - DNA, 25 bp, Mus musculus
gcgtttttctgacttggaagaacat

SEQ ID NO: 1207 - DNA, 25 bp, Mus musculus
tttttctgacttggaagaacattct

SEQ ID NO: 1208 - DNA, 25 bp, Mus musculus
acattctctgtaggtttctaagtgt

SEQ ID NO: 1209 - DNA, 25 bp, Mus musculus
tacagagccggaactgcctcgtggt

SEQ ID NO: 1210 - DNA, 25 bp, Mus musculus
actgcctcgtggttcctgggcttca

SEQ ID NO: 1211 - DNA, 25 bp, Mus musculus
gcctcgtggttcctgggcttcaggg

SEQ ID NO: 1212 - DNA, 25 bp, Mus musculus
tcgtggttcctgggcttcagggaag

SEQ ID NO: 1213 - DNA, 25 bp, Mus musculus
cagccagtttctgccttgagagcat

SEQ ID NO: 1214 - DNA, 25 bp, Mus musculus
ccagtttctgccttgagagcatttg

SEQ ID NO: 1215 - DNA, 25 bp, Mus musculus
gtttctgccttgagagcatttgcaa

SEQ ID NO: 1216 - DNA, 25 bp, Mus musculus
atggttttagcctgtaggtcatgct

SEQ ID NO: 1217 - DNA, 25 bp, Mus musculus
ttgcaagaatgctggccttgaattc

SEQ ID NO: 1218 - DNA, 25 bp, Mus musculus
ttagcctgtaggtcatgctgctagc

SEQ ID NO: 1219 - DNA, 25 bp, Mus musculus
tagctagtgtcagggggcaatagag

SEQ ID NO: 1220 - DNA, 25 bp, Mus musculus
ctatgcactagtattccagactttt

SEQ ID NO: 1221 - DNA, 25 bp, Mus musculus
tgcactagtattccagactttttta

SEQ ID NO: 1222 - DNA, 25 bp, Mus musculus
ttttgagttcagcctgaatgttcat

SEQ ID NO: 1223 - DNA, 25 bp, Mus musculus
gttcagcctgaatgttcatccgttt

SEQ ID NO: 1224 - DNA, 25 bp, Mus musculus
cagcctgaatgttcatccgtttggg

SEQ ID NO: 1225 - DNA, 25 bp, Mus musculus
aatttgcagaaacactctgaaagac

SEQ ID NO: 1226 - DNA, 25 bp, Mus musculus
atttgcagaaacactctgaaagacc

SEQ ID NO: 1227 - DNA, 25 bp, Mus musculus
ctgaaagacccaccatcaggtttag

SEQ ID NO: 1228 - DNA, 25 bp, Mus musculus
tgaaagacccaccatcaggtttagc

SEQ ID NO: 1229 - DNA, 25 bp, Mus musculus
gaaagacccaccatcaggtttagca

SEQ ID NO: 1230 - DNA, 25 bp, Mus musculus
aagacccaccatcaggtttagcaag

SEQ ID NO: 1231 - DNA, 25 bp, Mus musculus
agacccaccatcaggtttagcaagc

SEQ ID NO: 1232 - DNA, 25 bp, Mus musculus
gacccaccatcaggtttagcaagct

SEQ ID NO: 1233 - DNA, 25 bp, Mus musculus
acccaccatcaggtttagcaagcta

SEQ ID NO: 1234 - DNA, 25 bp, Mus musculus
cccaccatcaggtttagcaagctag

SEQ ID NO: 1235 - DNA, 25 bp, Mus musculus
tttgcagaaacactctgaaagaccc

SEQ ID NO: 1236 - DNA, 25 bp, Mus musculus
gaaacactctgaaagacccaccatc

SEQ ID NO: 1237 - DNA, 25 bp, Mus musculus
aacactctgaaagacccaccatcag

SEQ ID NO: 1238 - DNA, 25 bp, Mus musculus
acactctgaaagacccaccatcagg

SEQ ID NO: 1239 - DNA, 25 bp, Mus musculus
cactctgaaagacccaccatcaggt

SEQ ID NO: 1240 - DNA, 25 bp, Mus musculus
actctgaaagacccaccatcaggtt

SEQ ID NO: 1241 - DNA, 25 bp, Mus musculus
ctctgaaagacccaccatcaggttt

SEQ ID NO: 1242 - DNA, 25 bp, Mus musculus
tctgaaagacccaccatcaggttta

SEQ ID NO: 1243 - DNA, 25 bp, Mus musculus
gtgttcgatccagccgagcagtaca

SEQ ID NO: 1244 - DNA, 25 bp, Mus musculus
ttcgatccagccgagcagtacaaga

SEQ ID NO: 1245 - DNA, 25 bp, Mus musculus
accaacgcagacagagacaacctga

SEQ ID NO: 1246 - DNA, 25 bp, Mus musculus
gacagagacaacctgactcgcaggt

SEQ ID NO: 1247 - DNA, 25 bp, Mus musculus
ctgactcgcaggttttcagatctag

SEQ ID NO: 1248 - DNA, 25 bp, Mus musculus
actcgcaggttttcagatctaggat

SEQ ID NO: 1249 - DNA, 25 bp, Mus musculus
aaatgctttaacgacctcagagcag

SEQ ID NO: 1250 - DNA, 25 bp, Mus musculus
aacgacctcagagcagaagaactcc

SEQ ID NO: 1251 - DNA, 25 bp, Mus musculus
gcagaagaactcctgctcaaaattc

SEQ ID NO: 1252 - DNA, 25 bp, Mus musculus
gaagaactcctgctcaaaattcacg

SEQ ID NO: 1253 - DNA, 25 bp, Mus musculus
gaactcctgctcaaaattcacgagg

SEQ ID NO: 1254 - DNA, 25 bp, Mus musculus
ctcctgctcaaaattcacgaggtgt

SEQ ID NO: 1255 - DNA, 25 bp, Mus musculus
gatccagccgagcagtacaagatgg

SEQ ID NO: 1256 - DNA, 25 bp, Mus musculus
gtgtcgacttcaagccacatagatg

SEQ ID NO: 1257 - DNA, 25 bp, Mus musculus
ggagttgccctcatcttcaatcacg

SEQ ID NO: 1258 - DNA, 25 bp, Mus musculus
gttgccctcatcttcaatcacgaga

SEQ ID NO: 1259 - DNA, 25 bp, Mus musculus
gccctcatcttcaatcacgagaggt

SEQ ID NO: 1260 - DNA, 25 bp, Mus musculus
atcttcaatcacgagaggttctttt

SEQ ID NO: 1261 - DNA, 25 bp, Mus musculus
ttcaatcacgagaggttcttttggc

SEQ ID NO: 1262 - DNA, 25 bp, Mus musculus
cggggcaccaacgcagacagagaca

SEQ ID NO: 1263 - DNA, 25 bp, Mus musculus
ggcaccaacgcagacagagacaacc

SEQ ID NO: 1264 - DNA, 25 bp, Mus musculus
cttgtcgccttagcaccatggaagc

SEQ ID NO: 1265 - DNA, 25 bp, Mus musculus
ttgtcgccttagcaccatggaagcc

SEQ ID NO: 1266 - DNA, 25 bp, Mus musculus
tagcaccatggaagccaccaagcaa

SEQ ID NO: 1267 - DNA, 25 bp, Mus musculus
agcaccatggaagccaccaagcaag

SEQ ID NO: 1268 - DNA, 25 bp, Mus musculus
gcaccatggaagccaccaagcaagt

SEQ ID NO: 1269 - DNA, 25 bp, Mus musculus
caagctgccacactcggtattgttg

SEQ ID NO: 1270 - DNA, 25 bp, Mus musculus
gccacactcggtattgttggagatc

SEQ ID NO: 1271 - DNA, 25 bp, Mus musculus
ccacactcggtattgttggagatcc

SEQ ID NO: 1272 - DNA, 25 bp, Mus musculus
cacactcggtattgttggagatcca

SEQ ID NO: 1273 - DNA, 25 bp, Mus musculus
acactcggtattgttggagatccag

SEQ ID NO: 1274 - DNA, 25 bp, Mus musculus
tgtcgccttagcaccatggaagcca

SEQ ID NO: 1275 - DNA, 25 bp, Mus musculus
gtcgccttagcaccatggaagccac

SEQ ID NO: 1276 - DNA, 25 bp, Mus musculus
tcgccttagcaccatggaagccacc

SEQ ID NO: 1277 - DNA, 25 bp, Mus musculus
cgccttagcaccatggaagccacca

SEQ ID NO: 1278 - DNA, 25 bp, Mus musculus
gccttagcaccatggaagccaccaa

SEQ ID NO: 1279 - DNA, 25 bp, Mus musculus
ccttagcaccatggaagccaccaag

SEQ ID NO: 1280 - DNA, 25 bp, Mus musculus
cttagcaccatggaagccaccaagc

SEQ ID NO: 1281 - DNA, 25 bp, Mus musculus
ttagcaccatggaagccaccaagca

SEQ ID NO: 1282 - DNA, 25 bp, Mus musculus
tatacgtcctgggtaatgagaggtg

SEQ ID NO: 1283 - DNA, 25 bp, Mus musculus
acgtcctgggtaatgagaggtggct

SEQ ID NO: 1284 - DNA, 25 bp, Mus musculus
tcctacacggcctgtatactttagt

SEQ ID NO: 1285 - DNA, 25 bp, Mus musculus
tacacggcctgtatactttagtatg

SEQ ID NO: 1286 - DNA, 25 bp, Mus musculus
acggcctgtatactttagtatgacg

SEQ ID NO: 1287 - DNA, 25 bp, Mus musculus
atactttagtatgacgctgatacat

SEQ ID NO: 1288 - DNA, 25 bp, Mus musculus
tatttgttcatgtttggtgcataga

SEQ ID NO: 1289 - DNA, 25 bp, Mus musculus
atatttagtgctgcaccttagagca

SEQ ID NO: 1290 - DNA, 25 bp, Mus musculus
agtgctgcaccttagagcactttga

SEQ ID NO: 1291 - DNA, 25 bp, Mus musculus
gctgcaccttagagcactttgaaat

SEQ ID NO: 1292 - DNA, 25 bp, Mus musculus
agcactttgaaatacctcatgttta

SEQ ID NO: 1293 - DNA, 25 bp, Mus musculus
actttgaaatacctcatgtttatga

SEQ ID NO: 1294 - DNA, 25 bp, Mus musculus
ggctcttgcggccagtattagactg

SEQ ID NO: 1295 - DNA, 25 bp, Mus musculus
tcttgcggccagtattagactggaa

SEQ ID NO: 1296 - DNA, 25 bp, Mus musculus
tcacacctaagtactgtaagaatac

SEQ ID NO: 1297 - DNA, 25 bp, Mus musculus
agaatacctcaatgtttgaggggca

SEQ ID NO: 1298 - DNA, 25 bp, Mus musculus
atacctcaatgtttgaggggcatgt

SEQ ID NO: 1299 - DNA, 25 bp, Mus musculus
tctgttatgtactctactaattcct

SEQ ID NO: 1300 - DNA, 25 bp, Mus musculus
tactctactaattcctacacggcct

SEQ ID NO: 1301 - DNA, 25 bp, Mus musculus
tctactaattcctacacggcctgta

SEQ ID NO: 1302 - DNA, 25 bp, Mus musculus
tgtgagaactggcgccggatccatg

SEQ ID NO: 1303 - DNA, 25 bp, Mus musculus
aactggcgccggatccatgtaactg

SEQ ID NO: 1304 - DNA, 25 bp, Mus musculus
tgcaggcagcctccatcgctcagct

SEQ ID NO: 1305 - DNA, 25 bp, Mus musculus
agctctcacccaaagcagtagccgc

SEQ ID NO: 1306 - DNA, 25 bp, Mus musculus
ccaaagcagtagccgcaccactgct

SEQ ID NO: 1307 - DNA, 25 bp, Mus musculus
cactgctcactctcgcatagcatgg

SEQ ID NO: 1308 - DNA, 25 bp, Mus musculus
tgctcactctcgcatagcatggtct

SEQ ID NO: 1309 - DNA, 25 bp, Mus musculus
tcactctcgcatagcatggtctgtg

SEQ ID NO: 1310 - DNA, 25 bp, Mus musculus
tggatactttcttccaaattgtcat

SEQ ID NO: 1311 - DNA, 25 bp, Mus musculus
atactttcttccaaattgtcatcta

SEQ ID NO: 1312 - DNA, 25 bp, Mus musculus
ctttcttccaaattgtcatctacct

SEQ ID NO: 1313 - DNA, 25 bp, Mus musculus
tcttccaaattgtcatctaccttgg

SEQ ID NO: 1314 - DNA, 25 bp, Mus musculus
tggcgccggatccatgtaactgttc

SEQ ID NO: 1315 - DNA, 25 bp, Mus musculus
tccaaattgtcatctaccttggtga

SEQ ID NO: 1316 - DNA, 25 bp, Mus musculus
cgccggatccatgtaactgttccag

SEQ ID NO: 1317 - DNA, 25 bp, Mus musculus
atccatgtaactgttccagcagagg

SEQ ID NO: 1318 - DNA, 25 bp, Mus musculus
catgtaactgttccagcagaggctg

SEQ ID NO: 1319 - DNA, 25 bp, Mus musculus
gttccagcagaggctgggcccacga

SEQ ID NO: 1320 - DNA, 25 bp, Mus musculus
cccacgacggactctgagtggcctg

SEQ ID NO: 1321 - DNA, 25 bp, Mus musculus
acgacggactctgagtggcctgtgc

SEQ ID NO: 1322 - DNA, 25 bp, Mus musculus
acggactctgagtggcctgtgcatc

SEQ ID NO: 1323 - DNA, 25 bp, Mus musculus
aacgcaatgctgaggctgttaaagg

SEQ ID NO: 1324 - DNA, 25 bp, Mus musculus
atgctgaggctgttaaagggttaag

SEQ ID NO: 1325 - DNA, 25 bp, Mus musculus
ccaaaatcagcgcagagtaaacaca

SEQ ID NO: 1326 - DNA, 25 bp, Mus musculus
gagtaaacacatcttgcagaggaag

SEQ ID NO: 1327 - DNA, 25 bp, Mus musculus
gtaaacacatcttgcagaggaagga

SEQ ID NO: 1328 - DNA, 25 bp, Mus musculus
acacatcttgcagaggaaggaggct

SEQ ID NO: 1329 - DNA, 25 bp, Mus musculus
acatcttgcagaggaaggaggctgc

SEQ ID NO: 1330 - DNA, 25 bp, Mus musculus
gctgccaaggggctgaaggaaagca

SEQ ID NO: 1331 - DNA, 25 bp, Mus musculus
ggtcgcttgctgggtcacttgcctc

SEQ ID NO: 1332 - DNA, 25 bp, Mus musculus
tcgcttgctgggtcacttgcctctc

SEQ ID NO: 1333 - DNA, 25 bp, Mus musculus
tcacttgcctctctgggtttacttt

SEQ ID NO: 1334 - DNA, 25 bp, Mus musculus
ttttctcctactgctgactaaataa

SEQ ID NO: 1335 - DNA, 25 bp, Mus musculus
agaatgtgctccggctgcaggacct

SEQ ID NO: 1336 - DNA, 25 bp, Mus musculus
aatgtgctccggctgcaggacctgg

SEQ ID NO: 1337 - DNA, 25 bp, Mus musculus
gaggaacaatccaacgccaacctgg

SEQ ID NO: 1338 - DNA, 25 bp, Mus musculus
gaggttcacaccaaaatcagcgcag

SEQ ID NO: 1339 - DNA, 25 bp, Mus musculus
ggttcacaccaaaatcagcgcagag

SEQ ID NO: 1340 - DNA, 25 bp, Mus musculus
ttcacaccaaaatcagcgcagagta

SEQ ID NO: 1341 - DNA, 25 bp, Mus musculus
cacaccaaaatcagcgcagagtaaa

SEQ ID NO: 1342 - DNA, 25 bp, Mus musculus
caccaaaatcagcgcagagtaaaca

SEQ ID NO: 1343 - DNA, 25 bp, Mus musculus
agattggccaaggcatactgtgagc

SEQ ID NO: 1344 - DNA, 25 bp, Mus musculus
attggccaaggcatactgtgagctt

SEQ ID NO: 1345 - DNA, 25 bp, Mus musculus
tctgacatccctagtcaagtcaata

SEQ ID NO: 1346 - DNA, 25 bp, Mus musculus
tgacatccctagtcaagtcaatagg

SEQ ID NO: 1347 - DNA, 25 bp, Mus musculus
acatccctagtcaagtcaataggaa

SEQ ID NO: 1348 - DNA, 25 bp, Mus musculus
atccctagtcaagtcaataggaact

SEQ ID NO: 1349 - DNA, 25 bp, Mus musculus
tatgcttgtgaacttctttagcagg

SEQ ID NO: 1350 - DNA, 25 bp, Mus musculus
cttgtgaacttctttagcaggcgag

SEQ ID NO: 1351 - DNA, 25 bp, Mus musculus
aacttctttagcaggcgagtgaatc

SEQ ID NO: 1352 - DNA, 25 bp, Mus musculus
cttctttagcaggcgagtgaatctt

SEQ ID NO: 1353 - DNA, 25 bp, Mus musculus
tctttagcaggcgagtgaatcttga

SEQ ID NO: 1354 - DNA, 25 bp, Mus musculus
tcctgcgtgcatagtgcatatgtcc

SEQ ID NO: 1355 - DNA, 25 bp, Mus musculus
tggccaaggcatactgtgagcttgc

SEQ ID NO: 1356 - DNA, 25 bp, Mus musculus
atactgtgagcttgcacacgagcct

SEQ ID NO: 1357 - DNA, 25 bp, Mus musculus
tgagcttgcacacgagcctctgaca

SEQ ID NO: 1358 - DNA, 25 bp, Mus musculus
agcttgcacacgagcctctgacatc

SEQ ID NO: 1359 - DNA, 25 bp, Mus musculus
cacacgagcctctgacatccctagt

SEQ ID NO: 1360 - DNA, 25 bp, Mus musculus
cacgagcctctgacatccctagtca

SEQ ID NO: 1361 - DNA, 25 bp, Mus musculus
cgagcctctgacatccctagtcaag

SEQ ID NO: 1362 - DNA, 25 bp, Mus musculus
agcctctgacatccctagtcaagtc

SEQ ID NO: 1363 - DNA, 25 bp, Mus musculus
atggcacctttgtttgccaagaagc

SEQ ID NO: 1364 - DNA, 25 bp, Mus musculus
cctttgtttgccaagaagcggatag

SEQ ID NO: 1365 - DNA, 25 bp, Mus musculus
gaccagatgttcgcagcctttcccc

SEQ ID NO: 1366 - DNA, 25 bp, Mus musculus
cctgacgttaccggcaatcttgatt

SEQ ID NO: 1367 - DNA, 25 bp, Mus musculus
gacgttaccggcaatcttgattata

SEQ ID NO: 1368 - DNA, 25 bp, Mus musculus
ttggtccacatcattacccacggag

SEQ ID NO: 1369 - DNA, 25 bp, Mus musculus
gtccacatcattacccacggagaag

SEQ ID NO: 1370 - DNA, 25 bp, Mus musculus
aaggactgagccctgaaccacagcc

SEQ ID NO: 1371 - DNA, 25 bp, Mus musculus
gccctgaaccacagcctcaggtgac

SEQ ID NO: 1372 - DNA, 25 bp, Mus musculus
ctgaaccacagcctcaggtgaccca

SEQ ID NO: 1373 - DNA, 25 bp, Mus musculus
tctccatcccagggctgtgcgcaaa

SEQ ID NO: 1374 - DNA, 25 bp, Mus musculus
ccatcccagggctgtgcgcaaataa

SEQ ID NO: 1375 - DNA, 25 bp, Mus musculus
attctcaacgcattcaaggtgtttg

SEQ ID NO: 1376 - DNA, 25 bp, Mus musculus
ctcaacgcattcaaggtgtttgatc

SEQ ID NO: 1377 - DNA, 25 bp, Mus musculus
aaggctgactatgtccgggagatgc

SEQ ID NO: 1378 - DNA, 25 bp, Mus musculus
gctgactatgtccgggagatgctga

SEQ ID NO: 1379 - DNA, 25 bp, Mus musculus
gagatgctgaccacacaagcagaga

SEQ ID NO: 1380 - DNA, 25 bp, Mus musculus
ctgaccacacaagcagagaggttct

SEQ ID NO: 1381 - DNA, 25 bp, Mus musculus
accacacaagcagagaggttctcca

SEQ ID NO: 1382 - DNA, 25 bp, Mus musculus
atcgaccagatgttcgcagcctttc

SEQ ID NO: 1383 - DNA, 25 bp, Mus musculus
cccctatttctgatgatgtcgatat

SEQ ID NO: 1384 - DNA, 25 bp, Mus musculus
ctatttctgatgatgtcgatattgt

SEQ ID NO: 1385 - DNA, 25 bp, Mus musculus
ttttcctactctgttgccggcattt

SEQ ID NO: 1386 - DNA, 25 bp, Mus musculus
tcctactctgttgccggcatttgct

SEQ ID NO: 1387 - DNA, 25 bp, Mus musculus
gttgccggcatttgctgatttctag

SEQ ID NO: 1388 - DNA, 25 bp, Mus musculus
tatactttgtagtctcagtcggtgt

SEQ ID NO: 1389 - DNA, 25 bp, Mus musculus
actttgtagtctcagtcggtgttga

SEQ ID NO: 1390 - DNA, 25 bp, Mus musculus
tagtctcagtcggtgttgattccat

SEQ ID NO: 1391 - DNA, 25 bp, Mus musculus
gtgttgattccattccatggaaata

SEQ ID NO: 1392 - DNA, 25 bp, Mus musculus
tatgttgtacatactgcccaagaat

SEQ ID NO: 1393 - DNA, 25 bp, Mus musculus
catactgcccaagaattgtcctgca

SEQ ID NO: 1394 - DNA, 25 bp, Mus musculus
actgcccaagaattgtcctgcaagt

SEQ ID NO: 1395 - DNA, 25 bp, Mus musculus
aatagagccaactattttgtatgta

SEQ ID NO: 1396 - DNA, 25 bp, Mus musculus
tgcttctttcctcctgtcctggaac

SEQ ID NO: 1397 - DNA, 25 bp, Mus musculus
cctcctgtcctggaacttgtcgcca

SEQ ID NO: 1398 - DNA, 25 bp, Mus musculus
gaacttgtcgccaccgtgtgatcca

SEQ ID NO: 1399 - DNA, 25 bp, Mus musculus
gtcgccaccgtgtgatccagtcctg

SEQ ID NO: 1400 - DNA, 25 bp, Mus musculus
gtgtgatccagtcctggctctggct

SEQ ID NO: 1401 - DNA, 25 bp, Mus musculus
cagatcccagtgaagggtttcttgt

SEQ ID NO: 1402 - DNA, 25 bp, Mus musculus
aagggtttcttgtcttgatgcttca

SEQ ID NO: 1403 - DNA, 25 bp, Mus musculus
aactcgagatggcgtctaagatcat

SEQ ID NO: 1404 - DNA, 25 bp, Mus musculus
ggcgtctaagatcatccgcgggctg

SEQ ID NO: 1405 - DNA, 25 bp, Mus musculus
aggacatcctcaacaatctgaatga

SEQ ID NO: 1406 - DNA, 25 bp, Mus musculus
gacatcctcaacaatctgaatgatg

SEQ ID NO: 1407 - DNA, 25 bp, Mus musculus
catcctcaacaatctgaatgatgcc

SEQ ID NO: 1408 - DNA, 25 bp, Mus musculus
tcctcaacaatctgaatgatgccat

SEQ ID NO: 1409 - DNA, 25 bp, Mus musculus
atgagtcagctgctagctgctgtag

SEQ ID NO: 1410 - DNA, 25 bp, Mus musculus
gagtcagctgctagctgctgtagag

SEQ ID NO: 1411 - DNA, 25 bp, Mus musculus
gtcagctgctagctgctgtagagct

SEQ ID NO: 1412 - DNA, 25 bp, Mus musculus
ctagctgctgtagagctggctgacc

SEQ ID NO: 1413 - DNA, 25 bp, Mus musculus
agctgctgtagagctggctgaccgt

SEQ ID NO: 1414 - DNA, 25 bp, Mus musculus
tgtagagctggctgaccgtgggaac

SEQ ID NO: 1415 - DNA, 25 bp, Mus musculus
taagatcatccgcgggctgcgacga

SEQ ID NO: 1416 - DNA, 25 bp, Mus musculus
agatcatccgcgggctgcgacgagc

SEQ ID NO: 1417 - DNA, 25 bp, Mus musculus
atcatccgcgggctgcgacgagctg

SEQ ID NO: 1418 - DNA, 25 bp, Mus musculus
agctgcgagctatggcgagaatcca

SEQ ID NO: 1419 - DNA, 25 bp, Mus musculus
gagaatccactaatgtgcaggacat

SEQ ID NO: 1420 - DNA, 25 bp, Mus musculus
gaatccactaatgtgcaggacatcc

SEQ ID NO: 1421 - DNA, 25 bp, Mus musculus
atccactaatgtgcaggacatcctc

SEQ ID NO: 1422 - DNA, 25 bp, Mus musculus
gtgcaggacatcctcaacaatctga

SEQ ID NO: 1423 - DNA, 25 bp, Mus musculus
ttaaatgacactcttcccaactgtc

SEQ ID NO: 1424 - DNA, 25 bp, Mus musculus
ttttttcatgcggctcacagcgaag

SEQ ID NO: 1425 - DNA, 25 bp, Mus musculus
agctgatccttgagtggccaggcgc

SEQ ID NO: 1426 - DNA, 25 bp, Mus musculus
tgatccttgagtggccaggcgctct

SEQ ID NO: 1427 - DNA, 25 bp, Mus musculus
ttcctttcctcatagcacaggggtg

SEQ ID NO: 1428 - DNA, 25 bp, Mus musculus
tttgtttgtcactttctggagccct

SEQ ID NO: 1429 - DNA, 25 bp, Mus musculus
acagcttgcggaggccactcaggtc

SEQ ID NO: 1430 - DNA, 25 bp, Mus musculus
ggaggccactcaggtctcaggtgta

SEQ ID NO: 1431 - DNA, 25 bp, Mus musculus
ttatctcccaggcatgctgtgtagt

SEQ ID NO: 1432 - DNA, 25 bp, Mus musculus
tctcccaggcatgctgtgtagtgca

SEQ ID NO: 1433 - DNA, 25 bp, Mus musculus
cccaggcatgctgtgtagtgcaaca

SEQ ID NO: 1434 - DNA, 25 bp, Mus musculus
attcctcaagcgggcgagtcaggtg

SEQ ID NO: 1435 - DNA, 25 bp, Mus musculus
tttcatgcggctcacagcgaaggcc

SEQ ID NO: 1436 - DNA, 25 bp, Mus musculus
gctcacagcgaaggccacttgcact

SEQ ID NO: 1437 - DNA, 25 bp, Mus musculus
cacagcgaaggccacttgcactctg

SEQ ID NO: 1438 - DNA, 25 bp, Mus musculus
gaaggccacttgcactctggctgca

SEQ ID NO: 1439 - DNA, 25 bp, Mus musculus
acctcactgggccagagctgatcct

SEQ ID NO: 1440 - DNA, 25 bp, Mus musculus
tcactgggccagagctgatccttga

SEQ ID NO: 1441 - DNA, 25 bp, Mus musculus
ctgggccagagctgatccttgagtg

SEQ ID NO: 1442 - DNA, 25 bp, Mus musculus
cagagctgatccttgagtggccagg

SEQ ID NO: 1443 - DNA, 25 bp, Mus musculus
gtttttggcaacagcgacaatttga

SEQ ID NO: 1444 - DNA, 25 bp, Mus musculus
aatttgacatccaacacaaaggaat

SEQ ID NO: 1445 - DNA, 25 bp, Mus musculus
tctgcggggacgttaccatggccgc

SEQ ID NO: 1446 - DNA, 25 bp, Mus musculus
gggacgttaccatggccgctgatgt

SEQ ID NO: 1447 - DNA, 25 bp, Mus musculus
ctgatgtccttaaagccatccagcg

SEQ ID NO: 1448 - DNA, 25 bp, Mus musculus
aagccatccagcgcataatgaccca

SEQ ID NO: 1449 - DNA, 25 bp, Mus musculus
tgacccagcaggggaaactctcgga

SEQ ID NO: 1450 - DNA, 25 bp, Mus musculus
tcatcagcaggctgagggatgacaa

SEQ ID NO: 1451 - DNA, 25 bp, Mus musculus
atgacaaccggtaccacgaggacat

SEQ ID NO: 1452 - DNA, 25 bp, Mus musculus
tctttggggtcaccctcagaacata

SEQ ID NO: 1453 - DNA, 25 bp, Mus musculus
accgccttagatctgagtccatcgc

SEQ ID NO: 1454 - DNA, 25 bp, Mus musculus
ttagatctgagtccatcgccttcat

SEQ ID NO: 1455 - DNA, 25 bp, Mus musculus
acatccaacacaaaggaatgaatcc

SEQ ID NO: 1456 - DNA, 25 bp, Mus musculus
ttctggtcttcgggtgtcgacaatc

SEQ ID NO: 1457 - DNA, 25 bp, Mus musculus
tagatcatatctacagagaggagac

SEQ ID NO: 1458 - DNA, 25 bp, Mus musculus
aggagaccctgcaggccaagaacaa

SEQ ID NO: 1459 - DNA, 25 bp, Mus musculus
ccctgcaggccaagaacaagggcgt

SEQ ID NO: 1460 - DNA, 25 bp, Mus musculus
aggaacagctggccgagtctgtgta

SEQ ID NO: 1461 - DNA, 25 bp, Mus musculus
gccatatttatgtctgcggggacgt

SEQ ID NO: 1462 - DNA, 25 bp, Mus musculus
tttatgtctgcggggacgttaccat

SEQ ID NO: 1463 - DNA, 25 bp, Mus musculus
gaacaagccaatgctcatctcacca

SEQ ID NO: 1464 - DNA, 25 bp, Mus musculus
caagccaatgctcatctcaccaagt

SEQ ID NO: 1465 - DNA, 25 bp, Mus musculus
agccggatggtggtccatgaaagcg

SEQ ID NO: 1466 - DNA, 25 bp, Mus musculus
tgagcaagacctcctggtgcagggc

SEQ ID NO: 1467 - DNA, 25 bp, Mus musculus
agacctcctggtgcagggcagaaga

SEQ ID NO: 1468 - DNA, 25 bp, Mus musculus
cctcctggtgcagggcagaagatat

SEQ ID NO: 1469 - DNA, 25 bp, Mus musculus
ttcgtggctcctgacaattctactt

SEQ ID NO: 1470 - DNA, 25 bp, Mus musculus
gctcctgacaattctacttaatttc

SEQ ID NO: 1471 - DNA, 25 bp, Mus musculus
ccacgtatcacttttccacatgcaa

SEQ ID NO: 1472 - DNA, 25 bp, Mus musculus
cgtatcacttttccacatgcaataa

SEQ ID NO: 1473 - DNA, 25 bp, Mus musculus
atcacttttccacatgcaataaagt

SEQ ID NO: 1474 - DNA, 25 bp, Mus musculus
tttccacatgcaataaagtttgcct

SEQ ID NO: 1475 - DNA, 25 bp, Mus musculus
aatgctcatctcaccaagttcagga

SEQ ID NO: 1476 - DNA, 25 bp, Mus musculus
gctcatctcaccaagttcaggaaag

SEQ ID NO: 1477 - DNA, 25 bp, Mus musculus
ttcaggaaagcccagcatgagctag

SEQ ID NO: 1478 - DNA, 25 bp, Mus musculus
aaagcccagcatgagctagaggagg

SEQ ID NO: 1479 - DNA, 25 bp, Mus musculus
atcgcagaatcgcaagtcaataaac

SEQ ID NO: 1480 - DNA, 25 bp, Mus musculus
gcaaagacccgtgacttcacctcta

SEQ ID NO: 1481 - DNA, 25 bp, Mus musculus
gacttcacctctagccggatggtgg

SEQ ID NO: 1482 - DNA, 25 bp, Mus musculus
acctctagccggatggtggtccatg

SEQ ID NO: 1483 - DNA, 25 bp, Mus musculus
atttaaacagagcgcatcatgcgtg

SEQ ID NO: 1484 - DNA, 25 bp, Mus musculus
ttaaacagagcgcatcatgcgtgag

SEQ ID NO: 1485 - DNA, 25 bp, Mus musculus
attcatcactgacagttcagttagt

SEQ ID NO: 1486 - DNA, 25 bp, Mus musculus
tcatcactgacagttcagttagttc

SEQ ID NO: 1487 - DNA, 25 bp, Mus musculus
atcactgacagttcagttagttcag

SEQ ID NO: 1488 - DNA, 25 bp, Mus musculus
atatgacccaacgatagaagattcc

SEQ ID NO: 1489 - DNA, 25 bp, Mus musculus
atgacccaacgatagaagattccta

SEQ ID NO: 1490 - DNA, 25 bp, Mus musculus
attcctacagagagcaagtcgaggt

SEQ ID NO: 1491 - DNA, 25 bp, Mus musculus
tagattgccaacagtgcatgctgga

SEQ ID NO: 1492 - DNA, 25 bp, Mus musculus
gattgccaacagtgcatgctggaga

SEQ ID NO: 1493 - DNA, 25 bp, Mus musculus
ttgccaacagtgcatgctggagatc

SEQ ID NO: 1494 - DNA, 25 bp, Mus musculus
tgccaacagtgcatgctggagatcc

SEQ ID NO: 1495 - DNA, 25 bp, Mus musculus
acagagcgcatcatgcgtgagtaca

SEQ ID NO: 1496 - DNA, 25 bp, Mus musculus
gccaacagtgcatgctggagatcct

SEQ ID NO: 1497 - DNA, 25 bp, Mus musculus
agagcgcatcatgcgtgagtacaag

SEQ ID NO: 1498 - DNA, 25 bp, Mus musculus
agcgcatcatgcgtgagtacaagct

SEQ ID NO: 1499 - DNA, 25 bp, Mus musculus
cgcatcatgcgtgagtacaagctag

SEQ ID NO: 1500 - DNA, 25 bp, Mus musculus
gtacaagctagtagtccttggttgt

SEQ ID NO: 1501 - DNA, 25 bp, Mus musculus
acaagctagtagtccttggttgtga

SEQ ID NO: 1502 - DNA, 25 bp, Mus musculus
aagctagtagtccttggttgtgata

SEQ ID NO: 1503 - DNA, 25 bp, Mus musculus
gaattcatcactgacagttcagtta

SEQ ID NO: 1504 - DNA, 25 bp, Mus musculus
aatggtactctcaagtcatcacaaa

SEQ ID NO: 1505 - DNA, 25 bp, Mus musculus
actctcaagtcatcacaaagtccga

SEQ ID NO: 1506 - DNA, 25 bp, Mus musculus
ttctttgacgctgagatcaagaagc

SEQ ID NO: 1507 - DNA, 25 bp, Mus musculus
gaactgctacttccccatatttagt

SEQ ID NO: 1508 - DNA, 25 bp, Mus musculus
ctgctacttccccatatttagtgtc

SEQ ID NO: 1509 - DNA, 25 bp, Mus musculus
ctacttccccatatttagtgtctca

SEQ ID NO: 1510 - DNA, 25 bp, Mus musculus
cttccccatatttagtgtctcaggc

SEQ ID NO: 1511 - DNA, 25 bp, Mus musculus
ccccatatttagtgtctcaggctgc

SEQ ID NO: 1512 - DNA, 25 bp, Mus musculus
catatttagtgtctcaggctgcgtt

SEQ ID NO: 1513 - DNA, 25 bp, Mus musculus
atttagtgtctcaggctgcgttaga

SEQ ID NO: 1514 - DNA, 25 bp, Mus musculus
tagtgtctcaggctgcgttagagaa

SEQ ID NO: 1515 - DNA, 25 bp, Mus musculus
tgtctcaggctgcgttagagaaaga

SEQ ID NO: 1516 - DNA, 25 bp, Mus musculus
ctcaagtcatcacaaagtccgagta

SEQ ID NO: 1517 - DNA, 25 bp, Mus musculus
aagtcatcacaaagtccgagtatga

SEQ ID NO: 1518 - DNA, 25 bp, Mus musculus
tcacaaagtccgagtatgattgaat

SEQ ID NO: 1519 - DNA, 25 bp, Mus musculus
ctgcgtcgtactccatcgtgggagt

SEQ ID NO: 1520 - DNA, 25 bp, Mus musculus
cgtactccatcgtgggagtccatta

SEQ ID NO: 1521 - DNA, 25 bp, Mus musculus
tccattaaggacttctttgacgctg

SEQ ID NO: 1522 - DNA, 25 bp, Mus musculus
attaaggacttctttgacgctgaga

SEQ ID NO: 1523 - DNA, 25 bp, Mus musculus
aaggacttctttgacgctgagatca

SEQ ID NO: 1524 - DNA, 25 bp, Mus musculus
cctaagtccacattctgtcctgggc

SEQ ID NO: 1525 - DNA, 25 bp, Mus musculus
ttctgtcctgggcagaattcctctg

SEQ ID NO: 1526 - DNA, 25 bp, Mus musculus
gaccctggatgtgcacagtgtatcc

SEQ ID NO: 1527 - DNA, 25 bp, Mus musculus
gcacagtgtatccacccagggtcat

SEQ ID NO: 1528 - DNA, 25 bp, Mus musculus
ttagcttttgaaactgcatgataag

SEQ ID NO: 1529 - DNA, 25 bp, Mus musculus
agccgttcagactggcagatcttct

SEQ ID NO: 1530 - DNA, 25 bp, Mus musculus
cgttcagactggcagatcttctctt

SEQ ID NO: 1531 - DNA, 25 bp, Mus musculus
tggcagatcttctctttgatgtgca

SEQ ID NO: 1532 - DNA, 25 bp, Mus musculus
cagatcttctctttgatgtgcaata

SEQ ID NO: 1533 - DNA, 25 bp, Mus musculus
atcttctctttgatgtgcaataaaa

SEQ ID NO: 1534 - DNA, 25 bp, Mus musculus
acatccaagatcacttttgaaagtt

SEQ ID NO: 1535 - DNA, 25 bp, Mus musculus
tgtttcttatttgggaggataatgt

SEQ ID NO: 1536 - DNA, 25 bp, Mus musculus
catttaaacatacacatttattggt

SEQ ID NO: 1537 - DNA, 25 bp, Mus musculus
ttaaacatacacatttattggttca

SEQ ID NO: 1538 - DNA, 25 bp, Mus musculus
aacatacacatttattggttcagat

SEQ ID NO: 1539 - DNA, 25 bp, Mus musculus
tattggttcagatccgttttcactt

SEQ ID NO: 1540 - DNA, 25 bp, Mus musculus
gtcactgaagcagggctgtagaatg

SEQ ID NO: 1541 - DNA, 25 bp, Mus musculus
aatgctttgttcctgttccagagaa

SEQ ID NO: 1542 - DNA, 25 bp, Mus musculus
gctttgttcctgttccagagaagca

SEQ ID NO: 1543 - DNA, 25 bp, Mus musculus
agataggaccctggatgtgcacagt

SEQ ID NO: 1544 - DNA, 25 bp, Mus musculus
ctgtgaactgtcctttcagcagcca

SEQ ID NO: 1545 - DNA, 25 bp, Mus musculus
actgtcctttcagcagccaagacat

SEQ ID NO: 1546 - DNA, 25 bp, Mus musculus
ccttacagctacttctctttgcctc

SEQ ID NO: 1547 - DNA, 25 bp, Mus musculus
tacagctacttctctttgcctccaa

SEQ ID NO: 1548 - DNA, 25 bp, Mus musculus
agctacttctctttgcctccaagaa

SEQ ID NO: 1549 - DNA, 25 bp, Mus musculus
ttctctttgcctccaagaaagtcca

SEQ ID NO: 1550 - DNA, 25 bp, Mus musculus
tctttgcctccaagaaagtccagtc

SEQ ID NO: 1551 - DNA, 25 bp, Mus musculus
ttgcctccaagaaagtccagtcgga

SEQ ID NO: 1552 - DNA, 25 bp, Mus musculus
aagtccagtcggatgggcagattgt

SEQ ID NO: 1553 - DNA, 25 bp, Mus musculus
ctcatgaagctgcagcatgcatcac

SEQ ID NO: 1554 - DNA, 25 bp, Mus musculus
cagccctccggcgagccatggaagc

SEQ ID NO: 1555 - DNA, 25 bp, Mus musculus
ccctccggcgagccatggaagctct

SEQ ID NO: 1556 - DNA, 25 bp, Mus musculus
gtcctttcagcagccaagacatgaa

SEQ ID NO: 1557 - DNA, 25 bp, Mus musculus
ctttcagcagccaagacatgaagta

SEQ ID NO: 1558 - DNA, 25 bp, Mus musculus
ttagaacccgagccatctctgctaa

SEQ ID NO: 1559 - DNA, 25 bp, Mus musculus
gaacccgagccatctctgctaaagg

SEQ ID NO: 1560 - DNA, 25 bp, Mus musculus
gagccatctctgctaaaggcatgac

SEQ ID NO: 1561 - DNA, 25 bp, Mus musculus
ccatctctgctaaaggcatgacctt

SEQ ID NO: 1562 - DNA, 25 bp, Mus musculus
gcatgaccttagtgacccccttaca

SEQ ID NO: 1563 - DNA, 25 bp, Mus musculus
tgacccccttacagctacttctctt

SEQ ID NO: 1564 - DNA, 25 bp, Mus musculus
tgatatcaccacatgttggacatgc

SEQ ID NO: 1565 - DNA, 25 bp, Mus musculus
atatcaccacatgttggacatgcaa

SEQ ID NO: 1566 - DNA, 25 bp, Mus musculus
gagcactcctactggagatccaatc

SEQ ID NO: 1567 - DNA, 25 bp, Mus musculus
gcactcctactggagatccaatcga

SEQ ID NO: 1568 - DNA, 25 bp, Mus musculus
actcctactggagatccaatcgaga

SEQ ID NO: 1569 - DNA, 25 bp, Mus musculus
tcctactggagatccaatcgagatg

SEQ ID NO: 1570 - DNA, 25 bp, Mus musculus
ctactggagatccaatcgagatgag

SEQ ID NO: 1571 - DNA, 25 bp, Mus musculus
cgacaacaagaccagacaaaagctt

SEQ ID NO: 1572 - DNA, 25 bp, Mus musculus
caaagatatcagcagccctaagata

SEQ ID NO: 1573 - DNA, 25 bp, Mus musculus
tatcagcagccctaagatacagaaa

SEQ ID NO: 1574 - DNA, 25 bp, Mus musculus
tcagcagccctaagatacagaaagt

SEQ ID NO: 1575 - DNA, 25 bp, Mus musculus
agcagccctaagatacagaaagttg

SEQ ID NO: 1576 - DNA, 25 bp, Mus musculus
atcaccacatgttggacatgcaaga

SEQ ID NO: 1577 - DNA, 25 bp, Mus musculus
caccacatgttggacatgcaagaca

SEQ ID NO: 1578 - DNA, 25 bp, Mus musculus
agacagactcaatcaagtcatcaaa

SEQ ID NO: 1579 - DNA, 25 bp, Mus musculus
acagactcaatcaagtcatcaaaag

SEQ ID NO: 1580 - DNA, 25 bp, Mus musculus
agactcaatcaagtcatcaaaagcg

SEQ ID NO: 1581 - DNA, 25 bp, Mus musculus
actcaatcaagtcatcaaaagcgtg

SEQ ID NO: 1582 - DNA, 25 bp, Mus musculus
aagatagagcactcctactggagat

SEQ ID NO: 1583 - DNA, 25 bp, Mus musculus
gatagagcactcctactggagatcc

SEQ ID NO: 1584 - DNA, 25 bp, Mus musculus
agatgtacctcagaacccaggaggt

SEQ ID NO: 1585 - DNA, 25 bp, Mus musculus
tgaaagcacaacttcagtgactgac

SEQ ID NO: 1586 - DNA, 25 bp, Mus musculus
tgagtatcttatccttacgctcctg

SEQ ID NO: 1587 - DNA, 25 bp, Mus musculus
gtatcttatccttacgctcctgaga

SEQ ID NO: 1588 - DNA, 25 bp, Mus musculus
ccttacgctcctgagattctcctac

SEQ ID NO: 1589 - DNA, 25 bp, Mus musculus
tacgctcctgagattctcctacgat

SEQ ID NO: 1590 - DNA, 25 bp, Mus musculus
gctcctgagattctcctacgatcag

SEQ ID NO: 1591 - DNA, 25 bp, Mus musculus
gagattctcctacgatcagaagtac

SEQ ID NO: 1592 - DNA, 25 bp, Mus musculus
attctcctacgatcagaagtaccat

SEQ ID NO: 1593 - DNA, 25 bp, Mus musculus
ctcctacgatcagaagtaccatgtg

SEQ ID NO: 1594 - DNA, 25 bp, Mus musculus
gtcactgcctctggttttggagttg

SEQ ID NO: 1595 - DNA, 25 bp, Mus musculus
gcctctggttttggagttgccagtt

SEQ ID NO: 1596 - DNA, 25 bp, Mus musculus
cacaacttcagtgactgacttacta

SEQ ID NO: 1597 - DNA, 25 bp, Mus musculus
ttcagtgactgacttactaaactac

SEQ ID NO: 1598 - DNA, 25 bp, Mus musculus
gactgacttactaaactactttctg

SEQ ID NO: 1599 - DNA, 25 bp, Mus musculus
tgacttactaaactactttctggct

SEQ ID NO: 1600 - DNA, 25 bp, Mus musculus
ctttctggctccagaggttcttact

SEQ ID NO: 1601 - DNA, 25 bp, Mus musculus
ggctccagaggttcttactggggag

SEQ ID NO: 1602 - DNA, 25 bp, Mus musculus
gaaccaatactactgtgaaagctgt

SEQ ID NO: 1603 - DNA, 25 bp, Mus musculus
gcaaatcacggaggagcctgagtat

SEQ ID NO: 1604 - DNA, 25 bp, Mus musculus
ttcccaaagtggaagccaagttcat

SEQ ID NO: 1605 - DNA, 25 bp, Mus musculus
aattgtttccggatgactgaccagg

SEQ ID NO: 1606 - DNA, 25 bp, Mus musculus
gatctctggcagtggaggaaatctc

SEQ ID NO: 1607 - DNA, 25 bp, Mus musculus
atctctggcagtggaggaaatctct

SEQ ID NO: 1608 - DNA, 25 bp, Mus musculus
ctgtcttcatttctgtaatagttaa

SEQ ID NO: 1609 - DNA, 25 bp, Mus musculus
gtcttcatttctgtaatagttaata

SEQ ID NO: 1610 - DNA, 25 bp, Mus musculus
tgagaactttccctactgtgtttga

SEQ ID NO: 1611 - DNA, 25 bp, Mus musculus
ctttccctactgtgtttgataaatg

SEQ ID NO: 1612 - DNA, 25 bp, Mus musculus
ttccctactgtgtttgataaatgtt

SEQ ID NO: 1613 - DNA, 25 bp, Mus musculus
tccctactgtgtttgataaatgttg

SEQ ID NO: 1614 - DNA, 25 bp, Mus musculus
atgcctgtttagttttcaaggatgg

SEQ ID NO: 1615 - DNA, 25 bp, Mus musculus
tgcctgtttagttttcaaggatgga

SEQ ID NO: 1616 - DNA, 25 bp, Mus musculus
attgtttccggatgactgaccagga

SEQ ID NO: 1617 - DNA, 25 bp, Mus musculus
gtttccggatgactgaccaggaggc

SEQ ID NO: 1618 - DNA, 25 bp, Mus musculus
ttccggatgactgaccaggaggcta

SEQ ID NO: 1619 - DNA, 25 bp, Mus musculus
tccggatgactgaccaggaggctat

SEQ ID NO: 1620 - DNA, 25 bp, Mus musculus
atgactgaccaggaggctattcaag

SEQ ID NO: 1621 - DNA, 25 bp, Mus musculus
aggctattcaagatctctggcagtg

SEQ ID NO: 1622 - DNA, 25 bp, Mus musculus
gctattcaagatctctggcagtgga

SEQ ID NO: 1623 - DNA, 25 bp, Mus musculus
attcaagatctctggcagtggagga

SEQ ID NO: 1624 - DNA, 25 bp, Mus musculus
actactaaatatgtcctctgggtgg

SEQ ID NO: 1625 - DNA, 25 bp, Mus musculus
gacgatgactttctcttcagcgaca

SEQ ID NO: 1626 - DNA, 25 bp, Mus musculus
cccatcttgcaacgagtggcccacg

SEQ ID NO: 1627 - DNA, 25 bp, Mus musculus
ttgcaacgagtggcccacggagagt

SEQ ID NO: 1628 - DNA, 25 bp, Mus musculus
acaccaccaaaggatccaaagctgg

SEQ ID NO: 1629 - DNA, 25 bp, Mus musculus
gatccaaagctggctgccttggaga

SEQ ID NO: 1630 - DNA, 25 bp, Mus musculus
aattctgtgatccaattcaaggttg

SEQ ID NO: 1631 - DNA, 25 bp, Mus musculus
aaggttgcactccagtacttcaaga

SEQ ID NO: 1632 - DNA, 25 bp, Mus musculus
cagtacttcaagaaccatctctact

SEQ ID NO: 1633 - DNA, 25 bp, Mus musculus
ttcaagaaccatctctactgctcca

SEQ ID NO: 1634 - DNA, 25 bp, Mus musculus
aaccatctctactgctccacttaaa

SEQ ID NO: 1635 - DNA, 25 bp, Mus musculus
ccaagaccaggaatcgcaataaaca

SEQ ID NO: 1636 - DNA, 25 bp, Mus musculus
gactttctcttcagcgacaagacca

SEQ ID NO: 1637 - DNA, 25 bp, Mus musculus
ctcttcagcgacaagaccaagattg

SEQ ID NO: 1638 - DNA, 25 bp, Mus musculus
acttaccagttcaggctgctgtatg

SEQ ID NO: 1639 - DNA, 25 bp, Mus musculus
tcattccaggcccttgacggctttc

SEQ ID NO: 1640 - DNA, 25 bp, Mus musculus
ggctttcccggatgcacgttgacca

SEQ ID NO: 1641 - DNA, 25 bp, Mus musculus
cccggatgcacgttgaccagcggcg

SEQ ID NO: 1642 - DNA, 25 bp, Mus musculus
ttcttggctcacacggaacaactcc

SEQ ID NO: 1643 - DNA, 25 bp, Mus musculus
tttgatcccatcttgcaacgagtgg

SEQ ID NO: 1644 - DNA, 25 bp, Mus musculus
gacgccagcagagtcactttgacag

SEQ ID NO: 1645 - DNA, 25 bp, Mus musculus
tggaccgagtctgcttcctagccat

SEQ ID NO: 1646 - DNA, 25 bp, Mus musculus
tcctcctgggccctggaggtcagct

SEQ ID NO: 1647 - DNA, 25 bp, Mus musculus
gctgagtgtgctcttggggaaatta

SEQ ID NO: 1648 - DNA, 25 bp, Mus musculus
aggcttcctgggagaagatagagaa

SEQ ID NO: 1649 - DNA, 25 bp, Mus musculus
caccactgactttgagcagttctga

SEQ ID NO: 1650 - DNA, 25 bp, Mus musculus
tgactttgagcagttctgataggtc

SEQ ID NO: 1651 - DNA, 25 bp, Mus musculus
cactttgaagccctaagagctctgc

SEQ ID NO: 1652 - DNA, 25 bp, Mus musculus
ctaagagctctgcctttcctgatgt

SEQ ID NO: 1653 - DNA, 25 bp, Mus musculus
gctctgcctttcctgatgtcattga

SEQ ID NO: 1654 - DNA, 25 bp, Mus musculus
tttcctcctgccattttgtaagatt

SEQ ID NO: 1655 - DNA, 25 bp, Mus musculus
ctattatttctaacatatgtatgta

SEQ ID NO: 1656 - DNA, 25 bp, Mus musculus
gagtctgcttcctagccatgctctc

SEQ ID NO: 1657 - DNA, 25 bp, Mus musculus
tcatctgtggcactgctggcatctt

SEQ ID NO: 1658 - DNA, 25 bp, Mus musculus
ctgctggcatcttcctcatggccca

SEQ ID NO: 1659 - DNA, 25 bp, Mus musculus
gcatcttcctcatggcccactacaa

SEQ ID NO: 1660 - DNA, 25 bp, Mus musculus
tcctcatggcccactacaaccaagt

SEQ ID NO: 1661 - DNA, 25 bp, Mus musculus
tgcctgacctgccgttccccggaga

SEQ ID NO: 1662 - DNA, 25 bp, Mus musculus
acctgcctttgccagactgaggcca

SEQ ID NO: 1663 - DNA, 25 bp, Mus musculus
ctttgccagactgaggccaaccaat

SEQ ID NO: 1664 - DNA, 25 bp, Mus musculus
atcacagccaaggtgcagtacatca

SEQ ID NO: 1665 - DNA, 25 bp, Mus musculus
attcattactgccagggaaagtgtg

SEQ ID NO: 1666 - DNA, 25 bp, Mus musculus
caccaatggctctgtcgtgtaccac

SEQ ID NO: 1667 - DNA, 25 bp, Mus musculus
caatggctctgtcgtgtaccacgag

SEQ ID NO: 1668 - DNA, 25 bp, Mus musculus
tggctctgtcgtgtaccacgaggtc

SEQ ID NO: 1669 - DNA, 25 bp, Mus musculus
tgtcgtgtaccacgaggtcatcaac

SEQ ID NO: 1670 - DNA, 25 bp, Mus musculus
cgtgtaccacgaggtcatcaacgcc

SEQ ID NO: 1671 - DNA, 25 bp, Mus musculus
gtaccacgaggtcatcaacgccatg

SEQ ID NO: 1672 - DNA, 25 bp, Mus musculus
cgaggtcatcaacgccatgcagtgc

SEQ ID NO: 1673 - DNA, 25 bp, Mus musculus
ggtcatcaacgccatgcagtgcagg

SEQ ID NO: 1674 - DNA, 25 bp, Mus musculus
catcaacgccatgcagtgcaggtgt

SEQ ID NO: 1675 - DNA, 25 bp, Mus musculus
cgccatgcagtgcaggtgttctccc

SEQ ID NO: 1676 - DNA, 25 bp, Mus musculus
aagtgtgccagcaaagctgtgtact

SEQ ID NO: 1677 - DNA, 25 bp, Mus musculus
tgtgccagcaaagctgtgtactcca

SEQ ID NO: 1678 - DNA, 25 bp, Mus musculus
aaagctgtgtactccattgacatcg

SEQ ID NO: 1679 - DNA, 25 bp, Mus musculus
gctgtgtactccattgacatcgagg

SEQ ID NO: 1680 - DNA, 25 bp, Mus musculus
gtgtactccattgacatcgaggatg

SEQ ID NO: 1681 - DNA, 25 bp, Mus musculus
gcccttgcactgcaccaatggctct

SEQ ID NO: 1682 - DNA, 25 bp, Mus musculus
cttgcactgcaccaatggctctgtc

SEQ ID NO: 1683 - DNA, 25 bp, Mus musculus
gcactgcaccaatggctctgtcgtg

SEQ ID NO: 1684 - DNA, 25 bp, Mus musculus
aggtccaggggcacactgatagttt

SEQ ID NO: 1685 - DNA, 25 bp, Mus musculus
atagtttctgacccatactagggct

SEQ ID NO: 1686 - DNA, 25 bp, Mus musculus
gcaacgcagacctgagcaagagaaa

SEQ ID NO: 1687 - DNA, 25 bp, Mus musculus
aggcctttctccatatgacttcaac

SEQ ID NO: 1688 - DNA, 25 bp, Mus musculus
ttctccatatgacttcaactggcac

SEQ ID NO: 1689 - DNA, 25 bp, Mus musculus
atatgacttcaactggcacaggaag

SEQ ID NO: 1690 - DNA, 25 bp, Mus musculus
cttcaactggcacaggaagcatcca

SEQ ID NO: 1691 - DNA, 25 bp, Mus musculus
tgaactggactgttctcagtgtagg

SEQ ID NO: 1692 - DNA, 25 bp, Mus musculus
ggactgttctcagtgtaggcactta

SEQ ID NO: 1693 - DNA, 25 bp, Mus musculus
ttctcagtgtaggcacttagcaccc

SEQ ID NO: 1694 - DNA, 25 bp, Mus musculus
gcacttagcaccctttacaaaacat

SEQ ID NO: 1695 - DNA, 25 bp, Mus musculus
agcaccctttacaaaacatgtatgc

SEQ ID NO: 1696 - DNA, 25 bp, Mus musculus
tctgacccatactagggctgtgtaa

SEQ ID NO: 1697 - DNA, 25 bp, Mus musculus
ccatactagggctgtgtaagggtgg

SEQ ID NO: 1698 - DNA, 25 bp, Mus musculus
tagagtatcccaaatccacagtgca

SEQ ID NO: 1699 - DNA, 25 bp, Mus musculus
atcccaaatccacagtgcagtattt

SEQ ID NO: 1700 - DNA, 25 bp, Mus musculus
ttttccatacagtgcttttgtacct

SEQ ID NO: 1701 - DNA, 25 bp, Mus musculus
atacagtgcttttgtaccttgtaat

SEQ ID NO: 1702 - DNA, 25 bp, Mus musculus
tcttgttcctttgtatgggactgat

SEQ ID NO: 1703 - DNA, 25 bp, Mus musculus
ttaacagcaacgcagacctgagcaa

SEQ ID NO: 1704 - DNA, 25 bp, Mus musculus
gatggtcctctacgacattcctgac

SEQ ID NO: 1705 - DNA, 25 bp, Mus musculus
ggtcctctacgacattcctgacatc

SEQ ID NO: 1706 - DNA, 25 bp, Mus musculus
caagtttcagcctcttagcaagtac

SEQ ID NO: 1707 - DNA, 25 bp, Mus musculus
caatgacatttcattctggctgccc

SEQ ID NO: 1708 - DNA, 25 bp, Mus musculus
catttcattctggctgccctctgag

SEQ ID NO: 1709 - DNA, 25 bp, Mus musculus
ttcattctggctgccctctgagaac

SEQ ID NO: 1710 - DNA, 25 bp, Mus musculus
ctggctgccctctgagaactacacg

SEQ ID NO: 1711 - DNA, 25 bp, Mus musculus
gccctctgagaactacacggagaat

SEQ ID NO: 1712 - DNA, 25 bp, Mus musculus
tgatttctatgacatcgtccgaaca

SEQ ID NO: 1713 - DNA, 25 bp, Mus musculus
tttctatgacatcgtccgaacagtc

SEQ ID NO: 1714 - DNA, 25 bp, Mus musculus
ctatgacatcgtccgaacagtcgga

SEQ ID NO: 1715 - DNA, 25 bp, Mus musculus
catcgtccgaacagtcggaggagac

SEQ ID NO: 1716 - DNA, 25 bp, Mus musculus
ccgccttttctggagtgaggatgag

SEQ ID NO: 1717 - DNA, 25 bp, Mus musculus
ccttttctggagtgaggatgagcgc

SEQ ID NO: 1718 - DNA, 25 bp, Mus musculus
cctgaagcagttcctcctgtcggac

SEQ ID NO: 1719 - DNA, 25 bp, Mus musculus
gaagcagttcctcctgtcggacatc

SEQ ID NO: 1720 - DNA, 25 bp, Mus musculus
gttcctcctgtcggacatcaaccag

SEQ ID NO: 1721 - DNA, 25 bp, Mus musculus
ggacatcaaccagagtgtcaagttt

SEQ ID NO: 1722 - DNA, 25 bp, Mus musculus
catcaaccagagtgtcaagtttcag

SEQ ID NO: 1723 - DNA, 25 bp, Mus musculus
tgtcaagtttcagcctcttagcaag

SEQ ID NO: 1724 - DNA, 25 bp, Mus musculus
cactgcctcctgacataccgagctt

SEQ ID NO: 1725 - DNA, 25 bp, Mus musculus
ctcctgacataccgagcttcgacat

SEQ ID NO: 1726 - DNA, 25 bp, Mus musculus
agaagagcaagcacctgcaggagca

SEQ ID NO: 1727 - DNA, 25 bp, Mus musculus
cggccttggacgtcctacacagcga

SEQ ID NO: 1728 - DNA, 25 bp, Mus musculus
agagctcagacagaggcggccccag

SEQ ID NO: 1729 - DNA, 25 bp, Mus musculus
ataccattaaaaagctcactctgca

SEQ ID NO: 1730 - DNA, 25 bp, Mus musculus
agctcactctgcagagcgccaagtc

SEQ ID NO: 1731 - DNA, 25 bp, Mus musculus
ctctgcagagcgccaagtcccgagt

SEQ ID NO: 1732 - DNA, 25 bp, Mus musculus
ctgccaacatctgctgctcctgaca

SEQ ID NO: 1733 - DNA, 25 bp, Mus musculus
acatctgctgctcctgacaccaaca

SEQ ID NO: 1734 - DNA, 25 bp, Mus musculus
ctcttgagttgagggccccgtgcca

SEQ ID NO: 1735 - DNA, 25 bp, Mus musculus
aggtttctcacaatgtgttctaggt

SEQ ID NO: 1736 - DNA, 25 bp, Mus musculus
acataccgagcttcgacattattgc

SEQ ID NO: 1737 - DNA, 25 bp, Mus musculus
cgagcttcgacattattgctgacag

SEQ ID NO: 1738 - DNA, 25 bp, Mus musculus
ttattgctgacagcttgtcattcga

SEQ ID NO: 1739 - DNA, 25 bp, Mus musculus
ctgacagcttgtcattcgacttcaa

SEQ ID NO: 1740 - DNA, 25 bp, Mus musculus
gcttgtcattcgacttcaaggatac

SEQ ID NO: 1741 - DNA, 25 bp, Mus musculus
cattcgacttcaaggatacggacat

SEQ ID NO: 1742 - DNA, 25 bp, Mus musculus
tgaagcgactttccatggagataga

SEQ ID NO: 1743 - DNA, 25 bp, Mus musculus
gactttccatggagatagagaaaga

SEQ ID NO: 1744 - DNA, 25 bp, Mus musculus
ctgtgctcacacatagcacagacca

SEQ ID NO: 1745 - DNA, 25 bp, Mus musculus
tgctcacacatagcacagaccagga

SEQ ID NO: 1746 - DNA, 25 bp, Mus musculus
ttttcatctggagagtctgcaggag

SEQ ID NO: 1747 - DNA, 25 bp, Mus musculus
gatgctaccgaggcaaccttgcttc

SEQ ID NO: 1748 - DNA, 25 bp, Mus musculus
ttgcttccgtccacagttatagttt

SEQ ID NO: 1749 - DNA, 25 bp, Mus musculus
tcaactaccaaattcagaacttggc

SEQ ID NO: 1750 - DNA, 25 bp, Mus musculus
actaccaaattcagaacttggccag

SEQ ID NO: 1751 - DNA, 25 bp, Mus musculus
ttcagaacttggccaggaagatcaa

SEQ ID NO: 1752 - DNA, 25 bp, Mus musculus
agatcaatcagtccatcgtctggat

SEQ ID NO: 1753 - DNA, 25 bp, Mus musculus
atcagtccatcgtctggattggagg

SEQ ID NO: 1754 - DNA, 25 bp, Mus musculus
agtccatcgtctggattggaggcat

SEQ ID NO: 1755 - DNA, 25 bp, Mus musculus
ccatcgtctggattggaggcatcct

SEQ ID NO: 1756 - DNA, 25 bp, Mus musculus
tcacacatagcacagaccaggatcc

SEQ ID NO: 1757 - DNA, 25 bp, Mus musculus
atagcacagaccaggatcccaactg

SEQ ID NO: 1758 - DNA, 25 bp, Mus musculus
gcacagaccaggatcccaactggag

SEQ ID NO: 1759 - DNA, 25 bp, Mus musculus
cagaccaggatcccaactggagggc

SEQ ID NO: 1760 - DNA, 25 bp, Mus musculus
agacatgaaacagcccctgatcctg

SEQ ID NO: 1761 - DNA, 25 bp, Mus musculus
catgaaacagcccctgatcctgtcc

SEQ ID NO: 1762 - DNA, 25 bp, Mus musculus
gaaacagcccctgatcctgtccttt

SEQ ID NO: 1763 - DNA, 25 bp, Mus musculus
ttctgcttttcatctggagagtctg

SEQ ID NO: 1764 - DNA, 25 bp, Mus musculus
aactcaggacggtcccagtactcag

SEQ ID NO: 1765 - DNA, 25 bp, Mus musculus
atgatagcttcttgtagccgaacgt

SEQ ID NO: 1766 - DNA, 25 bp, Mus musculus
tcttgttttccaaaggagtggtcag

SEQ ID NO: 1767 - DNA, 25 bp, Mus musculus
tgcccagtacacgctcctggaagag

SEQ ID NO: 1768 - DNA, 25 bp, Mus musculus
tggccactgaaccacgccagggtgt

SEQ ID NO: 1769 - DNA, 25 bp, Mus musculus
cacgccagggtgtactctccactga

SEQ ID NO: 1770 - DNA, 25 bp, Mus musculus
agggtgtactctccactgaagtcca

SEQ ID NO: 1771 - DNA, 25 bp, Mus musculus
tactctccactgaagtccactttca

SEQ ID NO: 1772 - DNA, 25 bp, Mus musculus
ccactgaagtccactttcaattgct

SEQ ID NO: 1773 - DNA, 25 bp, Mus musculus
aagtccactttcaattgcttccatg

SEQ ID NO: 1774 - DNA, 25 bp, Mus musculus
actttcaattgcttccatgcaataa

SEQ ID NO: 1775 - DNA, 25 bp, Mus musculus
aattgcttccatgcaataaaaccaa

SEQ ID NO: 1776 - DNA, 25 bp, Mus musculus
gcttcttgtagccgaacgtgatgta

SEQ ID NO: 1777 - DNA, 25 bp, Mus musculus
atgctgaacgctacgcgtaaaacac

SEQ ID NO: 1778 - DNA, 25 bp, Mus musculus
gcatttatttcctgtatgtccaact

SEQ ID NO: 1779 - DNA, 25 bp, Mus musculus
atttcctgtatgtccaactgacaga

SEQ ID NO: 1780 - DNA, 25 bp, Mus musculus
tgtatgtccaactgacagatgaccg

SEQ ID NO: 1781 - DNA, 25 bp, Mus musculus
tccaactgacagatgaccgcaataa

SEQ ID NO: 1782 - DNA, 25 bp, Mus musculus
gttgtaacctattcctgaatgcctt

SEQ ID NO: 1783 - DNA, 25 bp, Mus musculus
tcctgaatgccttcttgttttccaa

SEQ ID NO: 1784 - DNA, 25 bp, Mus musculus
cagacgatcgatgacctctgacaag

SEQ ID NO: 1785 - DNA, 25 bp, Mus musculus
agacgatcgatgacctctgacaaga

SEQ ID NO: 1786 - DNA, 25 bp, Mus musculus
gatcaacgactatcgcgtattagtc

SEQ ID NO: 1787 - DNA, 25 bp, Mus musculus
atcaacgactatcgcgtattagtcg

SEQ ID NO: 1788 - DNA, 25 bp, Mus musculus
gactatcgcgtattagtcgagtcgc

SEQ ID NO: 1789 - DNA, 25 bp, Mus musculus
ctatcgcgtattagtcgagtcgcag

SEQ ID NO: 1790 - DNA, 25 bp, Mus musculus
cgtattagtcgagtcgcagttgcgg

SEQ ID NO: 1791 - DNA, 25 bp, Mus musculus
gtattagtcgagtcgcagttgcggt

SEQ ID NO: 1792 - DNA, 25 bp, Mus musculus
attagtcgagtcgcagttgcggtcc

SEQ ID NO: 1793 - DNA, 25 bp, Mus musculus
ttagtcgagtcgcagttgcggtcca

SEQ ID NO: 1794 - DNA, 25 bp, Mus musculus
agtcgagtcgcagttgcggtccatc

SEQ ID NO: 1795 - DNA, 25 bp, Mus musculus
cgagtcgcagttgcggtccatctgc

SEQ ID NO: 1796 - DNA, 25 bp, Mus musculus
acgatcgatgacctctgacaagaag

SEQ ID NO: 1797 - DNA, 25 bp, Mus musculus
cgatcgatgacctctgacaagaagt

SEQ ID NO: 1798 - DNA, 25 bp, Mus musculus
atcgatgacctctgacaagaagttg

SEQ ID NO: 1799 - DNA, 25 bp, Mus musculus
gatgacctctgacaagaagttgcag

SEQ ID NO: 1800 - DNA, 25 bp, Mus musculus
ttgcagctgatcaacgactatcgcg

SEQ ID NO: 1801 - DNA, 25 bp, Mus musculus
cagctgatcaacgactatcgcgtat

SEQ ID NO: 1802 - DNA, 25 bp, Mus musculus
gctgatcaacgactatcgcgtatta

SEQ ID NO: 1803 - DNA, 25 bp, Mus musculus
ctgatcaacgactatcgcgtattag

SEQ ID NO: 1804 - DNA, 25 bp, Mus musculus
actcggtgcatccctgtgttgatag

SEQ ID NO: 1805 - DNA, 25 bp, Mus musculus
ttgatagctcctgcttcggtaggga

SEQ ID NO: 1806 - DNA, 25 bp, Mus musculus
agcacatgaggggccgctcttctgt

SEQ ID NO: 1807 - DNA, 25 bp, Mus musculus
ctgccagctctccatgctgagctgt

SEQ ID NO: 1808 - DNA, 25 bp, Mus musculus
gctctccatgctgagctgtggccaa

SEQ ID NO: 1809 - DNA, 25 bp, Mus musculus
ttgctggccgccttcagaatcaggg

SEQ ID NO: 1810 - DNA, 25 bp, Mus musculus
ttagtctgagacatccctgctcccc

SEQ ID NO: 1811 - DNA, 25 bp, Mus musculus
tttcaagtgccttaatagcagggca

SEQ ID NO: 1812 - DNA, 25 bp, Mus musculus
ctagatgctcagccacaagacagcc

SEQ ID NO: 1813 - DNA, 25 bp, Mus musculus
tggactcttgctctttctagctctg

SEQ ID NO: 1814 - DNA, 25 bp, Mus musculus
cttgctctttctagctctgaactaa

SEQ ID NO: 1815 - DNA, 25 bp, Mus musculus
ctttctagctctgaactaataaatg

SEQ ID NO: 1816 - DNA, 25 bp, Mus musculus
gagatcctgcttccatctccagctt

SEQ ID NO: 1817 - DNA, 25 bp, Mus musculus
gagccatgccttaggccatatagcc

SEQ ID NO: 1818 - DNA, 25 bp, Mus musculus
tgccttaggccatatagccttacta

SEQ ID NO: 1819 - DNA, 25 bp, Mus musculus
tatagccttactatcaagtgtcttc

SEQ ID NO: 1820 - DNA, 25 bp, Mus musculus
tacaccttgatccaaagcagtgctc

SEQ ID NO: 1821 - DNA, 25 bp, Mus musculus
ttgatccaaagcagtgctcccaaga

SEQ ID NO: 1822 - DNA, 25 bp, Mus musculus
caaagcagtgctcccaagagcagct

SEQ ID NO: 1823 - DNA, 25 bp, Mus musculus
agcagctcctacgtggtgctgcccg

SEQ ID NO: 1824 - DNA, 25 bp, Mus musculus
aaagccatatttgtaggccgtgcac

SEQ ID NO: 1825 - DNA, 25 bp, Mus musculus
aagccatatttgtaggccgtgcaca

SEQ ID NO: 1826 - DNA, 25 bp, Mus musculus
tgagcagctcaagcaggagaggatt

SEQ ID NO: 1827 - DNA, 25 bp, Mus musculus
agcagctcaagcaggagaggattag

SEQ ID NO: 1828 - DNA, 25 bp, Mus musculus
tgaatctctacattaagaacttgga

SEQ ID NO: 1829 - DNA, 25 bp, Mus musculus
gaatctctacattaagaacttggat

SEQ ID NO: 1830 - DNA, 25 bp, Mus musculus
aatctctacattaagaacttggatg

SEQ ID NO: 1831 - DNA, 25 bp, Mus musculus
atctctacattaagaacttggatga

SEQ ID NO: 1832 - DNA, 25 bp, Mus musculus
tctctacattaagaacttggatgac

SEQ ID NO: 1833 - DNA, 25 bp, Mus musculus
gagagttttctccctttggatcaat

SEQ ID NO: 1834 - DNA, 25 bp, Mus musculus
agccatatttgtaggccgtgcacag

SEQ ID NO: 1835 - DNA, 25 bp, Mus musculus
ccatatttgtaggccgtgcacagaa

SEQ ID NO: 1836 - DNA, 25 bp, Mus musculus
atatttgtaggccgtgcacagaaaa

SEQ ID NO: 1837 - DNA, 25 bp, Mus musculus
tatttgtaggccgtgcacagaaaaa

SEQ ID NO: 1838 - DNA, 25 bp, Mus musculus
atttgtaggccgtgcacagaaaaag

SEQ ID NO: 1839 - DNA, 25 bp, Mus musculus
agtttgagcagctcaagcaggagag

SEQ ID NO: 1840 - DNA, 25 bp, Mus musculus
gtttgagcagctcaagcaggagagg

SEQ ID NO: 1841 - DNA, 25 bp, Mus musculus
ttgagcagctcaagcaggagaggat

SEQ ID NO: 1842 - DNA, 25 bp, Mus musculus
ctagtgctgctgtagagcgtggttc

SEQ ID NO: 1843 - DNA, 25 bp, Mus musculus
tagagcgtggttctccagtggatgg

SEQ ID NO: 1844 - DNA, 25 bp, Mus musculus
tgctcttcccatggcagctgattct

SEQ ID NO: 1845 - DNA, 25 bp, Mus musculus
tgattctctggtgccagtttccact

SEQ ID NO: 1846 - DNA, 25 bp, Mus musculus
ttctctgtaggccttgcagcaaggt

SEQ ID NO: 1847 - DNA, 25 bp, Mus musculus
gtaggccttgcagcaaggtttgctc

SEQ ID NO: 1848 - DNA, 25 bp, Mus musculus
cttgcagcaaggtttgctcactgca

SEQ ID NO: 1849 - DNA, 25 bp, Mus musculus
tttgctcactgcatcagtgctgtag

SEQ ID NO: 1850 - DNA, 25 bp, Mus musculus
cactgcatcagtgctgtagggacca

SEQ ID NO: 1851 - DNA, 25 bp, Mus musculus
aactacagcctgcaaggattcctgc

SEQ ID NO: 1852 - DNA, 25 bp, Mus musculus
ggacaagcactctaccactgagcca

SEQ ID NO: 1853 - DNA, 25 bp, Mus musculus
taccactgagccacacacatacata

SEQ ID NO: 1854 - DNA, 25 bp, Mus musculus
gtggttctccagtggatggatagat

SEQ ID NO: 1855 - DNA, 25 bp, Mus musculus
gcatgactcttaggctgaagaaacc

SEQ ID NO: 1856 - DNA, 25 bp, Mus musculus
acattgacaccttctggcgtgcact

SEQ ID NO: 1857 - DNA, 25 bp, Mus musculus
cttatattgcctgaagaagcactgt

SEQ ID NO: 1858 - DNA, 25 bp, Mus musculus
ttgagctagctgtcttggctgcagg

SEQ ID NO: 1859 - DNA, 25 bp, Mus musculus
gatgtgcttcatcccttgcctgggt

SEQ ID NO: 1860 - DNA, 25 bp, Mus musculus
tgctgacccagaggtgaatgctctt

SEQ ID NO: 1861 - DNA, 25 bp, Mus musculus
ggtgaatgctcttcccatggcagct

SEQ ID NO: 1862 - DNA, 25 bp, Mus musculus
cattgaagtgctcatcttggatgag

SEQ ID NO: 1863 - DNA, 25 bp, Mus musculus
tgaagtgctcatcttggatgaggct

SEQ ID NO: 1864 - DNA, 25 bp, Mus musculus
ggtctccttaaagaatcctgtgcgg

SEQ ID NO: 1865 - DNA, 25 bp, Mus musculus
ctccttaaagaatcctgtgcggata

SEQ ID NO: 1866 - DNA, 25 bp, Mus musculus
cttaaagaatcctgtgcggatattt

SEQ ID NO: 1867 - DNA, 25 bp, Mus musculus
gaatcctgtgcggatatttgtgaac

SEQ ID NO: 1868 - DNA, 25 bp, Mus musculus
tcctgtgcggatatttgtgaacagc

SEQ ID NO: 1869 - DNA, 25 bp, Mus musculus
gaacagcaacacagatgtcgctccc

SEQ ID NO: 1870 - DNA, 25 bp, Mus musculus
tcccttcctgcggcaagagttcata

SEQ ID NO: 1871 - DNA, 25 bp, Mus musculus
cttcctgcggcaagagttcatacgg

SEQ ID NO: 1872 - DNA, 25 bp, Mus musculus
agagttcatacggatccggcctaat

SEQ ID NO: 1873 - DNA, 25 bp, Mus musculus
gttcatacggatccggcctaatagg

SEQ ID NO: 1874 - DNA, 25 bp, Mus musculus
catgctcttctcggccaccatgaca

SEQ ID NO: 1875 - DNA, 25 bp, Mus musculus
gctcttctcggccaccatgacagat

SEQ ID NO: 1876 - DNA, 25 bp, Mus musculus
cttctcggccaccatgacagatgag

SEQ ID NO: 1877 - DNA, 25 bp, Mus musculus
ctcggccaccatgacagatgaggtg

SEQ ID NO: 1878 - DNA, 25 bp, Mus musculus
gaaagatctggcttcggtctcctta

SEQ ID NO: 1879 - DNA, 25 bp, Mus musculus
agatctggcttcggtctccttaaag

SEQ ID NO: 1880 - DNA, 25 bp, Mus musculus
tctggcttcggtctccttaaagaat

SEQ ID NO: 1881 - DNA, 25 bp, Mus musculus
ttcggtctccttaaagaatcctgtg

SEQ ID NO: 1882 - DNA, 25 bp, Mus musculus
tcctcctgcaggatgatggttaagc

SEQ ID NO: 1883 - DNA, 25 bp, Mus musculus
atggttaagccatggtcctgagaca

SEQ ID NO: 1884 - DNA, 25 bp, Mus musculus
agctctgtactgtaagctatgtgga

SEQ ID NO: 1885 - DNA, 25 bp, Mus musculus
tccctagctcaggctcgtcagttct

SEQ ID NO: 1886 - DNA, 25 bp, Mus musculus
gctcaggctcgtcagttctgagttt

SEQ ID NO: 1887 - DNA, 25 bp, Mus musculus
gctcgtcagttctgagtttacctga

SEQ ID NO: 1888 - DNA, 25 bp, Mus musculus
cagttctgagtttacctgagctctt

SEQ ID NO: 1889 - DNA, 25 bp, Mus musculus
ttctgagtttacctgagctctttta

SEQ ID NO: 1890 - DNA, 25 bp, Mus musculus
catcttcccaaggggttatcaagat

SEQ ID NO: 1891 - DNA, 25 bp, Mus musculus
agatactcagaggaacctggaaatg

SEQ ID NO: 1892 - DNA, 25 bp, Mus musculus
tgtatgctttgcattgtatatggaa

SEQ ID NO: 1893 - DNA, 25 bp, Mus musculus
agaacttgtgtcatcaagtatgtat

SEQ ID NO: 1894 - DNA, 25 bp, Mus musculus
gttaagccatggtcctgagacaaaa

SEQ ID NO: 1895 - DNA, 25 bp, Mus musculus
ccatggtcctgagacaaaagtaact

SEQ ID NO: 1896 - DNA, 25 bp, Mus musculus
tctttaagggctggtctgagtcctc

SEQ ID NO: 1897 - DNA, 25 bp, Mus musculus
ctgagtcctcactcaagtggctggg

SEQ ID NO: 1898 - DNA, 25 bp, Mus musculus
cctcactcaagtggctgggatggct

SEQ ID NO: 1899 - DNA, 25 bp, Mus musculus
tcaagtggctgggatggctgtccta

SEQ ID NO: 1900 - DNA, 25 bp, Mus musculus
tgtcctagctctgtactgtaagcta

SEQ ID NO: 1901 - DNA, 25 bp, Mus musculus
cctagctctgtactgtaagctatgt

SEQ ID NO: 1902 - DNA, 25 bp, Mus musculus
tgacctttgctggtctctgcccttg

SEQ ID NO: 1903 - DNA, 25 bp, Mus musculus
ttgctggtctctgcccttgaggtca

SEQ ID NO: 1904 - DNA, 25 bp, Mus musculus
aactgagctctgggcacgtgatgcc

SEQ ID NO: 1905 - DNA, 25 bp, Mus musculus
tgatgcctctaccaggccatgatgt

SEQ ID NO: 1906 - DNA, 25 bp, Mus musculus
atgatgtaccagcagaccctgagcc

SEQ ID NO: 1907 - DNA, 25 bp, Mus musculus
gctaggcttctcagctccattactg

SEQ ID NO: 1908 - DNA, 25 bp, Mus musculus
cttctcagctccattactggcagag

SEQ ID NO: 1909 - DNA, 25 bp, Mus musculus
agctccattactggcagagagggcc

SEQ ID NO: 1910 - DNA, 25 bp, Mus musculus
attactggcagagagggccttcttt

SEQ ID NO: 1911 - DNA, 25 bp, Mus musculus
tgccgtcctttttgctctagtttgc

SEQ ID NO: 1912 - DNA, 25 bp, Mus musculus
cctttttgctctagtttgcttcaca

SEQ ID NO: 1913 - DNA, 25 bp, Mus musculus
cttcacagttcttctttccatgatt

SEQ ID NO: 1914 - DNA, 25 bp, Mus musculus
gtctctgcccttgaggtcactgcag

SEQ ID NO: 1915 - DNA, 25 bp, Mus musculus
gacagcctcggaagactattgggaa

SEQ ID NO: 1916 - DNA, 25 bp, Mus musculus
ctactaggcaccacacactgaggaa

SEQ ID NO: 1917 - DNA, 25 bp, Mus musculus
ggcaccacacactgaggaatagaat

SEQ ID NO: 1918 - DNA, 25 bp, Mus musculus
aatttgctctcaaatgacaccagaa

SEQ ID NO: 1919 - DNA, 25 bp, Mus musculus
ctctcaaatgacaccagaagcccag

SEQ ID NO: 1920 - DNA, 25 bp, Mus musculus
ggtttaaatagcacccacatatcct

SEQ ID NO: 1921 - DNA, 25 bp, Mus musculus
aatagcacccacatatcctgggtaa

SEQ ID NO: 1922 - DNA, 25 bp, Mus musculus
aggccaacagtttcttgatatgggg

SEQ ID NO: 1923 - DNA, 25 bp, Mus musculus
tccatgtttcctggggcatgaccca

SEQ ID NO: 1924 - DNA, 25 bp, Mus musculus
tgccagccaggcatccaggtcttgt

SEQ ID NO: 1925 - DNA, 25 bp, Mus musculus
ctcgtatagtctctactcagtctca

SEQ ID NO: 1926 - DNA, 25 bp, Mus musculus
ctactcagtctcagaggccaggtca

SEQ ID NO: 1927 - DNA, 25 bp, Mus musculus
agtctcagaggccaggtcaagtgtc

SEQ ID NO: 1928 - DNA, 25 bp, Mus musculus
tgtcagctggactttcccagggtca

SEQ ID NO: 1929 - DNA, 25 bp, Mus musculus
tttcccagggtcaaaatgaatctga

SEQ ID NO: 1930 - DNA, 25 bp, Mus musculus
aatctgagctcccattttggctagt

SEQ ID NO: 1931 - DNA, 25 bp, Mus musculus
tctccccaacaaggggtatgggcat

SEQ ID NO: 1932 - DNA, 25 bp, Mus musculus
tgactttttccggtgtactgtcctg

SEQ ID NO: 1933 - DNA, 25 bp, Mus musculus
ttgacatcagagcaggcatggtttc

SEQ ID NO: 1934 - DNA, 25 bp, Mus musculus
tttcctggggcatgacccatactgg

SEQ ID NO: 1935 - DNA, 25 bp, Mus musculus
atactgggtctgctcttggcttgag

SEQ ID NO: 1936 - DNA, 25 bp, Mus musculus
ggtctgctcttggcttgagctctac

SEQ ID NO: 1937 - DNA, 25 bp, Mus musculus
ctcttggcttgagctctacaaatac

SEQ ID NO: 1938 - DNA, 25 bp, Mus musculus
gttttaccagcctcatatctccagt

SEQ ID NO: 1939 - DNA, 25 bp, Mus musculus
tcatatctccagtctctgccatgcc

SEQ ID NO: 1940 - DNA, 25 bp, Mus musculus
ctccagtctctgccatgcctgggga

SEQ ID NO: 1941 - DNA, 25 bp, Mus musculus
aaactctgccagccaggcatccagg

SEQ ID NO: 1942 - DNA, 25 bp, Mus musculus
agctccaggctgccggaaagagccc

SEQ ID NO: 1943 - DNA, 25 bp, Mus musculus
aagctgacacccttcattctggggg

SEQ ID NO: 1944 - DNA, 25 bp, Mus musculus
tggactacaaggctgttgggagaag

SEQ ID NO: 1945 - DNA, 25 bp, Mus musculus
gactacaaggctgttgggagaagct

SEQ ID NO: 1946 - DNA, 25 bp, Mus musculus
ctacaaggctgttgggagaagctgg

SEQ ID NO: 1947 - DNA, 25 bp, Mus musculus
cctccctgttgaagctgatggaagg

SEQ ID NO: 1948 - DNA, 25 bp, Mus musculus
tccctgttgaagctgatggaagggc

SEQ ID NO: 1949 - DNA, 25 bp, Mus musculus
ttgacgtgtcatgttgttctgacct

SEQ ID NO: 1950 - DNA, 25 bp, Mus musculus
gacgtgtcatgttgttctgacctgt

SEQ ID NO: 1951 - DNA, 25 bp, Mus musculus
tcatgttgttctgacctgtatttca

SEQ ID NO: 1952 - DNA, 25 bp, Mus musculus
atgttgttctgacctgtatttcaca

SEQ ID NO: 1953 - DNA, 25 bp, Mus musculus
caccccagctagaataaagacacct

SEQ ID NO: 1954 - DNA, 25 bp, Mus musculus
tgggacatcaacagcttcgaccagt

SEQ ID NO: 1955 - DNA, 25 bp, Mus musculus
ggacatcaacagcttcgaccagtgg

SEQ ID NO: 1956 - DNA, 25 bp, Mus musculus
acatcaacagcttcgaccagtgggg

SEQ ID NO: 1957 - DNA, 25 bp, Mus musculus
ggcagctctgctgtgacctcccatg

SEQ ID NO: 1958 - DNA, 25 bp, Mus musculus
ctagaataactccagccgcggccct

SEQ ID NO: 1959 - DNA, 25 bp, Mus musculus
agttggcctggactacaaggctgtt

SEQ ID NO: 1960 - DNA, 25 bp, Mus musculus
ttggcctggactacaaggctgttgg

SEQ ID NO: 1961 - DNA, 25 bp, Mus musculus
cctggactacaaggctgttgggaga

SEQ ID NO: 1962 - DNA, 25 bp, Mus musculus
aagccttgtcatctgaaggggacca

SEQ ID NO: 1963 - DNA, 25 bp, Mus musculus
ccttgtcatctgaaggggaccatgg

SEQ ID NO: 1964 - DNA, 25 bp, Mus musculus
gaggaccttctcaaggagcactaca

SEQ ID NO: 1965 - DNA, 25 bp, Mus musculus
gaccttctcaaggagcactacactg

SEQ ID NO: 1966 - DNA, 25 bp, Mus musculus
aaggagcactacactgacctgaagg

SEQ ID NO: 1967 - DNA, 25 bp, Mus musculus
gagcactacactgacctgaaggacc

SEQ ID NO: 1968 - DNA, 25 bp, Mus musculus
cactacactgacctgaaggaccgcc

SEQ ID NO: 1969 - DNA, 25 bp, Mus musculus
tttactggcctggtgaaatacatgc

SEQ ID NO: 1970 - DNA, 25 bp, Mus musculus
gtgaaatacatgcactcaggaccag

SEQ ID NO: 1971 - DNA, 25 bp, Mus musculus
tacatgcactcaggaccagtggttg

SEQ ID NO: 1972 - DNA, 25 bp, Mus musculus
cactcaggaccagtggttgctatgg

SEQ ID NO: 1973 - DNA, 25 bp, Mus musculus
tcaggaccagtggttgctatggtct

SEQ ID NO: 1974 - DNA, 25 bp, Mus musculus
gggaccatggccaacagtgagcgca

SEQ ID NO: 1975 - DNA, 25 bp, Mus musculus
atggccaacagtgagcgcaccttca

SEQ ID NO: 1976 - DNA, 25 bp, Mus musculus
gccaacagtgagcgcaccttcattg

SEQ ID NO: 1977 - DNA, 25 bp, Mus musculus
aacagtgagcgcaccttcattgcca

SEQ ID NO: 1978 - DNA, 25 bp, Mus musculus
cgccttgttggtctgaagtttctgc

SEQ ID NO: 1979 - DNA, 25 bp, Mus musculus
aagtttctgcaggcttcagaggacc

SEQ ID NO: 1980 - DNA, 25 bp, Mus musculus
caggcttcagaggaccttctcaagg

SEQ ID NO: 1981 - DNA, 25 bp, Mus musculus
gcttcagaggaccttctcaaggagc

SEQ ID NO: 1982 - DNA, 25 bp, Mus musculus
caaacagttcctgaggatttccaag

SEQ ID NO: 1983 - DNA, 25 bp, Mus musculus
gttcctgaggatttccaagaacaag

SEQ ID NO: 1984 - DNA, 25 bp, Mus musculus
ctttgtgcacaaggacttagcggct

SEQ ID NO: 1985 - DNA, 25 bp, Mus musculus
tgtgcacaaggacttagcggctcgc

SEQ ID NO: 1986 - DNA, 25 bp, Mus musculus
ggacttagcggctcgcaactgcctg

SEQ ID NO: 1987 - DNA, 25 bp, Mus musculus
cttagcggctcgcaactgcctgatc

SEQ ID NO: 1988 - DNA, 25 bp, Mus musculus
agcggctcgcaactgcctgatcagt

SEQ ID NO: 1989 - DNA, 25 bp, Mus musculus
tcgcaactgcctgatcagtgcccag

SEQ ID NO: 1990 - DNA, 25 bp, Mus musculus
caactgcctgatcagtgcccagagg

SEQ ID NO: 1991 - DNA, 25 bp, Mus musculus
ctgcctgatcagtgcccagaggcag

SEQ ID NO: 1992 - DNA, 25 bp, Mus musculus
cgcactgggcctgagcaaggatgta

SEQ ID NO: 1993 - DNA, 25 bp, Mus musculus
tgagtactaccacttccgccaggcc

SEQ ID NO: 1994 - DNA, 25 bp, Mus musculus
cctcagcaccaaacagaaggtggcc

SEQ ID NO: 1995 - DNA, 25 bp, Mus musculus
cagcaccaaacagaaggtggccctg

SEQ ID NO: 1996 - DNA, 25 bp, Mus musculus
catggagcacctgtccaacaaccgc

SEQ ID NO: 1997 - DNA, 25 bp, Mus musculus
ggagcacctgtccaacaaccgcttt

SEQ ID NO: 1998 - DNA, 25 bp, Mus musculus
gcacctgtccaacaaccgctttgtg

SEQ ID NO: 1999 - DNA, 25 bp, Mus musculus
gtccaacaaccgctttgtgcacaag

SEQ ID NO: 2000 - DNA, 25 bp, Mus musculus
caacaaccgctttgtgcacaaggac

SEQ ID NO: 2001 - DNA, 25 bp, Mus musculus
caaccgctttgtgcacaaggactta

SEQ ID NO: 2002 - DNA, 25 bp, Mus musculus
ctcgtgccaccaaagaactgtcagc

SEQ ID NO: 2003 - DNA, 25 bp, Mus musculus
tcgtgccaccaaagaactgtcagca

SEQ ID NO: 2004 - DNA, 25 bp, Mus musculus
gttggctttcctgtaagctatccag

SEQ ID NO: 2005 - DNA, 25 bp, Mus musculus
ttggctttcctgtaagctatccagg

SEQ ID NO: 2006 - DNA, 25 bp, Mus musculus
tttcctgtaagctatccaggagctt

SEQ ID NO: 2007 - DNA, 25 bp, Mus musculus
ttcctgtaagctatccaggagcttg

SEQ ID NO: 2008 - DNA, 25 bp, Mus musculus
cctgtaagctatccaggagcttggg

SEQ ID NO: 2009 - DNA, 25 bp, Mus musculus
ctgtaagctatccaggagcttgggt

SEQ ID NO: 2010 - DNA, 25 bp, Mus musculus
gtaagctatccaggagcttgggtta

SEQ ID NO: 2011 - DNA, 25 bp, Mus musculus
agctatccaggagcttgggttaata

SEQ ID NO: 2012 - DNA, 25 bp, Mus musculus
gctatccaggagcttgggttaatat

SEQ ID NO: 2013 - DNA, 25 bp, Mus musculus
taaataaagctcatctgtcgggtgt

SEQ ID NO: 2014 - DNA, 25 bp, Mus musculus
gtgccaccaaagaactgtcagcagc

SEQ ID NO: 2015 - DNA, 25 bp, Mus musculus
tgccaccaaagaactgtcagcagct

SEQ ID NO: 2016 - DNA, 25 bp, Mus musculus
ccaccaaagaactgtcagcagctgc

SEQ ID NO: 2017 - DNA, 25 bp, Mus musculus
caaagaactgtcagcagctgcctgc

SEQ ID NO: 2018 - DNA, 25 bp, Mus musculus
agaactgtcagcagctgcctgcacg

SEQ ID NO: 2019 - DNA, 25 bp, Mus musculus
tgtcagcagctgcctgcacgtcttt

SEQ ID NO: 2020 - DNA, 25 bp, Mus musculus
gtcagcagctgcctgcacgtctttc

SEQ ID NO: 2021 - DNA, 25 bp, Mus musculus
cagcagctgcctgcacgtctttcac

SEQ ID NO: 2022 - DNA, 25 bp, Mus musculus
tctcggaaaccggtagcccttgcag

SEQ ID NO: 2023 - DNA, 25 bp, Mus musculus
tcggaaaccggtagcccttgcagca

SEQ ID NO: 2024 - DNA, 25 bp, Mus musculus
tagcccttgcagcatggctgaccaa

SEQ ID NO: 2025 - DNA, 25 bp, Mus musculus
agcccttgcagcatggctgaccaac

SEQ ID NO: 2026 - DNA, 25 bp, Mus musculus
gcccttgcagcatggctgaccaact

SEQ ID NO: 2027 - DNA, 25 bp, Mus musculus
cccttgcagcatggctgaccaactg

SEQ ID NO: 2028 - DNA, 25 bp, Mus musculus
ccttgcagcatggctgaccaactga

SEQ ID NO: 2029 - DNA, 25 bp, Mus musculus
ttgcagcatggctgaccaactgact

SEQ ID NO: 2030 - DNA, 25 bp, Mus musculus
tgcagcatggctgaccaactgactg

SEQ ID NO: 2031 - DNA, 25 bp, Mus musculus
ggtctctggggcagaacccacagaa

SEQ ID NO: 2032 - DNA, 25 bp, Mus musculus
tctctggggcagaacccacagaagc

SEQ ID NO: 2033 - DNA, 25 bp, Mus musculus
ctctggggcagaacccacagaagca

SEQ ID NO: 2034 - DNA, 25 bp, Mus musculus
cggaaaccggtagcccttgcagcat

SEQ ID NO: 2035 - DNA, 25 bp, Mus musculus
gaaaccggtagcccttgcagcatgg

SEQ ID NO: 2036 - DNA, 25 bp, Mus musculus
aaaccggtagcccttgcagcatggc

SEQ ID NO: 2037 - DNA, 25 bp, Mus musculus
aaccggtagcccttgcagcatggct

SEQ ID NO: 2038 - DNA, 25 bp, Mus musculus
accggtagcccttgcagcatggctg

SEQ ID NO: 2039 - DNA, 25 bp, Mus musculus
ccggtagcccttgcagcatggctga

SEQ ID NO: 2040 - DNA, 25 bp, Mus musculus
cggtagcccttgcagcatggctgac

SEQ ID NO: 2041 - DNA, 25 bp, Mus musculus
gtagcccttgcagcatggctgacca

SEQ ID NO: 2042 - DNA, 25 bp, Mus musculus
cttgcctggcttgctttcagttttc

SEQ ID NO: 2043 - DNA, 25 bp, Mus musculus
tttcgcctttgttccacaaggatag

SEQ ID NO: 2044 - DNA, 25 bp, Mus musculus
gctattagttacctctctgtggttt

SEQ ID NO: 2045 - DNA, 25 bp, Mus musculus
ttgctcaaacaatggctgagggact

SEQ ID NO: 2046 - DNA, 25 bp, Mus musculus
ctcaaacaatggctgagggactaac

SEQ ID NO: 2047 - DNA, 25 bp, Mus musculus
cagtgactgacaagcctcgggggat

SEQ ID NO: 2048 - DNA, 25 bp, Mus musculus
tgactgacaagcctcgggggattgc

SEQ ID NO: 2049 - DNA, 25 bp, Mus musculus
ctgacaagcctcgggggattgctct

SEQ ID NO: 2050 - DNA, 25 bp, Mus musculus
acaagcctcgggggattgctctcca

SEQ ID NO: 2051 - DNA, 25 bp, Mus musculus
agcctcgggggattgctctccagct

SEQ ID NO: 2052 - DNA, 25 bp, Mus musculus
tctccgcctcattcttgctattctt

SEQ ID NO: 2053 - DNA, 25 bp, Mus musculus
ccgcctcattcttgctattctttct

SEQ ID NO: 2054 - DNA, 25 bp, Mus musculus
tcgcctcatgcgtttttggatagtt

SEQ ID NO: 2055 - DNA, 25 bp, Mus musculus
cctcatgcgtttttggatagttctg

SEQ ID NO: 2056 - DNA, 25 bp, Mus musculus
agttctgccacggcgtgtgacagca

SEQ ID NO: 2057 - DNA, 25 bp, Mus musculus
tctgccacggcgtgtgacagcaaaa

SEQ ID NO: 2058 - DNA, 25 bp, Mus musculus
tttcttcgggctagcctggctaaat

SEQ ID NO: 2059 - DNA, 25 bp, Mus musculus
cgggctagcctggctaaatggcatc

SEQ ID NO: 2060 - DNA, 25 bp, Mus musculus
gctagcctggctaaatggcatccaa

SEQ ID NO: 2061 - DNA, 25 bp, Mus musculus
ccacttgttgctattagttacctct

SEQ ID NO: 2062 - DNA, 25 bp, Mus musculus
atgcggaccacacaggactagtgag

SEQ ID NO: 2063 - DNA, 25 bp, Mus musculus
ttgagtcaactcaaggatggtttga

SEQ ID NO: 2064 - DNA, 25 bp, Mus musculus
tcctaatgattttgctcttcggacc

SEQ ID NO: 2065 - DNA, 25 bp, Mus musculus
gaccctgcattcttaatcgattagt

SEQ ID NO: 2066 - DNA, 25 bp, Mus musculus
cctgcattcttaatcgattagtcca

SEQ ID NO: 2067 - DNA, 25 bp, Mus musculus
ttcttaatcgattagtccaatttgt

SEQ ID NO: 2068 - DNA, 25 bp, Mus musculus
ctcaacaatatcaccagctgaagcc

SEQ ID NO: 2069 - DNA, 25 bp, Mus musculus
aatatcaccagctgaagcctataga

SEQ ID NO: 2070 - DNA, 25 bp, Mus musculus
atcaccagctgaagcctatagagta

SEQ ID NO: 2071 - DNA, 25 bp, Mus musculus
tcaccagctgaagcctatagagtac

SEQ ID NO: 2072 - DNA, 25 bp, Mus musculus
caccagctgaagcctatagagtacg

SEQ ID NO: 2073 - DNA, 25 bp, Mus musculus
accagctgaagcctatagagtacga

SEQ ID NO: 2074 - DNA, 25 bp, Mus musculus
ctaccattatgggacccctcattgt

SEQ ID NO: 2075 - DNA, 25 bp, Mus musculus
ccattatgggacccctcattgtact

SEQ ID NO: 2076 - DNA, 25 bp, Mus musculus
ttatgggacccctcattgtactcct

SEQ ID NO: 2077 - DNA, 25 bp, Mus musculus
tgggacccctcattgtactcctaat

SEQ ID NO: 2078 - DNA, 25 bp, Mus musculus
gacccctcattgtactcctaatgat

SEQ ID NO: 2079 - DNA, 25 bp, Mus musculus
ccctcattgtactcctaatgatttt

SEQ ID NO: 2080 - DNA, 25 bp, Mus musculus
tcattgtactcctaatgattttgct

SEQ ID NO: 2081 - DNA, 25 bp, Mus musculus
tactcctaatgattttgctcttcgg

SEQ ID NO: 2082 - DNA, 25 bp, Mus musculus
gaaagttggcctgttgtgtgcttga

SEQ ID NO: 2083 - DNA, 25 bp, Mus musculus
aagttggcctgttgtgtgcttgagt

SEQ ID NO: 2084 - DNA, 25 bp, Mus musculus
aaggggatatcctcaccttgctcaa

SEQ ID NO: 2085 - DNA, 25 bp, Mus musculus
ggggatatcctcaccttgctcaaca

SEQ ID NO: 2086 - DNA, 25 bp, Mus musculus
ggatatcctcaccttgctcaacagc

SEQ ID NO: 2087 - DNA, 25 bp, Mus musculus
atcctcaccttgctcaacagcacaa

SEQ ID NO: 2088 - DNA, 25 bp, Mus musculus
tcaccttgctcaacagcacaaacaa

SEQ ID NO: 2089 - DNA, 25 bp, Mus musculus
accttgctcaacagcacaaacaagg

SEQ ID NO: 2090 - DNA, 25 bp, Mus musculus
cttgctcaacagcacaaacaaggca

SEQ ID NO: 2091 - DNA, 25 bp, Mus musculus
tgctcaacagcacaaacaaggcaag

SEQ ID NO: 2092 - DNA, 25 bp, Mus musculus
ctcaacagcacaaacaaggcaaggc

SEQ ID NO: 2093 - DNA, 25 bp, Mus musculus
caacagcacaaacaaggcaaggcac

SEQ ID NO: 2094 - DNA, 25 bp, Mus musculus
agtggcccccatggatgatgagact

SEQ ID NO: 2095 - DNA, 25 bp, Mus musculus
agctggtcttggctctctatgacta

SEQ ID NO: 2096 - DNA, 25 bp, Mus musculus
ctggtcttggctctctatgactatc

SEQ ID NO: 2097 - DNA, 25 bp, Mus musculus
ggtcttggctctctatgactatcaa

SEQ ID NO: 2098 - DNA, 25 bp, Mus musculus
tcttggctctctatgactatcaaga

SEQ ID NO: 2099 - DNA, 25 bp, Mus musculus
ttggctctctatgactatcaagaga

SEQ ID NO: 2100 - DNA, 25 bp, Mus musculus
agaagagccctcgtgaggtcaccat

SEQ ID NO: 2101 - DNA, 25 bp, Mus musculus
aagagccctcgtgaggtcaccatga

SEQ ID NO: 2102 - DNA, 25 bp, Mus musculus
cagatgctgtgcctggagcggcata

SEQ ID NO: 2103 - DNA, 25 bp, Mus musculus
ctagagtcagcttcctccgatgagg

SEQ ID NO: 2104 - DNA, 25 bp, Mus musculus
ccttgccagggagattctccgcctt

SEQ ID NO: 2105 - DNA, 25 bp, Mus musculus
gattctccgccttatgtgggagatc

SEQ ID NO: 2106 - DNA, 25 bp, Mus musculus
ggagatctagcatctgcttgcacat

SEQ ID NO: 2107 - DNA, 25 bp, Mus musculus
ctagcatctgcttgcacattctctg

SEQ ID NO: 2108 - DNA, 25 bp, Mus musculus
tctgcttgcacattctctgtctggt

SEQ ID NO: 2109 - DNA, 25 bp, Mus musculus
tgcacattctctgtctggtatgaac

SEQ ID NO: 2110 - DNA, 25 bp, Mus musculus
gtctggtatgaaccctcaaactgga

SEQ ID NO: 2111 - DNA, 25 bp, Mus musculus
ccctcaaactggagatccaagtcca

SEQ ID NO: 2112 - DNA, 25 bp, Mus musculus
aggaaccctagagcccaggcatgga

SEQ ID NO: 2113 - DNA, 25 bp, Mus musculus
cctagagcccaggcatggatagaga

SEQ ID NO: 2114 - DNA, 25 bp, Mus musculus
tcagcttcctccgatgaggaaaatg

SEQ ID NO: 2115 - DNA, 25 bp, Mus musculus
gtgcgcaacccactgtttgaccatt

SEQ ID NO: 2116 - DNA, 25 bp, Mus musculus
ctgtttgaccattccacgctgtcag

SEQ ID NO: 2117 - DNA, 25 bp, Mus musculus
gaccattccacgctgtcagcaccag

SEQ ID NO: 2118 - DNA, 25 bp, Mus musculus
ttgccgccgctgcagtgactcctag

SEQ ID NO: 2119 - DNA, 25 bp, Mus musculus
cagtgactcctaggcccacatgcct

SEQ ID NO: 2120 - DNA, 25 bp, Mus musculus
ccacagcccaccagtggggacgagc

SEQ ID NO: 2121 - DNA, 25 bp, Mus musculus
ctggtgttccccatggaaaagagca

SEQ ID NO: 2122 - DNA, 25 bp, Mus musculus
cacaacaaccatatgggcaaaggtg

SEQ ID NO: 2123 - DNA, 25 bp, Mus musculus
caacaaccatatgggcaaaggtgct

SEQ ID NO: 2124 - DNA, 25 bp, Mus musculus
cgtacatcatgacaagtgggtgcaa

SEQ ID NO: 2125 - DNA, 25 bp, Mus musculus
ttttcgaccccatcattcaggaccg

SEQ ID NO: 2126 - DNA, 25 bp, Mus musculus
gaccccatcattcaggaccggcaag

SEQ ID NO: 2127 - DNA, 25 bp, Mus musculus
accccatcattcaggaccggcaagg

SEQ ID NO: 2128 - DNA, 25 bp, Mus musculus
cccatcattcaggaccggcaaggcg

SEQ ID NO: 2129 - DNA, 25 bp, Mus musculus
ccatcattcaggaccggcaaggcgg

SEQ ID NO: 2130 - DNA, 25 bp, Mus musculus
atcattcaggaccggcaaggcggct

SEQ ID NO: 2131 - DNA, 25 bp, Mus musculus
tcattcaggaccggcaaggcggcta

SEQ ID NO: 2132 - DNA, 25 bp, Mus musculus
attcaggaccggcaaggcggctagc

SEQ ID NO: 2133 - DNA, 25 bp, Mus musculus
ttcaggaccggcaaggcggctagca

SEQ ID NO: 2134 - DNA, 25 bp, Mus musculus
caaccatatgggcaaaggtgctgac

SEQ ID NO: 2135 - DNA, 25 bp, Mus musculus
aggaccggcaaggcggctagcaagc

SEQ ID NO: 2136 - DNA, 25 bp, Mus musculus
aggtgctgaccccgagctgtacgcg

SEQ ID NO: 2137 - DNA, 25 bp, Mus musculus
ggtgctgaccccgagctgtacgcgg

SEQ ID NO: 2138 - DNA, 25 bp, Mus musculus
cgtgccaagtggacgccgaagcgcg

SEQ ID NO: 2139 - DNA, 25 bp, Mus musculus
ctggcgtagacaatgccgggccacc

SEQ ID NO: 2140 - DNA, 25 bp, Mus musculus
caccccgtacatcatgacaagtggg

SEQ ID NO: 2141 - DNA, 25 bp, Mus musculus
ccccgtacatcatgacaagtgggtg

SEQ ID NO: 2142 - DNA, 25 bp, Mus musculus
cccgtacatcatgacaagtgggtgc

SEQ ID NO: 2143 - DNA, 25 bp, Mus musculus
ttgacagttggtcttccaggcccca

SEQ ID NO: 2144 - DNA, 25 bp, Mus musculus
cttccaggccccaagtcttctgttg

SEQ ID NO: 2145 - DNA, 25 bp, Mus musculus
tctcctggaatcttaagtgctgtga

SEQ ID NO: 2146 - DNA, 25 bp, Mus musculus
agccggctcccacaatactatccta

SEQ ID NO: 2147 - DNA, 25 bp, Mus musculus
ttttactagaccctgaagttcagtg

SEQ ID NO: 2148 - DNA, 25 bp, Mus musculus
tagaccctgaagttcagtgtccggt

SEQ ID NO: 2149 - DNA, 25 bp, Mus musculus
ctgaagttcagtgtccggtggtcga

SEQ ID NO: 2150 - DNA, 25 bp, Mus musculus
tggtcgaagcctctcctgagaatcc

SEQ ID NO: 2151 - DNA, 25 bp, Mus musculus
ctgagaatcctggtgctcaaatttc

SEQ ID NO: 2152 - DNA, 25 bp, Mus musculus
gtgctcaaatttccctcctaaagca

SEQ ID NO: 2153 - DNA, 25 bp, Mus musculus
aatatattgctaccgtacaagtcta

SEQ ID NO: 2154 - DNA, 25 bp, Mus musculus
atattgctaccgtacaagtctattt

SEQ ID NO: 2155 - DNA, 25 bp, Mus musculus
gcttattatggtaccccaggctggc

SEQ ID NO: 2156 - DNA, 25 bp, Mus musculus
tattatggtaccccaggctggcttt

SEQ ID NO: 2157 - DNA, 25 bp, Mus musculus
accccaggctggctttgaactcaat

SEQ ID NO: 2158 - DNA, 25 bp, Mus musculus
tgaactcaatataatcctgccttag

SEQ ID NO: 2159 - DNA, 25 bp, Mus musculus
caatataatcctgccttagcctttt

SEQ ID NO: 2160 - DNA, 25 bp, Mus musculus
tataatcctgccttagccttttcca

SEQ ID NO: 2161 - DNA, 25 bp, Mus musculus
tccaagttctggggttacaggtatg

SEQ ID NO: 2162 - DNA, 25 bp, Mus musculus
caactctggtctcctggaatcttaa

SEQ ID NO: 2163 - DNA, 25 bp, Mus musculus
tcttatatgggctccctaacgagga

SEQ ID NO: 2164 - DNA, 25 bp, Mus musculus
ggcatccagcaagcaaagaggcaac

SEQ ID NO: 2165 - DNA, 25 bp, Mus musculus
tccagttcccagaacacctcaaaca

SEQ ID NO: 2166 - DNA, 25 bp, Mus musculus
cagaacacctcaaacagaactgcca

SEQ ID NO: 2167 - DNA, 25 bp, Mus musculus
aacacctcaaacagaactgccacaa

SEQ ID NO: 2168 - DNA, 25 bp, Mus musculus
tcaaacagaactgccacaactccat

SEQ ID NO: 2169 - DNA, 25 bp, Mus musculus
aacagaactgccacaactccattgt

SEQ ID NO: 2170 - DNA, 25 bp, Mus musculus
agaactgccacaactccattgtctc

SEQ ID NO: 2171 - DNA, 25 bp, Mus musculus
acaactccattgtctcactccagct

SEQ ID NO: 2172 - DNA, 25 bp, Mus musculus
actccattgtctcactccagctcgt

SEQ ID NO: 2173 - DNA, 25 bp, Mus musculus
ttgtctcactccagctcgtggaaga

SEQ ID NO: 2174 - DNA, 25 bp, Mus musculus
cactccagctcgtggaagatgaagg

SEQ ID NO: 2175 - DNA, 25 bp, Mus musculus
agacacagcagagcaattggaggtc

SEQ ID NO: 2176 - DNA, 25 bp, Mus musculus
ctttacctcggaataatgacaccat

SEQ ID NO: 2177 - DNA, 25 bp, Mus musculus
atgacaccattcttatcaccacaac

SEQ ID NO: 2178 - DNA, 25 bp, Mus musculus
ccattcttatcaccacaacctaaga

SEQ ID NO: 2179 - DNA, 25 bp, Mus musculus
ttcttatcaccacaacctaagagac

SEQ ID NO: 2180 - DNA, 25 bp, Mus musculus
tcaactgaaggtgactccagttccc

SEQ ID NO: 2181 - DNA, 25 bp, Mus musculus
ggtgactccagttcccagaacacct

SEQ ID NO: 2182 - DNA, 25 bp, Mus musculus
gactccagttcccagaacacctcaa

SEQ ID NO: 2183 - DNA, 25 bp, Mus musculus
ctaaaattcacactgagtggtccta

SEQ ID NO: 2184 - DNA, 25 bp, Mus musculus
aattcacactgagtggtcctaaagt

SEQ ID NO: 2185 - DNA, 25 bp, Mus musculus
ccagtctcaaagctcctgatgtaga

SEQ ID NO: 2186 - DNA, 25 bp, Mus musculus
agtctcaaagctcctgatgtagatg

SEQ ID NO: 2187 - DNA, 25 bp, Mus musculus
tctcaaagctcctgatgtagatgtt

SEQ ID NO: 2188 - DNA, 25 bp, Mus musculus
aaagctcctgatgtagatgttagtg

SEQ ID NO: 2189 - DNA, 25 bp, Mus musculus
agctcctgatgtagatgttagtgtt

SEQ ID NO: 2190 - DNA, 25 bp, Mus musculus
gggcctgatgctgcactcaaagctg

SEQ ID NO: 2191 - DNA, 25 bp, Mus musculus
ctgcactcaaagctgaagtaaaatc

SEQ ID NO: 2192 - DNA, 25 bp, Mus musculus
atctcccaaagtcaagaaaactatg

SEQ ID NO: 2193 - DNA, 25 bp, Mus musculus
aaatgtactttccagatgtagaatt

SEQ ID NO: 2194 - DNA, 25 bp, Mus musculus
atgtactttccagatgtagaatttg

SEQ ID NO: 2195 - DNA, 25 bp, Mus musculus
ttcacactgagtggtcctaaagtta

SEQ ID NO: 2196 - DNA, 25 bp, Mus musculus
atttgaatattcctggaggtgagat

SEQ ID NO: 2197 - DNA, 25 bp, Mus musculus
ttgaatattcctggaggtgagattg

SEQ ID NO: 2198 - DNA, 25 bp, Mus musculus
gaatattcctggaggtgagattgat

SEQ ID NO: 2199 - DNA, 25 bp, Mus musculus
attcctggaggtgagattgatacca

SEQ ID NO: 2200 - DNA, 25 bp, Mus musculus
gattgataccagtctcaaagctcct

SEQ ID NO: 2201 - DNA, 25 bp, Mus musculus
ttgataccagtctcaaagctcctga

SEQ ID NO: 2202 - DNA, 25 bp, Mus musculus
taccagtctcaaagctcctgatgta

SEQ ID NO: 2203 - DNA, 25 bp, Mus musculus
tctccgtttgtagatcttgtttgca

SEQ ID NO: 2204 - DNA, 25 bp, Mus musculus
cttgtttgcaagttccatgaagatg

SEQ ID NO: 2205 - DNA, 25 bp, Mus musculus
gatccagcgcctcatacagtgcttt

SEQ ID NO: 2206 - DNA, 25 bp, Mus musculus
ccagcgcctcatacagtgctttcac

SEQ ID NO: 2207 - DNA, 25 bp, Mus musculus
gcgcctcatacagtgctttcacccg

SEQ ID NO: 2208 - DNA, 25 bp, Mus musculus
catacagtgctttcacccgagccac

SEQ ID NO: 2209 - DNA, 25 bp, Mus musculus
ctgggtccttctgcccataattctc

SEQ ID NO: 2210 - DNA, 25 bp, Mus musculus
ccttctgcccataattctcctctaa

SEQ ID NO: 2211 - DNA, 25 bp, Mus musculus
tctgcccataattctcctctaagat

SEQ ID NO: 2212 - DNA, 25 bp, Mus musculus
gcccataattctcctctaagatctg

SEQ ID NO: 2213 - DNA, 25 bp, Mus musculus
aattctcctctaagatctggcgctg

SEQ ID NO: 2214 - DNA, 25 bp, Mus musculus
ctaagatctggcgctgttgaggaga

SEQ ID NO: 2215 - DNA, 25 bp, Mus musculus
agagcactgctctatggagactctt

SEQ ID NO: 2216 - DNA, 25 bp, Mus musculus
gcactgctctatggagactcttgag

SEQ ID NO: 2217 - DNA, 25 bp, Mus musculus
ctgctctatggagactcttgaggcg

SEQ ID NO: 2218 - DNA, 25 bp, Mus musculus
ggttgtaactgtcttcctcatactt

SEQ ID NO: 2219 - DNA, 25 bp, Mus musculus
cttcctcatacttgaagaaagcaga

SEQ ID NO: 2220 - DNA, 25 bp, Mus musculus
aagcagactgcagatccagcgcctc

SEQ ID NO: 2221 - DNA, 25 bp, Mus musculus
cagactgcagatccagcgcctcata

SEQ ID NO: 2222 - DNA, 25 bp, Mus musculus
actgcagatccagcgcctcatacag

SEQ ID NO: 2223 - DNA, 25 bp, Mus musculus
cccatcctcacaagctttaactgaa

SEQ ID NO: 2224 - DNA, 25 bp, Mus musculus
catcctcacaagctttaactgaagc

SEQ ID NO: 2225 - DNA, 25 bp, Mus musculus
ggagccatctgatgccacaactgct

SEQ ID NO: 2226 - DNA, 25 bp, Mus musculus
agccatctgatgccacaactgctac

SEQ ID NO: 2227 - DNA, 25 bp, Mus musculus
gatgccacaactgctaccctcgcta

SEQ ID NO: 2228 - DNA, 25 bp, Mus musculus
taccctcgctagctcttcctgaggg

SEQ ID NO: 2229 - DNA, 25 bp, Mus musculus
cacagcatcaagctcctgcctgctg

SEQ ID NO: 2230 - DNA, 25 bp, Mus musculus
cagcatcaagctcctgcctgctggg

SEQ ID NO: 2231 - DNA, 25 bp, Mus musculus
gcatcaagctcctgcctgctgggcc

SEQ ID NO: 2232 - DNA, 25 bp, Mus musculus
cctgctgggccctagactagagggc

SEQ ID NO: 2233 - DNA, 25 bp, Mus musculus
ccctcagcagcctaacctctgtggt

SEQ ID NO: 2234 - DNA, 25 bp, Mus musculus
ctcagcagcctaacctctgtggtgg

SEQ ID NO: 2235 - DNA, 25 bp, Mus musculus
tcctcacaagctttaactgaagctc

SEQ ID NO: 2236 - DNA, 25 bp, Mus musculus
ctcacaagctttaactgaagctcag

SEQ ID NO: 2237 - DNA, 25 bp, Mus musculus
agctttaactgaagctcagactggc

SEQ ID NO: 2238 - DNA, 25 bp, Mus musculus
aactgaagctcagactggccaagat

SEQ ID NO: 2239 - DNA, 25 bp, Mus musculus
ctcagactggccaagattggagcca

SEQ ID NO: 2240 - DNA, 25 bp, Mus musculus
cagactggccaagattggagccatc

SEQ ID NO: 2241 - DNA, 25 bp, Mus musculus
aagattggagccatctgatgccaca

SEQ ID NO: 2242 - DNA, 25 bp, Mus musculus
ttggagccatctgatgccacaactg

SEQ ID NO: 2243 - DNA, 25 bp, Mus musculus
gggcacttctgagccccatttccct

SEQ ID NO: 2244 - DNA, 25 bp, Mus musculus
ttctgagccccatttccctggcagg

SEQ ID NO: 2245 - DNA, 25 bp, Mus musculus
caggccagaacccagaaagccaggg

SEQ ID NO: 2246 - DNA, 25 bp, Mus musculus
atatgctggtcaacacccagggccg

SEQ ID NO: 2247 - DNA, 25 bp, Mus musculus
taacagttaattccctgcctggctt

SEQ ID NO: 2248 - DNA, 25 bp, Mus musculus
cagttaattccctgcctggcttcca

SEQ ID NO: 2249 - DNA, 25 bp, Mus musculus
ctatcggccccaaggatggaatgca

SEQ ID NO: 2250 - DNA, 25 bp, Mus musculus
aggatcctgctgcactcagcttccg

SEQ ID NO: 2251 - DNA, 25 bp, Mus musculus
atcctgctgcactcagcttccgcag

SEQ ID NO: 2252 - DNA, 25 bp, Mus musculus
cccagacacaagctccttgagagtt

SEQ ID NO: 2253 - DNA, 25 bp, Mus musculus
agacacaagctccttgagagttcta

SEQ ID NO: 2254 - DNA, 25 bp, Mus musculus
gagagttctagccatcctgggcctc

SEQ ID NO: 2255 - DNA, 25 bp, Mus musculus
tgagccccatttccctggcaggttc

SEQ ID NO: 2256 - DNA, 25 bp, Mus musculus
tggcaggttcaccggaccaggaagg

SEQ ID NO: 2257 - DNA, 25 bp, Mus musculus
aggaaggcttcttcaacctgctgac

SEQ ID NO: 2258 - DNA, 25 bp, Mus musculus
aaggcttcttcaacctgctgaccca

SEQ ID NO: 2259 - DNA, 25 bp, Mus musculus
cccacgtgcagggcgatcggatgga

SEQ ID NO: 2260 - DNA, 25 bp, Mus musculus
agcagcgctgttccttgcaggctgg

SEQ ID NO: 2261 - DNA, 25 bp, Mus musculus
ccttgcaggctgggccaggccagaa

SEQ ID NO: 2262 - DNA, 25 bp, Mus musculus
ggccaggccagaacccagaaagcca

SEQ ID NO: 2263 - DNA, 25 bp, Mus musculus
gtttgtcacatgatacctaagatgt

SEQ ID NO: 2264 - DNA, 25 bp, Mus musculus
aagatgtaactcagctcagtaattc

SEQ ID NO: 2265 - DNA, 25 bp, Mus musculus
gattacaggcacattccaccacaca

SEQ ID NO: 2266 - DNA, 25 bp, Mus musculus
gactgagctcgttcctaatgagttt

SEQ ID NO: 2267 - DNA, 25 bp, Mus musculus
catcaccttgaaactaatcagaagg

SEQ ID NO: 2268 - DNA, 25 bp, Mus musculus
gctaacactgggctcattcacatgg

SEQ ID NO: 2269 - DNA, 25 bp, Mus musculus
ctcattcacatggggtttgcattcc

SEQ ID NO: 2270 - DNA, 25 bp, Mus musculus
gcattcctaggcaaactaaactgct

SEQ ID NO: 2271 - DNA, 25 bp, Mus musculus
tgccttttacaacaaggctcagtca

SEQ ID NO: 2272 - DNA, 25 bp, Mus musculus
caaggctcagtcatcttcctgaagc

SEQ ID NO: 2273 - DNA, 25 bp, Mus musculus
ctgctgagaccagcacttggtcttg

SEQ ID NO: 2274 - DNA, 25 bp, Mus musculus
agaccagcacttggtcttgttttgt

SEQ ID NO: 2275 - DNA, 25 bp, Mus musculus
aatggccattttctcttctgatctt

SEQ ID NO: 2276 - DNA, 25 bp, Mus musculus
ctcttctgatcttgtaatacctaaa

SEQ ID NO: 2277 - DNA, 25 bp, Mus musculus
ataacaggatcttgctgtgtagtcc

SEQ ID NO: 2278 - DNA, 25 bp, Mus musculus
ggatcttgctgtgtagtcctagctg

SEQ ID NO: 2279 - DNA, 25 bp, Mus musculus
ctagctggcctcaaactcacaatac

SEQ ID NO: 2280 - DNA, 25 bp, Mus musculus
ggcctcaaactcacaatactcttcc

SEQ ID NO: 2281 - DNA, 25 bp, Mus musculus
aaactcacaatactcttcctggatc

SEQ ID NO: 2282 - DNA, 25 bp, Mus musculus
ctcttcctggatcaatctcccaagt

SEQ ID NO: 2283 - DNA, 25 bp, Mus musculus
tgtatgtcagccgctccggagatgg

SEQ ID NO: 2284 - DNA, 25 bp, Mus musculus
tttctcatcggcgtgacggtggcac

SEQ ID NO: 2285 - DNA, 25 bp, Mus musculus
tgaaccgccggcagcgaagttggtc

SEQ ID NO: 2286 - DNA, 25 bp, Mus musculus
gaaccgccggcagcgaagttggtca

SEQ ID NO: 2287 - DNA, 25 bp, Mus musculus
aaccgccggcagcgaagttggtcat

SEQ ID NO: 2288 - DNA, 25 bp, Mus musculus
accgccggcagcgaagttggtcatc

SEQ ID NO: 2289 - DNA, 25 bp, Mus musculus
ccgccggcagcgaagttggtcatcc

SEQ ID NO: 2290 - DNA, 25 bp, Mus musculus
cgccggcagcgaagttggtcatcct

SEQ ID NO: 2291 - DNA, 25 bp, Mus musculus
ttctcatcggcgtgacggtggcact

SEQ ID NO: 2292 - DNA, 25 bp, Mus musculus
ctcatcggcgtgacggtggcactgc

SEQ ID NO: 2293 - DNA, 25 bp, Mus musculus
tcatcggcgtgacggtggcactgct

SEQ ID NO: 2294 - DNA, 25 bp, Mus musculus
catcggcgtgacggtggcactgcta

SEQ ID NO: 2295 - DNA, 25 bp, Mus musculus
agctgctggctgagaacgaagtgaa

SEQ ID NO: 2296 - DNA, 25 bp, Mus musculus
aagtgaaccgccggcagcgaagttg

SEQ ID NO: 2297 - DNA, 25 bp, Mus musculus
agtgaaccgccggcagcgaagttgg

SEQ ID NO: 2298 - DNA, 25 bp, Mus musculus
gtgaaccgccggcagcgaagttggt

SEQ ID NO: 2299 - DNA, 25 bp, Mus musculus
gccgatgctccgacagcgagaagct

SEQ ID NO: 2300 - DNA, 25 bp, Mus musculus
ccgatgctccgacagcgagaagctc

SEQ ID NO: 2301 - DNA, 25 bp, Mus musculus
aagtgcagggctcctcggctggaaa

SEQ ID NO: 2302 - DNA, 25 bp, Mus musculus
tggtctttgcctcaaatccacggga

SEQ ID NO: 2303 - DNA, 25 bp, Mus musculus
gtctttgcctcaaatccacgggaga

SEQ ID NO: 2304 - DNA, 25 bp, Mus musculus
tttgcctcaaatccacgggagattt

SEQ ID NO: 2305 - DNA, 25 bp, Mus musculus
ttgcctcaaatccacgggagatttt

SEQ ID NO: 2306 - DNA, 25 bp, Mus musculus
caaatccacgggagattttcctgag

SEQ ID NO: 2307 - DNA, 25 bp, Mus musculus
ctctcaagatctgtggtgacactcc

SEQ ID NO: 2308 - DNA, 25 bp, Mus musculus
ggtgacactccatggccagtactat

SEQ ID NO: 2309 - DNA, 25 bp, Mus musculus
gtgacactccatggccagtactatg

SEQ ID NO: 2310 - DNA, 25 bp, Mus musculus
acactccatggccagtactatgacc

SEQ ID NO: 2311 - DNA, 25 bp, Mus musculus
atgctccgacagcgagaagctcaac

SEQ ID NO: 2312 - DNA, 25 bp, Mus musculus
gctccgacagcgagaagctcaacct

SEQ ID NO: 2313 - DNA, 25 bp, Mus musculus
acagcgagaagctcaacctggattc

SEQ ID NO: 2314 - DNA, 25 bp, Mus musculus
cgagaagctcaacctggattccatc

SEQ ID NO: 2315 - DNA, 25 bp, Mus musculus
gctcaacctggattccatcatcggg

SEQ ID NO: 2316 - DNA, 25 bp, Mus musculus
tcaacctggattccatcatcgggcg

SEQ ID NO: 2317 - DNA, 25 bp, Mus musculus
cctggattccatcatcgggcgcctg

SEQ ID NO: 2318 - DNA, 25 bp, Mus musculus
tgcaagtgcagggctcctcggctgg

SEQ ID NO: 2319 - DNA, 25 bp, Mus musculus
tgcctactttgctcgttctctgttc

SEQ ID NO: 2320 - DNA, 25 bp, Mus musculus
ctttgctcgttctctgttccaggct

SEQ ID NO: 2321 - DNA, 25 bp, Mus musculus
ctgccttctgtggagccaatgatct

SEQ ID NO: 2322 - DNA, 25 bp, Mus musculus
atgatctcaattccttttggtggct

SEQ ID NO: 2323 - DNA, 25 bp, Mus musculus
cccagatatggctacacccctagct

SEQ ID NO: 2324 - DNA, 25 bp, Mus musculus
tatggctacacccctagctgaggtc

SEQ ID NO: 2325 - DNA, 25 bp, Mus musculus
ccaaccctgctcagggctcctgaaa

SEQ ID NO: 2326 - DNA, 25 bp, Mus musculus
ctgctcagggctcctgaaaattggt

SEQ ID NO: 2327 - DNA, 25 bp, Mus musculus
aacttccctggcttcaggccacact

SEQ ID NO: 2328 - DNA, 25 bp, Mus musculus
gtcctgctctgtgccccagttccat

SEQ ID NO: 2329 - DNA, 25 bp, Mus musculus
tccaaatatagcccggcacaaataa

SEQ ID NO: 2330 - DNA, 25 bp, Mus musculus
tatagcccggcacaaataaacatta

SEQ ID NO: 2331 - DNA, 25 bp, Mus musculus
tcgttctctgttccaggctcagcct

SEQ ID NO: 2332 - DNA, 25 bp, Mus musculus
tcagcctctctgcttcctgtaccta

SEQ ID NO: 2333 - DNA, 25 bp, Mus musculus
cttcctgtacctagtgtcactggat

SEQ ID NO: 2334 - DNA, 25 bp, Mus musculus
agtgtcactggatcacaggaccttg

SEQ ID NO: 2335 - DNA, 25 bp, Mus musculus
actggatcacaggaccttggcttag

SEQ ID NO: 2336 - DNA, 25 bp, Mus musculus
tcacaggaccttggcttagtgtctc

SEQ ID NO: 2337 - DNA, 25 bp, Mus musculus
gaccttggcttagtgtctctgactc

SEQ ID NO: 2338 - DNA, 25 bp, Mus musculus
gtgtctctgactctgccttctgtgg

SEQ ID NO: 2339 - DNA, 25 bp, Mus musculus
gtcttgggttcagcattgctggagg

SEQ ID NO: 2340 - DNA, 25 bp, Mus musculus
tcttgggttcagcattgctggaggt

SEQ ID NO: 2341 - DNA, 25 bp, Mus musculus
acattcctggggataacagcatcta

SEQ ID NO: 2342 - DNA, 25 bp, Mus musculus
cattcctggggataacagcatctat

SEQ ID NO: 2343 - DNA, 25 bp, Mus musculus
taacagcatctatgtaaccaaaata

SEQ ID NO: 2344 - DNA, 25 bp, Mus musculus
aggtgcagcacacaaggacggcaaa

SEQ ID NO: 2345 - DNA, 25 bp, Mus musculus
gtgcagcacacaaggacggcaaact

SEQ ID NO: 2346 - DNA, 25 bp, Mus musculus
tgcagcacacaaggacggcaaactt

SEQ ID NO: 2347 - DNA, 25 bp, Mus musculus
gcagcacacaaggacggcaaacttc

SEQ ID NO: 2348 - DNA, 25 bp, Mus musculus
cagcacacaaggacggcaaacttca

SEQ ID NO: 2349 - DNA, 25 bp, Mus musculus
cacacaaggacggcaaacttcagat

SEQ ID NO: 2350 - DNA, 25 bp, Mus musculus
acggcaaacttcagattggagacaa

SEQ ID NO: 2351 - DNA, 25 bp, Mus musculus
tgggttcagcattgctggaggtgtt

SEQ ID NO: 2352 - DNA, 25 bp, Mus musculus
gttcagcattgctggaggtgttgga

SEQ ID NO: 2353 - DNA, 25 bp, Mus musculus
ttcagcattgctggaggtgttggaa

SEQ ID NO: 2354 - DNA, 25 bp, Mus musculus
tcagcattgctggaggtgttggaaa

SEQ ID NO: 2355 - DNA, 25 bp, Mus musculus
cagcattgctggaggtgttggaaac

SEQ ID NO: 2356 - DNA, 25 bp, Mus musculus
agcattgctggaggtgttggaaacc

SEQ ID NO: 2357 - DNA, 25 bp, Mus musculus
gcattgctggaggtgttggaaacca

SEQ ID NO: 2358 - DNA, 25 bp, Mus musculus
cacattcctggggataacagcatct

SEQ ID NO: 2359 - DNA, 25 bp, Mus musculus
tttattacaatcatctcctcaatag

SEQ ID NO: 2360 - DNA, 25 bp, Mus musculus
ttattacaatcatctcctcaatagc

SEQ ID NO: 2361 - DNA, 25 bp, Mus musculus
acactcagtgcggcactgactaatc

SEQ ID NO: 2362 - DNA, 25 bp, Mus musculus
cactcagtgcggcactgactaatca

SEQ ID NO: 2363 - DNA, 25 bp, Mus musculus
actcagtgcggcactgactaatcaa

SEQ ID NO: 2364 - DNA, 25 bp, Mus musculus
ctcagtgcggcactgactaatcaaa

SEQ ID NO: 2365 - DNA, 25 bp, Mus musculus
tcagtgcggcactgactaatcaaac

SEQ ID NO: 2366 - DNA, 25 bp, Mus musculus
agtgcggcactgactaatcaaactt

SEQ ID NO: 2367 - DNA, 25 bp, Mus musculus
cagcaaccgactacactcagtgcgg

SEQ ID NO: 2368 - DNA, 25 bp, Mus musculus
agcaaccgactacactcagtgcggc

SEQ ID NO: 2369 - DNA, 25 bp, Mus musculus
gcaaccgactacactcagtgcggca

SEQ ID NO: 2370 - DNA, 25 bp, Mus musculus
caaccgactacactcagtgcggcac

SEQ ID NO: 2371 - DNA, 25 bp, Mus musculus
aaccgactacactcagtgcggcact

SEQ ID NO: 2372 - DNA, 25 bp, Mus musculus
actacactcagtgcggcactgacta

SEQ ID NO: 2373 - DNA, 25 bp, Mus musculus
ctacactcagtgcggcactgactaa

SEQ ID NO: 2374 - DNA, 25 bp, Mus musculus
tacactcagtgcggcactgactaat

SEQ ID NO: 2375 - DNA, 25 bp, Mus musculus
ctccacctattgtggacaagatctt

SEQ ID NO: 2376 - DNA, 25 bp, Mus musculus
agatctttatggacacattgtcttt

SEQ ID NO: 2377 - DNA, 25 bp, Mus musculus
catttttaacacataccactctgtt

SEQ ID NO: 2378 - DNA, 25 bp, Mus musculus
ttttaacacataccactctgttgta

SEQ ID NO: 2379 - DNA, 25 bp, Mus musculus
cacataccactctgttgtaaataag

SEQ ID NO: 2380 - DNA, 25 bp, Mus musculus
ataccactctgttgtaaataagctg

SEQ ID NO: 2381 - DNA, 25 bp, Mus musculus
gcgagcctccaactcgagatctctt

SEQ ID NO: 2382 - DNA, 25 bp, Mus musculus
tccgctctccttccatgtgtacata

SEQ ID NO: 2383 - DNA, 25 bp, Mus musculus
gtacataactgtcactcaagaaggt

SEQ ID NO: 2384 - DNA, 25 bp, Mus musculus
cataactgtcactcaagaaggtgat

SEQ ID NO: 2385 - DNA, 25 bp, Mus musculus
aactgtcactcaagaaggtgattga

SEQ ID NO: 2386 - DNA, 25 bp, Mus musculus
tgtattttcctggatttataggatg

SEQ ID NO: 2387 - DNA, 25 bp, Mus musculus
cttctgtcacccatgtgcctttaag

SEQ ID NO: 2388 - DNA, 25 bp, Mus musculus
ctgtcacccatgtgcctttaagcct

SEQ ID NO: 2389 - DNA, 25 bp, Mus musculus
cagcctggttttgagctaagactga

SEQ ID NO: 2390 - DNA, 25 bp, Mus musculus
agactgacgtacctcctcactccag

SEQ ID NO: 2391 - DNA, 25 bp, Mus musculus
ctcctcactccagaagatggacaga

SEQ ID NO: 2392 - DNA, 25 bp, Mus musculus
tatttgtcttatccctccagctcag

SEQ ID NO: 2393 - DNA, 25 bp, Mus musculus
agctcagtcctggccttcgtgtgtt

SEQ ID NO: 2394 - DNA, 25 bp, Mus musculus
tcagtcctggccttcgtgtgttttt

SEQ ID NO: 2395 - DNA, 25 bp, Mus musculus
agcagatcactcacatcgccaatca

SEQ ID NO: 2396 - DNA, 25 bp, Mus musculus
ctcacatcgccaatcagcttgggct

SEQ ID NO: 2397 - DNA, 25 bp, Mus musculus
cactgctctgggctctcccatgcat

SEQ ID NO: 2398 - DNA, 25 bp, Mus musculus
gggctctcccatgcattcaaactga

SEQ ID NO: 2399 - DNA, 25 bp, Mus musculus
ctctcccatgcattcaaactgaggc

SEQ ID NO: 2400 - DNA, 25 bp, Mus musculus
tcccatgcattcaaactgaggcacc

SEQ ID NO: 2401 - DNA, 25 bp, Mus musculus
gcattcaaactgaggcaccagccct

SEQ ID NO: 2402 - DNA, 25 bp, Mus musculus
tccctggggatgctgtgagccaagg

SEQ ID NO: 2403 - DNA, 25 bp, Mus musculus
tcaggagcctggcctgtctgtcact

SEQ ID NO: 2404 - DNA, 25 bp, Mus musculus
gcctggcctgtctgtcactcatcat

SEQ ID NO: 2405 - DNA, 25 bp, Mus musculus
cctgtctgtcactcatcattttgtt

SEQ ID NO: 2406 - DNA, 25 bp, Mus musculus
tgtcactcatcattttgttcttaaa

SEQ ID NO: 2407 - DNA, 25 bp, Mus musculus
acatcgccaatcagcttgggctaga

SEQ ID NO: 2408 - DNA, 25 bp, Mus musculus
ccaatcagcttgggctagagaagga

SEQ ID NO: 2409 - DNA, 25 bp, Mus musculus
atcagcttgggctagagaaggatgt

SEQ ID NO: 2410 - DNA, 25 bp, Mus musculus
ttgagtattcccaacgagaagagta

SEQ ID NO: 2411 - DNA, 25 bp, Mus musculus
attcccaacgagaagagtatgaggc

SEQ ID NO: 2412 - DNA, 25 bp, Mus musculus
tggcaccccaggctatggaagcccc

SEQ ID NO: 2413 - DNA, 25 bp, Mus musculus
actctactcagtcccttttcctgag

SEQ ID NO: 2414 - DNA, 25 bp, Mus musculus
cgtcactgctctgggctctcccatg

SEQ ID NO: 2415 - DNA, 25 bp, Mus musculus
tattcacttttcagacatgatacta

SEQ ID NO: 2416 - DNA, 25 bp, Mus musculus
tcagctgctgagcaagcgtttgtag

SEQ ID NO: 2417 - DNA, 25 bp, Mus musculus
cacttcctagggaggacatctgaag

SEQ ID NO: 2418 - DNA, 25 bp, Mus musculus
tctgaagtccttgcctgcagaaacc

SEQ ID NO: 2419 - DNA, 25 bp, Mus musculus
gtccttgcctgcagaaaccctgact

SEQ ID NO: 2420 - DNA, 25 bp, Mus musculus
gcctgcagaaaccctgactgttccc

SEQ ID NO: 2421 - DNA, 25 bp, Mus musculus
tgttccctcaacccttgactccaat

SEQ ID NO: 2422 - DNA, 25 bp, Mus musculus
ctcaacccttgactccaattgcatc

SEQ ID NO: 2423 - DNA, 25 bp, Mus musculus
ttgcatcaccacctagtaacagttg

SEQ ID NO: 2424 - DNA, 25 bp, Mus musculus
atcatacaacatcggcagtcaactt

SEQ ID NO: 2425 - DNA, 25 bp, Mus musculus
caacatcggcagtcaacttcctgta

SEQ ID NO: 2426 - DNA, 25 bp, Mus musculus
cggcagtcaacttcctgtaataaat

SEQ ID NO: 2427 - DNA, 25 bp, Mus musculus
ttatgttgtgacccattgtgaaaat

SEQ ID NO: 2428 - DNA, 25 bp, Mus musculus
ccaacatctgcacagtctgctgtgt

SEQ ID NO: 2429 - DNA, 25 bp, Mus musculus
cagtctgctgtgtcatggagagacc

SEQ ID NO: 2430 - DNA, 25 bp, Mus musculus
agagacccactgcctgtggatctga

SEQ ID NO: 2431 - DNA, 25 bp, Mus musculus
cagcatcagtctgcttagcccatcc

SEQ ID NO: 2432 - DNA, 25 bp, Mus musculus
tttgttgcccagagtctgttggtga

SEQ ID NO: 2433 - DNA, 25 bp, Mus musculus
gtcacctgcctagtgaccggttggc

SEQ ID NO: 2434 - DNA, 25 bp, Mus musculus
catggccacttcctagggaggacat

SEQ ID NO: 2435 - DNA, 25 bp, Mus musculus
ccagtgagctcctggattctgctga

SEQ ID NO: 2436 - DNA, 25 bp, Mus musculus
tggattctgctgacccagcacactc

SEQ ID NO: 2437 - DNA, 25 bp, Mus musculus
tgactcctggccttctatgccctct

SEQ ID NO: 2438 - DNA, 25 bp, Mus musculus
ttctatgccctctatcctatcatag

SEQ ID NO: 2439 - DNA, 25 bp, Mus musculus
tatcctatcatagataacattctcc

SEQ ID NO: 2440 - DNA, 25 bp, Mus musculus
atcatagataacattctccacagcc

SEQ ID NO: 2441 - DNA, 25 bp, Mus musculus
ctcacttcattccacctattctctg

SEQ ID NO: 2442 - DNA, 25 bp, Mus musculus
tcattccacctattctctgaaaata

SEQ ID NO: 2443 - DNA, 25 bp, Mus musculus
ttctctgaaaatattccctgagaga

SEQ ID NO: 2444 - DNA, 25 bp, Mus musculus
aatgaaattccagccttgactttct

SEQ ID NO: 2445 - DNA, 25 bp, Mus musculus
gccttgactttcttctgtgcacctg

SEQ ID NO: 2446 - DNA, 25 bp, Mus musculus
actttcttctgtgcacctgatggga

SEQ ID NO: 2447 - DNA, 25 bp, Mus musculus
caccatcctctgaatgccagtgcat

SEQ ID NO: 2448 - DNA, 25 bp, Mus musculus
aatgccagtgcatcttgggggaaag

SEQ ID NO: 2449 - DNA, 25 bp, Mus musculus
tatctggaccagttccttcattttc

SEQ ID NO: 2450 - DNA, 25 bp, Mus musculus
gaccagttccttcattttcaggtgg

SEQ ID NO: 2451 - DNA, 25 bp, Mus musculus
ttccttcattttcaggtgggactct

SEQ ID NO: 2452 - DNA, 25 bp, Mus musculus
ggactcttgatccagagaagacaaa

SEQ ID NO: 2453 - DNA, 25 bp, Mus musculus
agctcctcagtgagctggtgtataa

SEQ ID NO: 2454 - DNA, 25 bp, Mus musculus
gtctcctgactcctggccttctatg

SEQ ID NO: 2455 - DNA, 25 bp, Mus musculus
agtcaggcacagcttcctcttgccg

SEQ ID NO: 2456 - DNA, 25 bp, Mus musculus
cttgccgcctctgtatccaagagag

SEQ ID NO: 2457 - DNA, 25 bp, Mus musculus
tgcctcctacagtgtgatctgaccg

SEQ ID NO: 2458 - DNA, 25 bp, Mus musculus
tgtgatctgaccgctctttaacaca

SEQ ID NO: 2459 - DNA, 25 bp, Mus musculus
ctgaccgctctttaacacatagacc

SEQ ID NO: 2460 - DNA, 25 bp, Mus musculus
gctctttaacacatagaccttagcc

SEQ ID NO: 2461 - DNA, 25 bp, Mus musculus
taacacatagaccttagccgtgtcc

SEQ ID NO: 2462 - DNA, 25 bp, Mus musculus
cttagccgtgtccattgcaagtgga

SEQ ID NO: 2463 - DNA, 25 bp, Mus musculus
accagttgcccctgtggtccgcatg

SEQ ID NO: 2464 - DNA, 25 bp, Mus musculus
tgtggtccgcatgcttactgagcaa

SEQ ID NO: 2465 - DNA, 25 bp, Mus musculus
ccgcatgcttactgagcaaagcacc

SEQ ID NO: 2466 - DNA, 25 bp, Mus musculus
cctccacacatcatcagtggtacct

SEQ ID NO: 2467 - DNA, 25 bp, Mus musculus
cccactgtcattgtgtgtttgctaa

SEQ ID NO: 2468 - DNA, 25 bp, Mus musculus
acatcatcagtggtaccttaagttt

SEQ ID NO: 2469 - DNA, 25 bp, Mus musculus
ttgctaataacctgggggctcatag

SEQ ID NO: 2470 - DNA, 25 bp, Mus musculus
aagagcactgttcctcttatgtagg

SEQ ID NO: 2471 - DNA, 25 bp, Mus musculus
actgttcctcttatgtaggatcagc

SEQ ID NO: 2472 - DNA, 25 bp, Mus musculus
catctgtaactccaattccagggga

SEQ ID NO: 2473 - DNA, 25 bp, Mus musculus
taactccaattccaggggatccagt

SEQ ID NO: 2474 - DNA, 25 bp, Mus musculus
agacagtctttgccagtgctaagag

SEQ ID NO: 2475 - DNA, 25 bp, Mus musculus
tctttgccagtgctaagagggaaaa

SEQ ID NO: 2476 - DNA, 25 bp, Mus musculus
gcaacaacaacagcagtaccatatc

SEQ ID NO: 2477 - DNA, 25 bp, Mus musculus
gcagtaccatatccgacagcaacag

SEQ ID NO: 2478 - DNA, 25 bp, Mus musculus
tcaacaacagctctctaatacccag

SEQ ID NO: 2479 - DNA, 25 bp, Mus musculus
acagctctctaatacccagccacag

SEQ ID NO: 2480 - DNA, 25 bp, Mus musculus
caccaacatatttggacgctactga

SEQ ID NO: 2481 - DNA, 25 bp, Mus musculus
catatttggacgctactgagtcact

SEQ ID NO: 2482 - DNA, 25 bp, Mus musculus
tggacgctactgagtcacttggagg

SEQ ID NO: 2483 - DNA, 25 bp, Mus musculus
ctactgagtcacttggaggaactgc

SEQ ID NO: 2484 - DNA, 25 bp, Mus musculus
cttgtacactggatgtggcccagcc

SEQ ID NO: 2485 - DNA, 25 bp, Mus musculus
cccagcctttctgcttaatcccagt

SEQ ID NO: 2486 - DNA, 25 bp, Mus musculus
ccttcctaggcgagctccgatagtg

SEQ ID NO: 2487 - DNA, 25 bp, Mus musculus
tcctaggcgagctccgatagtggtt

SEQ ID NO: 2488 - DNA, 25 bp, Mus musculus
ccatatccgacagcaacagcagcag

SEQ ID NO: 2489 - DNA, 25 bp, Mus musculus
gatgctacggcaacagcagcaacaa

SEQ ID NO: 2490 - DNA, 25 bp, Mus musculus
ccagcagcagcagcaggcagctcct

SEQ ID NO: 2491 - DNA, 25 bp, Mus musculus
gcagcagcaacagcccgcagctttg

SEQ ID NO: 2492 - DNA, 25 bp, Mus musculus
gcaacagcccgcagctttggtccgg

SEQ ID NO: 2493 - DNA, 25 bp, Mus musculus
gcccgcagctttggtccggcaactt

SEQ ID NO: 2494 - DNA, 25 bp, Mus musculus
ggtccggcaacttcaacaacagctc

SEQ ID NO: 2495 - DNA, 25 bp, Mus musculus
gcaacttcaacaacagctctctaat

SEQ ID NO: 2496 - DNA, 25 bp, Mus musculus
tgaatatctcggatgagcagctggg

SEQ ID NO: 2497 - DNA, 25 bp, Mus musculus
atatctcggatgagcagctgggcag

SEQ ID NO: 2498 - DNA, 25 bp, Mus musculus
gatttcttcactaaagggcagagac

SEQ ID NO: 2499 - DNA, 25 bp, Mus musculus
agaccaaattattcttgctttctag

SEQ ID NO: 2500 - DNA, 25 bp, Mus musculus
ccaaattattcttgctttctagtat

SEQ ID NO: 2501 - DNA, 25 bp, Mus musculus
ttttcccagaatactacagctcttg

SEQ ID NO: 2502 - DNA, 25 bp, Mus musculus
tcccagaatactacagctcttgcat

SEQ ID NO: 2503 - DNA, 25 bp, Mus musculus
cagaatactacagctcttgcatgac

SEQ ID NO: 2504 - DNA, 25 bp, Mus musculus
actacagctcttgcatgacaacctg

SEQ ID NO: 2505 - DNA, 25 bp, Mus musculus
acagctcttgcatgacaacctgaag

SEQ ID NO: 2506 - DNA, 25 bp, Mus musculus
gctcttgcatgacaacctgaagtct

SEQ ID NO: 2507 - DNA, 25 bp, Mus musculus
cttgcatgacaacctgaagtctctc

SEQ ID NO: 2508 - DNA, 25 bp, Mus musculus
agcagctgggcagtattgcggacag

SEQ ID NO: 2509 - DNA, 25 bp, Mus musculus
gcatgacaacctgaagtctctcctg

SEQ ID NO: 2510 - DNA, 25 bp, Mus musculus
ttgcggacaggaccatccaggaggc

SEQ ID NO: 2511 - DNA, 25 bp, Mus musculus
cggacaggaccatccaggaggctga

SEQ ID NO: 2512 - DNA, 25 bp, Mus musculus
acaggaccatccaggaggctgacca

SEQ ID NO: 2513 - DNA, 25 bp, Mus musculus
ccatccaggaggctgaccaagatgg

SEQ ID NO: 2514 - DNA, 25 bp, Mus musculus
gtgccatatcttttacagaattcgt

SEQ ID NO: 2515 - DNA, 25 bp, Mus musculus
gcatccgatttcttcactaaagggc

SEQ ID NO: 2516 - DNA, 25 bp, Mus musculus
tccgatttcttcactaaagggcaga

SEQ ID NO: 2517 - DNA, 25 bp, Mus musculus
atgcatcatctacccgggacctcat

SEQ ID NO: 2518 - DNA, 25 bp, Mus musculus
tgcatcatctacccgggacctcatc

SEQ ID NO: 2519 - DNA, 25 bp, Mus musculus
cgacgagtcgctcatcggcgtaaat

SEQ ID NO: 2520 - DNA, 25 bp, Mus musculus
acgagtcgctcatcggcgtaaatgc

SEQ ID NO: 2521 - DNA, 25 bp, Mus musculus
cgagtcgctcatcggcgtaaatgct

SEQ ID NO: 2522 - DNA, 25 bp, Mus musculus
gagtcgctcatcggcgtaaatgcta

SEQ ID NO: 2523 - DNA, 25 bp, Mus musculus
gtcgctcatcggcgtaaatgctacc

SEQ ID NO: 2524 - DNA, 25 bp, Mus musculus
cgctcatcggcgtaaatgctaccgg

SEQ ID NO: 2525 - DNA, 25 bp, Mus musculus
ctcatcggcgtaaatgctaccggcg

SEQ ID NO: 2526 - DNA, 25 bp, Mus musculus
gtaaatgctaccggcgaaggtgtcg

SEQ ID NO: 2527 - DNA, 25 bp, Mus musculus
taaatgctaccggcgaaggtgtcgg

SEQ ID NO: 2528 - DNA, 25 bp, Mus musculus
atgctaccggcgaaggtgtcggacg

SEQ ID NO: 2529 - DNA, 25 bp, Mus musculus
atcatctacccgggacctcatcacg

SEQ ID NO: 2530 - DNA, 25 bp, Mus musculus
atctacccgggacctcatcacgcat

SEQ ID NO: 2531 - DNA, 25 bp, Mus musculus
ctacccgggacctcatcacgcatga

SEQ ID NO: 2532 - DNA, 25 bp, Mus musculus
acccgggacctcatcacgcatgacg

SEQ ID NO: 2533 - DNA, 25 bp, Mus musculus
ccggcgccatcgacgagtcgctcat

SEQ ID NO: 2534 - DNA, 25 bp, Mus musculus
cggcgccatcgacgagtcgctcatc

SEQ ID NO: 2535 - DNA, 25 bp, Mus musculus
ccatcgacgagtcgctcatcggcgt

SEQ ID NO: 2536 - DNA, 25 bp, Mus musculus
atcgacgagtcgctcatcggcgtaa

SEQ ID NO: 2537 - DNA, 25 bp, Mus musculus
gtctgaatcagcgccttgcggtctc

SEQ ID NO: 2538 - DNA, 25 bp, Mus musculus
ctgaatcagcgccttgcggtctcac

SEQ ID NO: 2539 - DNA, 25 bp, Mus musculus
gctcataggcttcttcatgatgccc

SEQ ID NO: 2540 - DNA, 25 bp, Mus musculus
tcataggcttcttcatgatgcccgt

SEQ ID NO: 2541 - DNA, 25 bp, Mus musculus
cataggcttcttcatgatgcccgtc

SEQ ID NO: 2542 - DNA, 25 bp, Mus musculus
ataggcttcttcatgatgcccgtct

SEQ ID NO: 2543 - DNA, 25 bp, Mus musculus
gtcgtgtagcccgcacttgttgtcg

SEQ ID NO: 2544 - DNA, 25 bp, Mus musculus
tcgtgtagcccgcacttgttgtcga

SEQ ID NO: 2545 - DNA, 25 bp, Mus musculus
agcccgcacttgttgtcgatgaact

SEQ ID NO: 2546 - DNA, 25 bp, Mus musculus
gcccgcacttgttgtcgatgaactc

SEQ ID NO: 2547 - DNA, 25 bp, Mus musculus
cccgcacttgttgtcgatgaactcc

SEQ ID NO: 2548 - DNA, 25 bp, Mus musculus
cgcacttgttgtcgatgaactccat

SEQ ID NO: 2549 - DNA, 25 bp, Mus musculus
tgaatcagcgccttgcggtctcact

SEQ ID NO: 2550 - DNA, 25 bp, Mus musculus
cgccttgcggtctcactggtgatca

SEQ ID NO: 2551 - DNA, 25 bp, Mus musculus
gccttgcggtctcactggtgatcat

SEQ ID NO: 2552 - DNA, 25 bp, Mus musculus
tggacagctcataggcttcttcatg

SEQ ID NO: 2553 - DNA, 25 bp, Mus musculus
ggacagctcataggcttcttcatga

SEQ ID NO: 2554 - DNA, 25 bp, Mus musculus
gacagctcataggcttcttcatgat

SEQ ID NO: 2555 - DNA, 25 bp, Mus musculus
cagctcataggcttcttcatgatgc

SEQ ID NO: 2556 - DNA, 25 bp, Mus musculus
agctcataggcttcttcatgatgcc

SEQ ID NO: 2557 - DNA, 25 bp, Mus musculus
cctgtagtccccacagggtcacctg

SEQ ID NO: 2558 - DNA, 25 bp, Mus musculus
gccaggctccaagcaagcagccttt

SEQ ID NO: 2559 - DNA, 25 bp, Mus musculus
tccctagactacacaggccacggct

SEQ ID NO: 2560 - DNA, 25 bp, Mus musculus
acaggccacggctctgagctgaaag

SEQ ID NO: 2561 - DNA, 25 bp, Mus musculus
gtgagagacaccttagctggtggag

SEQ ID NO: 2562 - DNA, 25 bp, Mus musculus
tttacctctgagaaacattgagggt

SEQ ID NO: 2563 - DNA, 25 bp, Mus musculus
tgaccccagatatatagggaattaa

SEQ ID NO: 2564 - DNA, 25 bp, Mus musculus
aacacaagtcaaacatctactgata

SEQ ID NO: 2565 - DNA, 25 bp, Mus musculus
agtcaaacatctactgataatcata

SEQ ID NO: 2566 - DNA, 25 bp, Mus musculus
tttgcattctaatgagatggatctg

SEQ ID NO: 2567 - DNA, 25 bp, Mus musculus
ggatctgcttgctttttcacaagga

SEQ ID NO: 2568 - DNA, 25 bp, Mus musculus
gcttgctttttcacaaggaatgatc

SEQ ID NO: 2569 - DNA, 25 bp, Mus musculus
ctccaagcaagcagcctttgtggaa

SEQ ID NO: 2570 - DNA, 25 bp, Mus musculus
atgatccgttgacctgcaggtcgac

SEQ ID NO: 2571 - DNA, 25 bp, Mus musculus
gcaagcagcctttgtggaacataca

SEQ ID NO: 2572 - DNA, 25 bp, Mus musculus
ctcagccaatcacaggtcagacagg

SEQ ID NO: 2573 - DNA, 25 bp, Mus musculus
agacagggctgtcaccccaataaag

SEQ ID NO: 2574 - DNA, 25 bp, Mus musculus
ggctgtcaccccaataaagagacac

SEQ ID NO: 2575 - DNA, 25 bp, Mus musculus
ctgaggtgccccagagaaacacagt

SEQ ID NO: 2576 - DNA, 25 bp, Mus musculus
acacagtgccagtcccagggtaagt

SEQ ID NO: 2577 - DNA, 25 bp, Mus musculus
tgccagtcccagggtaagtccctag

SEQ ID NO: 2578 - DNA, 25 bp, Mus musculus
agattttcccatcgcagtctgttgc

SEQ ID NO: 2579 - DNA, 25 bp, Mus musculus
gattttcccatcgcagtctgttgct

SEQ ID NO: 2580 - DNA, 25 bp, Mus musculus
gcagtctgttgctttaccaaataat

SEQ ID NO: 2581 - DNA, 25 bp, Mus musculus
cagtctgttgctttaccaaataata

SEQ ID NO: 2582 - DNA, 25 bp, Mus musculus
taatataacacattccttcagtcgt

SEQ ID NO: 2583 - DNA, 25 bp, Mus musculus
atataacacattccttcagtcgtta

SEQ ID NO: 2584 - DNA, 25 bp, Mus musculus
tataacacattccttcagtcgttat

SEQ ID NO: 2585 - DNA, 25 bp, Mus musculus
ataacacattccttcagtcgttata

SEQ ID NO: 2586 - DNA, 25 bp, Mus musculus
acacattccttcagtcgttataaag

SEQ ID NO: 2587 - DNA, 25 bp, Mus musculus
cacattccttcagtcgttataaagt

SEQ ID NO: 2588 - DNA, 25 bp, Mus musculus
accttgcccatagtaacctccactg

SEQ ID NO: 2589 - DNA, 25 bp, Mus musculus
ttgcccatagtaacctccactgcct

SEQ ID NO: 2590 - DNA, 25 bp, Mus musculus
attttcccatcgcagtctgttgctt

SEQ ID NO: 2591 - DNA, 25 bp, Mus musculus
tttcccatcgcagtctgttgcttta

SEQ ID NO: 2592 - DNA, 25 bp, Mus musculus
ttcccatcgcagtctgttgctttac

SEQ ID NO: 2593 - DNA, 25 bp, Mus musculus
tcccatcgcagtctgttgctttacc

SEQ ID NO: 2594 - DNA, 25 bp, Mus musculus
ccatcgcagtctgttgctttaccaa

SEQ ID NO: 2595 - DNA, 25 bp, Mus musculus
catcgcagtctgttgctttaccaaa

SEQ ID NO: 2596 - DNA, 25 bp, Mus musculus
atcgcagtctgttgctttaccaaat

SEQ ID NO: 2597 - DNA, 25 bp, Mus musculus
cgcagtctgttgctttaccaaataa

SEQ ID NO: 2598 - DNA, 25 bp, Mus musculus
agcgccgtactctaggaaaagctga

SEQ ID NO: 2599 - DNA, 25 bp, Mus musculus
aagctgactctgctgctatccgtcc

SEQ ID NO: 2600 - DNA, 25 bp, Mus musculus
taacctcaggacatgctgctagcct

SEQ ID NO: 2601 - DNA, 25 bp, Mus musculus
caggacatgctgctagccttcttgg

SEQ ID NO: 2602 - DNA, 25 bp, Mus musculus
atgctgctagccttcttgggactat

SEQ ID NO: 2603 - DNA, 25 bp, Mus musculus
ctagccttcttgggactattggcac

SEQ ID NO: 2604 - DNA, 25 bp, Mus musculus
gccttcttgggactattggcacgac

SEQ ID NO: 2605 - DNA, 25 bp, Mus musculus
ggactattggcacgactcgcagaaa

SEQ ID NO: 2606 - DNA, 25 bp, Mus musculus
ctattggcacgactcgcagaaatgt

SEQ ID NO: 2607 - DNA, 25 bp, Mus musculus
ttggcacgactcgcagaaatgttgc

SEQ ID NO: 2608 - DNA, 25 bp, Mus musculus
cagtcaaaatcgtactacagaactg

SEQ ID NO: 2609 - DNA, 25 bp, Mus musculus
aaatcgtactacagaactgatcatc

SEQ ID NO: 2610 - DNA, 25 bp, Mus musculus
ctgctatccgtccgtccagaattag

SEQ ID NO: 2611 - DNA, 25 bp, Mus musculus
ctatccgtccgtccagaattagtat

SEQ ID NO: 2612 - DNA, 25 bp, Mus musculus
tggagttcactcttgaggaacagga

SEQ ID NO: 2613 - DNA, 25 bp, Mus musculus
agttcactcttgaggaacaggagga

SEQ ID NO: 2614 - DNA, 25 bp, Mus musculus
atgacgaatttctcctgtatgagag

SEQ ID NO: 2615 - DNA, 25 bp, Mus musculus
acgaatttctcctgtatgagagaac

SEQ ID NO: 2616 - DNA, 25 bp, Mus musculus
gagcatttccaataacctcaggaca

SEQ ID NO: 2617 - DNA, 25 bp, Mus musculus
caataacctcaggacatgctgctag

SEQ ID NO: 2618 - DNA, 25 bp, Mus musculus
tgaccgtcatgaatcctcgcctctg

SEQ ID NO: 2619 - DNA, 25 bp, Mus musculus
gtggcttaggcaactccgtgattca

SEQ ID NO: 2620 - DNA, 25 bp, Mus musculus
ttgctcaggcagtgatgaagatccg

SEQ ID NO: 2621 - DNA, 25 bp, Mus musculus
tagtgtttctcttctatggctctgc

SEQ ID NO: 2622 - DNA, 25 bp, Mus musculus
ttctcttctatggctctgcgatcta

SEQ ID NO: 2623 - DNA, 25 bp, Mus musculus
gctctgcgatctatgggtatctgct

SEQ ID NO: 2624 - DNA, 25 bp, Mus musculus
atgggtatctgcttccagctaagag

SEQ ID NO: 2625 - DNA, 25 bp, Mus musculus
atctgcttccagctaagagcagtaa

SEQ ID NO: 2626 - DNA, 25 bp, Mus musculus
tctactctgtggtcacacccatggt

SEQ ID NO: 2627 - DNA, 25 bp, Mus musculus
ctgtggtcacacccatggtgaatcc

SEQ ID NO: 2628 - DNA, 25 bp, Mus musculus
tcacacccatggtgaatccgctcat

SEQ ID NO: 2629 - DNA, 25 bp, Mus musculus
cgctcatctatactctaagaaacaa

SEQ ID NO: 2630 - DNA, 25 bp, Mus musculus
taggcaactccgtgattcagtcaac

SEQ ID NO: 2631 - DNA, 25 bp, Mus musculus
ctctccagctcccattttgcggaca

SEQ ID NO: 2632 - DNA, 25 bp, Mus musculus
tacccgccatgattaaattggcctg

SEQ ID NO: 2633 - DNA, 25 bp, Mus musculus
acacaagtctcaatgaggcggtgct

SEQ ID NO: 2634 - DNA, 25 bp, Mus musculus
ctgtggtcccagtaagcgtcatcct

SEQ ID NO: 2635 - DNA, 25 bp, Mus musculus
tcccagtaagcgtcatcctggtctc

SEQ ID NO: 2636 - DNA, 25 bp, Mus musculus
taagcgtcatcctggtctcttactg

SEQ ID NO: 2637 - DNA, 25 bp, Mus musculus
tcatcctggtctcttactgcttcat

SEQ ID NO: 2638 - DNA, 25 bp, Mus musculus
gcctatttgctccaactactggcag

SEQ ID NO: 2639 - DNA, 25 bp, Mus musculus
tttgctccaactactggcaggcacc

SEQ ID NO: 2640 - DNA, 25 bp, Mus musculus
gtcctgacccagactagctcacact

SEQ ID NO: 2641 - DNA, 25 bp, Mus musculus
gagcccaggttcattgtcgttggct

SEQ ID NO: 2642 - DNA, 25 bp, Mus musculus
agcccaggttcattgtcgttggcta

SEQ ID NO: 2643 - DNA, 25 bp, Mus musculus
gcccaggttcattgtcgttggctac

SEQ ID NO: 2644 - DNA, 25 bp, Mus musculus
cccaggttcattgtcgttggctacg

SEQ ID NO: 2645 - DNA, 25 bp, Mus musculus
caggttcattgtcgttggctacgtg

SEQ ID NO: 2646 - DNA, 25 bp, Mus musculus
aggttcattgtcgttggctacgtgg

SEQ ID NO: 2647 - DNA, 25 bp, Mus musculus
tgcgctatgacagcgatgtggagaa

SEQ ID NO: 2648 - DNA, 25 bp, Mus musculus
gcgctatgacagcgatgtggagaat

SEQ ID NO: 2649 - DNA, 25 bp, Mus musculus
gaaccttcaaagtgaatctgaggac

SEQ ID NO: 2650 - DNA, 25 bp, Mus musculus
gctccaactactggcaggcaccatg

SEQ ID NO: 2651 - DNA, 25 bp, Mus musculus
actactggcaggcaccatggtcctg

SEQ ID NO: 2652 - DNA, 25 bp, Mus musculus
ctactggcaggcaccatggtcctga

SEQ ID NO: 2653 - DNA, 25 bp, Mus musculus
accatggtcctgacccagactagct

SEQ ID NO: 2654 - DNA, 25 bp, Mus musculus
ccatggtcctgacccagactagctc

SEQ ID NO: 2655 - DNA, 25 bp, Mus musculus
catggtcctgacccagactagctca

SEQ ID NO: 2656 - DNA, 25 bp, Mus musculus
atggtcctgacccagactagctcac

SEQ ID NO: 2657 - DNA, 25 bp, Mus musculus
ggtcctgacccagactagctcacac

SEQ ID NO: 2658 - DNA, 25 bp, Mus musculus
acagctctgtcactacccaagctta

SEQ ID NO: 2659 - DNA, 25 bp, Mus musculus
gctctgtcactacccaagcttacac

SEQ ID NO: 2660 - DNA, 25 bp, Mus musculus
ttcttgtgccagtattctatagcta

SEQ ID NO: 2661 - DNA, 25 bp, Mus musculus
atagctatcatctcagaaaggaaaa

SEQ ID NO: 2662 - DNA, 25 bp, Mus musculus
gctatcatctcagaaaggaaaagaa

SEQ ID NO: 2663 - DNA, 25 bp, Mus musculus
aggaagccccaggagtgtctgtcat

SEQ ID NO: 2664 - DNA, 25 bp, Mus musculus
aagccccaggagtgtctgtcatagg

SEQ ID NO: 2665 - DNA, 25 bp, Mus musculus
ctttgttggtcgccttggtctctgt

SEQ ID NO: 2666 - DNA, 25 bp, Mus musculus
tgttggtcgccttggtctctgtcca

SEQ ID NO: 2667 - DNA, 25 bp, Mus musculus
tcgccttggtctctgtccagaggtc

SEQ ID NO: 2668 - DNA, 25 bp, Mus musculus
ccttggtctctgtccagaggtcaaa

SEQ ID NO: 2669 - DNA, 25 bp, Mus musculus
tggtctctgtccagaggtcaaaggc

SEQ ID NO: 2670 - DNA, 25 bp, Mus musculus
gttctggctgtgcaccctgggccta

SEQ ID NO: 2671 - DNA, 25 bp, Mus musculus
ttcaacatttccctgggccacagcc

SEQ ID NO: 2672 - DNA, 25 bp, Mus musculus
atttccctgggccacagccaccaat

SEQ ID NO: 2673 - DNA, 25 bp, Mus musculus
agccaccaatctcggcccagaatgt

SEQ ID NO: 2674 - DNA, 25 bp, Mus musculus
tctcggcccagaatgtacacaacgc

SEQ ID NO: 2675 - DNA, 25 bp, Mus musculus
tgcactgcacacctgctagtcccag

SEQ ID NO: 2676 - DNA, 25 bp, Mus musculus
aagcattggctcgggacctgcagtg

SEQ ID NO: 2677 - DNA, 25 bp, Mus musculus
tctttcttgtgccagtattctatag

SEQ ID NO: 2678 - DNA, 25 bp, Mus musculus
ggtcattagtgttcccagaggcaga

SEQ ID NO: 2679 - DNA, 25 bp, Mus musculus
cattagtgttcccagaggcagagaa

SEQ ID NO: 2680 - DNA, 25 bp, Mus musculus
atccctagtgcatggtatgattatg

SEQ ID NO: 2681 - DNA, 25 bp, Mus musculus
gtaattgctttgctattatgagaat

SEQ ID NO: 2682 - DNA, 25 bp, Mus musculus
acactctcttcaatttacaacctct

SEQ ID NO: 2683 - DNA, 25 bp, Mus musculus
ctctcttcaatttacaacctctgaa

SEQ ID NO: 2684 - DNA, 25 bp, Mus musculus
atttacaacctctgaatgacatttg

SEQ ID NO: 2685 - DNA, 25 bp, Mus musculus
tacaacctctgaatgacatttgggt

SEQ ID NO: 2686 - DNA, 25 bp, Mus musculus
aacctctgaatgacatttgggtatc

SEQ ID NO: 2687 - DNA, 25 bp, Mus musculus
tatcatacacatttccttccactaa

SEQ ID NO: 2688 - DNA, 25 bp, Mus musculus
aacattaaacactttgcttacaatg

SEQ ID NO: 2689 - DNA, 25 bp, Mus musculus
attaaacactttgcttacaatgtct

SEQ ID NO: 2690 - DNA, 25 bp, Mus musculus
ggacaatcatggctgtcatggtatc

SEQ ID NO: 2691 - DNA, 25 bp, Mus musculus
tcatggtatccctgctgacagacta

SEQ ID NO: 2692 - DNA, 25 bp, Mus musculus
tggtatccctgctgacagactactc

SEQ ID NO: 2693 - DNA, 25 bp, Mus musculus
tgctgacagactactcacctgtgct

SEQ ID NO: 2694 - DNA, 25 bp, Mus musculus
tgacagactactcacctgtgctcca

SEQ ID NO: 2695 - DNA, 25 bp, Mus musculus
tgctccagaagccaaagttttgatg

SEQ ID NO: 2696 - DNA, 25 bp, Mus musculus
ccctctgttctttagcaatagaata

SEQ ID NO: 2697 - DNA, 25 bp, Mus musculus
tgtaaacacatccctagtgcatggt

SEQ ID NO: 2698 - DNA, 25 bp, Mus musculus
gctcctttagtctctttggacactt

SEQ ID NO: 2699 - DNA, 25 bp, Mus musculus
gtctctttggacactttccaaatat

SEQ ID NO: 2700 - DNA, 25 bp, Mus musculus
ttcagaagcttgccaacaactccta

SEQ ID NO: 2701 - DNA, 25 bp, Mus musculus
agaagcttgccaacaactcctatgc

SEQ ID NO: 2702 - DNA, 25 bp, Mus musculus
agcttgccaacaactcctatgcatg

SEQ ID NO: 2703 - DNA, 25 bp, Mus musculus
ttgccaacaactcctatgcatgcaa

SEQ ID NO: 2704 - DNA, 25 bp, Mus musculus
ccaacaactcctatgcatgcaaaca

SEQ ID NO: 2705 - DNA, 25 bp, Mus musculus
acaactcctatgcatgcaaacaccc

SEQ ID NO: 2706 - DNA, 25 bp, Mus musculus
catgcaaacaccctgaagttcaatc

SEQ ID NO: 2707 - DNA, 25 bp, Mus musculus
gcaaacaccctgaagttcaatccta

SEQ ID NO: 2708 - DNA, 25 bp, Mus musculus
ctgaagttcaatcctatttgaaaat

SEQ ID NO: 2709 - DNA, 25 bp, Mus musculus
ttcaatcctatttgaaaatctccca

SEQ ID NO: 2710 - DNA, 25 bp, Mus musculus
tctttggacactttccaaatatcgg

SEQ ID NO: 2711 - DNA, 25 bp, Mus musculus
caagtccctctcaacaaatcaacct

SEQ ID NO: 2712 - DNA, 25 bp, Mus musculus
gacactttccaaatatcggggcgat

SEQ ID NO: 2713 - DNA, 25 bp, Mus musculus
cgatgaccgtcaaaaccgaggctgc

SEQ ID NO: 2714 - DNA, 25 bp, Mus musculus
tgaccgtcaaaaccgaggctgctcg

SEQ ID NO: 2715 - DNA, 25 bp, Mus musculus
tggtagcaatcctcatcgctttcat

SEQ ID NO: 2716 - DNA, 25 bp, Mus musculus
tagcaatcctcatcgctttcatgaa

SEQ ID NO: 2717 - DNA, 25 bp, Mus musculus
caatcctcatcgctttcatgaaaca

SEQ ID NO: 2718 - DNA, 25 bp, Mus musculus
ttattcagaagcttgccaacaactc

SEQ ID NO: 2719 - DNA, 25 bp, Mus musculus
tatgcatcctgctagtcagcgaggt

SEQ ID NO: 2720 - DNA, 25 bp, Mus musculus
cgaggtcatctgcaatctataaaat

SEQ ID NO: 2721 - DNA, 25 bp, Mus musculus
gcaatatcatcagcgacatcgacaa

SEQ ID NO: 2722 - DNA, 25 bp, Mus musculus
aatatcatcagcgacatcgacaatt

SEQ ID NO: 2723 - DNA, 25 bp, Mus musculus
atatcatcagcgacatcgacaattt

SEQ ID NO: 2724 - DNA, 25 bp, Mus musculus
tatcatcagcgacatcgacaatttg

SEQ ID NO: 2725 - DNA, 25 bp, Mus musculus
tcatcagcgacatcgacaatttgca

SEQ ID NO: 2726 - DNA, 25 bp, Mus musculus
catcagcgacatcgacaatttgcag

SEQ ID NO: 2727 - DNA, 25 bp, Mus musculus
atcagcgacatcgacaatttgcagc

SEQ ID NO: 2728 - DNA, 25 bp, Mus musculus
taggcacccgggacgcagctcgcta

SEQ ID NO: 2729 - DNA, 25 bp, Mus musculus
cacccgggacgcagctcgctactgg

SEQ ID NO: 2730 - DNA, 25 bp, Mus musculus
acccgggacgcagctcgctactggt

SEQ ID NO: 2731 - DNA, 25 bp, Mus musculus
gaggtcatctgcaatctataaaatg

SEQ ID NO: 2732 - DNA, 25 bp, Mus musculus
aggtcatctgcaatctataaaatgt

SEQ ID NO: 2733 - DNA, 25 bp, Mus musculus
gtcatctgcaatctataaaatgtgg

SEQ ID NO: 2734 - DNA, 25 bp, Mus musculus
tcatctgcaatctataaaatgtggt

SEQ ID NO: 2735 - DNA, 25 bp, Mus musculus
tcccagcaatatcatcagcgacatc

SEQ ID NO: 2736 - DNA, 25 bp, Mus musculus
cccagcaatatcatcagcgacatcg

SEQ ID NO: 2737 - DNA, 25 bp, Mus musculus
cagcaatatcatcagcgacatcgac

SEQ ID NO: 2738 - DNA, 25 bp, Mus musculus
agcaatatcatcagcgacatcgaca

SEQ ID NO: 2739 - DNA, 25 bp, Mus musculus
ccatcacctacagcggatctcagac

SEQ ID NO: 2740 - DNA, 25 bp, Mus musculus
tcacctacagcggatctcagactga

SEQ ID NO: 2741 - DNA, 25 bp, Mus musculus
gctgtgctggacctggatatgcgca

SEQ ID NO: 2742 - DNA, 25 bp, Mus musculus
gtgctggacctggatatgcgcaagt

SEQ ID NO: 2743 - DNA, 25 bp, Mus musculus
gacctggatatgcgcaagtgtctcc

SEQ ID NO: 2744 - DNA, 25 bp, Mus musculus
gccacaggcatctgctgcagcccgg

SEQ ID NO: 2745 - DNA, 25 bp, Mus musculus
acaggcatctgctgcagcccggatg

SEQ ID NO: 2746 - DNA, 25 bp, Mus musculus
ggcatctgctgcagcccggatggct

SEQ ID NO: 2747 - DNA, 25 bp, Mus musculus
atctgctgcagcccggatggctgcc

SEQ ID NO: 2748 - DNA, 25 bp, Mus musculus
tgcgaccctgagtctgccttctcgg

SEQ ID NO: 2749 - DNA, 25 bp, Mus musculus
tgagcccactttctgggaatacctt

SEQ ID NO: 2750 - DNA, 25 bp, Mus musculus
cgttccccatggccactgccagaaa

SEQ ID NO: 2751 - DNA, 25 bp, Mus musculus
cctacagcggatctcagactgagca

SEQ ID NO: 2752 - DNA, 25 bp, Mus musculus
acagcggatctcagactgagcacca

SEQ ID NO: 2753 - DNA, 25 bp, Mus musculus
gatctcagactgagcaccatcgcca

SEQ ID NO: 2754 - DNA, 25 bp, Mus musculus
ctcagactgagcaccatcgccatgg

SEQ ID NO: 2755 - DNA, 25 bp, Mus musculus
agactgagcaccatcgccatggcct

SEQ ID NO: 2756 - DNA, 25 bp, Mus musculus
ctgcttggcttactggctctgacct

SEQ ID NO: 2757 - DNA, 25 bp, Mus musculus
ggcttactggctctgacctcggcct

SEQ ID NO: 2758 - DNA, 25 bp, Mus musculus
agggctgtgctggacctggatatgc

SEQ ID NO: 2759 - DNA, 25 bp, Mus musculus
atcggccaccgatgggctgcacact

SEQ ID NO: 2760 - DNA, 25 bp, Mus musculus
tcggccaccgatgggctgcacactg

SEQ ID NO: 2761 - DNA, 25 bp, Mus musculus
gatgatcgaccgcaacctccgggag

SEQ ID NO: 2762 - DNA, 25 bp, Mus musculus
atgatcgaccgcaacctccgggagg

SEQ ID NO: 2763 - DNA, 25 bp, Mus musculus
aaattatccacgaggctggctactc

SEQ ID NO: 2764 - DNA, 25 bp, Mus musculus
aattatccacgaggctggctactca

SEQ ID NO: 2765 - DNA, 25 bp, Mus musculus
attatccacgaggctggctactcag

SEQ ID NO: 2766 - DNA, 25 bp, Mus musculus
ttatccacgaggctggctactcagg

SEQ ID NO: 2767 - DNA, 25 bp, Mus musculus
tatccacgaggctggctactcagga

SEQ ID NO: 2768 - DNA, 25 bp, Mus musculus
acgaggctggctactcaggagaaga

SEQ ID NO: 2769 - DNA, 25 bp, Mus musculus
aggctggctactcaggagaagagtg

SEQ ID NO: 2770 - DNA, 25 bp, Mus musculus
cggccaccgatgggctgcacactga

SEQ ID NO: 2771 - DNA, 25 bp, Mus musculus
ggccaccgatgggctgcacactgag

SEQ ID NO: 2772 - DNA, 25 bp, Mus musculus
gccaccgatgggctgcacactgagc

SEQ ID NO: 2773 - DNA, 25 bp, Mus musculus
caccgatgggctgcacactgagcgc

SEQ ID NO: 2774 - DNA, 25 bp, Mus musculus
accgatgggctgcacactgagcgct

SEQ ID NO: 2775 - DNA, 25 bp, Mus musculus
ccgatgggctgcacactgagcgctg

SEQ ID NO: 2776 - DNA, 25 bp, Mus musculus
aggatgatcgaccgcaacctccggg

SEQ ID NO: 2777 - DNA, 25 bp, Mus musculus
ggatgatcgaccgcaacctccggga

SEQ ID NO: 2778 - DNA, 25 bp, Mus musculus
cctgctcttctcttctttggtgctg

SEQ ID NO: 2779 - DNA, 25 bp, Mus musculus
cttctcttctttggtgctgtctcca

SEQ ID NO: 2780 - DNA, 25 bp, Mus musculus
ggtctcagatgacatctcttttacc

SEQ ID NO: 2781 - DNA, 25 bp, Mus musculus
ctcagatgacatctcttttacctgg

SEQ ID NO: 2782 - DNA, 25 bp, Mus musculus
tgacatctcttttacctggcgctac

SEQ ID NO: 2783 - DNA, 25 bp, Mus musculus
catctcttttacctggcgctaccag

SEQ ID NO: 2784 - DNA, 25 bp, Mus musculus
ctcttttacctggcgctaccagcct

SEQ ID NO: 2785 - DNA, 25 bp, Mus musculus
ccgagatgccatttcgattttccac

SEQ ID NO: 2786 - DNA, 25 bp, Mus musculus
catttcgattttccactatgccaag

SEQ ID NO: 2787 - DNA, 25 bp, Mus musculus
ttcgattttccactatgccaaggga

SEQ ID NO: 2788 - DNA, 25 bp, Mus musculus
gattttccactatgccaagggacaa

SEQ ID NO: 2789 - DNA, 25 bp, Mus musculus
ctatgccaagggacaaccttacatc

SEQ ID NO: 2790 - DNA, 25 bp, Mus musculus
ttctttggtgctgtctccagccctg

SEQ ID NO: 2791 - DNA, 25 bp, Mus musculus
ggtgctgtctccagccctggccatt

SEQ ID NO: 2792 - DNA, 25 bp, Mus musculus
gtctccagccctggccattgtggtt

SEQ ID NO: 2793 - DNA, 25 bp, Mus musculus
tccagccctggccattgtggtttac

SEQ ID NO: 2794 - DNA, 25 bp, Mus musculus
agccctggccattgtggtttacacg

SEQ ID NO: 2795 - DNA, 25 bp, Mus musculus
aatctatggtgctgtgggctcccag

SEQ ID NO: 2796 - DNA, 25 bp, Mus musculus
ctgctccttctggtccagtgaatgg

SEQ ID NO: 2797 - DNA, 25 bp, Mus musculus
ctccttctggtccagtgaatgggtc

SEQ ID NO: 2798 - DNA, 25 bp, Mus musculus
tcagctcccaatgaatttggcatct

SEQ ID NO: 2799 - DNA, 25 bp, Mus musculus
gctcccaatgaatttggcatcttta

SEQ ID NO: 2800 - DNA, 25 bp, Mus musculus
ctcatcattatatcgtcctacactg

SEQ ID NO: 2801 - DNA, 25 bp, Mus musculus
atcattatatcgtcctacactgcta

SEQ ID NO: 2802 - DNA, 25 bp, Mus musculus
atatcgtcctacactgctaatctgg

SEQ ID NO: 2803 - DNA, 25 bp, Mus musculus
tacactgctaatctggctgcatgcc

SEQ ID NO: 2804 - DNA, 25 bp, Mus musculus
actgctaatctggctgcatgcctta

SEQ ID NO: 2805 - DNA, 25 bp, Mus musculus
gctgcatgccttactgtggagagga

SEQ ID NO: 2806 - DNA, 25 bp, Mus musculus
tgccttactgtggagaggatggtct

SEQ ID NO: 2807 - DNA, 25 bp, Mus musculus
tcccccatagaaagtgcagaagacc

SEQ ID NO: 2808 - DNA, 25 bp, Mus musculus
agtgcagaagacctgccaagacgac

SEQ ID NO: 2809 - DNA, 25 bp, Mus musculus
gcagaagacctgccaagacgacaga

SEQ ID NO: 2810 - DNA, 25 bp, Mus musculus
tcacccagatccctgtcaggtcgga

SEQ ID NO: 2811 - DNA, 25 bp, Mus musculus
cccagatccctgtcaggtcggattg

SEQ ID NO: 2812 - DNA, 25 bp, Mus musculus
agatccctgtcaggtcggattgttg

SEQ ID NO: 2813 - DNA, 25 bp, Mus musculus
tccctgtcaggtcggattgttggag

SEQ ID NO: 2814 - DNA, 25 bp, Mus musculus
tggttcttcacactcatcattatat

SEQ ID NO: 2815 - DNA, 25 bp, Mus musculus
ttcttcacactcatcattatatcgt

SEQ ID NO: 2816 - DNA, 25 bp, Mus musculus
ttcacactcatcattatatcgtcct

SEQ ID NO: 2817 - DNA, 25 bp, Mus musculus
acactcatcattatatcgtcctaca

SEQ ID NO: 2818 - DNA, 25 bp, Mus musculus
aaagtcccaatcatttgtacgtgtg

SEQ ID NO: 2819 - DNA, 25 bp, Mus musculus
atcatttgtacgtgtgagttgggaa

SEQ ID NO: 2820 - DNA, 25 bp, Mus musculus
agagcccaggctacctggattagga

SEQ ID NO: 2821 - DNA, 25 bp, Mus musculus
caggctacctggattaggagtagaa

SEQ ID NO: 2822 - DNA, 25 bp, Mus musculus
cccctcttgttcccatggtgatgta

SEQ ID NO: 2823 - DNA, 25 bp, Mus musculus
ttcccatggtgatgtaggatggact

SEQ ID NO: 2824 - DNA, 25 bp, Mus musculus
ccctcaggccaagagacaaacctct

SEQ ID NO: 2825 - DNA, 25 bp, Mus musculus
caagagacaaacctctgagagctaa

SEQ ID NO: 2826 - DNA, 25 bp, Mus musculus
gagacaaacctctgagagctaatgt

SEQ ID NO: 2827 - DNA, 25 bp, Mus musculus
gagctaatgtcaggtccctggagac

SEQ ID NO: 2828 - DNA, 25 bp, Mus musculus
ctggctggcagcaggtgggaaccat

SEQ ID NO: 2829 - DNA, 25 bp, Mus musculus
tctctttattcttccaagcatgaga

SEQ ID NO: 2830 - DNA, 25 bp, Mus musculus
ccgactcctatgcagacagctgcca

SEQ ID NO: 2831 - DNA, 25 bp, Mus musculus
atgcagacagctgccattcctgcca

SEQ ID NO: 2832 - DNA, 25 bp, Mus musculus
cagacagctgccattcctgccaagg

SEQ ID NO: 2833 - DNA, 25 bp, Mus musculus
acagctgccattcctgccaaggtac

SEQ ID NO: 2834 - DNA, 25 bp, Mus musculus
gccattcctgccaaggtacctaggc

SEQ ID NO: 2835 - DNA, 25 bp, Mus musculus
gtacctaggctgagattcagcctcc

SEQ ID NO: 2836 - DNA, 25 bp, Mus musculus
ctgagattcagcctcccagatccaa

SEQ ID NO: 2837 - DNA, 25 bp, Mus musculus
ttcagcctcccagatccaaggggga

SEQ ID NO: 2838 - DNA, 25 bp, Mus musculus
atgacctcaaggatggccatactat

SEQ ID NO: 2839 - DNA, 25 bp, Mus musculus
acctcaaggatggccatactatctg

SEQ ID NO: 2840 - DNA, 25 bp, Mus musculus
agacagacatccagaggcttgctgc

SEQ ID NO: 2841 - DNA, 25 bp, Mus musculus
acagacatccagaggcttgctgcat

SEQ ID NO: 2842 - DNA, 25 bp, Mus musculus
gacatccagaggcttgctgcatgga

SEQ ID NO: 2843 - DNA, 25 bp, Mus musculus
cagaggcttgctgcatggagtcatg

SEQ ID NO: 2844 - DNA, 25 bp, Mus musculus
agaggcttgctgcatggagtcatgg

SEQ ID NO: 2845 - DNA, 25 bp, Mus musculus
ggcttgctgcatggagtcatggagc

SEQ ID NO: 2846 - DNA, 25 bp, Mus musculus
ttgctgcatggagtcatggagcagc

SEQ ID NO: 2847 - DNA, 25 bp, Mus musculus
aattgccaggcacgtgtgagttccc

SEQ ID NO: 2848 - DNA, 25 bp, Mus musculus
attgccaggcacgtgtgagttccca

SEQ ID NO: 2849 - DNA, 25 bp, Mus musculus
tgccaggcacgtgtgagttcccagc

SEQ ID NO: 2850 - DNA, 25 bp, Mus musculus
aggatggccatactatctggtcttt

SEQ ID NO: 2851 - DNA, 25 bp, Mus musculus
ggatggccatactatctggtctttt

SEQ ID NO: 2852 - DNA, 25 bp, Mus musculus
tggccatactatctggtcttttgtg

SEQ ID NO: 2853 - DNA, 25 bp, Mus musculus
gccatactatctggtcttttgtgtt

SEQ ID NO: 2854 - DNA, 25 bp, Mus musculus
ccatactatctggtcttttgtgttg

SEQ ID NO: 2855 - DNA, 25 bp, Mus musculus
atactatctggtcttttgtgttggc

SEQ ID NO: 2856 - DNA, 25 bp, Mus musculus
ctggtcttttgtgttggctgctgct

SEQ ID NO: 2857 - DNA, 25 bp, Mus musculus
gtcttttgtgttggctgctgcttga

SEQ ID NO: 2858 - DNA, 25 bp, Mus musculus
atgctacctccaaagacagagcagt

SEQ ID NO: 2859 - DNA, 25 bp, Mus musculus
cctccaaagacagagcagtacgtgg

SEQ ID NO: 2860 - DNA, 25 bp, Mus musculus
catatcattgactgtatcctgtaat

SEQ ID NO: 2861 - DNA, 25 bp, Mus musculus
atcattgactgtatcctgtaatatg

SEQ ID NO: 2862 - DNA, 25 bp, Mus musculus
taatatgcaacggcacagctagttt

SEQ ID NO: 2863 - DNA, 25 bp, Mus musculus
tatgcaacggcacagctagtttttc

SEQ ID NO: 2864 - DNA, 25 bp, Mus musculus
gcaacggcacagctagtttttctga

SEQ ID NO: 2865 - DNA, 25 bp, Mus musculus
cagctagtttttctgatctggataa

SEQ ID NO: 2866 - DNA, 25 bp, Mus musculus
ctagtttttctgatctggataaaag

SEQ ID NO: 2867 - DNA, 25 bp, Mus musculus
agtcaacatcttgaactatatttca

SEQ ID NO: 2868 - DNA, 25 bp, Mus musculus
agaataaatctcaacagacaactct

SEQ ID NO: 2869 - DNA, 25 bp, Mus musculus
aatctcaacagacaactctattctg

SEQ ID NO: 2870 - DNA, 25 bp, Mus musculus
cttcacaaaggcgaggtggtagatg

SEQ ID NO: 2871 - DNA, 25 bp, Mus musculus
aacagacaactctattctgattata

SEQ ID NO: 2872 - DNA, 25 bp, Mus musculus
gatgtcatggtcattggacggctat

SEQ ID NO: 2873 - DNA, 25 bp, Mus musculus
gtcatggtcattggacggctatgat

SEQ ID NO: 2874 - DNA, 25 bp, Mus musculus
atggtcattggacggctatgatggt

SEQ ID NO: 2875 - DNA, 25 bp, Mus musculus
tttgatgcatgtccacatatcattg

SEQ ID NO: 2876 - DNA, 25 bp, Mus musculus
gatgcatgtccacatatcattgact

SEQ ID NO: 2877 - DNA, 25 bp, Mus musculus
gcatgtccacatatcattgactgta

SEQ ID NO: 2878 - DNA, 25 bp, Mus musculus
ccacatatcattgactgtatcctgt

SEQ ID NO: 2879 - DNA, 25 bp, Mus musculus
actagccacatctggcacacacacg

SEQ ID NO: 2880 - DNA, 25 bp, Mus musculus
cacggtcaccatggtcagcgctgat

SEQ ID NO: 2881 - DNA, 25 bp, Mus musculus
ggcgtctcttcatcaccaacaggtg

SEQ ID NO: 2882 - DNA, 25 bp, Mus musculus
tcttcatcaccaacaggtggcgctg

SEQ ID NO: 2883 - DNA, 25 bp, Mus musculus
tcatcaccaacaggtggcgctgttg

SEQ ID NO: 2884 - DNA, 25 bp, Mus musculus
tcaccaacaggtggcgctgttggcc

SEQ ID NO: 2885 - DNA, 25 bp, Mus musculus
acaggtggcgctgttggccacagcc

SEQ ID NO: 2886 - DNA, 25 bp, Mus musculus
caacggaacacacatcgcagtgcag

SEQ ID NO: 2887 - DNA, 25 bp, Mus musculus
cggaacacacatcgcagtgcagctg

SEQ ID NO: 2888 - DNA, 25 bp, Mus musculus
aacacacatcgcagtgcagctggag

SEQ ID NO: 2889 - DNA, 25 bp, Mus musculus
catcgcagtgcagctggaggaccag

SEQ ID NO: 2890 - DNA, 25 bp, Mus musculus
ggccataagcgtacgcactgctgct

SEQ ID NO: 2891 - DNA, 25 bp, Mus musculus
cagcgctgatggcacgcagactcag

SEQ ID NO: 2892 - DNA, 25 bp, Mus musculus
cgtacgcactgctgctatgcacgaa

SEQ ID NO: 2893 - DNA, 25 bp, Mus musculus
tcagcccgtcacaatcattacctct

SEQ ID NO: 2894 - DNA, 25 bp, Mus musculus
cgtcacaatcattacctctggggcc

SEQ ID NO: 2895 - DNA, 25 bp, Mus musculus
aatcattacctctggggccttggtg

SEQ ID NO: 2896 - DNA, 25 bp, Mus musculus
cattacctctggggccttggtgact

SEQ ID NO: 2897 - DNA, 25 bp, Mus musculus
tacctctggggccttggtgactgag

SEQ ID NO: 2898 - DNA, 25 bp, Mus musculus
tggggccttggtgactgaggactca

SEQ ID NO: 2899 - DNA, 25 bp, Mus musculus
tgaggactcaagcgtggcgtctctt

SEQ ID NO: 2900 - DNA, 25 bp, Mus musculus
atgcaatactggcccccaggggctg

SEQ ID NO: 2901 - DNA, 25 bp, Mus musculus
gtgaactctgtccaatgtggccttc

SEQ ID NO: 2902 - DNA, 25 bp, Mus musculus
gttctgagcccagtgcccatggttg

SEQ ID NO: 2903 - DNA, 25 bp, Mus musculus
gtaagcatccatgttgactgaccac

SEQ ID NO: 2904 - DNA, 25 bp, Mus musculus
atccatgttgactgaccacgactgc

SEQ ID NO: 2905 - DNA, 25 bp, Mus musculus
tgaccacgactgctgtcccccagtg

SEQ ID NO: 2906 - DNA, 25 bp, Mus musculus
cccagtgccatggccactttgatat

SEQ ID NO: 2907 - DNA, 25 bp, Mus musculus
gccatggccactttgatatccgttt

SEQ ID NO: 2908 - DNA, 25 bp, Mus musculus
ttgatatccgtttccagacatttct

SEQ ID NO: 2909 - DNA, 25 bp, Mus musculus
tttccccagttctaccagagtaatg

SEQ ID NO: 2910 - DNA, 25 bp, Mus musculus
cagttctaccagagtaatggtattt

SEQ ID NO: 2911 - DNA, 25 bp, Mus musculus
tggtctctaacttctgtgtgaaata

SEQ ID NO: 2912 - DNA, 25 bp, Mus musculus
ggccttctctctgtaagggagaatc

SEQ ID NO: 2913 - DNA, 25 bp, Mus musculus
gagaatcttgcctggctctcttctc

SEQ ID NO: 2914 - DNA, 25 bp, Mus musculus
cttgcctggctctcttctcttgggc

SEQ ID NO: 2915 - DNA, 25 bp, Mus musculus
tggctctcttctcttgggcctctaa

SEQ ID NO: 2916 - DNA, 25 bp, Mus musculus
cacatccagccagtggcctgaactt

SEQ ID NO: 2917 - DNA, 25 bp, Mus musculus
ttgaaaccagcagccccaaatcctg

SEQ ID NO: 2918 - DNA, 25 bp, Mus musculus
aatcctgcagcagagccccaaaact

SEQ ID NO: 2919 - DNA, 25 bp, Mus musculus
gcagcagagccccaaaactggcctg

SEQ ID NO: 2920 - DNA, 25 bp, Mus musculus
aaatgtcttcatcaagaacctggac

SEQ ID NO: 2921 - DNA, 25 bp, Mus musculus
tgtcttcatcaagaacctggacaaa

SEQ ID NO: 2922 - DNA, 25 bp, Mus musculus
tttctctgcctttggaaacatcttg

SEQ ID NO: 2923 - DNA, 25 bp, Mus musculus
ctctgcctttggaaacatcttgtcc

SEQ ID NO: 2924 - DNA, 25 bp, Mus musculus
tggaaacatcttgtcctgtaaggtg

SEQ ID NO: 2925 - DNA, 25 bp, Mus musculus
catcttgtcctgtaaggtggtctgt

SEQ ID NO: 2926 - DNA, 25 bp, Mus musculus
cttgtcctgtaaggtggtctgtgat

SEQ ID NO: 2927 - DNA, 25 bp, Mus musculus
gtcctgtaaggtggtctgtgatgag

SEQ ID NO: 2928 - DNA, 25 bp, Mus musculus
cggctctaagggctatgcttttgtt

SEQ ID NO: 2929 - DNA, 25 bp, Mus musculus
ctctaagggctatgcttttgttcac

SEQ ID NO: 2930 - DNA, 25 bp, Mus musculus
ctatgcttttgttcacttcgagacc

SEQ ID NO: 2931 - DNA, 25 bp, Mus musculus
atgcttttgttcacttcgagaccca

SEQ ID NO: 2932 - DNA, 25 bp, Mus musculus
cttcatcaagaacctggacaaatcc

SEQ ID NO: 2933 - DNA, 25 bp, Mus musculus
tgcttttgttcacttcgagacccaa

SEQ ID NO: 2934 - DNA, 25 bp, Mus musculus
caagaacctggacaaatccatagac

SEQ ID NO: 2935 - DNA, 25 bp, Mus musculus
gaacctggacaaatccatagacaac

SEQ ID NO: 2936 - DNA, 25 bp, Mus musculus
caaatccatagacaacaaggcactg

SEQ ID NO: 2937 - DNA, 25 bp, Mus musculus
agacaacaaggcactgtatgacact

SEQ ID NO: 2938 - DNA, 25 bp, Mus musculus
gtatgacactttctctgcctttgga

SEQ ID NO: 2939 - DNA, 25 bp, Mus musculus
tgacactttctctgcctttggaaac

SEQ ID NO: 2940 - DNA, 25 bp, Mus musculus
cactttctctgcctttggaaacatc

SEQ ID NO: 2941 - DNA, 25 bp, Mus musculus
gacatacatccttgcctctgttttg

SEQ ID NO: 2942 - DNA, 25 bp, Mus musculus
cagcaccacatggggcatcagagac

SEQ ID NO: 2943 - DNA, 25 bp, Mus musculus
gctgaccaatgccacacagaaatca

SEQ ID NO: 2944 - DNA, 25 bp, Mus musculus
gaaatcaagactcttgcctgttttc

SEQ ID NO: 2945 - DNA, 25 bp, Mus musculus
gtccttttcctgcgaaaagccatgc

SEQ ID NO: 2946 - DNA, 25 bp, Mus musculus
ttcctgcgaaaagccatgcaaccag

SEQ ID NO: 2947 - DNA, 25 bp, Mus musculus
cgaaaagccatgcaaccagaccatg

SEQ ID NO: 2948 - DNA, 25 bp, Mus musculus
gccatgcaaccagaccatggcaggc

SEQ ID NO: 2949 - DNA, 25 bp, Mus musculus
caaccagaccatggcaggcaacaca

SEQ ID NO: 2950 - DNA, 25 bp, Mus musculus
gaagagtctcctggggacgttccag

SEQ ID NO: 2951 - DNA, 25 bp, Mus musculus
gcagaaaagccgaccatgaagacag

SEQ ID NO: 2952 - DNA, 25 bp, Mus musculus
aagccgaccatgaagacagatgcta

SEQ ID NO: 2953 - DNA, 25 bp, Mus musculus
caccaattaccttattgaaaatctg

SEQ ID NO: 2954 - DNA, 25 bp, Mus musculus
ttaccttattgaaaatctgaaggat

SEQ ID NO: 2955 - DNA, 25 bp, Mus musculus
tgatccaccgtcaaaatgcagctgc

SEQ ID NO: 2956 - DNA, 25 bp, Mus musculus
accgtcaaaatgcagctgcagcggc

SEQ ID NO: 2957 - DNA, 25 bp, Mus musculus
caacgtgaccagctgcttgtgtctc

SEQ ID NO: 2958 - DNA, 25 bp, Mus musculus
tgatgattgtaccacaccgtgctac

SEQ ID NO: 2959 - DNA, 25 bp, Mus musculus
ttgtaccacaccgtgctacagggag

SEQ ID NO: 2960 - DNA, 25 bp, Mus musculus
gttacagctgaccaatgccacacag

SEQ ID NO: 2961 - DNA, 25 bp, Mus musculus
acctgaaatattcaccgaactggag

SEQ ID NO: 2962 - DNA, 25 bp, Mus musculus
tgaaatattcaccgaactggagatt

SEQ ID NO: 2963 - DNA, 25 bp, Mus musculus
caacataggctccctgtcgacagga

SEQ ID NO: 2964 - DNA, 25 bp, Mus musculus
cataggctccctgtcgacaggagga

SEQ ID NO: 2965 - DNA, 25 bp, Mus musculus
ctccctgtcgacaggaggaagagtt

SEQ ID NO: 2966 - DNA, 25 bp, Mus musculus
agttagtgcagtcaaggctgatttg

SEQ ID NO: 2967 - DNA, 25 bp, Mus musculus
tgcagtcaaggctgatttgggcaaa

SEQ ID NO: 2968 - DNA, 25 bp, Mus musculus
gaccaatcccgtgtgcacagaagta

SEQ ID NO: 2969 - DNA, 25 bp, Mus musculus
caatcccgtgtgcacagaagtagga

SEQ ID NO: 2970 - DNA, 25 bp, Mus musculus
tcccgtgtgcacagaagtaggagaa

SEQ ID NO: 2971 - DNA, 25 bp, Mus musculus
aattgcccttagcagaagagttgag

SEQ ID NO: 2972 - DNA, 25 bp, Mus musculus
tgcccttagcagaagagttgagaaa

SEQ ID NO: 2973 - DNA, 25 bp, Mus musculus
attcaccgaactggagatttcctat

SEQ ID NO: 2974 - DNA, 25 bp, Mus musculus
ggagatttcctatttcctgcttaga

SEQ ID NO: 2975 - DNA, 25 bp, Mus musculus
gatttcctatttcctgcttagacgt

SEQ ID NO: 2976 - DNA, 25 bp, Mus musculus
ctatttcctgcttagacgtcttctg

SEQ ID NO: 2977 - DNA, 25 bp, Mus musculus
cctgcttagacgtcttctgggtgta

SEQ ID NO: 2978 - DNA, 25 bp, Mus musculus
gcttagacgtcttctgggtgtacgt

SEQ ID NO: 2979 - DNA, 25 bp, Mus musculus
tcttctgggtgtacgtactgaagga

SEQ ID NO: 2980 - DNA, 25 bp, Mus musculus
ggtcaacataggctccctgtcgaca

SEQ ID NO: 2981 - DNA, 25 bp, Mus musculus
ctattataacacattaacataggac

SEQ ID NO: 2982 - DNA, 25 bp, Mus musculus
attataacacattaacataggacct

SEQ ID NO: 2983 - DNA, 25 bp, Mus musculus
acacccgacagcagctttacctgct

SEQ ID NO: 2984 - DNA, 25 bp, Mus musculus
acccgacagcagctttacctgcttt

SEQ ID NO: 2985 - DNA, 25 bp, Mus musculus
cagcagctttacctgctttccaaca

SEQ ID NO: 2986 - DNA, 25 bp, Mus musculus
gcagctttacctgctttccaacata

SEQ ID NO: 2987 - DNA, 25 bp, Mus musculus
agctttacctgctttccaacatatg

SEQ ID NO: 2988 - DNA, 25 bp, Mus musculus
ctttacctgctttccaacatatgat

SEQ ID NO: 2989 - DNA, 25 bp, Mus musculus
tatgtgaccatcaaagggtttcgaa

SEQ ID NO: 2990 - DNA, 25 bp, Mus musculus
tttcgaaatccatggttgagaactg

SEQ ID NO: 2991 - DNA, 25 bp, Mus musculus
tgttctagatgcacacaacatataa

SEQ ID NO: 2992 - DNA, 25 bp, Mus musculus
ttctagatgcacacaacatataatt

SEQ ID NO: 2993 - DNA, 25 bp, Mus musculus
ctaaacttatctatagctagatctt

SEQ ID NO: 2994 - DNA, 25 bp, Mus musculus
acttatctatagctagatcttcatg

SEQ ID NO: 2995 - DNA, 25 bp, Mus musculus
atctatagctagatcttcatgagtg

SEQ ID NO: 2996 - DNA, 25 bp, Mus musculus
ctatagctagatcttcatgagtgct

SEQ ID NO: 2997 - DNA, 25 bp, Mus musculus
agatcttcatgagtgctggtgtttt

SEQ ID NO: 2998 - DNA, 25 bp, Mus musculus
atcttcatgagtgctggtgttttcg

SEQ ID NO: 2999 - DNA, 25 bp, Mus musculus
gactctattcaggtcatacaccaca

SEQ ID NO: 3000 - DNA, 25 bp, Mus musculus
ctctattcaggtcatacaccacacc

SEQ ID NO: 3001 - DNA, 25 bp, Mus musculus
tgcatcctcgagggaaccacaaccc

SEQ ID NO: 3002 - DNA, 25 bp, Mus musculus
tcccactttggggtcaccattgcct

SEQ ID NO: 3003 - DNA, 25 bp, Mus musculus
actgacttcagtgctgggcagcggc

SEQ ID NO: 3004 - DNA, 25 bp, Mus musculus
gacttcagtgctgggcagcggccct

SEQ ID NO: 3005 - DNA, 25 bp, Mus musculus
cggccctcggagctggtcttcactt

SEQ ID NO: 3006 - DNA, 25 bp, Mus musculus
ccctcggagctggtcttcactttgg

SEQ ID NO: 3007 - DNA, 25 bp, Mus musculus
ctggtcttcactttggcccctcttg

SEQ ID NO: 3008 - DNA, 25 bp, Mus musculus
gcccctcttggggtcctcactgtca

SEQ ID NO: 3009 - DNA, 25 bp, Mus musculus
cctcttggggtcctcactgtcactc

SEQ ID NO: 3010 - DNA, 25 bp, Mus musculus
gtcactccgggctcgctcaacatca

SEQ ID NO: 3011 - DNA, 25 bp, Mus musculus
tcgctcaacatcagccaccgataca

SEQ ID NO: 3012 - DNA, 25 bp, Mus musculus
aacatcagccaccgatacacaccat

SEQ ID NO: 3013 - DNA, 25 bp, Mus musculus
cactttggggtcaccattgcctgtc

SEQ ID NO: 3014 - DNA, 25 bp, Mus musculus
gtcaccattgcctgtcgggtgctat

SEQ ID NO: 3015 - DNA, 25 bp, Mus musculus
accattgcctgtcgggtgctatagt

SEQ ID NO: 3016 - DNA, 25 bp, Mus musculus
attgcctgtcgggtgctatagtgtc

SEQ ID NO: 3017 - DNA, 25 bp, Mus musculus
tagtgtcaccctagttcaacaaagt

SEQ ID NO: 3018 - DNA, 25 bp, Mus musculus
tgtcaccctagttcaacaaagtagc

SEQ ID NO: 3019 - DNA, 25 bp, Mus musculus
caccctagttcaacaaagtagcagg

SEQ ID NO: 3020 - DNA, 25 bp, Mus musculus
gatactgacttcagtgctgggcagc

SEQ ID NO: 3021 - DNA, 25 bp, Mus musculus
gcccagcaactctggagtctatggt

SEQ ID NO: 3022 - DNA, 25 bp, Mus musculus
ccagcaactctggagtctatggtat

SEQ ID NO: 3023 - DNA, 25 bp, Mus musculus
acactaattccagacatgctctgta

SEQ ID NO: 3024 - DNA, 25 bp, Mus musculus
actaattccagacatgctctgtagg

SEQ ID NO: 3025 - DNA, 25 bp, Mus musculus
ctaattccagacatgctctgtaggg

SEQ ID NO: 3026 - DNA, 25 bp, Mus musculus
aattccagacatgctctgtagggca

SEQ ID NO: 3027 - DNA, 25 bp, Mus musculus
attccagacatgctctgtagggcag

SEQ ID NO: 3028 - DNA, 25 bp, Mus musculus
tccagacatgctctgtagggcagtt

SEQ ID NO: 3029 - DNA, 25 bp, Mus musculus
ccagacatgctctgtagggcagttt

SEQ ID NO: 3030 - DNA, 25 bp, Mus musculus
tagggcagtttcctgccatgtataa

SEQ ID NO: 3031 - DNA, 25 bp, Mus musculus
agggcagtttcctgccatgtataat

SEQ ID NO: 3032 - DNA, 25 bp, Mus musculus
ggcagtttcctgccatgtataataa

SEQ ID NO: 3033 - DNA, 25 bp, Mus musculus
cagcaactctggagtctatggtatt

SEQ ID NO: 3034 - DNA, 25 bp, Mus musculus
gcaactctggagtctatggtattct

SEQ ID NO: 3035 - DNA, 25 bp, Mus musculus
caactctggagtctatggtattctt

SEQ ID NO: 3036 - DNA, 25 bp, Mus musculus
ccagctctgtgctgtggtacgagac

SEQ ID NO: 3037 - DNA, 25 bp, Mus musculus
agctctgtgctgtggtacgagacca

SEQ ID NO: 3038 - DNA, 25 bp, Mus musculus
gctctgtgctgtggtacgagaccaa

SEQ ID NO: 3039 - DNA, 25 bp, Mus musculus
aggacactaattccagacatgctct

SEQ ID NO: 3040 - DNA, 25 bp, Mus musculus
gacactaattccagacatgctctgt

SEQ ID NO: 3041 - DNA, 25 bp, Mus musculus
acgagcaaggctcgccgctcagcgc

SEQ ID NO: 3042 - DNA, 25 bp, Mus musculus
gagcaaggctcgccgctcagcgccg

SEQ ID NO: 3043 - DNA, 25 bp, Mus musculus
gtccgcatccagaggaacaaggccg

SEQ ID NO: 3044 - DNA, 25 bp, Mus musculus
ccgcatccagaggaacaaggccgcg

SEQ ID NO: 3045 - DNA, 25 bp, Mus musculus
gcttcggcgagagctggaagcagca

SEQ ID NO: 3046 - DNA, 25 bp, Mus musculus
cttcggcgagagctggaagcagcag

SEQ ID NO: 3047 - DNA, 25 bp, Mus musculus
ggaagccgtacttcgtcaagctaat

SEQ ID NO: 3048 - DNA, 25 bp, Mus musculus
gaagccgtacttcgtcaagctaatg

SEQ ID NO: 3049 - DNA, 25 bp, Mus musculus
aagccgtacttcgtcaagctaatgg

SEQ ID NO: 3050 - DNA, 25 bp, Mus musculus
agccgtacttcgtcaagctaatggg

SEQ ID NO: 3051 - DNA, 25 bp, Mus musculus
gccgtacttcgtcaagctaatggga

SEQ ID NO: 3052 - DNA, 25 bp, Mus musculus
ccgtacttcgtcaagctaatgggat

SEQ ID NO: 3053 - DNA, 25 bp, Mus musculus
tcagcgccgagcagctcgtccgcat

SEQ ID NO: 3054 - DNA, 25 bp, Mus musculus
cgtacttcgtcaagctaatgggatt

SEQ ID NO: 3055 - DNA, 25 bp, Mus musculus
gagcagctcgtccgcatccagagga

SEQ ID NO: 3056 - DNA, 25 bp, Mus musculus
agcagctcgtccgcatccagaggaa

SEQ ID NO: 3057 - DNA, 25 bp, Mus musculus
cagctcgtccgcatccagaggaaca

SEQ ID NO: 3058 - DNA, 25 bp, Mus musculus
agctcgtccgcatccagaggaacaa

SEQ ID NO: 3059 - DNA, 25 bp, Mus musculus
ctcgtccgcatccagaggaacaagg

SEQ ID NO: 3060 - DNA, 25 bp, Mus musculus
tcgtccgcatccagaggaacaaggc

SEQ ID NO: 3061 - DNA, 25 bp, Mus musculus
cgtccgcatccagaggaacaaggcc

SEQ ID NO: 3062 - DNA, 25 bp, Mus musculus
cattgactccagcattggagagttt

SEQ ID NO: 3063 - DNA, 25 bp, Mus musculus
gatcatcaatctctgggcactgcat

SEQ ID NO: 3064 - DNA, 25 bp, Mus musculus
ggccttgctgctgcagaggtttgac

SEQ ID NO: 3065 - DNA, 25 bp, Mus musculus
caaacagctgccctgtctggtgggt

SEQ ID NO: 3066 - DNA, 25 bp, Mus musculus
tctgatcgaccctttcaaagtgaaa

SEQ ID NO: 3067 - DNA, 25 bp, Mus musculus
aatcacagtgcgacaagcatggaag

SEQ ID NO: 3068 - DNA, 25 bp, Mus musculus
tagcacctagaggccgaatctaacg

SEQ ID NO: 3069 - DNA, 25 bp, Mus musculus
gccgaatctaacgtccggatcccat

SEQ ID NO: 3070 - DNA, 25 bp, Mus musculus
tctaacgtccggatcccatgccttg

SEQ ID NO: 3071 - DNA, 25 bp, Mus musculus
ccaatcttagaggtgcctccaacaa

SEQ ID NO: 3072 - DNA, 25 bp, Mus musculus
ttagaggtgcctccaacaatcctcc

SEQ ID NO: 3073 - DNA, 25 bp, Mus musculus
tctacttggcagcaatgaagggtga

SEQ ID NO: 3074 - DNA, 25 bp, Mus musculus
caatctctgggcactgcatcacgat

SEQ ID NO: 3075 - DNA, 25 bp, Mus musculus
ggaccagccagatcggtttatgcct

SEQ ID NO: 3076 - DNA, 25 bp, Mus musculus
tatgcctgagcgcttcttagatcca

SEQ ID NO: 3077 - DNA, 25 bp, Mus musculus
tgagcgcttcttagatccaacagga

SEQ ID NO: 3078 - DNA, 25 bp, Mus musculus
aacaggaagccatctcattacaccc

SEQ ID NO: 3079 - DNA, 25 bp, Mus musculus
cttcggagctggtccccgatcgtgc

SEQ ID NO: 3080 - DNA, 25 bp, Mus musculus
agctggtccccgatcgtgcattgga

SEQ ID NO: 3081 - DNA, 25 bp, Mus musculus
ggagctctttatcttcatggccttg

SEQ ID NO: 3082 - DNA, 25 bp, Mus musculus
ttttcagggccaccatggcaagaag

SEQ ID NO: 3083 - DNA, 25 bp, Mus musculus
ttcagggccaccatggcaagaagta

SEQ ID NO: 3084 - DNA, 25 bp, Mus musculus
agaagtccgatctttctggtcggag

SEQ ID NO: 3085 - DNA, 25 bp, Mus musculus
tctttctggtcggaggaagaaatct

SEQ ID NO: 3086 - DNA, 25 bp, Mus musculus
gaaatctctagttggcttcggtctc

SEQ ID NO: 3087 - DNA, 25 bp, Mus musculus
aatctctagttggcttcggtctcca

SEQ ID NO: 3088 - DNA, 25 bp, Mus musculus
tctagttggcttcggtctccacgag

SEQ ID NO: 3089 - DNA, 25 bp, Mus musculus
tagttggcttcggtctccacgagag

SEQ ID NO: 3090 - DNA, 25 bp, Mus musculus
tggcttcggtctccacgagaggaag

SEQ ID NO: 3091 - DNA, 25 bp, Mus musculus
ttcggtctccacgagaggaagcctg

SEQ ID NO: 3092 - DNA, 25 bp, Mus musculus
cggtctccacgagaggaagcctgaa

SEQ ID NO: 3093 - DNA, 25 bp, Mus musculus
gaatggccagctccagttctcaaca

SEQ ID NO: 3094 - DNA, 25 bp, Mus musculus
cagggccaccatggcaagaagtagt

SEQ ID NO: 3095 - DNA, 25 bp, Mus musculus
gccaccatggcaagaagtagtggat

SEQ ID NO: 3096 - DNA, 25 bp, Mus musculus
gataggctctgggtgtcctggtgcc

SEQ ID NO: 3097 - DNA, 25 bp, Mus musculus
gtgtcctggtgccgctaatgcgaga

SEQ ID NO: 3098 - DNA, 25 bp, Mus musculus
gtcctggtgccgctaatgcgagaag

SEQ ID NO: 3099 - DNA, 25 bp, Mus musculus
tggtgccgctaatgcgagaagtccg

SEQ ID NO: 3100 - DNA, 25 bp, Mus musculus
gtgccgctaatgcgagaagtccgat

SEQ ID NO: 3101 - DNA, 25 bp, Mus musculus
cgagaagtccgatctttctggtcgg

SEQ ID NO: 3102 - DNA, 25 bp, Mus musculus
atcgcctgtatacactgctgaccgt

SEQ ID NO: 3103 - DNA, 25 bp, Mus musculus
cgcctgtatacactgctgaccgtcg

SEQ ID NO: 3104 - DNA, 25 bp, Mus musculus
tgaccgtcgcactgcagtccggcta

SEQ ID NO: 3105 - DNA, 25 bp, Mus musculus
accgtcgcactgcagtccggctact

SEQ ID NO: 3106 - DNA, 25 bp, Mus musculus
ccgtcgcactgcagtccggctactg

SEQ ID NO: 3107 - DNA, 25 bp, Mus musculus
gtcgcactgcagtccggctactgtc

SEQ ID NO: 3108 - DNA, 25 bp, Mus musculus
tcgcactgcagtccggctactgtct

SEQ ID NO: 3109 - DNA, 25 bp, Mus musculus
aaggcggacttccaaggcatctctc

SEQ ID NO: 3110 - DNA, 25 bp, Mus musculus
tccaaggcatctctccggagcgaag

SEQ ID NO: 3111 - DNA, 25 bp, Mus musculus
tctccggagcgaagctatgctgacg

SEQ ID NO: 3112 - DNA, 25 bp, Mus musculus
cgaagctatgctgacgtcatctgtg

SEQ ID NO: 3113 - DNA, 25 bp, Mus musculus
agctatgctgacgtcatctgtgcca

SEQ ID NO: 3114 - DNA, 25 bp, Mus musculus
gcctgtatacactgctgaccgtcgc

SEQ ID NO: 3115 - DNA, 25 bp, Mus musculus
gctatgctgacgtcatctgtgccaa

SEQ ID NO: 3116 - DNA, 25 bp, Mus musculus
tgtatacactgctgaccgtcgcact

SEQ ID NO: 3117 - DNA, 25 bp, Mus musculus
tatacactgctgaccgtcgcactgc

SEQ ID NO: 3118 - DNA, 25 bp, Mus musculus
atacactgctgaccgtcgcactgca

SEQ ID NO: 3119 - DNA, 25 bp, Mus musculus
acactgctgaccgtcgcactgcagt

SEQ ID NO: 3120 - DNA, 25 bp, Mus musculus
ctgctgaccgtcgcactgcagtccg

SEQ ID NO: 3121 - DNA, 25 bp, Mus musculus
tgctgaccgtcgcactgcagtccgg

SEQ ID NO: 3122 - DNA, 25 bp, Mus musculus
ctgaccgtcgcactgcagtccggct

SEQ ID NO: 3123 - DNA, 25 bp, Mus musculus
ttaaaggatgcccatgctacagagg

SEQ ID NO: 3124 - DNA, 25 bp, Mus musculus
gatgcccatgctacagaggagtctg

SEQ ID NO: 3125 - DNA, 25 bp, Mus musculus
ctggcccagcgaaattctatccagc

SEQ ID NO: 3126 - DNA, 25 bp, Mus musculus
aattctatccagccagttgttggac

SEQ ID NO: 3127 - DNA, 25 bp, Mus musculus
gttggaccctggcacctacaatgaa

SEQ ID NO: 3128 - DNA, 25 bp, Mus musculus
ccctggcacctacaatgaaatctca

SEQ ID NO: 3129 - DNA, 25 bp, Mus musculus
cacctacaatgaaatctcaccctac

SEQ ID NO: 3130 - DNA, 25 bp, Mus musculus
tctatcttgggccctcatagggtcc

SEQ ID NO: 3131 - DNA, 25 bp, Mus musculus
ttgggccctcatagggtccatatcc

SEQ ID NO: 3132 - DNA, 25 bp, Mus musculus
cctcatagggtccatatcctccagg

SEQ ID NO: 3133 - DNA, 25 bp, Mus musculus
ctttccttccattctgcaaagcctg

SEQ ID NO: 3134 - DNA, 25 bp, Mus musculus
ttccattctgcaaagcctgtctgca

SEQ ID NO: 3135 - DNA, 25 bp, Mus musculus
tccagctacctgaagaccaagaagg

SEQ ID NO: 3136 - DNA, 25 bp, Mus musculus
tacctgaagaccaagaagggccagt

SEQ ID NO: 3137 - DNA, 25 bp, Mus musculus
tccttgctgtcttatgacttcaggg

SEQ ID NO: 3138 - DNA, 25 bp, Mus musculus
ctgtcttatgacttcagggctgaga

SEQ ID NO: 3139 - DNA, 25 bp, Mus musculus
tatgacttcagggctgagacacaat

SEQ ID NO: 3140 - DNA, 25 bp, Mus musculus
tttttaccttgtagctagggctcag

SEQ ID NO: 3141 - DNA, 25 bp, Mus musculus
tctctgagtagtggttcctggccca

SEQ ID NO: 3142 - DNA, 25 bp, Mus musculus
tctctgctggcccagcgaaattcta

SEQ ID NO: 3143 - DNA, 25 bp, Mus musculus
cataatttccgaaatcccagtgtgc

SEQ ID NO: 3144 - DNA, 25 bp, Mus musculus
aatttccgaaatcccagtgtgctgt

SEQ ID NO: 3145 - DNA, 25 bp, Mus musculus
ttcttgctgccctgacctgccatag

SEQ ID NO: 3146 - DNA, 25 bp, Mus musculus
ccctgacctgccatagtcactctga

SEQ ID NO: 3147 - DNA, 25 bp, Mus musculus
tgacctgccatagtcactctgatac

SEQ ID NO: 3148 - DNA, 25 bp, Mus musculus
cctgccatagtcactctgataccct

SEQ ID NO: 3149 - DNA, 25 bp, Mus musculus
gccatagtcactctgataccctgag

SEQ ID NO: 3150 - DNA, 25 bp, Mus musculus
atagtcactctgataccctgagccc

SEQ ID NO: 3151 - DNA, 25 bp, Mus musculus
gtcactctgataccctgagccccaa

SEQ ID NO: 3152 - DNA, 25 bp, Mus musculus
actctgataccctgagccccaagtc

SEQ ID NO: 3153 - DNA, 25 bp, Mus musculus
ctcctgctgttcttggcttccacaa

SEQ ID NO: 3154 - DNA, 25 bp, Mus musculus
ctgctgttcttggcttccacaaccc

SEQ ID NO: 3155 - DNA, 25 bp, Mus musculus
ttccgaaatcccagtgtgctgtgat

SEQ ID NO: 3156 - DNA, 25 bp, Mus musculus
cgaaatcccagtgtgctgtgatccc

SEQ ID NO: 3157 - DNA, 25 bp, Mus musculus
aatcccagtgtgctgtgatcccctt

SEQ ID NO: 3158 - DNA, 25 bp, Mus musculus
tgcctgaacgcgggaacatctcatt

SEQ ID NO: 3159 - DNA, 25 bp, Mus musculus
ggaacatctcattctcctggagcct

SEQ ID NO: 3160 - DNA, 25 bp, Mus musculus
acatctcattctcctggagcctctt

SEQ ID NO: 3161 - DNA, 25 bp, Mus musculus
tctcattctcctggagcctctttct

SEQ ID NO: 3162 - DNA, 25 bp, Mus musculus
cattctcctggagcctctttcttgc

SEQ ID NO: 3163 - DNA, 25 bp, Mus musculus
ccaacaagcaactcaaagctacggg

SEQ ID NO: 3164 - DNA, 25 bp, Mus musculus
agcaactcaaagctacggggcctat

SEQ ID NO: 3165 - DNA, 25 bp, Mus musculus
cagtcagctgacacttcaggatacg

SEQ ID NO: 3166 - DNA, 25 bp, Mus musculus
tcagctgacacttcaggatacggcc

SEQ ID NO: 3167 - DNA, 25 bp, Mus musculus
gctgacacttcaggatacggccaga

SEQ ID NO: 3168 - DNA, 25 bp, Mus musculus
tcaggatacggccagagcagctatg

SEQ ID NO: 3169 - DNA, 25 bp, Mus musculus
ggatacggccagagcagctatggtt

SEQ ID NO: 3170 - DNA, 25 bp, Mus musculus
tacggccagagcagctatggttctt

SEQ ID NO: 3171 - DNA, 25 bp, Mus musculus
agctatggttcttcttatggacaga

SEQ ID NO: 3172 - DNA, 25 bp, Mus musculus
tatggttcttcttatggacagaccc

SEQ ID NO: 3173 - DNA, 25 bp, Mus musculus
tcttcttatggacagacccaaaact

SEQ ID NO: 3174 - DNA, 25 bp, Mus musculus
tcttatggacagacccaaaactaat

SEQ ID NO: 3175 - DNA, 25 bp, Mus musculus
gggctactcccaacagagcagtcag

SEQ ID NO: 3176 - DNA, 25 bp, Mus musculus
ctcccaacagagcagtcagccctat

SEQ ID NO: 3177 - DNA, 25 bp, Mus musculus
ccaacagagcagtcagccctatggc

SEQ ID NO: 3178 - DNA, 25 bp, Mus musculus
acagagcagtcagccctatggcaac

SEQ ID NO: 3179 - DNA, 25 bp, Mus musculus
gagcagtcagccctatggcaacaga

SEQ ID NO: 3180 - DNA, 25 bp, Mus musculus
cagtcagccctatggcaacagagtt

SEQ ID NO: 3181 - DNA, 25 bp, Mus musculus
tcagccctatggcaacagagttaca

SEQ ID NO: 3182 - DNA, 25 bp, Mus musculus
ggccagtcagctgacacttcaggat

SEQ ID NO: 3183 - DNA, 25 bp, Mus musculus
gccatctgcctgagcaaatgatgct

SEQ ID NO: 3184 - DNA, 25 bp, Mus musculus
gccagacttaagtctcttcttccac

SEQ ID NO: 3185 - DNA, 25 bp, Mus musculus
atgatcgctttgttcctggaggaca

SEQ ID NO: 3186 - DNA, 25 bp, Mus musculus
tggccagagtctttttctagttagt

SEQ ID NO: 3187 - DNA, 25 bp, Mus musculus
ttagctgctgggagccatgtctgac

SEQ ID NO: 3188 - DNA, 25 bp, Mus musculus
agccatgtctgacctgctggtgcct

SEQ ID NO: 3189 - DNA, 25 bp, Mus musculus
gtctgacctgctggtgcctagggcc

SEQ ID NO: 3190 - DNA, 25 bp, Mus musculus
ggtgcctagggcctgcttagccctt

SEQ ID NO: 3191 - DNA, 25 bp, Mus musculus
ctgcttagcccttggtgaggctgag

SEQ ID NO: 3192 - DNA, 25 bp, Mus musculus
agcccttggtgaggctgagagtcga

SEQ ID NO: 3193 - DNA, 25 bp, Mus musculus
acttgaggctttctaacttgcatat

SEQ ID NO: 3194 - DNA, 25 bp, Mus musculus
ctaacttgcatattcaaatagcgac

SEQ ID NO: 3195 - DNA, 25 bp, Mus musculus
tctcttcttccacagtgtgcagtga

SEQ ID NO: 3196 - DNA, 25 bp, Mus musculus
atttaatgccaacagttctaactgg

SEQ ID NO: 3197 - DNA, 25 bp, Mus musculus
gatctcacaaactaagtatgaacat

SEQ ID NO: 3198 - DNA, 25 bp, Mus musculus
tgaacattctaactcaggaccgaga

SEQ ID NO: 3199 - DNA, 25 bp, Mus musculus
aatcaaaattctgctcggcagactt

SEQ ID NO: 3200 - DNA, 25 bp, Mus musculus
aattctgctcggcagacttctcctt

SEQ ID NO: 3201 - DNA, 25 bp, Mus musculus
gctcggcagacttctcctttcagga

SEQ ID NO: 3202 - DNA, 25 bp, Mus musculus
cagacttctcctttcaggatgatcg

SEQ ID NO: 3203 - DNA, 25 bp, Mus musculus
tatgcccatttcctcaattgttaat

SEQ ID NO: 3204 - DNA, 25 bp, Mus musculus
catttcctcaattgttaattgctgg

SEQ ID NO: 3205 - DNA, 25 bp, Mus musculus
caaagccaactggatgaggaaggac

SEQ ID NO: 3206 - DNA, 25 bp, Mus musculus
gaaggactctggcttttggcataaa

SEQ ID NO: 3207 - DNA, 25 bp, Mus musculus
aggtcctgcagacagacagacagac

SEQ ID NO: 3208 - DNA, 25 bp, Mus musculus
agctgggctacctgagagactgtcc

SEQ ID NO: 3209 - DNA, 25 bp, Mus musculus
gctacctgagagactgtcccagaaa

SEQ ID NO: 3210 - DNA, 25 bp, Mus musculus
ccaacaaccttccttatgctatata

SEQ ID NO: 3211 - DNA, 25 bp, Mus musculus
accttccttatgctatatagatgtc

SEQ ID NO: 3212 - DNA, 25 bp, Mus musculus
agatgtctcagtgtctttatcatta

SEQ ID NO: 3213 - DNA, 25 bp, Mus musculus
gtctttatcattaaacaccaagcag

SEQ ID NO: 3214 - DNA, 25 bp, Mus musculus
atcattaaacaccaagcaggactgc

SEQ ID NO: 3215 - DNA, 25 bp, Mus musculus
ttgctgggcctgtggctggctagct

SEQ ID NO: 3216 - DNA, 25 bp, Mus musculus
tcattaaacaccaagcaggactgct

SEQ ID NO: 3217 - DNA, 25 bp, Mus musculus
tggctggctagctagccaaatatgt

SEQ ID NO: 3218 - DNA, 25 bp, Mus musculus
taaatgcttgtttctcgtctgccca

SEQ ID NO: 3219 - DNA, 25 bp, Mus musculus
cttgtttctcgtctgcccaaagaga

SEQ ID NO: 3220 - DNA, 25 bp, Mus musculus
tctcgtctgcccaaagagaaaggca

SEQ ID NO: 3221 - DNA, 25 bp, Mus musculus
aaaggcaggctcctgtgtgggaagt

SEQ ID NO: 3222 - DNA, 25 bp, Mus musculus
aggctcctgtgtgggaagtcacaga

SEQ ID NO: 3223 - DNA, 25 bp, Mus musculus
agcccccaaagccaactggatgagg

SEQ ID NO: 3224 - DNA, 25 bp, Mus musculus
cggctgtctgcacatgggactagag

SEQ ID NO: 3225 - DNA, 25 bp, Mus musculus
tctgcacatgggactagagctttct

SEQ ID NO: 3226 - DNA, 25 bp, Mus musculus
acccagacacatcacactgtggatt

SEQ ID NO: 3227 - DNA, 25 bp, Mus musculus
acacatcacactgtggattatttcc

SEQ ID NO: 3228 - DNA, 25 bp, Mus musculus
catcacactgtggattatttccttt

SEQ ID NO: 3229 - DNA, 25 bp, Mus musculus
tatcagagagccgcgtctgctcacg

SEQ ID NO: 3230 - DNA, 25 bp, Mus musculus
gcgtctgctcacgcaggacactttg

SEQ ID NO: 3231 - DNA, 25 bp, Mus musculus
tctgctcacgcaggacactttgaga

SEQ ID NO: 3232 - DNA, 25 bp, Mus musculus
acattgatgcagtctgttcggagga

SEQ ID NO: 3233 - DNA, 25 bp, Mus musculus
taaacttatcaagtcagcaaccaac

SEQ ID NO: 3234 - DNA, 25 bp, Mus musculus
acttatcaagtcagcaaccaacaac

SEQ ID NO: 3235 - DNA, 25 bp, Mus musculus
tatcaagtcagcaaccaacaaccca

SEQ ID NO: 3236 - DNA, 25 bp, Mus musculus
acacgcagcctcggactgttggatg

SEQ ID NO: 3237 - DNA, 25 bp, Mus musculus
aaatgcaaaaatctctccgtgcagg

SEQ ID NO: 3238 - DNA, 25 bp, Mus musculus
ctctccgtgcagggacaaagaggcc

SEQ ID NO: 3239 - DNA, 25 bp, Mus musculus
caaagaggcctttaaccatggtgct

SEQ ID NO: 3240 - DNA, 25 bp, Mus musculus
agaggcctttaaccatggtgcttgt

SEQ ID NO: 3241 - DNA, 25 bp, Mus musculus
gaagctttaccagctacaagttggg

SEQ ID NO: 3242 - DNA, 25 bp, Mus musculus
tggtccagcctggtgtagcctgggt

SEQ ID NO: 3243 - DNA, 25 bp, Mus musculus
tggtgaacccagacacatcacactg

SEQ ID NO: 3244 - DNA, 25 bp, Mus musculus
tcagagctgcactggtgactcactt

SEQ ID NO: 3245 - DNA, 25 bp, Mus musculus
gagctgcactggtgactcacttcaa

SEQ ID NO: 3246 - DNA, 25 bp, Mus musculus
ctagcaggccactctgcatctgtta

SEQ ID NO: 3247 - DNA, 25 bp, Mus musculus
cactctgcatctgttatgtctccac

SEQ ID NO: 3248 - DNA, 25 bp, Mus musculus
tctgcatctgttatgtctccaccgg

SEQ ID NO: 3249 - DNA, 25 bp, Mus musculus
gcatctgttatgtctccaccggaaa

SEQ ID NO: 3250 - DNA, 25 bp, Mus musculus
cttttcattatgcactggacagcca

SEQ ID NO: 3251 - DNA, 25 bp, Mus musculus
atgcactggacagccacacaccgtg

SEQ ID NO: 3252 - DNA, 25 bp, Mus musculus
cactggacagccacacaccgtgtac

SEQ ID NO: 3253 - DNA, 25 bp, Mus musculus
gccacacaccgtgtaccatagggcc

SEQ ID NO: 3254 - DNA, 25 bp, Mus musculus
tagggccccaaatgtggggtcacat

SEQ ID NO: 3255 - DNA, 25 bp, Mus musculus
tgtggggtcacatggtcttgaattt

SEQ ID NO: 3256 - DNA, 25 bp, Mus musculus
cactggtgactcacttcaatgtgtc

SEQ ID NO: 3257 - DNA, 25 bp, Mus musculus
tgactcacttcaatgtgtcatttcc

SEQ ID NO: 3258 - DNA, 25 bp, Mus musculus
acttcaatgtgtcatttccggctgc

SEQ ID NO: 3259 - DNA, 25 bp, Mus musculus
tcaatgtgtcatttccggctgctgt

SEQ ID NO: 3260 - DNA, 25 bp, Mus musculus
cggctgctgtatgtgagcagtggac

SEQ ID NO: 3261 - DNA, 25 bp, Mus musculus
gacagcagctcctggtcaaccacct

SEQ ID NO: 3262 - DNA, 25 bp, Mus musculus
agcagctcctggtcaaccaccttag

SEQ ID NO: 3263 - DNA, 25 bp, Mus musculus
tggtcaaccaccttagttagataat

SEQ ID NO: 3264 - DNA, 25 bp, Mus musculus
gatgtggtcacgacggaatggcata

SEQ ID NO: 3265 - DNA, 25 bp, Mus musculus
tgtggtcacgacggaatggcatatc

SEQ ID NO: 3266 - DNA, 25 bp, Mus musculus
accagacagatgcgctcagctgatg

SEQ ID NO: 3267 - DNA, 25 bp, Mus musculus
ccagacagatgcgctcagctgatga

SEQ ID NO: 3268 - DNA, 25 bp, Mus musculus
agacagatgcgctcagctgatgaag

SEQ ID NO: 3269 - DNA, 25 bp, Mus musculus
cagatgcgctcagctgatgaaggac

SEQ ID NO: 3270 - DNA, 25 bp, Mus musculus
agatgcgctcagctgatgaaggaca

SEQ ID NO: 3271 - DNA, 25 bp, Mus musculus
acggtcttctatacctgtatcaact

SEQ ID NO: 3272 - DNA, 25 bp, Mus musculus
cggtcttctatacctgtatcaactg

SEQ ID NO: 3273 - DNA, 25 bp, Mus musculus
gtcttctatacctgtatcaactgca

SEQ ID NO: 3274 - DNA, 25 bp, Mus musculus
tcttctatacctgtatcaactgcaa

SEQ ID NO: 3275 - DNA, 25 bp, Mus musculus
tctatacctgtatcaactgcaagtt

SEQ ID NO: 3276 - DNA, 25 bp, Mus musculus
gaatggcatatcacaccagacagat

SEQ ID NO: 3277 - DNA, 25 bp, Mus musculus
ctatacctgtatcaactgcaagttt

SEQ ID NO: 3278 - DNA, 25 bp, Mus musculus
atggcatatcacaccagacagatgc

SEQ ID NO: 3279 - DNA, 25 bp, Mus musculus
tggcatatcacaccagacagatgcg

SEQ ID NO: 3280 - DNA, 25 bp, Mus musculus
gcatatcacaccagacagatgcgct

SEQ ID NO: 3281 - DNA, 25 bp, Mus musculus
catatcacaccagacagatgcgctc

SEQ ID NO: 3282 - DNA, 25 bp, Mus musculus
tatcacaccagacagatgcgctcag

SEQ ID NO: 3283 - DNA, 25 bp, Mus musculus
atcacaccagacagatgcgctcagc

SEQ ID NO: 3284 - DNA, 25 bp, Mus musculus
acaccagacagatgcgctcagctga

SEQ ID NO: 3285 - DNA, 25 bp, Mus musculus
caacttccttggattgctgccccta

SEQ ID NO: 3286 - DNA, 25 bp, Mus musculus
agtgactaggctggctttgtttcta

SEQ ID NO: 3287 - DNA, 25 bp, Mus musculus
agagccatcagcatggtttcgggtg

SEQ ID NO: 3288 - DNA, 25 bp, Mus musculus
atcagcatggtttcgggtgtttggg

SEQ ID NO: 3289 - DNA, 25 bp, Mus musculus
gaaggcttcttctggagctaggcaa

SEQ ID NO: 3290 - DNA, 25 bp, Mus musculus
ttcttctggagctaggcaagagggc

SEQ ID NO: 3291 - DNA, 25 bp, Mus musculus
ttcaagttaaggcgcactggtggtg

SEQ ID NO: 3292 - DNA, 25 bp, Mus musculus
gtctgacttcacctgttaaacatgg

SEQ ID NO: 3293 - DNA, 25 bp, Mus musculus
cttcacctgttaaacatggctgcct

SEQ ID NO: 3294 - DNA, 25 bp, Mus musculus
ctgttaaacatggctgcctttgaat

SEQ ID NO: 3295 - DNA, 25 bp, Mus musculus
aacatggctgcctttgaataaagga

SEQ ID NO: 3296 - DNA, 25 bp, Mus musculus
aaagtctgaaactcgccagcttggt

SEQ ID NO: 3297 - DNA, 25 bp, Mus musculus
atgtcacccaaaagaagacaggaca

SEQ ID NO: 3298 - DNA, 25 bp, Mus musculus
aagactaggcttatctctcagccag

SEQ ID NO: 3299 - DNA, 25 bp, Mus musculus
aggcttatctctcagccagatatgc

SEQ ID NO: 3300 - DNA, 25 bp, Mus musculus
cagccagatatgcccaacactcctt

SEQ ID NO: 3301 - DNA, 25 bp, Mus musculus
gatatgcccaacactccttaatgta

SEQ ID NO: 3302 - DNA, 25 bp, Mus musculus
actccttaatgtacctccagagcca

SEQ ID NO: 3303 - DNA, 25 bp, Mus musculus
taatgtacctccagagccatcagca

SEQ ID NO: 3304 - DNA, 25 bp, Mus musculus
acctccagagccatcagcatggttt

SEQ ID NO: 3305 - DNA, 25 bp, Mus musculus
ccgtatccactttaactgagtgagc

SEQ ID NO: 3306 - DNA, 25 bp, Mus musculus
tatccactttaactgagtgagcaaa

SEQ ID NO: 3307 - DNA, 25 bp, Mus musculus
ggatgatctagctctgccaaggctc

SEQ ID NO: 3308 - DNA, 25 bp, Mus musculus
tgatctagctctgccaaggctctgc

SEQ ID NO: 3309 - DNA, 25 bp, Mus musculus
tctagctctgccaaggctctgcaga

SEQ ID NO: 3310 - DNA, 25 bp, Mus musculus
agctctgccaaggctctgcagacac

SEQ ID NO: 3311 - DNA, 25 bp, Mus musculus
tctgccaaggctctgcagacaccca

SEQ ID NO: 3312 - DNA, 25 bp, Mus musculus
ccctgttgcccaatctgtggccatt

SEQ ID NO: 3313 - DNA, 25 bp, Mus musculus
tgttgcccaatctgtggccattcac

SEQ ID NO: 3314 - DNA, 25 bp, Mus musculus
tgcccaatctgtggccattcacctg

SEQ ID NO: 3315 - DNA, 25 bp, Mus musculus
ggccattcacctgcctgaaccaatc

SEQ ID NO: 3316 - DNA, 25 bp, Mus musculus
ctaacacacggcttctgccaggagc

SEQ ID NO: 3317 - DNA, 25 bp, Mus musculus
tcttgggtccaaccacttcatttgc

SEQ ID NO: 3318 - DNA, 25 bp, Mus musculus
tgggtccaaccacttcatttgctgt

SEQ ID NO: 3319 - DNA, 25 bp, Mus musculus
gtccaaccacttcatttgctgtaca

SEQ ID NO: 3320 - DNA, 25 bp, Mus musculus
caaccacttcatttgctgtacagcc

SEQ ID NO: 3321 - DNA, 25 bp, Mus musculus
ccacttcatttgctgtacagcctta

SEQ ID NO: 3322 - DNA, 25 bp, Mus musculus
cttcatttgctgtacagccttacct

SEQ ID NO: 3323 - DNA, 25 bp, Mus musculus
ttgctgtacagccttacctttgggc

SEQ ID NO: 3324 - DNA, 25 bp, Mus musculus
aattttgtagtgcaggagggatgat

SEQ ID NO: 3325 - DNA, 25 bp, Mus musculus
aaagtggcctgcagactgtcctgaa

SEQ ID NO: 3326 - DNA, 25 bp, Mus musculus
agactgtcctgaactcatctctcaa

SEQ ID NO: 3327 - DNA, 25 bp, Mus musculus
acaagccactacggccgcttctggt

SEQ ID NO: 3328 - DNA, 25 bp, Mus musculus
ggcctcatccatcatcgatgcgggt

SEQ ID NO: 3329 - DNA, 25 bp, Mus musculus
atccatcatcgatgcgggtgcctgc

SEQ ID NO: 3330 - DNA, 25 bp, Mus musculus
catcgatgcgggtgcctgcagtttc

SEQ ID NO: 3331 - DNA, 25 bp, Mus musculus
cctcttctttgccaataccttaatg

SEQ ID NO: 3332 - DNA, 25 bp, Mus musculus
cttaatgtgcctcttctacctcagc

SEQ ID NO: 3333 - DNA, 25 bp, Mus musculus
tgaaggcgcagcttctgaagccccg

SEQ ID NO: 3334 - DNA, 25 bp, Mus musculus
ctgctgccaccatcagtagcgagag

SEQ ID NO: 3335 - DNA, 25 bp, Mus musculus
ccaccatcagtagcgagagacatcc

SEQ ID NO: 3336 - DNA, 25 bp, Mus musculus
cgtgacacccagctagggcacaata

SEQ ID NO: 3337 - DNA, 25 bp, Mus musculus
tcctgaactcatctctcaaagctgc

SEQ ID NO: 3338 - DNA, 25 bp, Mus musculus
ctctcaaagctgctccagagcccag

SEQ ID NO: 3339 - DNA, 25 bp, Mus musculus
aagctgctccagagcccaggaagat

SEQ ID NO: 3340 - DNA, 25 bp, Mus musculus
gatgaagagcttcctcctcttcctc

SEQ ID NO: 3341 - DNA, 25 bp, Mus musculus
cactatcattcttctggttgtgatt

SEQ ID NO: 3342 - DNA, 25 bp, Mus musculus
cattcttctggttgtgattcagata

SEQ ID NO: 3343 - DNA, 25 bp, Mus musculus
aggatccttgggacaagccactacg

SEQ ID NO: 3344 - DNA, 25 bp, Mus musculus
cttgggacaagccactacggccgct

SEQ ID NO: 3345 - DNA, 25 bp, Mus musculus
ggaagatatgcctcaccttggggcc

SEQ ID NO: 3346 - DNA, 25 bp, Mus musculus
gaagatatgcctcaccttggggcct

SEQ ID NO: 3347 - DNA, 25 bp, Mus musculus
gggcttcatctctttagagaaagtc

SEQ ID NO: 3348 - DNA, 25 bp, Mus musculus
cttcatctctttagagaaagtccat

SEQ ID NO: 3349 - DNA, 25 bp, Mus musculus
gaaagtccatgccaatctttgaatg

SEQ ID NO: 3350 - DNA, 25 bp, Mus musculus
agtccatgccaatctttgaatgtaa

SEQ ID NO: 3351 - DNA, 25 bp, Mus musculus
gtccatgccaatctttgaatgtaac

SEQ ID NO: 3352 - DNA, 25 bp, Mus musculus
ccatgccaatctttgaatgtaacca

SEQ ID NO: 3353 - DNA, 25 bp, Mus musculus
catgccaatctttgaatgtaaccaa

SEQ ID NO: 3354 - DNA, 25 bp, Mus musculus
tggttcttctgatagagttggggaa

SEQ ID NO: 3355 - DNA, 25 bp, Mus musculus
gttcttctgatagagttggggaaga

SEQ ID NO: 3356 - DNA, 25 bp, Mus musculus
ttcttctgatagagttggggaagat

SEQ ID NO: 3357 - DNA, 25 bp, Mus musculus
gatatgcctcaccttggggcctcca

SEQ ID NO: 3358 - DNA, 25 bp, Mus musculus
tatgcctcaccttggggcctccata

SEQ ID NO: 3359 - DNA, 25 bp, Mus musculus
atgcctcaccttggggcctccatat

SEQ ID NO: 3360 - DNA, 25 bp, Mus musculus
tcaccttggggcctccatatctgcc

SEQ ID NO: 3361 - DNA, 25 bp, Mus musculus
ccttggggcctccatatctgccttt

SEQ ID NO: 3362 - DNA, 25 bp, Mus musculus
ctccatatctgcctttccctcagta

SEQ ID NO: 3363 - DNA, 25 bp, Mus musculus
tccatatctgcctttccctcagtag

SEQ ID NO: 3364 - DNA, 25 bp, Mus musculus
catatctgcctttccctcagtagtt

SEQ ID NO: 3365 - DNA, 25 bp, Mus musculus
gcgtcaggccttgaacactgaccag

SEQ ID NO: 3366 - DNA, 25 bp, Mus musculus
ggccttgaacactgaccagagtctc

SEQ ID NO: 3367 - DNA, 25 bp, Mus musculus
gaagccaacatcgacaggataaagg

SEQ ID NO: 3368 - DNA, 25 bp, Mus musculus
gccaacatcgacaggataaaggtgt

SEQ ID NO: 3369 - DNA, 25 bp, Mus musculus
gctgctgacttgatggcctactgtg

SEQ ID NO: 3370 - DNA, 25 bp, Mus musculus
gctgacttgatggcctactgtgagg

SEQ ID NO: 3371 - DNA, 25 bp, Mus musculus
ttgatggcctactgtgaggcacatg

SEQ ID NO: 3372 - DNA, 25 bp, Mus musculus
gcctactgtgaggcacatgccacag

SEQ ID NO: 3373 - DNA, 25 bp, Mus musculus
gcacatgccacaggaagaccctctg

SEQ ID NO: 3374 - DNA, 25 bp, Mus musculus
gccacaggaagaccctctgctgacc

SEQ ID NO: 3375 - DNA, 25 bp, Mus musculus
gttcttctgcgccatcctttaagtc

SEQ ID NO: 3376 - DNA, 25 bp, Mus musculus
cttctgcgccatcctttaagtctct

SEQ ID NO: 3377 - DNA, 25 bp, Mus musculus
cttgaacactgaccagagtctctga

SEQ ID NO: 3378 - DNA, 25 bp, Mus musculus
gaacactgaccagagtctctgaaga

SEQ ID NO: 3379 - DNA, 25 bp, Mus musculus
atggccagcaacaacaccgccagca

SEQ ID NO: 3380 - DNA, 25 bp, Mus musculus
gccagcaacaacaccgccagcatag

SEQ ID NO: 3381 - DNA, 25 bp, Mus musculus
aacaccgccagcatagcacaagcca

SEQ ID NO: 3382 - DNA, 25 bp, Mus musculus
gccagcatagcacaagccaggaagc

SEQ ID NO: 3383 - DNA, 25 bp, Mus musculus
gcacaagccaggaagctggtagaac

SEQ ID NO: 3384 - DNA, 25 bp, Mus musculus
atggaagccaacatcgacaggataa

SEQ ID NO: 3385 - DNA, 25 bp, Mus musculus
cgcctcatggatctctctggtagtt

SEQ ID NO: 3386 - DNA, 25 bp, Mus musculus
cctcatggatctctctggtagttgg

SEQ ID NO: 3387 - DNA, 25 bp, Mus musculus
ttgtgaccattaatcatccaatgca

SEQ ID NO: 3388 - DNA, 25 bp, Mus musculus
gtgaccattaatcatccaatgcatc

SEQ ID NO: 3389 - DNA, 25 bp, Mus musculus
gaccattaatcatccaatgcatcag

SEQ ID NO: 3390 - DNA, 25 bp, Mus musculus
ccattaatcatccaatgcatcaggc

SEQ ID NO: 3391 - DNA, 25 bp, Mus musculus
attaatcatccaatgcatcaggctg

SEQ ID NO: 3392 - DNA, 25 bp, Mus musculus
taatcatccaatgcatcaggctgta

SEQ ID NO: 3393 - DNA, 25 bp, Mus musculus
atcatccaatgcatcaggctgtaat

SEQ ID NO: 3394 - DNA, 25 bp, Mus musculus
catccaatgcatcaggctgtaatgt

SEQ ID NO: 3395 - DNA, 25 bp, Mus musculus
tccaatgcatcaggctgtaatgtct

SEQ ID NO: 3396 - DNA, 25 bp, Mus musculus
caatgcatcaggctgtaatgtctcg

SEQ ID NO: 3397 - DNA, 25 bp, Mus musculus
tcatggatctctctggtagttggcg

SEQ ID NO: 3398 - DNA, 25 bp, Mus musculus
ggagtcatcgggacatcaagttcag

SEQ ID NO: 3399 - DNA, 25 bp, Mus musculus
agtcatcgggacatcaagttcagcc

SEQ ID NO: 3400 - DNA, 25 bp, Mus musculus
ggacatcaagttcagcctagggggt

SEQ ID NO: 3401 - DNA, 25 bp, Mus musculus
tgcagatatacatcacgacgtgagg

SEQ ID NO: 3402 - DNA, 25 bp, Mus musculus
cagatatacatcacgacgtgaggag

SEQ ID NO: 3403 - DNA, 25 bp, Mus musculus
gatatacatcacgacgtgaggagat

SEQ ID NO: 3404 - DNA, 25 bp, Mus musculus
tacatcacgacgtgaggagatcagt

SEQ ID NO: 3405 - DNA, 25 bp, Mus musculus
tgtacgcatgggaagcgggagtctt

SEQ ID NO: 3406 - DNA, 25 bp, Mus musculus
gagtcttcatgggtcgaggagttgc

SEQ ID NO: 3407 - DNA, 25 bp, Mus musculus
cctggctgggttgtgtgacgactca

SEQ ID NO: 3408 - DNA, 25 bp, Mus musculus
cgactcagcacatctgcagagtgtt

SEQ ID NO: 3409 - DNA, 25 bp, Mus musculus
agcacatctgcagagtgttcctgtc

SEQ ID NO: 3410 - DNA, 25 bp, Mus musculus
tcctgtcctgtgccatgcagacttc

SEQ ID NO: 3411 - DNA, 25 bp, Mus musculus
cctgtgccatgcagacttcctgtct

SEQ ID NO: 3412 - DNA, 25 bp, Mus musculus
ccatgcagacttcctgtctaagaat

SEQ ID NO: 3413 - DNA, 25 bp, Mus musculus
agacttcctgtctaagaattagatg

SEQ ID NO: 3414 - DNA, 25 bp, Mus musculus
gagtaaagacacttcacctcacacc

SEQ ID NO: 3415 - DNA, 25 bp, Mus musculus
ttcacctcacacctggaagtgttct

SEQ ID NO: 3416 - DNA, 25 bp, Mus musculus
tcacacctggaagtgttcttaaggg

SEQ ID NO: 3417 - DNA, 25 bp, Mus musculus
ctgaccttgcacagagctcgggtca

SEQ ID NO: 3418 - DNA, 25 bp, Mus musculus
gtggaactcatcactggcctcagct

SEQ ID NO: 3419 - DNA, 25 bp, Mus musculus
actggcctcagcttctaccaggacc

SEQ ID NO: 3420 - DNA, 25 bp, Mus musculus
gtttcagaactgctgaggttgaaaa

SEQ ID NO: 3421 - DNA, 25 bp, Mus musculus
acacatttgccaatcttcagccaag

SEQ ID NO: 3422 - DNA, 25 bp, Mus musculus
ttgccaatcttcagccaagaagact

SEQ ID NO: 3423 - DNA, 25 bp, Mus musculus
cagtcctctacacttttgcattgtt

SEQ ID NO: 3424 - DNA, 25 bp, Mus musculus
gatgtccctggctgggttgtgtgac

SEQ ID NO: 3425 - DNA, 25 bp, Mus musculus
tttgtaacagctacatgcacggtct

SEQ ID NO: 3426 - DNA, 25 bp, Mus musculus
gtaacagctacatgcacggtctgtc

SEQ ID NO: 3427 - DNA, 25 bp, Mus musculus
gctgacttcgctttggcagatctgc

SEQ ID NO: 3428 - DNA, 25 bp, Mus musculus
gacttcgctttggcagatctgctac

SEQ ID NO: 3429 - DNA, 25 bp, Mus musculus
ttcgctttggcagatctgctactca

SEQ ID NO: 3430 - DNA, 25 bp, Mus musculus
ttggcagatctgctactcattcttg

SEQ ID NO: 3431 - DNA, 25 bp, Mus musculus
gcagatctgctactcattcttggga

SEQ ID NO: 3432 - DNA, 25 bp, Mus musculus
gatctgctactcattcttgggacct

SEQ ID NO: 3433 - DNA, 25 bp, Mus musculus
ctactcattcttgggacctccctgg

SEQ ID NO: 3434 - DNA, 25 bp, Mus musculus
ctcattcttgggacctccctggagg

SEQ ID NO: 3435 - DNA, 25 bp, Mus musculus
gagccttttgccagcttgtctgaag

SEQ ID NO: 3436 - DNA, 25 bp, Mus musculus
gccagcttgtctgaagcagtacaga

SEQ ID NO: 3437 - DNA, 25 bp, Mus musculus
acagctacatgcacggtctgtcgaa

SEQ ID NO: 3438 - DNA, 25 bp, Mus musculus
tgcacggtctgtcgaaggtccttcc

SEQ ID NO: 3439 - DNA, 25 bp, Mus musculus
gagcagctgcctgcaaggttcctac

SEQ ID NO: 3440 - DNA, 25 bp, Mus musculus
cagctgcctgcaaggttcctactcc

SEQ ID NO: 3441 - DNA, 25 bp, Mus musculus
cctgcaaggttcctactccatatgg

SEQ ID NO: 3442 - DNA, 25 bp, Mus musculus
gcaaggttcctactccatatggctg

SEQ ID NO: 3443 - DNA, 25 bp, Mus musculus
aggttcctactccatatggctgact

SEQ ID NO: 3444 - DNA, 25 bp, Mus musculus
catatggctgacttcgctttggcag

SEQ ID NO: 3445 - DNA, 25 bp, Mus musculus
agcttggactgagctactgtctgtt

SEQ ID NO: 3446 - DNA, 25 bp, Mus musculus
gactgagctactgtctgttgctaac

SEQ ID NO: 3447 - DNA, 25 bp, Mus musculus
aagtgagctgtgcctgtggctccgg

SEQ ID NO: 3448 - DNA, 25 bp, Mus musculus
tccggccgctgactgactgagtata

SEQ ID NO: 3449 - DNA, 25 bp, Mus musculus
cggccgctgactgactgagtataga

SEQ ID NO: 3450 - DNA, 25 bp, Mus musculus
gccgctgactgactgagtatagaca

SEQ ID NO: 3451 - DNA, 25 bp, Mus musculus
agaatcgccgactgtaccgccagtc

SEQ ID NO: 3452 - DNA, 25 bp, Mus musculus
gccgactgtaccgccagtcctgttc

SEQ ID NO: 3453 - DNA, 25 bp, Mus musculus
actgtaccgccagtcctgttcagtg

SEQ ID NO: 3454 - DNA, 25 bp, Mus musculus
tgtaccgccagtcctgttcagtgct

SEQ ID NO: 3455 - DNA, 25 bp, Mus musculus
taccgccagtcctgttcagtgctga

SEQ ID NO: 3456 - DNA, 25 bp, Mus musculus
ccgccagtcctgttcagtgctgatg

SEQ ID NO: 3457 - DNA, 25 bp, Mus musculus
ctgagctactgtctgttgctaacca

SEQ ID NO: 3458 - DNA, 25 bp, Mus musculus
gagctactgtctgttgctaaccaga

SEQ ID NO: 3459 - DNA, 25 bp, Mus musculus
gctactgtctgttgctaaccagacc

SEQ ID NO: 3460 - DNA, 25 bp, Mus musculus
gtctgttgctaaccagaccaaagtg

SEQ ID NO: 3461 - DNA, 25 bp, Mus musculus
ctgttgctaaccagaccaaagtgag

SEQ ID NO: 3462 - DNA, 25 bp, Mus musculus
gttgctaaccagaccaaagtgagct

SEQ ID NO: 3463 - DNA, 25 bp, Mus musculus
ctaaccagaccaaagtgagctgtgc

SEQ ID NO: 3464 - DNA, 25 bp, Mus musculus
caaagtgagctgtgcctgtggctcc

SEQ ID NO: 3465 - DNA, 25 bp, Mus musculus
ccaaagctgactgcctggtgcccag

SEQ ID NO: 3466 - DNA, 25 bp, Mus musculus
gcctggtgcccagtgagatccggaa

SEQ ID NO: 3467 - DNA, 25 bp, Mus musculus
accagtttccagaatgtgattcgga

SEQ ID NO: 3468 - DNA, 25 bp, Mus musculus
gtttccagaatgtgattcggatgaa

SEQ ID NO: 3469 - DNA, 25 bp, Mus musculus
tgcacccttcgccgttattggcagc

SEQ ID NO: 3470 - DNA, 25 bp, Mus musculus
ccttcgccgttattggcagcaacac

SEQ ID NO: 3471 - DNA, 25 bp, Mus musculus
agaatcaggcgcactgcgactttgt

SEQ ID NO: 3472 - DNA, 25 bp, Mus musculus
gaatcaggcgcactgcgactttgtg

SEQ ID NO: 3473 - DNA, 25 bp, Mus musculus
cgactttgtgaagctccgcaacatg

SEQ ID NO: 3474 - DNA, 25 bp, Mus musculus
actttgtgaagctccgcaacatgct

SEQ ID NO: 3475 - DNA, 25 bp, Mus musculus
ctttgtgaagctccgcaacatgctc

SEQ ID NO: 3476 - DNA, 25 bp, Mus musculus
ttgtgaagctccgcaacatgctcat

SEQ ID NO: 3477 - DNA, 25 bp, Mus musculus
tggtgcccagtgagatccggaagct

SEQ ID NO: 3478 - DNA, 25 bp, Mus musculus
tgtgaagctccgcaacatgctcatc

SEQ ID NO: 3479 - DNA, 25 bp, Mus musculus
tgcccagtgagatccggaagctgaa

SEQ ID NO: 3480 - DNA, 25 bp, Mus musculus
tgggatccacgtgtaccagtttcca

SEQ ID NO: 3481 - DNA, 25 bp, Mus musculus
ggatccacgtgtaccagtttccaga

SEQ ID NO: 3482 - DNA, 25 bp, Mus musculus
tccacgtgtaccagtttccagaatg

SEQ ID NO: 3483 - DNA, 25 bp, Mus musculus
acgtgtaccagtttccagaatgtga

SEQ ID NO: 3484 - DNA, 25 bp, Mus musculus
cgtgtaccagtttccagaatgtgat

SEQ ID NO: 3485 - DNA, 25 bp, Mus musculus
gtaccagtttccagaatgtgattcg

SEQ ID NO: 3486 - DNA, 25 bp, Mus musculus
ggcctggccattgctgttgaaggcc

SEQ ID NO: 3487 - DNA, 25 bp, Mus musculus
ctggccattgctgttgaaggcccca

SEQ ID NO: 3488 - DNA, 25 bp, Mus musculus
gtagttcaggagccaggtgactatg

SEQ ID NO: 3489 - DNA, 25 bp, Mus musculus
gtctcagtcaagttcaacgaggagc

SEQ ID NO: 3490 - DNA, 25 bp, Mus musculus
cacatacctgatagccccttcgtgg

SEQ ID NO: 3491 - DNA, 25 bp, Mus musculus
atacctgatagccccttcgtggtgc

SEQ ID NO: 3492 - DNA, 25 bp, Mus musculus
cctgatagccccttcgtggtgcctg

SEQ ID NO: 3493 - DNA, 25 bp, Mus musculus
gtggttctccgtctggtgacgcccg

SEQ ID NO: 3494 - DNA, 25 bp, Mus musculus
gccgccttactgtttctagtcttca

SEQ ID NO: 3495 - DNA, 25 bp, Mus musculus
ttactgtttctagtcttcaggagtc

SEQ ID NO: 3496 - DNA, 25 bp, Mus musculus
ctgtttctagtcttcaggagtcagg

SEQ ID NO: 3497 - DNA, 25 bp, Mus musculus
tttctagtcttcaggagtcagggtt

SEQ ID NO: 3498 - DNA, 25 bp, Mus musculus
gaaggccccagcaaggctgagatct

SEQ ID NO: 3499 - DNA, 25 bp, Mus musculus
ggccccagcaaggctgagatctctt

SEQ ID NO: 3500 - DNA, 25 bp, Mus musculus
gctgagatctctttcgaggaccgaa

SEQ ID NO: 3501 - DNA, 25 bp, Mus musculus
gatggctcctgtggtgtggcctacg

SEQ ID NO: 3502 - DNA, 25 bp, Mus musculus
ggctcctgtggtgtggcctacgtag

SEQ ID NO: 3503 - DNA, 25 bp, Mus musculus
tcctgtggtgtggcctacgtagttc

SEQ ID NO: 3504 - DNA, 25 bp, Mus musculus
gtggcctacgtagttcaggagccag

SEQ ID NO: 3505 - DNA, 25 bp, Mus musculus
tacgtagttcaggagccaggtgact

SEQ ID NO: 3506 - DNA, 25 bp, Mus musculus
cacacttccctgtttaacaacagca

SEQ ID NO: 3507 - DNA, 25 bp, Mus musculus
ctgtttaacaacagcatgctttgtt

SEQ ID NO: 3508 - DNA, 25 bp, Mus musculus
atgtcctgagataccacctgaagct

SEQ ID NO: 3509 - DNA, 25 bp, Mus musculus
tcctgagataccacctgaagctgaa

SEQ ID NO: 3510 - DNA, 25 bp, Mus musculus
tgagataccacctgaagctgaattc

SEQ ID NO: 3511 - DNA, 25 bp, Mus musculus
accacctgaagctgaattccacttc

SEQ ID NO: 3512 - DNA, 25 bp, Mus musculus
tgaagctgaattccacttcatagta

SEQ ID NO: 3513 - DNA, 25 bp, Mus musculus
ctctcctacctgttgtattacttgc

SEQ ID NO: 3514 - DNA, 25 bp, Mus musculus
cttgttaccttgtatactacatgat

SEQ ID NO: 3515 - DNA, 25 bp, Mus musculus
gttaccttgtatactacatgattat

SEQ ID NO: 3516 - DNA, 25 bp, Mus musculus
aggcttactttgtgttcttagagat

SEQ ID NO: 3517 - DNA, 25 bp, Mus musculus
cttactttgtgttcttagagatagc

SEQ ID NO: 3518 - DNA, 25 bp, Mus musculus
tttaacaacagcatgctttgtttcc

SEQ ID NO: 3519 - DNA, 25 bp, Mus musculus
atgctttgtttcctcatgagtcatg

SEQ ID NO: 3520 - DNA, 25 bp, Mus musculus
ctttgtttcctcatgagtcatgtga

SEQ ID NO: 3521 - DNA, 25 bp, Mus musculus
ttcctcatgagtcatgtgacacagt

SEQ ID NO: 3522 - DNA, 25 bp, Mus musculus
aattatggacgcagttggagaggta

SEQ ID NO: 3523 - DNA, 25 bp, Mus musculus
tatggacgcagttggagaggtatta

SEQ ID NO: 3524 - DNA, 25 bp, Mus musculus
tccagcagctctgaggaaacaaacc

SEQ ID NO: 3525 - DNA, 25 bp, Mus musculus
tcatagtgccagactgcttaaaaga

SEQ ID NO: 3526 - DNA, 25 bp, Mus musculus
ctaccatctcaaaacttctagtgtc

SEQ ID NO: 3527 - DNA, 25 bp, Mus musculus
ataactcatgcaagccaactgtttt

SEQ ID NO: 3528 - DNA, 25 bp, Mus musculus
aaccacactattgactccagctggc

SEQ ID NO: 3529 - DNA, 25 bp, Mus musculus
actattgactccagctggcttggta

SEQ ID NO: 3530 - DNA, 25 bp, Mus musculus
ccagatgacacataactatgtctga

SEQ ID NO: 3531 - DNA, 25 bp, Mus musculus
taactatgtctgattctatgcctat

SEQ ID NO: 3532 - DNA, 25 bp, Mus musculus
tgtctgattctatgcctatatttcc

SEQ ID NO: 3533 - DNA, 25 bp, Mus musculus
attctatgcctatatttccaagaag

SEQ ID NO: 3534 - DNA, 25 bp, Mus musculus
tgcctatatttccaagaagtctact

SEQ ID NO: 3535 - DNA, 25 bp, Mus musculus
gtctactgccagagagtatgaccat

SEQ ID NO: 3536 - DNA, 25 bp, Mus musculus
gtcatattctctgtgtgctctctga

SEQ ID NO: 3537 - DNA, 25 bp, Mus musculus
gtgtgctctctgattaaactcaatg

SEQ ID NO: 3538 - DNA, 25 bp, Mus musculus
accataggactgtcacccaaagcac

SEQ ID NO: 3539 - DNA, 25 bp, Mus musculus
aaagcacctctgtgctgcttctatc

SEQ ID NO: 3540 - DNA, 25 bp, Mus musculus
cctctgtgctgcttctatctggcgg

SEQ ID NO: 3541 - DNA, 25 bp, Mus musculus
atggcttctgcctctgaagcaccaa

SEQ ID NO: 3542 - DNA, 25 bp, Mus musculus
tctgcctctgaagcaccaaatatca

SEQ ID NO: 3543 - DNA, 25 bp, Mus musculus
gcaccaaatatcaacagttaattat

SEQ ID NO: 3544 - DNA, 25 bp, Mus musculus
tattctgaaacgatctccctagaga

SEQ ID NO: 3545 - DNA, 25 bp, Mus musculus
atctccctagagatttagtgtactg

SEQ ID NO: 3546 - DNA, 25 bp, Mus musculus
gcttcctaggtgacatggaatggga

SEQ ID NO: 3547 - DNA, 25 bp, Mus musculus
atattgtctatttcaactataagcc

SEQ ID NO: 3548 - DNA, 25 bp, Mus musculus
aatgaccagtctcaggataaagagt

SEQ ID NO: 3549 - DNA, 25 bp, Mus musculus
tgaatcctgttacccctttcctcat

SEQ ID NO: 3550 - DNA, 25 bp, Mus musculus
tcctcattaactcgtaaggaattat

SEQ ID NO: 3551 - DNA, 25 bp, Mus musculus
aatgctgttacctatcttgttgttc

SEQ ID NO: 3552 - DNA, 25 bp, Mus musculus
tatcttgttgttctggaaaatgcct

SEQ ID NO: 3553 - DNA, 25 bp, Mus musculus
gaacaatctttcatacctaaagtgt

SEQ ID NO: 3554 - DNA, 25 bp, Mus musculus
caatctttcatacctaaagtgttca

SEQ ID NO: 3555 - DNA, 25 bp, Mus musculus
tctttcatacctaaagtgttcagga

SEQ ID NO: 3556 - DNA, 25 bp, Mus musculus
ttcaggaacccaactcgcattgtga

SEQ ID NO: 3557 - DNA, 25 bp, Mus musculus
aggaacccaactcgcattgtgaatt

SEQ ID NO: 3558 - DNA, 25 bp, Mus musculus
tctatttcaactataagccttttga

SEQ ID NO: 3559 - DNA, 25 bp, Mus musculus
atttcaactataagccttttgacag

SEQ ID NO: 3560 - DNA, 25 bp, Mus musculus
tcaactataagccttttgacaggat

SEQ ID NO: 3561 - DNA, 25 bp, Mus musculus
cttttgacaggattctcactgagca

SEQ ID NO: 3562 - DNA, 25 bp, Mus musculus
acaggattctcactgagcaaaacca

SEQ ID NO: 3563 - DNA, 25 bp, Mus musculus
ttctcactgagcaaaaccaagacca

SEQ ID NO: 3564 - DNA, 25 bp, Mus musculus
ctgagcaaaaccaagaccaaccaga

SEQ ID NO: 3565 - DNA, 25 bp, Mus musculus
gaatgtgacggtctctgtctcccca

SEQ ID NO: 3566 - DNA, 25 bp, Mus musculus
gggcaccaccatatgactcgcttca

SEQ ID NO: 3567 - DNA, 25 bp, Mus musculus
caccaccatatgactcgcttcagac

SEQ ID NO: 3568 - DNA, 25 bp, Mus musculus
tagattctaacagctcgaactctga

SEQ ID NO: 3569 - DNA, 25 bp, Mus musculus
gctcgaactctgatcagaattatga

SEQ ID NO: 3570 - DNA, 25 bp, Mus musculus
gtcctcgctttaaacgactggctga

SEQ ID NO: 3571 - DNA, 25 bp, Mus musculus
ctcgctttaaacgactggctgaaat

SEQ ID NO: 3572 - DNA, 25 bp, Mus musculus
gctttaaacgactggctgaaatgta

SEQ ID NO: 3573 - DNA, 25 bp, Mus musculus
ttaaacgactggctgaaatgtatgg

SEQ ID NO: 3574 - DNA, 25 bp, Mus musculus
tgtactcatagccttggatcctaat

SEQ ID NO: 3575 - DNA, 25 bp, Mus musculus
actcatagccttggatcctaatttg

SEQ ID NO: 3576 - DNA, 25 bp, Mus musculus
catagccttggatcctaatttggaa

SEQ ID NO: 3577 - DNA, 25 bp, Mus musculus
agccttggatcctaatttggaatgt

SEQ ID NO: 3578 - DNA, 25 bp, Mus musculus
caccatatgactcgcttcagactta

SEQ ID NO: 3579 - DNA, 25 bp, Mus musculus
catatgactcgcttcagacttatgc

SEQ ID NO: 3580 - DNA, 25 bp, Mus musculus
cgcttcagacttatgcatttgaagg

SEQ ID NO: 3581 - DNA, 25 bp, Mus musculus
tagctgaatctctcagttctttaga

SEQ ID NO: 3582 - DNA, 25 bp, Mus musculus
ctgaatctctcagttctttagattc

SEQ ID NO: 3583 - DNA, 25 bp, Mus musculus
aatctctcagttctttagattctaa

SEQ ID NO: 3584 - DNA, 25 bp, Mus musculus
ctctcagttctttagattctaacag

SEQ ID NO: 3585 - DNA, 25 bp, Mus musculus
ctttagattctaacagctcgaactc

SEQ ID NO: 3586 - DNA, 25 bp, Mus musculus
cagttcctaagctggccagactatg

SEQ ID NO: 3587 - DNA, 25 bp, Mus musculus
ttcctaagctggccagactatggtg

SEQ ID NO: 3588 - DNA, 25 bp, Mus musculus
caggtaccttctgctcactggacat

SEQ ID NO: 3589 - DNA, 25 bp, Mus musculus
tctgctcactggacatctgcctggc

SEQ ID NO: 3590 - DNA, 25 bp, Mus musculus
gctcactggacatctgcctggcaca

SEQ ID NO: 3591 - DNA, 25 bp, Mus musculus
acatctgcctggcacagctggagga

SEQ ID NO: 3592 - DNA, 25 bp, Mus musculus
tctgcctggcacagctggaggagct

SEQ ID NO: 3593 - DNA, 25 bp, Mus musculus
aggagcttggcacccttaatgtgtt

SEQ ID NO: 3594 - DNA, 25 bp, Mus musculus
agcttggcacccttaatgtgttcca

SEQ ID NO: 3595 - DNA, 25 bp, Mus musculus
cccttaatgtgttccagacagtgtc

SEQ ID NO: 3596 - DNA, 25 bp, Mus musculus
ttaatgtgttccagacagtgtcacg

SEQ ID NO: 3597 - DNA, 25 bp, Mus musculus
atgtgttccagacagtgtcacgaat

SEQ ID NO: 3598 - DNA, 25 bp, Mus musculus
ctaagctggccagactatggtgtcc

SEQ ID NO: 3599 - DNA, 25 bp, Mus musculus
ccagactatggtgtcccttcctcag

SEQ ID NO: 3600 - DNA, 25 bp, Mus musculus
gctgcttccctcattgacttcctga

SEQ ID NO: 3601 - DNA, 25 bp, Mus musculus
attgacttcctgagagtggtcagaa

SEQ ID NO: 3602 - DNA, 25 bp, Mus musculus
cagcagagcatggccgtacgagcct

SEQ ID NO: 3603 - DNA, 25 bp, Mus musculus
cacgctccaaagggcagtgtcctga

SEQ ID NO: 3604 - DNA, 25 bp, Mus musculus
ccaaagggcagtgtcctgagccacc

SEQ ID NO: 3605 - DNA, 25 bp, Mus musculus
agtgtcctgagccacccattgtggt

SEQ ID NO: 3606 - DNA, 25 bp, Mus musculus
cactctgcccaggaagagagcgtga

SEQ ID NO: 3607 - DNA, 25 bp, Mus musculus
cagcttccttagggatggtacacat

SEQ ID NO: 3608 - DNA, 25 bp, Mus musculus
ctggtctcatctgaacaagacaatt

SEQ ID NO: 3609 - DNA, 25 bp, Mus musculus
aatttgctctgcctagtgttctgtg

SEQ ID NO: 3610 - DNA, 25 bp, Mus musculus
ttgctctgcctagtgttctgtgccc

SEQ ID NO: 3611 - DNA, 25 bp, Mus musculus
cgctcatgcagtccagatttcatcc

SEQ ID NO: 3612 - DNA, 25 bp, Mus musculus
ggagagctcacgacagcaatgccat

SEQ ID NO: 3613 - DNA, 25 bp, Mus musculus
gagctcacgacagcaatgccatcat

SEQ ID NO: 3614 - DNA, 25 bp, Mus musculus
ctcacgacagcaatgccatcatcaa

SEQ ID NO: 3615 - DNA, 25 bp, Mus musculus
acagcaatgccatcatcaaaagttt

SEQ ID NO: 3616 - DNA, 25 bp, Mus musculus
gcaatgccatcatcaaaagttttgc

SEQ ID NO: 3617 - DNA, 25 bp, Mus musculus
atgccatcatcaaaagttttgctgc

SEQ ID NO: 3618 - DNA, 25 bp, Mus musculus
tgatctctggagatcagaggttgcc

SEQ ID NO: 3619 - DNA, 25 bp, Mus musculus
cccacacacatgatgataaaacttt

SEQ ID NO: 3620 - DNA, 25 bp, Mus musculus
ttgaaagtcaatcctttctttgaga

SEQ ID NO: 3621 - DNA, 25 bp, Mus musculus
gtcaatcctttctttgagacactcc

SEQ ID NO: 3622 - DNA, 25 bp, Mus musculus
gagacactccgaataaactatggag

SEQ ID NO: 3623 - DNA, 25 bp, Mus musculus
ggagattttcctgcataggaaagtg

SEQ ID NO: 3624 - DNA, 25 bp, Mus musculus
gattttcctgcataggaaagtgtgg

SEQ ID NO: 3625 - DNA, 25 bp, Mus musculus
tttttcctggtctcatctgaacaag

SEQ ID NO: 3626 - DNA, 25 bp, Mus musculus
cagaccctgcagcaggcatacctgc

SEQ ID NO: 3627 - DNA, 25 bp, Mus musculus
tacctgcccagcgtgtcctatagca

SEQ ID NO: 3628 - DNA, 25 bp, Mus musculus
attgcctccaactgagcgacttccg

SEQ ID NO: 3629 - DNA, 25 bp, Mus musculus
tccaactgagcgacttccggagtcc

SEQ ID NO: 3630 - DNA, 25 bp, Mus musculus
caagatggctcttagctttgcaatg

SEQ ID NO: 3631 - DNA, 25 bp, Mus musculus
ggctcttagctttgcaatgagactg

SEQ ID NO: 3632 - DNA, 25 bp, Mus musculus
tatgtcgacgagccttgggctccat

SEQ ID NO: 3633 - DNA, 25 bp, Mus musculus
ccttgggctccatccctaatactgc

SEQ ID NO: 3634 - DNA, 25 bp, Mus musculus
gctccatccctaatactgcaacagg

SEQ ID NO: 3635 - DNA, 25 bp, Mus musculus
tccctaatactgcaacaggagcagg

SEQ ID NO: 3636 - DNA, 25 bp, Mus musculus
atactgcaacaggagcaggggaatg

SEQ ID NO: 3637 - DNA, 25 bp, Mus musculus
gcaactcagactactgaatcagata

SEQ ID NO: 3638 - DNA, 25 bp, Mus musculus
gtgtcctatagcatctgctccagct

SEQ ID NO: 3639 - DNA, 25 bp, Mus musculus
tccagctcctcttactggggctcct

SEQ ID NO: 3640 - DNA, 25 bp, Mus musculus
tcctcttactggggctcctctttga

SEQ ID NO: 3641 - DNA, 25 bp, Mus musculus
tactggggctcctctttgaagaata

SEQ ID NO: 3642 - DNA, 25 bp, Mus musculus
cagtatgctgtcgacggagtgacca

SEQ ID NO: 3643 - DNA, 25 bp, Mus musculus
gctgtcgacggagtgaccagctttg

SEQ ID NO: 3644 - DNA, 25 bp, Mus musculus
accgtcttcaccagactctctgctt

SEQ ID NO: 3645 - DNA, 25 bp, Mus musculus
tctgcttacatttcctggatgaata

SEQ ID NO: 3646 - DNA, 25 bp, Mus musculus
agaatagcaagctgcggccagagat

SEQ ID NO: 3647 - DNA, 25 bp, Mus musculus
tgctgcaggacctgcgagagaacac

SEQ ID NO: 3648 - DNA, 25 bp, Mus musculus
acggcgatgcctccaagttcgccga

SEQ ID NO: 3649 - DNA, 25 bp, Mus musculus
atgcctccaagttcgccgagcatgt

SEQ ID NO: 3650 - DNA, 25 bp, Mus musculus
ccaagttcgccgagcatgtcttccg

SEQ ID NO: 3651 - DNA, 25 bp, Mus musculus
tcgccgagcatgtcttccgcacttt

SEQ ID NO: 3652 - DNA, 25 bp, Mus musculus
agcatgtcttccgcacttttgacac

SEQ ID NO: 3653 - DNA, 25 bp, Mus musculus
tcttccgcacttttgacaccaacag

SEQ ID NO: 3654 - DNA, 25 bp, Mus musculus
gcacttttgacaccaacagcgacgg

SEQ ID NO: 3655 - DNA, 25 bp, Mus musculus
ccaacagcgacggcaccatcgactt

SEQ ID NO: 3656 - DNA, 25 bp, Mus musculus
gcgacggcaccatcgacttccggga

SEQ ID NO: 3657 - DNA, 25 bp, Mus musculus
tcgacttccgggagttcatcatcgc

SEQ ID NO: 3658 - DNA, 25 bp, Mus musculus
agaacaccgagttctctgagctgga

SEQ ID NO: 3659 - DNA, 25 bp, Mus musculus
ccgagttctctgagctggagctaca

SEQ ID NO: 3660 - DNA, 25 bp, Mus musculus
agctggagctacaggagtggtacaa

SEQ ID NO: 3661 - DNA, 25 bp, Mus musculus
tcctgaaggactgcccgactggcat

SEQ ID NO: 3662 - DNA, 25 bp, Mus musculus
aggactgcccgactggcatcctcaa

SEQ ID NO: 3663 - DNA, 25 bp, Mus musculus
gcccgactggcatcctcaacgtgga

SEQ ID NO: 3664 - DNA, 25 bp, Mus musculus
ctggcatcctcaacgtggatgagtt

SEQ ID NO: 3665 - DNA, 25 bp, Mus musculus
tcctcaacgtggatgagttcaagaa

SEQ ID NO: 3666 - DNA, 25 bp, Mus musculus
gaaaccgtgtccagcacagaatcat

SEQ ID NO: 3667 - DNA, 25 bp, Mus musculus
aaccgtgtccagcacagaatcatcc

SEQ ID NO: 3668 - DNA, 25 bp, Mus musculus
atcctgaccctgctgacctggtcct

SEQ ID NO: 3669 - DNA, 25 bp, Mus musculus
cctgctgacctggtcctctctagtg

SEQ ID NO: 3670 - DNA, 25 bp, Mus musculus
tgctgacctggtcctctctagtgta

SEQ ID NO: 3671 - DNA, 25 bp, Mus musculus
tggtcctctctagtgtaccaggtgg

SEQ ID NO: 3672 - DNA, 25 bp, Mus musculus
ttcaaccctcggaagcacaagtttg

SEQ ID NO: 3673 - DNA, 25 bp, Mus musculus
caaccctcggaagcacaagtttgca

SEQ ID NO: 3674 - DNA, 25 bp, Mus musculus
gaaagtctttgtccctgatgagcag

SEQ ID NO: 3675 - DNA, 25 bp, Mus musculus
aagtctttgtccctgatgagcagaa

SEQ ID NO: 3676 - DNA, 25 bp, Mus musculus
gtctttgtccctgatgagcagaagg

SEQ ID NO: 3677 - DNA, 25 bp, Mus musculus
ttgtccctgatgagcagaaggatga

SEQ ID NO: 3678 - DNA, 25 bp, Mus musculus
ccgtgtccagcacagaatcatcctt

SEQ ID NO: 3679 - DNA, 25 bp, Mus musculus
gtgtccagcacagaatcatccttgg

SEQ ID NO: 3680 - DNA, 25 bp, Mus musculus
ccagcacagaatcatccttggaaaa

SEQ ID NO: 3681 - DNA, 25 bp, Mus musculus
agcacagaatcatccttggaaaagg

SEQ ID NO: 3682 - DNA, 25 bp, Mus musculus
cacagaatcatccttggaaaaggag

SEQ ID NO: 3683 - DNA, 25 bp, Mus musculus
cagaatcatccttggaaaaggagag

SEQ ID NO: 3684 - DNA, 25 bp, Mus musculus
gaccccaactgtgtggaggttgatg

SEQ ID NO: 3685 - DNA, 25 bp, Mus musculus
ttcaatcctgaccctgctgacctgg

SEQ ID NO: 3686 - DNA, 25 bp, Mus musculus
actaggaagccctcatccgaccaat

SEQ ID NO: 3687 - DNA, 25 bp, Mus musculus
tcatccgaccaatgtctgtaaacgc

SEQ ID NO: 3688 - DNA, 25 bp, Mus musculus
cacccagagcgagtgcagccaggta

SEQ ID NO: 3689 - DNA, 25 bp, Mus musculus
catttaaggccaagtccaggtgact

SEQ ID NO: 3690 - DNA, 25 bp, Mus musculus
ctcctctcttgtaaatacatgcatt

SEQ ID NO: 3691 - DNA, 25 bp, Mus musculus
ccctgttcttgtgaagtccatctcc

SEQ ID NO: 3692 - DNA, 25 bp, Mus musculus
tcttgtgaagtccatctccatggtc

SEQ ID NO: 3693 - DNA, 25 bp, Mus musculus
gaagtccatctccatggtcattaga

SEQ ID NO: 3694 - DNA, 25 bp, Mus musculus
catctccatggtcattagacctgcc

SEQ ID NO: 3695 - DNA, 25 bp, Mus musculus
cattagacctgccactctgaaccgc

SEQ ID NO: 3696 - DNA, 25 bp, Mus musculus
acctgccactctgaaccgcatgtga

SEQ ID NO: 3697 - DNA, 25 bp, Mus musculus
aggcccctgctatagccagagatca

SEQ ID NO: 3698 - DNA, 25 bp, Mus musculus
tgtctgtaaacgctctgaggtcttc

SEQ ID NO: 3699 - DNA, 25 bp, Mus musculus
taaacgctctgaggtcttccttcag

SEQ ID NO: 3700 - DNA, 25 bp, Mus musculus
ctctgaggtcttccttcaggatgta

SEQ ID NO: 3701 - DNA, 25 bp, Mus musculus
ggtcttccttcaggatgtatcttat

SEQ ID NO: 3702 - DNA, 25 bp, Mus musculus
agcagctagccccagtacaagcagg

SEQ ID NO: 3703 - DNA, 25 bp, Mus musculus
gtattacccagtaatgttgacacag

SEQ ID NO: 3704 - DNA, 25 bp, Mus musculus
agcaacttggagcacccagagcgag

SEQ ID NO: 3705 - DNA, 25 bp, Mus musculus
ttggagcacccagagcgagtgcagc

SEQ ID NO: 3706 - DNA, 25 bp, Mus musculus
gaaggctcagtactacctgcccgat

SEQ ID NO: 3707 - DNA, 25 bp, Mus musculus
tcagtactacctgcccgatggcagc

SEQ ID NO: 3708 - DNA, 25 bp, Mus musculus
gctgttcaggcctgacttgattggc

SEQ ID NO: 3709 - DNA, 25 bp, Mus musculus
gttcaggcctgacttgattggcgag

SEQ ID NO: 3710 - DNA, 25 bp, Mus musculus
gcctgacttgattggcgaggagagt

SEQ ID NO: 3711 - DNA, 25 bp, Mus musculus
tatccatgaggtgctggtgttcgct

SEQ ID NO: 3712 - DNA, 25 bp, Mus musculus
ccatgaggtgctggtgttcgctatc

SEQ ID NO: 3713 - DNA, 25 bp, Mus musculus
tgaggtgctggtgttcgctatccag

SEQ ID NO: 3714 - DNA, 25 bp, Mus musculus
ggtgttcgctatccagaagtcagac

SEQ ID NO: 3715 - DNA, 25 bp, Mus musculus
gttcgctatccagaagtcagacatg

SEQ ID NO: 3716 - DNA, 25 bp, Mus musculus
cgctatccagaagtcagacatggat

SEQ ID NO: 3717 - DNA, 25 bp, Mus musculus
tatccagaagtcagacatggattta

SEQ ID NO: 3718 - DNA, 25 bp, Mus musculus
gtactacctgcccgatggcagcacc

SEQ ID NO: 3719 - DNA, 25 bp, Mus musculus
ctacctgcccgatggcagcaccatt

SEQ ID NO: 3720 - DNA, 25 bp, Mus musculus
tggcagcaccattgagattggccct

SEQ ID NO: 3721 - DNA, 25 bp, Mus musculus
caccattgagattggcccttccagg

SEQ ID NO: 3722 - DNA, 25 bp, Mus musculus
tgagattggcccttccaggttccgg

SEQ ID NO: 3723 - DNA, 25 bp, Mus musculus
ggcccctgagctgctgttcaggcct

SEQ ID NO: 3724 - DNA, 25 bp, Mus musculus
tgagctgctgttcaggcctgacttg

SEQ ID NO: 3725 - DNA, 25 bp, Mus musculus
gctgctgttcaggcctgacttgatt

SEQ ID NO: 3726 - DNA, 25 bp, Mus musculus
cattcctgcagtttgcaagaccagg

SEQ ID NO: 3727 - DNA, 25 bp, Mus musculus
ttgcaagaccaggacggtcatttac

SEQ ID NO: 3728 - DNA, 25 bp, Mus musculus
tgtcaaggtggccaaagtggagtat

SEQ ID NO: 3729 - DNA, 25 bp, Mus musculus
acacctggagtgtgcatgtgcgacc

SEQ ID NO: 3730 - DNA, 25 bp, Mus musculus
tgcatgtgcgacctccaacctgaac

SEQ ID NO: 3731 - DNA, 25 bp, Mus musculus
tgacattcctgaacatactatgtat

SEQ ID NO: 3732 - DNA, 25 bp, Mus musculus
tcctgaacatactatgtatggtgct

SEQ ID NO: 3733 - DNA, 25 bp, Mus musculus
tggtgcttcattgccaatgtgcgtg

SEQ ID NO: 3734 - DNA, 25 bp, Mus musculus
ttcattgccaatgtgcgtgcggtct

SEQ ID NO: 3735 - DNA, 25 bp, Mus musculus
gccaatgtgcgtgcggtctttgttc

SEQ ID NO: 3736 - DNA, 25 bp, Mus musculus
cagtgtccgtttgttcagtgtgaca

SEQ ID NO: 3737 - DNA, 25 bp, Mus musculus
cttccttgtcacagagagcgaaaac

SEQ ID NO: 3738 - DNA, 25 bp, Mus musculus
catttacgagatacctcggagccag

SEQ ID NO: 3739 - DNA, 25 bp, Mus musculus
cgagatacctcggagccaggtggac

SEQ ID NO: 3740 - DNA, 25 bp, Mus musculus
atcggccaacttcctgatctggccc

SEQ ID NO: 3741 - DNA, 25 bp, Mus musculus
caacttcctgatctggcccccatgt

SEQ ID NO: 3742 - DNA, 25 bp, Mus musculus
gcgctgcactggctgttgtaacacc

SEQ ID NO: 3743 - DNA, 25 bp, Mus musculus
ctgttgtaacaccagcagcgtcaag

SEQ ID NO: 3744 - DNA, 25 bp, Mus musculus
cagcagcgtcaagtgccagccttca

SEQ ID NO: 3745 - DNA, 25 bp, Mus musculus
cgtcaagtgccagccttcacgggtc

SEQ ID NO: 3746 - DNA, 25 bp, Mus musculus
cctcacactggtaatgtctttcctg

SEQ ID NO: 3747 - DNA, 25 bp, Mus musculus
accacttcgcatttcatctgtgagg

SEQ ID NO: 3748 - DNA, 25 bp, Mus musculus
ggatctatgcatcctgtcaagaggg

SEQ ID NO: 3749 - DNA, 25 bp, Mus musculus
tcaagccaggactaccgaccagccg

SEQ ID NO: 3750 - DNA, 25 bp, Mus musculus
caggactaccgaccagccggctatg

SEQ ID NO: 3751 - DNA, 25 bp, Mus musculus
taccgaccagccggctatgggcaca

SEQ ID NO: 3752 - DNA, 25 bp, Mus musculus
ctgtggctgctggattcttttccag

SEQ ID NO: 3753 - DNA, 25 bp, Mus musculus
gattcttttccagcatgcctgtggc

SEQ ID NO: 3754 - DNA, 25 bp, Mus musculus
tttccagcatgcctgtggcctgtgt

SEQ ID NO: 3755 - DNA, 25 bp, Mus musculus
aatgaaatgcccattcttcaggcat

SEQ ID NO: 3756 - DNA, 25 bp, Mus musculus
atgcccattcttcaggcatttctac

SEQ ID NO: 3757 - DNA, 25 bp, Mus musculus
attcttcaggcatttctaccataat

SEQ ID NO: 3758 - DNA, 25 bp, Mus musculus
ttcatctgtgaggcatttcatcttt

SEQ ID NO: 3759 - DNA, 25 bp, Mus musculus
atgtcttcatgtccagctacttgtt

SEQ ID NO: 3760 - DNA, 25 bp, Mus musculus
acttgtttcaccatggcagacctcc

SEQ ID NO: 3761 - DNA, 25 bp, Mus musculus
ttcaccatggcagacctccctgagt

SEQ ID NO: 3762 - DNA, 25 bp, Mus musculus
tcctgccctgggtaggaagtgtggc

SEQ ID NO: 3763 - DNA, 25 bp, Mus musculus
ctctgggtctgtggtcactctccac

SEQ ID NO: 3764 - DNA, 25 bp, Mus musculus
tctccaccttgtcctagtgttgcca

SEQ ID NO: 3765 - DNA, 25 bp, Mus musculus
catttaacctggggatctatgcatc

SEQ ID NO: 3766 - DNA, 25 bp, Mus musculus
aggcgttgtccagttccaacgccag

SEQ ID NO: 3767 - DNA, 25 bp, Mus musculus
gcgttgtccagttccaacgccagct

SEQ ID NO: 3768 - DNA, 25 bp, Mus musculus
ttcgtcaccttccctgacttgctct

SEQ ID NO: 3769 - DNA, 25 bp, Mus musculus
tcaccttccctgacttgctcttcat

SEQ ID NO: 3770 - DNA, 25 bp, Mus musculus
tccctgacttgctcttcatctttga

SEQ ID NO: 3771 - DNA, 25 bp, Mus musculus
cctgacttgctcttcatctttgagt

SEQ ID NO: 3772 - DNA, 25 bp, Mus musculus
catctttgagtttatctttggaggc

SEQ ID NO: 3773 - DNA, 25 bp, Mus musculus
tttgagtttatctttggaggcctgg

SEQ ID NO: 3774 - DNA, 25 bp, Mus musculus
agtttatctttggaggcctggtgtg

SEQ ID NO: 3775 - DNA, 25 bp, Mus musculus
tttatctttggaggcctggtgtgga

SEQ ID NO: 3776 - DNA, 25 bp, Mus musculus
tctgtgttctgcttcctggccacca

SEQ ID NO: 3777 - DNA, 25 bp, Mus musculus
tgttctgcttcctggccaccacttc

SEQ ID NO: 3778 - DNA, 25 bp, Mus musculus
gttgtccagttccaacgccagctcg

SEQ ID NO: 3779 - DNA, 25 bp, Mus musculus
ccccggcagcagcttcgggtggcag

SEQ ID NO: 3780 - DNA, 25 bp, Mus musculus
ggcagcagcttcgggtggcagcacc

SEQ ID NO: 3781 - DNA, 25 bp, Mus musculus
cagcagcttcgggtggcagcaccct

SEQ ID NO: 3782 - DNA, 25 bp, Mus musculus
tgcccagtggcttctccgtcttcgt

SEQ ID NO: 3783 - DNA, 25 bp, Mus musculus
cccagtggcttctccgtcttcgtca

SEQ ID NO: 3784 - DNA, 25 bp, Mus musculus
cagtggcttctccgtcttcgtcacc

SEQ ID NO: 3785 - DNA, 25 bp, Mus musculus
gtggcttctccgtcttcgtcacctt

SEQ ID NO: 3786 - DNA, 25 bp, Mus musculus
ataccagcctaggcaagaaatacaa

SEQ ID NO: 3787 - DNA, 25 bp, Mus musculus
acctggtcatcgccaagatggatgc

SEQ ID NO: 3788 - DNA, 25 bp, Mus musculus
aacatgccacaaagaggagcaggac

SEQ ID NO: 3789 - DNA, 25 bp, Mus musculus
aggcaccaggcactagtggacagca

SEQ ID NO: 3790 - DNA, 25 bp, Mus musculus
gacagcattggccaccaagcacgtg

SEQ ID NO: 3791 - DNA, 25 bp, Mus musculus
caccaagcacgtgagccatcagtga

SEQ ID NO: 3792 - DNA, 25 bp, Mus musculus
ttttgttaatgccacctcatgctct

SEQ ID NO: 3793 - DNA, 25 bp, Mus musculus
taatgccacctcatgctctgaatac

SEQ ID NO: 3794 - DNA, 25 bp, Mus musculus
cacctcatgctctgaatactgaata

SEQ ID NO: 3795 - DNA, 25 bp, Mus musculus
actatttacttcagtatctcttcag

SEQ ID NO: 3796 - DNA, 25 bp, Mus musculus
tacttcagtatctcttcagacaaat

SEQ ID NO: 3797 - DNA, 25 bp, Mus musculus
agtatctcttcagacaaataagttt

SEQ ID NO: 3798 - DNA, 25 bp, Mus musculus
tggatgctactgccaacgacatcac

SEQ ID NO: 3799 - DNA, 25 bp, Mus musculus
ctactgccaacgacatcaccaacga

SEQ ID NO: 3800 - DNA, 25 bp, Mus musculus
ccaacgacatcaccaacgaccaata

SEQ ID NO: 3801 - DNA, 25 bp, Mus musculus
acatcaccaacgaccaatataaggt

SEQ ID NO: 3802 - DNA, 25 bp, Mus musculus
gcttccctaccatctattttgctcc

SEQ ID NO: 3803 - DNA, 25 bp, Mus musculus
ctaccatctattttgctcccagtgg

SEQ ID NO: 3804 - DNA, 25 bp, Mus musculus
tctattttgctcccagtggggacaa

SEQ ID NO: 3805 - DNA, 25 bp, Mus musculus
tagatgaacatgccacaaagaggag

SEQ ID NO: 3806 - DNA, 25 bp, Mus musculus
aggcgtcctctacgtcggaagcaag

SEQ ID NO: 3807 - DNA, 25 bp, Mus musculus
ggcgtcctctacgtcggaagcaaga

SEQ ID NO: 3808 - DNA, 25 bp, Mus musculus
gcagccaccggcctggtgaagaagg

SEQ ID NO: 3809 - DNA, 25 bp, Mus musculus
agccaccggcctggtgaagaaggag

SEQ ID NO: 3810 - DNA, 25 bp, Mus musculus
gaggagttcccacagacctgaagcc

SEQ ID NO: 3811 - DNA, 25 bp, Mus musculus
ggagttcccacagacctgaagccag

SEQ ID NO: 3812 - DNA, 25 bp, Mus musculus
gagttcccacagacctgaagccaga

SEQ ID NO: 3813 - DNA, 25 bp, Mus musculus
gttcccacagacctgaagccagagg

SEQ ID NO: 3814 - DNA, 25 bp, Mus musculus
ttcccacagacctgaagccagagga

SEQ ID NO: 3815 - DNA, 25 bp, Mus musculus
cccacagacctgaagccagaggaag

SEQ ID NO: 3816 - DNA, 25 bp, Mus musculus
ccacagacctgaagccagaggaagt

SEQ ID NO: 3817 - DNA, 25 bp, Mus musculus
acagacctgaagccagaggaagtgg

SEQ ID NO: 3818 - DNA, 25 bp, Mus musculus
gtcctctacgtcggaagcaagacca

SEQ ID NO: 3819 - DNA, 25 bp, Mus musculus
cagacctgaagccagaggaagtggc

SEQ ID NO: 3820 - DNA, 25 bp, Mus musculus
ctctacgtcggaagcaagaccaaag

SEQ ID NO: 3821 - DNA, 25 bp, Mus musculus
gaacattgcagcagccaccggcctg

SEQ ID NO: 3822 - DNA, 25 bp, Mus musculus
aacattgcagcagccaccggcctgg

SEQ ID NO: 3823 - DNA, 25 bp, Mus musculus
cattgcagcagccaccggcctggtg

SEQ ID NO: 3824 - DNA, 25 bp, Mus musculus
attgcagcagccaccggcctggtga

SEQ ID NO: 3825 - DNA, 25 bp, Mus musculus
tgcagcagccaccggcctggtgaag

SEQ ID NO: 3826 - DNA, 25 bp, Mus musculus
agcagccaccggcctggtgaagaag

SEQ ID NO: 3827 - DNA, 25 bp, Mus musculus
gctcatgtcctgcaccattgggatg

SEQ ID NO: 3828 - DNA, 25 bp, Mus musculus
gtcctgcaccattgggatgtgctat

SEQ ID NO: 3829 - DNA, 25 bp, Mus musculus
acatggcaaccaatctttgttcagg

SEQ ID NO: 3830 - DNA, 25 bp, Mus musculus
caaccaatctttgttcaggtggatg

SEQ ID NO: 3831 - DNA, 25 bp, Mus musculus
atctttgttcaggtggatgatggga

SEQ ID NO: 3832 - DNA, 25 bp, Mus musculus
aaactacatcttctccctgtagaca

SEQ ID NO: 3833 - DNA, 25 bp, Mus musculus
catcttctccctgtagacaaaaagt

SEQ ID NO: 3834 - DNA, 25 bp, Mus musculus
aaatggtgcaaatccacccaaacag

SEQ ID NO: 3835 - DNA, 25 bp, Mus musculus
ttttctcaatgtaatcaccctacat

SEQ ID NO: 3836 - DNA, 25 bp, Mus musculus
caatgtaatcaccctacatgtggaa

SEQ ID NO: 3837 - DNA, 25 bp, Mus musculus
aatcaccctacatgtggaaatagca

SEQ ID NO: 3838 - DNA, 25 bp, Mus musculus
atgtctttttctgggaagagacaga

SEQ ID NO: 3839 - DNA, 25 bp, Mus musculus
gtgctatctcctgattgctcacatt

SEQ ID NO: 3840 - DNA, 25 bp, Mus musculus
tctcctgattgctcacattgtggtg

SEQ ID NO: 3841 - DNA, 25 bp, Mus musculus
gaattaacagccagccagccatcat

SEQ ID NO: 3842 - DNA, 25 bp, Mus musculus
acagccagccagccatcatttgcag

SEQ ID NO: 3843 - DNA, 25 bp, Mus musculus
agccagccatcatttgcagaccaag

SEQ ID NO: 3844 - DNA, 25 bp, Mus musculus
cagcatcagcatcagcatcaggtgg

SEQ ID NO: 3845 - DNA, 25 bp, Mus musculus
atgagctcaccatgatatacatggc

SEQ ID NO: 3846 - DNA, 25 bp, Mus musculus
tgatatacatggcaaccaatctttg

SEQ ID NO: 3847 - DNA, 25 bp, Mus musculus
ctcagttcatcaactttcccatcta

SEQ ID NO: 3848 - DNA, 25 bp, Mus musculus
cagttcatcaactttcccatctatg

SEQ ID NO: 3849 - DNA, 25 bp, Mus musculus
tgaatgacatcaaaccaatatggca

SEQ ID NO: 3850 - DNA, 25 bp, Mus musculus
aatgacatcaaaccaatatggcaga

SEQ ID NO: 3851 - DNA, 25 bp, Mus musculus
atgacatcaaaccaatatggcagag

SEQ ID NO: 3852 - DNA, 25 bp, Mus musculus
gacatcaaaccaatatggcagaggc

SEQ ID NO: 3853 - DNA, 25 bp, Mus musculus
atcaaaccaatatggcagaggccgt

SEQ ID NO: 3854 - DNA, 25 bp, Mus musculus
tcaaaccaatatggcagaggccgtc

SEQ ID NO: 3855 - DNA, 25 bp, Mus musculus
aaccaatatggcagaggccgtccaa

SEQ ID NO: 3856 - DNA, 25 bp, Mus musculus
atatggcagaggccgtccaaagaag

SEQ ID NO: 3857 - DNA, 25 bp, Mus musculus
tatggcagaggccgtccaaagaagt

SEQ ID NO: 3858 - DNA, 25 bp, Mus musculus
cagaggccgtccaaagaagtagaag

SEQ ID NO: 3859 - DNA, 25 bp, Mus musculus
ttcatcaactttcccatctatgtgt

SEQ ID NO: 3860 - DNA, 25 bp, Mus musculus
tcatcaactttcccatctatgtgtg

SEQ ID NO: 3861 - DNA, 25 bp, Mus musculus
tcaactttcccatctatgtgtggag

SEQ ID NO: 3862 - DNA, 25 bp, Mus musculus
aactttcccatctatgtgtggagta

SEQ ID NO: 3863 - DNA, 25 bp, Mus musculus
actttcccatctatgtgtggagtag

SEQ ID NO: 3864 - DNA, 25 bp, Mus musculus
tttcccatctatgtgtggagtagca

SEQ ID NO: 3865 - DNA, 25 bp, Mus musculus
ttcccatctatgtgtggagtagcaa

SEQ ID NO: 3866 - DNA, 25 bp, Mus musculus
cccatctatgtgtggagtagcaaga

SEQ ID NO: 3867 - DNA, 25 bp, Mus musculus
gtgctcctggtcctatgggtgatgg

SEQ ID NO: 3868 - DNA, 25 bp, Mus musculus
ctggtcctatgggtgatggggacaa

SEQ ID NO: 3869 - DNA, 25 bp, Mus musculus
tggatgcctgtgtgtccagagtgca

SEQ ID NO: 3870 - DNA, 25 bp, Mus musculus
gggcaacaccagtccctgaacattt

SEQ ID NO: 3871 - DNA, 25 bp, Mus musculus
gaacattcgagtgtcctgcttgtcg

SEQ ID NO: 3872 - DNA, 25 bp, Mus musculus
tcgagtgtcctgcttgtcgtggagt

SEQ ID NO: 3873 - DNA, 25 bp, Mus musculus
gcccttttgcgacaccgagattttg

SEQ ID NO: 3874 - DNA, 25 bp, Mus musculus
ttgcgacaccgagattttgatttga

SEQ ID NO: 3875 - DNA, 25 bp, Mus musculus
atcacatatgccggctatgacagcc

SEQ ID NO: 3876 - DNA, 25 bp, Mus musculus
tatgccggctatgacagcccttact

SEQ ID NO: 3877 - DNA, 25 bp, Mus musculus
ggctatgacagcccttacttttcaa

SEQ ID NO: 3878 - DNA, 25 bp, Mus musculus
ccttacttttcaagaattcagcaat

SEQ ID NO: 3879 - DNA, 25 bp, Mus musculus
atgagccagttgctgagggcactga

SEQ ID NO: 3880 - DNA, 25 bp, Mus musculus
cagttgctgagggcactgagagcca

SEQ ID NO: 3881 - DNA, 25 bp, Mus musculus
ggttcgcccagcatcgactgaggga

SEQ ID NO: 3882 - DNA, 25 bp, Mus musculus
cccagcatcgactgagggaactgga

SEQ ID NO: 3883 - DNA, 25 bp, Mus musculus
agtccattttgcagcgcactaattc

SEQ ID NO: 3884 - DNA, 25 bp, Mus musculus
ttttgcagcgcactaattcctttga

SEQ ID NO: 3885 - DNA, 25 bp, Mus musculus
agcgcactaattcctttgatgtccc

SEQ ID NO: 3886 - DNA, 25 bp, Mus musculus
atgtcccaagggaggatcttgatag

SEQ ID NO: 3887 - DNA, 25 bp, Mus musculus
acactctgaacctgcaacaacattg

SEQ ID NO: 3888 - DNA, 25 bp, Mus musculus
tctgaacctgcaacaacattgtcaa

SEQ ID NO: 3889 - DNA, 25 bp, Mus musculus
gatctgctgcatcgaccagctcata

SEQ ID NO: 3890 - DNA, 25 bp, Mus musculus
gtatttgaatgccactggcagccgc

SEQ ID NO: 3891 - DNA, 25 bp, Mus musculus
tagcatgctggtgggtttaagggaa

SEQ ID NO: 3892 - DNA, 25 bp, Mus musculus
tggacatgctcaaccttacgtcttc

SEQ ID NO: 3893 - DNA, 25 bp, Mus musculus
gacatgctcaaccttacgtcttcct

SEQ ID NO: 3894 - DNA, 25 bp, Mus musculus
tgctcaaccttacgtcttcctccag

SEQ ID NO: 3895 - DNA, 25 bp, Mus musculus
tccaggtgtcgcaggcaggactcct

SEQ ID NO: 3896 - DNA, 25 bp, Mus musculus
gcaggactcctgacatcctttatac

SEQ ID NO: 3897 - DNA, 25 bp, Mus musculus
aggactcctgacatcctttataccg

SEQ ID NO: 3898 - DNA, 25 bp, Mus musculus
gactcctgacatcctttataccggc

SEQ ID NO: 3899 - DNA, 25 bp, Mus musculus
tgaacctgcaacaacattgtcaaca

SEQ ID NO: 3900 - DNA, 25 bp, Mus musculus
cctgacatcctttataccggctcag

SEQ ID NO: 3901 - DNA, 25 bp, Mus musculus
aacctgcaacaacattgtcaacatg

SEQ ID NO: 3902 - DNA, 25 bp, Mus musculus
cctgcaacaacattgtcaacatgac

SEQ ID NO: 3903 - DNA, 25 bp, Mus musculus
caacaacattgtcaacatgacttga

SEQ ID NO: 3904 - DNA, 25 bp, Mus musculus
acaacattgtcaacatgacttgaat

SEQ ID NO: 3905 - DNA, 25 bp, Mus musculus
aacattgtcaacatgacttgaatcc

SEQ ID NO: 3906 - DNA, 25 bp, Mus musculus
cattgtcaacatgacttgaatccac

SEQ ID NO: 3907 - DNA, 25 bp, Mus musculus
gcgatctgctgcatcgaccagctca

SEQ ID NO: 3908 - DNA, 25 bp, Mus musculus
gttcgagcgacacgacgggatccgc

SEQ ID NO: 3909 - DNA, 25 bp, Mus musculus
tcgagcgacacgacgggatccgcag

SEQ ID NO: 3910 - DNA, 25 bp, Mus musculus
agagcttttccacggctaagccatt

SEQ ID NO: 3911 - DNA, 25 bp, Mus musculus
tttccacggctaagccattgcctct

SEQ ID NO: 3912 - DNA, 25 bp, Mus musculus
cacggctaagccattgcctctccat

SEQ ID NO: 3913 - DNA, 25 bp, Mus musculus
cggctaagccattgcctctccattt

SEQ ID NO: 3914 - DNA, 25 bp, Mus musculus
taagccattgcctctccatttcggt

SEQ ID NO: 3915 - DNA, 25 bp, Mus musculus
agccattgcctctccatttcggtgc

SEQ ID NO: 3916 - DNA, 25 bp, Mus musculus
attgcctctccatttcggtgccgct

SEQ ID NO: 3917 - DNA, 25 bp, Mus musculus
tgcctctccatttcggtgccgcttc

SEQ ID NO: 3918 - DNA, 25 bp, Mus musculus
cctctccatttcggtgccgcttctt

SEQ ID NO: 3919 - DNA, 25 bp, Mus musculus
tccatttcggtgccgcttcttttat

SEQ ID NO: 3920 - DNA, 25 bp, Mus musculus
cgacgggatccgcagccattaggga

SEQ ID NO: 3921 - DNA, 25 bp, Mus musculus
gggatccgcagccattagggaatgg

SEQ ID NO: 3922 - DNA, 25 bp, Mus musculus
gatccgcagccattagggaatggct

SEQ ID NO: 3923 - DNA, 25 bp, Mus musculus
ggtaacctttaagcagcattgcctt

SEQ ID NO: 3924 - DNA, 25 bp, Mus musculus
taacctttaagcagcattgccttcc

SEQ ID NO: 3925 - DNA, 25 bp, Mus musculus
ctttaagcagcattgccttccagct

SEQ ID NO: 3926 - DNA, 25 bp, Mus musculus
cttccagcttgctttagttttcaca

SEQ ID NO: 3927 - DNA, 25 bp, Mus musculus
gcttgctttagttttcacaagaaga

SEQ ID NO: 3928 - DNA, 25 bp, Mus musculus
gcttgcggcttctaaaatgccggat

SEQ ID NO: 3929 - DNA, 25 bp, Mus musculus
aaggacgacaagcccatccgagctc

SEQ ID NO: 3930 - DNA, 25 bp, Mus musculus
atgacattcagcaacttcttaaaaa

SEQ ID NO: 3931 - DNA, 25 bp, Mus musculus
aaattaatgagctcactggtatcaa

SEQ ID NO: 3932 - DNA, 25 bp, Mus musculus
attaatgagctcactggtatcaaag

SEQ ID NO: 3933 - DNA, 25 bp, Mus musculus
atgagctcactggtatcaaagagtc

SEQ ID NO: 3934 - DNA, 25 bp, Mus musculus
gagctcactggtatcaaagagtccg

SEQ ID NO: 3935 - DNA, 25 bp, Mus musculus
atcaaagagtccgacactgggctgg

SEQ ID NO: 3936 - DNA, 25 bp, Mus musculus
caaagagtccgacactgggctggcc

SEQ ID NO: 3937 - DNA, 25 bp, Mus musculus
ctccagccctctgggatttggctgc

SEQ ID NO: 3938 - DNA, 25 bp, Mus musculus
ccagccctctgggatttggctgcag

SEQ ID NO: 3939 - DNA, 25 bp, Mus musculus
agccctctgggatttggctgcagac

SEQ ID NO: 3940 - DNA, 25 bp, Mus musculus
ggacgacaagcccatccgagctctg

SEQ ID NO: 3941 - DNA, 25 bp, Mus musculus
ccctctgggatttggctgcagacaa

SEQ ID NO: 3942 - DNA, 25 bp, Mus musculus
acgacaagcccatccgagctctgga

SEQ ID NO: 3943 - DNA, 25 bp, Mus musculus
catccgagctctggatgaaggggat

SEQ ID NO: 3944 - DNA, 25 bp, Mus musculus
tccgagctctggatgaaggggatat

SEQ ID NO: 3945 - DNA, 25 bp, Mus musculus
gatatcgccttgttgaaaacttatg

SEQ ID NO: 3946 - DNA, 25 bp, Mus musculus
acttatggccagagtacttattcga

SEQ ID NO: 3947 - DNA, 25 bp, Mus musculus
agtacttattcgaggcagatcaagc

SEQ ID NO: 3948 - DNA, 25 bp, Mus musculus
cttattcgaggcagatcaagcaggt

SEQ ID NO: 3949 - DNA, 25 bp, Mus musculus
cacgttcgacaccatgggccttcgg

SEQ ID NO: 3950 - DNA, 25 bp, Mus musculus
tgaaaaaccttctgcgatccaacag

SEQ ID NO: 3951 - DNA, 25 bp, Mus musculus
gtcatcgcacagtctcagtctggca

SEQ ID NO: 3952 - DNA, 25 bp, Mus musculus
catcgcacagtctcagtctggcaca

SEQ ID NO: 3953 - DNA, 25 bp, Mus musculus
gcaagacggccaccttcagtatttc

SEQ ID NO: 3954 - DNA, 25 bp, Mus musculus
aagacggccaccttcagtatttcag

SEQ ID NO: 3955 - DNA, 25 bp, Mus musculus
gacggccaccttcagtatttcagtc

SEQ ID NO: 3956 - DNA, 25 bp, Mus musculus
cggccaccttcagtatttcagtcct

SEQ ID NO: 3957 - DNA, 25 bp, Mus musculus
caccttcagtatttcagtccttcag

SEQ ID NO: 3958 - DNA, 25 bp, Mus musculus
ccttcagtatttcagtccttcagtg

SEQ ID NO: 3959 - DNA, 25 bp, Mus musculus
ttcagtatttcagtccttcagtgct

SEQ ID NO: 3960 - DNA, 25 bp, Mus musculus
cagtatttcagtccttcagtgcttg

SEQ ID NO: 3961 - DNA, 25 bp, Mus musculus
accttctgcgatccaacagcgtgct

SEQ ID NO: 3962 - DNA, 25 bp, Mus musculus
gtatttcagtccttcagtgcttgga

SEQ ID NO: 3963 - DNA, 25 bp, Mus musculus
cttctgcgatccaacagcgtgctat

SEQ ID NO: 3964 - DNA, 25 bp, Mus musculus
tctgcgatccaacagcgtgctatca

SEQ ID NO: 3965 - DNA, 25 bp, Mus musculus
tgcgatccaacagcgtgctatcaag

SEQ ID NO: 3966 - DNA, 25 bp, Mus musculus
atccaacagcgtgctatcaagcaga

SEQ ID NO: 3967 - DNA, 25 bp, Mus musculus
ccaacagcgtgctatcaagcagata

SEQ ID NO: 3968 - DNA, 25 bp, Mus musculus
aacagcgtgctatcaagcagataat

SEQ ID NO: 3969 - DNA, 25 bp, Mus musculus
atgtcatcgcacagtctcagtctgg

SEQ ID NO: 3970 - DNA, 25 bp, Mus musculus
taccacaggcagacaccaggatggg

SEQ ID NO: 3971 - DNA, 25 bp, Mus musculus
acaccaggatgggcatgggaagatc

SEQ ID NO: 3972 - DNA, 25 bp, Mus musculus
tatgagacactgtctgatagtgacg

SEQ ID NO: 3973 - DNA, 25 bp, Mus musculus
acactgtctgatagtgacgactgag

SEQ ID NO: 3974 - DNA, 25 bp, Mus musculus
ccatgatttgtgcccagagacttct

SEQ ID NO: 3975 - DNA, 25 bp, Mus musculus
tttgtgcccagagacttctcaggag

SEQ ID NO: 3976 - DNA, 25 bp, Mus musculus
tcaggagagccaggccatggatgag

SEQ ID NO: 3977 - DNA, 25 bp, Mus musculus
gagccaggccatggatgaggaagaa

SEQ ID NO: 3978 - DNA, 25 bp, Mus musculus
aaactgcctctaatacaggcacttc

SEQ ID NO: 3979 - DNA, 25 bp, Mus musculus
cctctaatacaggcacttcaatgga

SEQ ID NO: 3980 - DNA, 25 bp, Mus musculus
atacaggcacttcaatggattataa

SEQ ID NO: 3981 - DNA, 25 bp, Mus musculus
ggacaattcttgttcttacatctgt

SEQ ID NO: 3982 - DNA, 25 bp, Mus musculus
tcttcaacaggttctactcagttcc

SEQ ID NO: 3983 - DNA, 25 bp, Mus musculus
atacggatgctcagcagtacaccac

SEQ ID NO: 3984 - DNA, 25 bp, Mus musculus
acaccacctacacagatcgcatgcg

SEQ ID NO: 3985 - DNA, 25 bp, Mus musculus
caagcagctccacatcaacagaacc

SEQ ID NO: 3986 - DNA, 25 bp, Mus musculus
gctccacatcaacagaaccgcatct

SEQ ID NO: 3987 - DNA, 25 bp, Mus musculus
catcaacagaaccgcatctgggaga

SEQ ID NO: 3988 - DNA, 25 bp, Mus musculus
ccgctcctctcagcgcagtatgaga

SEQ ID NO: 3989 - DNA, 25 bp, Mus musculus
ctctcagcgcagtatgagacactgt

SEQ ID NO: 3990 - DNA, 25 bp, Mus musculus
taagctgccgtactcggtattgtta

SEQ ID NO: 3991 - DNA, 25 bp, Mus musculus
gccgtactcggtattgttagagata

SEQ ID NO: 3992 - DNA, 25 bp, Mus musculus
aaatctgattggcctgaaagctgga

SEQ ID NO: 3993 - DNA, 25 bp, Mus musculus
aatctgattggcctgaaagctggaa

SEQ ID NO: 3994 - DNA, 25 bp, Mus musculus
atctgattggcctgaaagctggaag

SEQ ID NO: 3995 - DNA, 25 bp, Mus musculus
tctgattggcctgaaagctggaagg

SEQ ID NO: 3996 - DNA, 25 bp, Mus musculus
ctgattggcctgaaagctggaaggt

SEQ ID NO: 3997 - DNA, 25 bp, Mus musculus
tgattggcctgaaagctggaaggtg

SEQ ID NO: 3998 - DNA, 25 bp, Mus musculus
attggcctgaaagctggaaggtgtg

SEQ ID NO: 3999 - DNA, 25 bp, Mus musculus
ttggcctgaaagctggaaggtgtgc

SEQ ID NO: 4000 - DNA, 25 bp, Mus musculus
gtactcggtattgttagagatacag

SEQ ID NO: 4001 - DNA, 25 bp, Mus musculus
tcacaggtcaccagatttcgccaaa

SEQ ID NO: 4002 - DNA, 25 bp, Mus musculus
cacaggtcaccagatttcgccaaaa

SEQ ID NO: 4003 - DNA, 25 bp, Mus musculus
acaggtcaccagatttcgccaaaat

SEQ ID NO: 4004 - DNA, 25 bp, Mus musculus
ccttaaatctgattggcctgaaagc

SEQ ID NO: 4005 - DNA, 25 bp, Mus musculus
cttaaatctgattggcctgaaagct

SEQ ID NO: 4006 - DNA, 25 bp, Mus musculus
ttaaatctgattggcctgaaagctg

SEQ ID NO: 4007 - DNA, 25 bp, Mus musculus
taaatctgattggcctgaaagctgg

SEQ ID NO: 4008 - DNA, 25 bp, Mus musculus
gctcagttaccacctggtgcctcac

SEQ ID NO: 4009 - DNA, 25 bp, Mus musculus
cagttaccacctggtgcctcactgt

SEQ ID NO: 4010 - DNA, 25 bp, Mus musculus
agaggtcccatgtccttggcagtgt

SEQ ID NO: 4011 - DNA, 25 bp, Mus musculus
gctctgccctcagagctgcaaggga

SEQ ID NO: 4012 - DNA, 25 bp, Mus musculus
agaccaactctttcccagaatcgct

SEQ ID NO: 4013 - DNA, 25 bp, Mus musculus
ccaactctttcccagaatcgctagc

SEQ ID NO: 4014 - DNA, 25 bp, Mus musculus
cagctgagacctcagcttgggaagg

SEQ ID NO: 4015 - DNA, 25 bp, Mus musculus
ccatctgggagcctgaggacctgac

SEQ ID NO: 4016 - DNA, 25 bp, Mus musculus
ggtaagcaggcccagactgtggctc

SEQ ID NO: 4017 - DNA, 25 bp, Mus musculus
cagactgtggctcttgggtcctaga

SEQ ID NO: 4018 - DNA, 25 bp, Mus musculus
actgtggctcttgggtcctagaggg

SEQ ID NO: 4019 - DNA, 25 bp, Mus musculus
gaaccccctgtggtctttctctgat

SEQ ID NO: 4020 - DNA, 25 bp, Mus musculus
ccacctggtgcctcactgtcaaact

SEQ ID NO: 4021 - DNA, 25 bp, Mus musculus
ggccatggctgagccactgttctgg

SEQ ID NO: 4022 - DNA, 25 bp, Mus musculus
catggctgagccactgttctgggag

SEQ ID NO: 4023 - DNA, 25 bp, Mus musculus
tgagccactgttctgggagcagaag

SEQ ID NO: 4024 - DNA, 25 bp, Mus musculus
gccactgttctgggagcagaaggca

SEQ ID NO: 4025 - DNA, 25 bp, Mus musculus
acccacctagccagaggtcccatgt

SEQ ID NO: 4026 - DNA, 25 bp, Mus musculus
ctagccagaggtcccatgtccttgg

SEQ ID NO: 4027 - DNA, 25 bp, Mus musculus
gccagaggtcccatgtccttggcag

SEQ ID NO: 4028 - DNA, 25 bp, Mus musculus
gttcctggtcaatgatctataacat

SEQ ID NO: 4029 - DNA, 25 bp, Mus musculus
acattcccaacttgaatgtctagaa

SEQ ID NO: 4030 - DNA, 25 bp, Mus musculus
ttgggagccacacttagactctttc

SEQ ID NO: 4031 - DNA, 25 bp, Mus musculus
ggagccacacttagactctttccaa

SEQ ID NO: 4032 - DNA, 25 bp, Mus musculus
acacttagactctttccaaagatgt

SEQ ID NO: 4033 - DNA, 25 bp, Mus musculus
atggactcatctatgatcttggttg

SEQ ID NO: 4034 - DNA, 25 bp, Mus musculus
gactcatctatgatcttggttggaa

SEQ ID NO: 4035 - DNA, 25 bp, Mus musculus
tcatctatgatcttggttggaaacc

SEQ ID NO: 4036 - DNA, 25 bp, Mus musculus
atccagatctttgcttgtggcagct

SEQ ID NO: 4037 - DNA, 25 bp, Mus musculus
cagatctttgcttgtggcagctgtt

SEQ ID NO: 4038 - DNA, 25 bp, Mus musculus
tgtggcagctgtttctcatgaagct

SEQ ID NO: 4039 - DNA, 25 bp, Mus musculus
ggcagctgtttctcatgaagctaat

SEQ ID NO: 4040 - DNA, 25 bp, Mus musculus
ttcccaacttgaatgtctagaatgt

SEQ ID NO: 4041 - DNA, 25 bp, Mus musculus
aattggttcattttcctgttcagtg

SEQ ID NO: 4042 - DNA, 25 bp, Mus musculus
ttcctgttcagtgaaatggacacag

SEQ ID NO: 4043 - DNA, 25 bp, Mus musculus
aacccagtgtccagcaagaattgcc

SEQ ID NO: 4044 - DNA, 25 bp, Mus musculus
ccagtgtccagcaagaattgccttg

SEQ ID NO: 4045 - DNA, 25 bp, Mus musculus
agcaagaattgccttgcccaaacct

SEQ ID NO: 4046 - DNA, 25 bp, Mus musculus
tgccttgcccaaacctacgtctacg

SEQ ID NO: 4047 - DNA, 25 bp, Mus musculus
tacgtctacgccaaaggtcaaggca

SEQ ID NO: 4048 - DNA, 25 bp, Mus musculus
gtggctgcagccaacttccagatag

SEQ ID NO: 4049 - DNA, 25 bp, Mus musculus
tggctgcagccaacttccagatagc

SEQ ID NO: 4050 - DNA, 25 bp, Mus musculus
tgtgtaccggtatgccaacggcaag

SEQ ID NO: 4051 - DNA, 25 bp, Mus musculus
gtgtaccggtatgccaacggcaagt

SEQ ID NO: 4052 - DNA, 25 bp, Mus musculus
tgtaccggtatgccaacggcaagtt

SEQ ID NO: 4053 - DNA, 25 bp, Mus musculus
taccggtatgccaacggcaagtttg

SEQ ID NO: 4054 - DNA, 25 bp, Mus musculus
cggtatgccaacggcaagtttgtat

SEQ ID NO: 4055 - DNA, 25 bp, Mus musculus
ggtatgccaacggcaagtttgtatc

SEQ ID NO: 4056 - DNA, 25 bp, Mus musculus
gtatgccaacggcaagtttgtatcc

SEQ ID NO: 4057 - DNA, 25 bp, Mus musculus
tatgccaacggcaagtttgtatccc

SEQ ID NO: 4058 - DNA, 25 bp, Mus musculus
atgccaacggcaagtttgtatccct

SEQ ID NO: 4059 - DNA, 25 bp, Mus musculus
ggctgcagccaacttccagatagcg

SEQ ID NO: 4060 - DNA, 25 bp, Mus musculus
gctgcagccaacttccagatagcgg

SEQ ID NO: 4061 - DNA, 25 bp, Mus musculus
ctgcagccaacttccagatagcgga

SEQ ID NO: 4062 - DNA, 25 bp, Mus musculus
tgcagccaacttccagatagcggag

SEQ ID NO: 4063 - DNA, 25 bp, Mus musculus
gcagccaacttccagatagcggagt

SEQ ID NO: 4064 - DNA, 25 bp, Mus musculus
cagccaacttccagatagcggagtg

SEQ ID NO: 4065 - DNA, 25 bp, Mus musculus
agccaacttccagatagcggagtgg

SEQ ID NO: 4066 - DNA, 25 bp, Mus musculus
ttgtgtaccggtatgccaacggcaa

SEQ ID NO: 4067 - DNA, 25 bp, Mus musculus
gctttcaggccctgctagctctggt

SEQ ID NO: 4068 - DNA, 25 bp, Mus musculus
aggccctgctagctctggtcactgg

SEQ ID NO: 4069 - DNA, 25 bp, Mus musculus
agatgggccacagtgatctgtcatt

SEQ ID NO: 4070 - DNA, 25 bp, Mus musculus
tgggccacagtgatctgtcattcta

SEQ ID NO: 4071 - DNA, 25 bp, Mus musculus
acagtgatctgtcattctaaatagg

SEQ ID NO: 4072 - DNA, 25 bp, Mus musculus
agcctttggtctcctctatgtagac

SEQ ID NO: 4073 - DNA, 25 bp, Mus musculus
cctctatgtagactactgcttctca

SEQ ID NO: 4074 - DNA, 25 bp, Mus musculus
tgtagactactgcttctcaagacat

SEQ ID NO: 4075 - DNA, 25 bp, Mus musculus
ctattgctgttgttgcagaaaagtc

SEQ ID NO: 4076 - DNA, 25 bp, Mus musculus
acatcccattctggacatggtgaaa

SEQ ID NO: 4077 - DNA, 25 bp, Mus musculus
gaaatccaggtctcgggtctgattt

SEQ ID NO: 4078 - DNA, 25 bp, Mus musculus
atccaggtctcgggtctgatttaat

SEQ ID NO: 4079 - DNA, 25 bp, Mus musculus
ccctgctagctctggtcactgggga

SEQ ID NO: 4080 - DNA, 25 bp, Mus musculus
tgctagctctggtcactggggacaa

SEQ ID NO: 4081 - DNA, 25 bp, Mus musculus
tggtcactggggacaagggaaatga

SEQ ID NO: 4082 - DNA, 25 bp, Mus musculus
accacacttcaggcctcaagggagc

SEQ ID NO: 4083 - DNA, 25 bp, Mus musculus
cttcaggcctcaagggagcagtctc

SEQ ID NO: 4084 - DNA, 25 bp, Mus musculus
tctcacctgtctgtgtccctaaata

SEQ ID NO: 4085 - DNA, 25 bp, Mus musculus
cacctgtctgtgtccctaaatagat

SEQ ID NO: 4086 - DNA, 25 bp, Mus musculus
tctgtgtccctaaatagatgggcca

SEQ ID NO: 4087 - DNA, 25 bp, Mus musculus
tttccattcattcgcatggccattt

SEQ ID NO: 4088 - DNA, 25 bp, Mus musculus
ccattcattcgcatggccatttggc

SEQ ID NO: 4089 - DNA, 25 bp, Mus musculus
aacctggttacctcactcaggatga

SEQ ID NO: 4090 - DNA, 25 bp, Mus musculus
ctggttacctcactcaggatgatac

SEQ ID NO: 4091 - DNA, 25 bp, Mus musculus
gttacctcactcaggatgatactct

SEQ ID NO: 4092 - DNA, 25 bp, Mus musculus
atgatactctcaagttctatccaaa

SEQ ID NO: 4093 - DNA, 25 bp, Mus musculus
atactctcaagttctatccaaatta

SEQ ID NO: 4094 - DNA, 25 bp, Mus musculus
ctctcaagttctatccaaattaatg

SEQ ID NO: 4095 - DNA, 25 bp, Mus musculus
tcaagttctatccaaattaatgatg

SEQ ID NO: 4096 - DNA, 25 bp, Mus musculus
agttctatccaaattaatgatgcct

SEQ ID NO: 4097 - DNA, 25 bp, Mus musculus
gttctatccaaattaatgatgcctt

SEQ ID NO: 4098 - DNA, 25 bp, Mus musculus
ttctatccaaattaatgatgccttc

SEQ ID NO: 4099 - DNA, 25 bp, Mus musculus
ttcattcgcatggccatttggccat

SEQ ID NO: 4100 - DNA, 25 bp, Mus musculus
cagttccattcctccatctgccttt

SEQ ID NO: 4101 - DNA, 25 bp, Mus musculus
ttccccttctacatgagattcaagc

SEQ ID NO: 4102 - DNA, 25 bp, Mus musculus
cccttctacatgagattcaagcatc

SEQ ID NO: 4103 - DNA, 25 bp, Mus musculus
tatataccatgcatgccattttgga

SEQ ID NO: 4104 - DNA, 25 bp, Mus musculus
ataccatgcatgccattttggaacc

SEQ ID NO: 4105 - DNA, 25 bp, Mus musculus
tgcatgccattttggaacctggtta

SEQ ID NO: 4106 - DNA, 25 bp, Mus musculus
tggaacctggttacctcactcagga

SEQ ID NO: 4107 - DNA, 25 bp, Mus musculus
tgtgagctacctgatggccatggag

SEQ ID NO: 4108 - DNA, 25 bp, Mus musculus
gtgagctacctgatggccatggaga

SEQ ID NO: 4109 - DNA, 25 bp, Mus musculus
cagcatccgcagcgtcatgcagaag

SEQ ID NO: 4110 - DNA, 25 bp, Mus musculus
agcatccgcagcgtcatgcagaagt

SEQ ID NO: 4111 - DNA, 25 bp, Mus musculus
catccgcagcgtcatgcagaagtat

SEQ ID NO: 4112 - DNA, 25 bp, Mus musculus
atccgcagcgtcatgcagaagtatc

SEQ ID NO: 4113 - DNA, 25 bp, Mus musculus
ccgcagcgtcatgcagaagtatcta

SEQ ID NO: 4114 - DNA, 25 bp, Mus musculus
cgcagcgtcatgcagaagtatctag

SEQ ID NO: 4115 - DNA, 25 bp, Mus musculus
aagatcttctcacagaagttaggat

SEQ ID NO: 4116 - DNA, 25 bp, Mus musculus
gatcttctcacagaagttaggatac

SEQ ID NO: 4117 - DNA, 25 bp, Mus musculus
atcttctcacagaagttaggatacc

SEQ ID NO: 4118 - DNA, 25 bp, Mus musculus
cttctcacagaagttaggatacctg

SEQ ID NO: 4119 - DNA, 25 bp, Mus musculus
gagctacctgatggccatggagaag

SEQ ID NO: 4120 - DNA, 25 bp, Mus musculus
agctacctgatggccatggagaaga

SEQ ID NO: 4121 - DNA, 25 bp, Mus musculus
ctacctgatggccatggagaagagc

SEQ ID NO: 4122 - DNA, 25 bp, Mus musculus
gcgcgcgccagcaagaagatcctgc

SEQ ID NO: 4123 - DNA, 25 bp, Mus musculus
caagaagatcctgctgccagagccc

SEQ ID NO: 4124 - DNA, 25 bp, Mus musculus
gaagatcctgctgccagagcccagc

SEQ ID NO: 4125 - DNA, 25 bp, Mus musculus
agagcccagcatccgcagcgtcatg

SEQ ID NO: 4126 - DNA, 25 bp, Mus musculus
gcccagcatccgcagcgtcatgcag

SEQ ID NO: 4127 - DNA, 25 bp, Mus musculus
tgaggtcctcacctgcctctcagct

SEQ ID NO: 4128 - DNA, 25 bp, Mus musculus
ctcagctgacactggaatcttcatc

SEQ ID NO: 4129 - DNA, 25 bp, Mus musculus
tacagccaccattgtgagtcatgtc

SEQ ID NO: 4130 - DNA, 25 bp, Mus musculus
tcatgtctgtaatgctgggataatt

SEQ ID NO: 4131 - DNA, 25 bp, Mus musculus
gacagaccaggacctaaaatgagac

SEQ ID NO: 4132 - DNA, 25 bp, Mus musculus
atgagactctgtctccaaaggaaaa

SEQ ID NO: 4133 - DNA, 25 bp, Mus musculus
ctctgtctccaaaggaaaacagaca

SEQ ID NO: 4134 - DNA, 25 bp, Mus musculus
atatatagccagtcatcagaataca

SEQ ID NO: 4135 - DNA, 25 bp, Mus musculus
tacatggcaatccaattttgagagc

SEQ ID NO: 4136 - DNA, 25 bp, Mus musculus
gagcccccaaactttgagtctgctg

SEQ ID NO: 4137 - DNA, 25 bp, Mus musculus
tttgagtctgctgtttaaatgttgc

SEQ ID NO: 4138 - DNA, 25 bp, Mus musculus
atgttgcagcgtttgaatagaaata

SEQ ID NO: 4139 - DNA, 25 bp, Mus musculus
agctgacactggaatcttcatccgt

SEQ ID NO: 4140 - DNA, 25 bp, Mus musculus
gaaataaatgctcctgtcatatacc

SEQ ID NO: 4141 - DNA, 25 bp, Mus musculus
tggaatcttcatccgttggatcttc

SEQ ID NO: 4142 - DNA, 25 bp, Mus musculus
aatcttcatccgttggatcttcaat

SEQ ID NO: 4143 - DNA, 25 bp, Mus musculus
gtgacacttcctttcatcctataaa

SEQ ID NO: 4144 - DNA, 25 bp, Mus musculus
tgtcagttaccactcaggtacagcc

SEQ ID NO: 4145 - DNA, 25 bp, Mus musculus
ttaccactcaggtacagccaccatt

SEQ ID NO: 4146 - DNA, 25 bp, Mus musculus
ctcaggtacagccaccattgtgagt

SEQ ID NO: 4147 - DNA, 25 bp, Mus musculus
aggtacagccaccattgtgagtcat

SEQ ID NO: 4148 - DNA, 25 bp, Mus musculus
ttcggatccatgctaacatctacct

SEQ ID NO: 4149 - DNA, 25 bp, Mus musculus
atgctaacatctaccttgatgaaga

SEQ ID NO: 4150 - DNA, 25 bp, Mus musculus
ttaacaagatcacaaacgtgtcagc

SEQ ID NO: 4151 - DNA, 25 bp, Mus musculus
tcacaaacgtgtcagccatcatcaa

SEQ ID NO: 4152 - DNA, 25 bp, Mus musculus
caaacgtgtcagccatcatcaagcc

SEQ ID NO: 4153 - DNA, 25 bp, Mus musculus
gtctgtcagctctgtctgaagtgaa

SEQ ID NO: 4154 - DNA, 25 bp, Mus musculus
tgtcagctctgtctgaagtgaaggt

SEQ ID NO: 4155 - DNA, 25 bp, Mus musculus
aggtgcagcctggctcgtacctgcc

SEQ ID NO: 4156 - DNA, 25 bp, Mus musculus
tgcagcctggctcgtacctgcccag

SEQ ID NO: 4157 - DNA, 25 bp, Mus musculus
tgcccagcaaccctgaagcaatcgt

SEQ ID NO: 4158 - DNA, 25 bp, Mus musculus
ccagcaaccctgaagcaatcgtgct

SEQ ID NO: 4159 - DNA, 25 bp, Mus musculus
gcaaccctgaagcaatcgtgctaga

SEQ ID NO: 4160 - DNA, 25 bp, Mus musculus
ctaacatctaccttgatgaagaagg

SEQ ID NO: 4161 - DNA, 25 bp, Mus musculus
ggcaccagaaagaccctgacatcgg

SEQ ID NO: 4162 - DNA, 25 bp, Mus musculus
accagaaagaccctgacatcggtga

SEQ ID NO: 4163 - DNA, 25 bp, Mus musculus
aagaccctgacatcggtgacctcct

SEQ ID NO: 4164 - DNA, 25 bp, Mus musculus
gtgacctcctggagcagttagtaga

SEQ ID NO: 4165 - DNA, 25 bp, Mus musculus
ggtctctatcaggcccagccaaaga

SEQ ID NO: 4166 - DNA, 25 bp, Mus musculus
ctctatcaggcccagccaaagattt

SEQ ID NO: 4167 - DNA, 25 bp, Mus musculus
caggcccagccaaagatttctatca

SEQ ID NO: 4168 - DNA, 25 bp, Mus musculus
gtgaaagccacttctaggggttgca

SEQ ID NO: 4169 - DNA, 25 bp, Mus musculus
gccacttctaggggttgcatcacta

SEQ ID NO: 4170 - DNA, 25 bp, Mus musculus
accattgtgcattgtagagggcgtc

SEQ ID NO: 4171 - DNA, 25 bp, Mus musculus
atattctgcctgagaaaggaagtga

SEQ ID NO: 4172 - DNA, 25 bp, Mus musculus
aaaggctgagctctctctctgacgt

SEQ ID NO: 4173 - DNA, 25 bp, Mus musculus
ctctctctgacgtatgtagcctctg

SEQ ID NO: 4174 - DNA, 25 bp, Mus musculus
tatgtagcctctggttagcttcgtc

SEQ ID NO: 4175 - DNA, 25 bp, Mus musculus
gcctctggttagcttcgtcactcac

SEQ ID NO: 4176 - DNA, 25 bp, Mus musculus
cactcactgttcttgactcagcatg

SEQ ID NO: 4177 - DNA, 25 bp, Mus musculus
ttgactcagcatggcaatctgatga

SEQ ID NO: 4178 - DNA, 25 bp, Mus musculus
ctgatgaaattcccagctgtaagtc

SEQ ID NO: 4179 - DNA, 25 bp, Mus musculus
aaattcccagctgtaagtctgcaga

SEQ ID NO: 4180 - DNA, 25 bp, Mus musculus
tgctcctaagctaacctgctgtttt

SEQ ID NO: 4181 - DNA, 25 bp, Mus musculus
taagctaacctgctgttttccacat

SEQ ID NO: 4182 - DNA, 25 bp, Mus musculus
tgtggcacagaccttaacagtgcaa

SEQ ID NO: 4183 - DNA, 25 bp, Mus musculus
agtgcaagcatctcagctcgtctta

SEQ ID NO: 4184 - DNA, 25 bp, Mus musculus
agcatctcagctcgtcttactgcat

SEQ ID NO: 4185 - DNA, 25 bp, Mus musculus
tcagctcgtcttactgcatcagatg

SEQ ID NO: 4186 - DNA, 25 bp, Mus musculus
cgtcttactgcatcagatgctggtt

SEQ ID NO: 4187 - DNA, 25 bp, Mus musculus
gctggttcttcaagatcccatttaa

SEQ ID NO: 4188 - DNA, 25 bp, Mus musculus
cagaccccatggacatgtcccttga

SEQ ID NO: 4189 - DNA, 25 bp, Mus musculus
ccatggacatgtcccttgacaaggc

SEQ ID NO: 4190 - DNA, 25 bp, Mus musculus
agtcacactacccaactatgacaac

SEQ ID NO: 4191 - DNA, 25 bp, Mus musculus
caactatgacaacgtcccaggcaat

SEQ ID NO: 4192 - DNA, 25 bp, Mus musculus
ctatgacaacgtcccaggcaatctc

SEQ ID NO: 4193 - DNA, 25 bp, Mus musculus
caacgtcccaggcaatctcatgctc

SEQ ID NO: 4194 - DNA, 25 bp, Mus musculus
cccaggcaatctcatgctcagcgcg

SEQ ID NO: 4195 - DNA, 25 bp, Mus musculus
caatctcatgctcagcgcgctgggc

SEQ ID NO: 4196 - DNA, 25 bp, Mus musculus
tctcatgctcagcgcgctgggcctg

SEQ ID NO: 4197 - DNA, 25 bp, Mus musculus
cctgcgtctaggagaccgagtgctc

SEQ ID NO: 4198 - DNA, 25 bp, Mus musculus
agaccgagtgctcctcgatggccag

SEQ ID NO: 4199 - DNA, 25 bp, Mus musculus
cctcgatggccagaagacgggcacg

SEQ ID NO: 4200 - DNA, 25 bp, Mus musculus
tggacatgtcccttgacaaggcaga

SEQ ID NO: 4201 - DNA, 25 bp, Mus musculus
acatgtcccttgacaaggcagaggc

SEQ ID NO: 4202 - DNA, 25 bp, Mus musculus
aggcagccctggtggccaaggaact

SEQ ID NO: 4203 - DNA, 25 bp, Mus musculus
cagccctggtggccaaggaactgcg

SEQ ID NO: 4204 - DNA, 25 bp, Mus musculus
ccaaggaactgcggacgctgctaga

SEQ ID NO: 4205 - DNA, 25 bp, Mus musculus
aactgcggacgctgctagaagaggc

SEQ ID NO: 4206 - DNA, 25 bp, Mus musculus
ctgcacccttcctaaagtcacacta

SEQ ID NO: 4207 - DNA, 25 bp, Mus musculus
taaagtcacactacccaactatgac

SEQ ID NO: 4208 - DNA, 25 bp, Mus musculus
actgcttttccaagtctctgaatat

SEQ ID NO: 4209 - DNA, 25 bp, Mus musculus
tttccaagtctctgaatatctttgg

SEQ ID NO: 4210 - DNA, 25 bp, Mus musculus
ctgtcctccagctgaacccagctat

SEQ ID NO: 4211 - DNA, 25 bp, Mus musculus
tccagctgaacccagctatccctgg

SEQ ID NO: 4212 - DNA, 25 bp, Mus musculus
tgaacccagctatccctggagtctt

SEQ ID NO: 4213 - DNA, 25 bp, Mus musculus
acccagctatccctggagtctttgg

SEQ ID NO: 4214 - DNA, 25 bp, Mus musculus
cagctatccctggagtctttggtgg

SEQ ID NO: 4215 - DNA, 25 bp, Mus musculus
ttggtggcccttacccatttggcat

SEQ ID NO: 4216 - DNA, 25 bp, Mus musculus
ggaacatcgcaaccaacaagctgac

SEQ ID NO: 4217 - DNA, 25 bp, Mus musculus
acaagctgaccttcctcaactcctt

SEQ ID NO: 4218 - DNA, 25 bp, Mus musculus
ttgggatcatccacatgctgttcgg

SEQ ID NO: 4219 - DNA, 25 bp, Mus musculus
ggatcatccacatgctgttcggggt

SEQ ID NO: 4220 - DNA, 25 bp, Mus musculus
ccaagtctctgaatatctttgggtc

SEQ ID NO: 4221 - DNA, 25 bp, Mus musculus
gggtcagcctgagccttttcaacca

SEQ ID NO: 4222 - DNA, 25 bp, Mus musculus
atatctttgggtcatcatggagcgt

SEQ ID NO: 4223 - DNA, 25 bp, Mus musculus
tctttgggtcatcatggagcgtacg

SEQ ID NO: 4224 - DNA, 25 bp, Mus musculus
tacggccaatgttcaccatagggaa

SEQ ID NO: 4225 - DNA, 25 bp, Mus musculus
caatgttcaccatagggaactggac

SEQ ID NO: 4226 - DNA, 25 bp, Mus musculus
tgttcaccatagggaactggacgga

SEQ ID NO: 4227 - DNA, 25 bp, Mus musculus
tcaccatagggaactggacggagga

SEQ ID NO: 4228 - DNA, 25 bp, Mus musculus
cgctcctggggagttctgtcctcca

SEQ ID NO: 4229 - DNA, 25 bp, Mus musculus
gaaccaaagctctcatggatgaagt

SEQ ID NO: 4230 - DNA, 25 bp, Mus musculus
cctccaatggctgtgtcaccattat

SEQ ID NO: 4231 - DNA, 25 bp, Mus musculus
cccgtatgtgctgcgtgtgccatca

SEQ ID NO: 4232 - DNA, 25 bp, Mus musculus
gccatcaatatcacattcagcaagt

SEQ ID NO: 4233 - DNA, 25 bp, Mus musculus
aatatcacattcagcaagtcttaat

SEQ ID NO: 4234 - DNA, 25 bp, Mus musculus
acattcagcaagtcttaattctgtc

SEQ ID NO: 4235 - DNA, 25 bp, Mus musculus
catcatcatttgttagtctcttcaa

SEQ ID NO: 4236 - DNA, 25 bp, Mus musculus
tcttcaagatctcatcaggatttcc

SEQ ID NO: 4237 - DNA, 25 bp, Mus musculus
agatctcatcaggatttcccacagt

SEQ ID NO: 4238 - DNA, 25 bp, Mus musculus
catcaggatttcccacagtccttcc

SEQ ID NO: 4239 - DNA, 25 bp, Mus musculus
aggaaacattctcatgtcaactatt

SEQ ID NO: 4240 - DNA, 25 bp, Mus musculus
cattctcatgtcaactattaaagaa

SEQ ID NO: 4241 - DNA, 25 bp, Mus musculus
ctacttgctgcgccaaatggggcac

SEQ ID NO: 4242 - DNA, 25 bp, Mus musculus
tagaggccctcagcaacatgtaatt

SEQ ID NO: 4243 - DNA, 25 bp, Mus musculus
aatgtacttgcttcctgtttcctgc

SEQ ID NO: 4244 - DNA, 25 bp, Mus musculus
cttgcttcctgtttcctgcgcacag

SEQ ID NO: 4245 - DNA, 25 bp, Mus musculus
cgcacaggaccagaaccaactcaac

SEQ ID NO: 4246 - DNA, 25 bp, Mus musculus
ctatatctcaacatttgttaacctc

SEQ ID NO: 4247 - DNA, 25 bp, Mus musculus
tgaatcaagacgcccgtatgtgctg

SEQ ID NO: 4248 - DNA, 25 bp, Mus musculus
aagacgcccgtatgtgctgcgtgtg

SEQ ID NO: 4249 - DNA, 25 bp, Mus musculus
gaccctgctgtacccagtagctact

SEQ ID NO: 4250 - DNA, 25 bp, Mus musculus
cctgctgtacccagtagctactcag

SEQ ID NO: 4251 - DNA, 25 bp, Mus musculus
ttttctgacacaagaacttgtaagc

SEQ ID NO: 4252 - DNA, 25 bp, Mus musculus
cagcggtacctagtagctgataaac

SEQ ID NO: 4253 - DNA, 25 bp, Mus musculus
ggatctatactctgctacactggaa

SEQ ID NO: 4254 - DNA, 25 bp, Mus musculus
tctatactctgctacactggaaatg

SEQ ID NO: 4255 - DNA, 25 bp, Mus musculus
atactctgctacactggaaatgaag

SEQ ID NO: 4256 - DNA, 25 bp, Mus musculus
ctctgctacactggaaatgaagggg

SEQ ID NO: 4257 - DNA, 25 bp, Mus musculus
gacattgtctggttttgtaataata

SEQ ID NO: 4258 - DNA, 25 bp, Mus musculus
atgctggtgtctgctgagcatcgat

SEQ ID NO: 4259 - DNA, 25 bp, Mus musculus
gtgtctgctgagcatcgatacgagg

SEQ ID NO: 4260 - DNA, 25 bp, Mus musculus
tctgctgagcatcgatacgagggga

SEQ ID NO: 4261 - DNA, 25 bp, Mus musculus
gctgtacccagtagctactcagttc

SEQ ID NO: 4262 - DNA, 25 bp, Mus musculus
gtacccagtagctactcagttcatt

SEQ ID NO: 4263 - DNA, 25 bp, Mus musculus
cccagtagctactcagttcattact

SEQ ID NO: 4264 - DNA, 25 bp, Mus musculus
agtagctactcagttcattacttcc

SEQ ID NO: 4265 - DNA, 25 bp, Mus musculus
tactcagttcattacttccaacaga

SEQ ID NO: 4266 - DNA, 25 bp, Mus musculus
tcagttcattacttccaacagaagg

SEQ ID NO: 4267 - DNA, 25 bp, Mus musculus
gttcattacttccaacagaaggttg

SEQ ID NO: 4268 - DNA, 25 bp, Mus musculus
tacttccaacagaaggttgaccact

SEQ ID NO: 4269 - DNA, 25 bp, Mus musculus
gagctataagccttctggcttctct

SEQ ID NO: 4270 - DNA, 25 bp, Mus musculus
taagccttctggcttctctactgtg

SEQ ID NO: 4271 - DNA, 25 bp, Mus musculus
ggcatcagaaaccctgaaactggag

SEQ ID NO: 4272 - DNA, 25 bp, Mus musculus
tagatagctgagcccaccttgtggg

SEQ ID NO: 4273 - DNA, 25 bp, Mus musculus
agcaagaacaggcgctcataactgt

SEQ ID NO: 4274 - DNA, 25 bp, Mus musculus
aacaggcgctcataactgtctagct

SEQ ID NO: 4275 - DNA, 25 bp, Mus musculus
cgctcataactgtctagctaaagtt

SEQ ID NO: 4276 - DNA, 25 bp, Mus musculus
taactgtctagctaaagttatggat

SEQ ID NO: 4277 - DNA, 25 bp, Mus musculus
ttcaaggtcatttgtggctacacaa

SEQ ID NO: 4278 - DNA, 25 bp, Mus musculus
gtcatttgtggctacacaaggagct

SEQ ID NO: 4279 - DNA, 25 bp, Mus musculus
atttgtggctacacaaggagcttga

SEQ ID NO: 4280 - DNA, 25 bp, Mus musculus
gtgcttcctgatatacataagaatt

SEQ ID NO: 4281 - DNA, 25 bp, Mus musculus
ttctggcttctctactgtgcacctt

SEQ ID NO: 4282 - DNA, 25 bp, Mus musculus
tactgtgcacctttgttgatgtcta

SEQ ID NO: 4283 - DNA, 25 bp, Mus musculus
gcacctttgttgatgtctatagttt

SEQ ID NO: 4284 - DNA, 25 bp, Mus musculus
tttagctgcatgcattttatgtaac

SEQ ID NO: 4285 - DNA, 25 bp, Mus musculus
atgtaacccacatgcatgcagtacc

SEQ ID NO: 4286 - DNA, 25 bp, Mus musculus
taacccacatgcatgcagtacctgt

SEQ ID NO: 4287 - DNA, 25 bp, Mus musculus
cccacatgcatgcagtacctgtaga

SEQ ID NO: 4288 - DNA, 25 bp, Mus musculus
tgcatgcagtacctgtagaggtcac

SEQ ID NO: 4289 - DNA, 25 bp, Mus musculus
ctcagaggccaggctccgcagagat

SEQ ID NO: 4290 - DNA, 25 bp, Mus musculus
ccaggctccgcagagatcctagctg

SEQ ID NO: 4291 - DNA, 25 bp, Mus musculus
gctgaactcgttggcgatggtctcg

SEQ ID NO: 4292 - DNA, 25 bp, Mus musculus
tgaactcgttggcgatggtctcgat

SEQ ID NO: 4293 - DNA, 25 bp, Mus musculus
aactcgttggcgatggtctcgatgc

SEQ ID NO: 4294 - DNA, 25 bp, Mus musculus
ctcgttggcgatggtctcgatgccc

SEQ ID NO: 4295 - DNA, 25 bp, Mus musculus
cgttggcgatggtctcgatgccccc

SEQ ID NO: 4296 - DNA, 25 bp, Mus musculus
cggccccgtgccactgcaatgtagc

SEQ ID NO: 4297 - DNA, 25 bp, Mus musculus
gccccgtgccactgcaatgtagcag

SEQ ID NO: 4298 - DNA, 25 bp, Mus musculus
cgtgccactgcaatgtagcagctct

SEQ ID NO: 4299 - DNA, 25 bp, Mus musculus
tgccactgcaatgtagcagctctgc

SEQ ID NO: 4300 - DNA, 25 bp, Mus musculus
actgcaatgtagcagctctgcgagc

SEQ ID NO: 4301 - DNA, 25 bp, Mus musculus
gctccgcagagatcctagctgaggt

SEQ ID NO: 4302 - DNA, 25 bp, Mus musculus
tgcaatgtagcagctctgcgagccc

SEQ ID NO: 4303 - DNA, 25 bp, Mus musculus
tccgcagagatcctagctgaggtgg

SEQ ID NO: 4304 - DNA, 25 bp, Mus musculus
ggtcgccggatgtcacggttctcta

SEQ ID NO: 4305 - DNA, 25 bp, Mus musculus
tcgccggatgtcacggttctctaaa

SEQ ID NO: 4306 - DNA, 25 bp, Mus musculus
ttacggggtgcagcggtcgctgaac

SEQ ID NO: 4307 - DNA, 25 bp, Mus musculus
tgcagcggtcgctgaactcgttggc

SEQ ID NO: 4308 - DNA, 25 bp, Mus musculus
gcggtcgctgaactcgttggcgatg

SEQ ID NO: 4309 - DNA, 25 bp, Mus musculus
tcgctgaactcgttggcgatggtct

SEQ ID NO: 4310 - DNA, 25 bp, Mus musculus
gctatctgccttgcctgtatctgga

SEQ ID NO: 4311 - DNA, 25 bp, Mus musculus
tgccttgcctgtatctggaatcctc

SEQ ID NO: 4312 - DNA, 25 bp, Mus musculus
tatattctccagaccctgcaacctc

SEQ ID NO: 4313 - DNA, 25 bp, Mus musculus
caacctccatggaacattccagatc

SEQ ID NO: 4314 - DNA, 25 bp, Mus musculus
aacattccagatctgaccttctctc

SEQ ID NO: 4315 - DNA, 25 bp, Mus musculus
gaacactgggccccatagtcacggc

SEQ ID NO: 4316 - DNA, 25 bp, Mus musculus
ccatagtcacggccagtcctcaagc

SEQ ID NO: 4317 - DNA, 25 bp, Mus musculus
caggtctgctcaggatgagactccc

SEQ ID NO: 4318 - DNA, 25 bp, Mus musculus
ggaagaacactccagccggacagga

SEQ ID NO: 4319 - DNA, 25 bp, Mus musculus
attgcagagactcgccaacccttca

SEQ ID NO: 4320 - DNA, 25 bp, Mus musculus
cgccaacccttcactgaagtggctc

SEQ ID NO: 4321 - DNA, 25 bp, Mus musculus
cccttcactgaagtggctctcctgt

SEQ ID NO: 4322 - DNA, 25 bp, Mus musculus
gcctgtatctggaatcctccatggg

SEQ ID NO: 4323 - DNA, 25 bp, Mus musculus
aatcctccatgggccagattcctgg

SEQ ID NO: 4324 - DNA, 25 bp, Mus musculus
ccatgggccagattcctggctctgc

SEQ ID NO: 4325 - DNA, 25 bp, Mus musculus
ttcctggctctgcctttattcccta

SEQ ID NO: 4326 - DNA, 25 bp, Mus musculus
agttattgccctttggccagcaggt

SEQ ID NO: 4327 - DNA, 25 bp, Mus musculus
agcaggtttctctcttgggcaggca

SEQ ID NO: 4328 - DNA, 25 bp, Mus musculus
tttctctcttgggcaggcaagacac

SEQ ID NO: 4329 - DNA, 25 bp, Mus musculus
gcacagattcccaaagcaccttatt

SEQ ID NO: 4330 - DNA, 25 bp, Mus musculus
ccgagcctcgtcgtctactgatggc

SEQ ID NO: 4331 - DNA, 25 bp, Mus musculus
ctcgtcgtctactgatggccagctg

SEQ ID NO: 4332 - DNA, 25 bp, Mus musculus
caacttcatcaaggtgttaggcaaa

SEQ ID NO: 4333 - DNA, 25 bp, Mus musculus
cttcatcaaggtgttaggcaaaggc

SEQ ID NO: 4334 - DNA, 25 bp, Mus musculus
catgctggccgagctcaagggtaag

SEQ ID NO: 4335 - DNA, 25 bp, Mus musculus
gctggccgagctcaagggtaaggat

SEQ ID NO: 4336 - DNA, 25 bp, Mus musculus
tgaagtctatgctgtgaaggtctta

SEQ ID NO: 4337 - DNA, 25 bp, Mus musculus
agtctatgctgtgaaggtcttaaag

SEQ ID NO: 4338 - DNA, 25 bp, Mus musculus
catcctgcaggatgacgacgtggac

SEQ ID NO: 4339 - DNA, 25 bp, Mus musculus
cctgcaggatgacgacgtggactgc

SEQ ID NO: 4340 - DNA, 25 bp, Mus musculus
tgacgacgtggactgcacgatgaca

SEQ ID NO: 4341 - DNA, 25 bp, Mus musculus
cgacgtggactgcacgatgacagag

SEQ ID NO: 4342 - DNA, 25 bp, Mus musculus
gtcgtctactgatggccagctggca

SEQ ID NO: 4343 - DNA, 25 bp, Mus musculus
gtctactgatggccagctggcaagc

SEQ ID NO: 4344 - DNA, 25 bp, Mus musculus
tactgatggccagctggcaagccct

SEQ ID NO: 4345 - DNA, 25 bp, Mus musculus
tgatggccagctggcaagccctggc

SEQ ID NO: 4346 - DNA, 25 bp, Mus musculus
ccagctggcaagccctggcgagaac

SEQ ID NO: 4347 - DNA, 25 bp, Mus musculus
gcgcttgggcctggatgagttcaac

SEQ ID NO: 4348 - DNA, 25 bp, Mus musculus
tgagttcaacttcatcaaggtgtta

SEQ ID NO: 4349 - DNA, 25 bp, Mus musculus
gttcaacttcatcaaggtgttaggc

SEQ ID NO: 4350 - DNA, 25 bp, Mus musculus
tgtctggtggtacctggctgcagaa

SEQ ID NO: 4351 - DNA, 25 bp, Mus musculus
ctggtggtacctggctgcagaaggt

SEQ ID NO: 4352 - DNA, 25 bp, Mus musculus
ctacccatggcttcccaggccttga

SEQ ID NO: 4353 - DNA, 25 bp, Mus musculus
ccctcatgctggcagtggtgcatct

SEQ ID NO: 4354 - DNA, 25 bp, Mus musculus
tcatgctggcagtggtgcatctgaa

SEQ ID NO: 4355 - DNA, 25 bp, Mus musculus
tgcatctgaagagtcccttccacct

SEQ ID NO: 4356 - DNA, 25 bp, Mus musculus
tgaagagtcccttccacctttgcag

SEQ ID NO: 4357 - DNA, 25 bp, Mus musculus
tccacctttgcagcaaccccgtaag

SEQ ID NO: 4358 - DNA, 25 bp, Mus musculus
ttgggctagttggctgctgactgat

SEQ ID NO: 4359 - DNA, 25 bp, Mus musculus
ggctagttggctgctgactgatcct

SEQ ID NO: 4360 - DNA, 25 bp, Mus musculus
ttggctgctgactgatcctcatccc

SEQ ID NO: 4361 - DNA, 25 bp, Mus musculus
tcatccctgccatggccgctgttac

SEQ ID NO: 4362 - DNA, 25 bp, Mus musculus
gtggtacctggctgcagaaggttat

SEQ ID NO: 4363 - DNA, 25 bp, Mus musculus
ctgccatggccgctgttacctatcc

SEQ ID NO: 4364 - DNA, 25 bp, Mus musculus
aggttatccagcctggcgactgcaa

SEQ ID NO: 4365 - DNA, 25 bp, Mus musculus
aagggaattcttgccctgtgcgaga

SEQ ID NO: 4366 - DNA, 25 bp, Mus musculus
attcttgccctgtgcgagaatcttg

SEQ ID NO: 4367 - DNA, 25 bp, Mus musculus
gccctgtgcgagaatcttggaacct

SEQ ID NO: 4368 - DNA, 25 bp, Mus musculus
cttggaacctccatgcagcagaatg

SEQ ID NO: 4369 - DNA, 25 bp, Mus musculus
tgcaagctacccatggcttcccagg

SEQ ID NO: 4370 - DNA, 25 bp, Mus musculus
aagctacccatggcttcccaggcct

SEQ ID NO: 4371 - DNA, 25 bp, Mus musculus
ttatttggttgccttcctgtccaag

SEQ ID NO: 4372 - DNA, 25 bp, Mus musculus
atttggttgccttcctgtccaagct

SEQ ID NO: 4373 - DNA, 25 bp, Mus musculus
tgttgcccccggtttattgtcatgt

SEQ ID NO: 4374 - DNA, 25 bp, Mus musculus
tgcccccggtttattgtcatgttct

SEQ ID NO: 4375 - DNA, 25 bp, Mus musculus
agtgggtctagggtctgctgactgt

SEQ ID NO: 4376 - DNA, 25 bp, Mus musculus
gtctagggtctgctgactgtacata

SEQ ID NO: 4377 - DNA, 25 bp, Mus musculus
tctagggtctgctgactgtacataa

SEQ ID NO: 4378 - DNA, 25 bp, Mus musculus
ggtctgctgactgtacataagacag

SEQ ID NO: 4379 - DNA, 25 bp, Mus musculus
gtctgctgactgtacataagacagt

SEQ ID NO: 4380 - DNA, 25 bp, Mus musculus
ggatcctctctggggctgtgctttg

SEQ ID NO: 4381 - DNA, 25 bp, Mus musculus
ctctggggctgtgctttgagcagcg

SEQ ID NO: 4382 - DNA, 25 bp, Mus musculus
tttgagcagcgtgcagcccgctggt

SEQ ID NO: 4383 - DNA, 25 bp, Mus musculus
tttggttgccttcctgtccaagctt

SEQ ID NO: 4384 - DNA, 25 bp, Mus musculus
tggttgccttcctgtccaagcttcc

SEQ ID NO: 4385 - DNA, 25 bp, Mus musculus
tgccttcctgtccaagcttccactg

SEQ ID NO: 4386 - DNA, 25 bp, Mus musculus
cttcctgtccaagcttccactgact

SEQ ID NO: 4387 - DNA, 25 bp, Mus musculus
tgtccaagcttccactgactgttgc

SEQ ID NO: 4388 - DNA, 25 bp, Mus musculus
gtccaagcttccactgactgttgcc

SEQ ID NO: 4389 - DNA, 25 bp, Mus musculus
agcttccactgactgttgcccccgg

SEQ ID NO: 4390 - DNA, 25 bp, Mus musculus
gcttccactgactgttgcccccggt

SEQ ID NO: 4391 - DNA, 25 bp, Mus musculus
ccacaatacaaccatactttctcac

SEQ ID NO: 4392 - DNA, 25 bp, Mus musculus
caatacaaccatactttctcaccaa

SEQ ID NO: 4393 - DNA, 25 bp, Mus musculus
tacaaatcttccacacaactaatca

SEQ ID NO: 4394 - DNA, 25 bp, Mus musculus
aaatcttccacacaactaatcaaca

SEQ ID NO: 4395 - DNA, 25 bp, Mus musculus
caactaatcaacaacaattccaatc

SEQ ID NO: 4396 - DNA, 25 bp, Mus musculus
ctaatcaacaacaattccaatctct

SEQ ID NO: 4397 - DNA, 25 bp, Mus musculus
aattccaatctcttgctataacctt

SEQ ID NO: 4398 - DNA, 25 bp, Mus musculus
ctcttgctataaccttctacacaat

SEQ ID NO: 4399 - DNA, 25 bp, Mus musculus
ttgctataaccttctacacaattac

SEQ ID NO: 4400 - DNA, 25 bp, Mus musculus
taaccttctacacaattacacatta

SEQ ID NO: 4401 - DNA, 25 bp, Mus musculus
ccttctacacaattacacattactc

SEQ ID NO: 4402 - DNA, 25 bp, Mus musculus
cacacaacacattcaaaacccttca

SEQ ID NO: 4403 - DNA, 25 bp, Mus musculus
catactttctcaccaaacacattat

SEQ ID NO: 4404 - DNA, 25 bp, Mus musculus
actttctcaccaaacacattatcct

SEQ ID NO: 4405 - DNA, 25 bp, Mus musculus
ttctcaccaaacacattatcctaca

SEQ ID NO: 4406 - DNA, 25 bp, Mus musculus
ccaaacacattatcctacatcacaa

SEQ ID NO: 4407 - DNA, 25 bp, Mus musculus
aacacattatcctacatcacaaact

SEQ ID NO: 4408 - DNA, 25 bp, Mus musculus
acattatcctacatcacaaacttct

SEQ ID NO: 4409 - DNA, 25 bp, Mus musculus
tacatcacaaacttcttaccataca

SEQ ID NO: 4410 - DNA, 25 bp, Mus musculus
atcacaaacttcttaccatacaaat

SEQ ID NO: 4411 - DNA, 25 bp, Mus musculus
agatcttgaatctcagggtcgaact

SEQ ID NO: 4412 - DNA, 25 bp, Mus musculus
tcttgaatctcagggtcgaactctc

SEQ ID NO: 4413 - DNA, 25 bp, Mus musculus
tcaaatctgcgcagagttgaagtgg

SEQ ID NO: 4414 - DNA, 25 bp, Mus musculus
cccgggactggtcaacctagatgat

SEQ ID NO: 4415 - DNA, 25 bp, Mus musculus
caacctagatgatcgcctggcgtgg

SEQ ID NO: 4416 - DNA, 25 bp, Mus musculus
cctagatgatcgcctggcgtggacc

SEQ ID NO: 4417 - DNA, 25 bp, Mus musculus
ccgctggtcgtagttgctgccgtag

SEQ ID NO: 4418 - DNA, 25 bp, Mus musculus
gttgctgccgtagacacagcttctt

SEQ ID NO: 4419 - DNA, 25 bp, Mus musculus
gctgccgtagacacagcttcttcgg

SEQ ID NO: 4420 - DNA, 25 bp, Mus musculus
gccgtagacacagcttcttcgggca

SEQ ID NO: 4421 - DNA, 25 bp, Mus musculus
actacctggagttttacaatgtcag

SEQ ID NO: 4422 - DNA, 25 bp, Mus musculus
tttacaatgtcagctaggaaaataa

SEQ ID NO: 4423 - DNA, 25 bp, Mus musculus
tcgaactctctaggggccaggctgc

SEQ ID NO: 4424 - DNA, 25 bp, Mus musculus
tcggcccctacaagtgggcacgctt

SEQ ID NO: 4425 - DNA, 25 bp, Mus musculus
gcccctacaagtgggcacgcttgtg

SEQ ID NO: 4426 - DNA, 25 bp, Mus musculus
agtgggcacgcttgtgcaagcggtc

SEQ ID NO: 4427 - DNA, 25 bp, Mus musculus
gcttgtgcaagcggtcagagttgcg

SEQ ID NO: 4428 - DNA, 25 bp, Mus musculus
ggtcagagttgcgtcatgggacaga

SEQ ID NO: 4429 - DNA, 25 bp, Mus musculus
gtcatgggacagacgcgggtgcttc

SEQ ID NO: 4430 - DNA, 25 bp, Mus musculus
cctgaactgaaccaatcaaatctgc

SEQ ID NO: 4431 - DNA, 25 bp, Mus musculus
acctccaaatgtcaatgtgtgtgac

SEQ ID NO: 4432 - DNA, 25 bp, Mus musculus
tgtgtgtgacgtgaactgggaaaag

SEQ ID NO: 4433 - DNA, 25 bp, Mus musculus
gttcctgtactgcattgctgccctt

SEQ ID NO: 4434 - DNA, 25 bp, Mus musculus
gtactgcattgctgcccttctgctc

SEQ ID NO: 4435 - DNA, 25 bp, Mus musculus
cattgctgcccttctgctctatgtt

SEQ ID NO: 4436 - DNA, 25 bp, Mus musculus
tgcccttctgctctatgttggttac

SEQ ID NO: 4437 - DNA, 25 bp, Mus musculus
ccttctgctctatgttggttacacg

SEQ ID NO: 4438 - DNA, 25 bp, Mus musculus
cctctaccgggatagtcgcaaactg

SEQ ID NO: 4439 - DNA, 25 bp, Mus musculus
ggatagtcgcaaactgcccatgatc

SEQ ID NO: 4440 - DNA, 25 bp, Mus musculus
tagtcgcaaactgcccatgatcgac

SEQ ID NO: 4441 - DNA, 25 bp, Mus musculus
caaactgcccatgatcgactttatt

SEQ ID NO: 4442 - DNA, 25 bp, Mus musculus
gcccatgatcgactttattgttact

SEQ ID NO: 4443 - DNA, 25 bp, Mus musculus
gcatgtcctcataggtgattactcc

SEQ ID NO: 4444 - DNA, 25 bp, Mus musculus
tgtcctcataggtgattactcctct

SEQ ID NO: 4445 - DNA, 25 bp, Mus musculus
tgattactcctcttctgcacagttc

SEQ ID NO: 4446 - DNA, 25 bp, Mus musculus
ctcttctgcacagttctacgttacg

SEQ ID NO: 4447 - DNA, 25 bp, Mus musculus
ctacgttacgtttgcagtctttgtg

SEQ ID NO: 4448 - DNA, 25 bp, Mus musculus
tacgtttgcagtctttgtgttcctg

SEQ ID NO: 4449 - DNA, 25 bp, Mus musculus
gtttgcagtctttgtgttcctgtac

SEQ ID NO: 4450 - DNA, 25 bp, Mus musculus
tgtgttcctgtactgcattgctgcc

SEQ ID NO: 4451 - DNA, 25 bp, Mus musculus
gtcgagattgcccattgccataagg

SEQ ID NO: 4452 - DNA, 25 bp, Mus musculus
attgcccattgccataaggggcagt

SEQ ID NO: 4453 - DNA, 25 bp, Mus musculus
atcttggagccttctcagtgtgata

SEQ ID NO: 4454 - DNA, 25 bp, Mus musculus
accttccagtcagccacaagaacac

SEQ ID NO: 4455 - DNA, 25 bp, Mus musculus
gacagaaccgctcctgctgctgtct

SEQ ID NO: 4456 - DNA, 25 bp, Mus musculus
ttgcttctgaacgccgtcattagac

SEQ ID NO: 4457 - DNA, 25 bp, Mus musculus
ctgaacgccgtcattagaccactta

SEQ ID NO: 4458 - DNA, 25 bp, Mus musculus
attagaccacttatgtcatgagtac

SEQ ID NO: 4459 - DNA, 25 bp, Mus musculus
atgtcatgagtactccaacccaggt

SEQ ID NO: 4460 - DNA, 25 bp, Mus musculus
tgagtactccaacccaggtttcaca

SEQ ID NO: 4461 - DNA, 25 bp, Mus musculus
ttcagaatgtctctccagcaattta

SEQ ID NO: 4462 - DNA, 25 bp, Mus musculus
atgtctctccagcaatttaagtgcc

SEQ ID NO: 4463 - DNA, 25 bp, Mus musculus
tacttcggagaacttgccctggtca

SEQ ID NO: 4464 - DNA, 25 bp, Mus musculus
aaacccagagctgcttccgcttacg

SEQ ID NO: 4465 - DNA, 25 bp, Mus musculus
aggcttctgggcccctgcatggaca

SEQ ID NO: 4466 - DNA, 25 bp, Mus musculus
aagaggaacatctcacattacgaag

SEQ ID NO: 4467 - DNA, 25 bp, Mus musculus
tttggctccaacttggatctgatgg

SEQ ID NO: 4468 - DNA, 25 bp, Mus musculus
tccaacttggatctgatggaccccg

SEQ ID NO: 4469 - DNA, 25 bp, Mus musculus
ttggatctgatggaccccgggcagt

SEQ ID NO: 4470 - DNA, 25 bp, Mus musculus
ctgatggaccccgggcagtagatgt

SEQ ID NO: 4471 - DNA, 25 bp, Mus musculus
ggcaatgccaaatgcagccatgaag

SEQ ID NO: 4472 - DNA, 25 bp, Mus musculus
caatgccaaatgcagccatgaagaa

SEQ ID NO: 4473 - DNA, 25 bp, Mus musculus
atactagaccgtatacatagtcttc

SEQ ID NO: 4474 - DNA, 25 bp, Mus musculus
gcagtttgagcacctactctctcgt

SEQ ID NO: 4475 - DNA, 25 bp, Mus musculus
agtttgagcacctactctctcgtag

SEQ ID NO: 4476 - DNA, 25 bp, Mus musculus
tgagcacctactctctcgtagactc

SEQ ID NO: 4477 - DNA, 25 bp, Mus musculus
ctctcgtagactctgttggaaatac

SEQ ID NO: 4478 - DNA, 25 bp, Mus musculus
ctcgtagactctgttggaaatacaa

SEQ ID NO: 4479 - DNA, 25 bp, Mus musculus
gtagaacattctcatgttcgatttc

SEQ ID NO: 4480 - DNA, 25 bp, Mus musculus
agaacattctcatgttcgatttctg

SEQ ID NO: 4481 - DNA, 25 bp, Mus musculus
aacattctcatgttcgatttctggg

SEQ ID NO: 4482 - DNA, 25 bp, Mus musculus
cattctcatgttcgatttctgggaa

SEQ ID NO: 4483 - DNA, 25 bp, Mus musculus
attatattgccagagacacacgtcg

SEQ ID NO: 4484 - DNA, 25 bp, Mus musculus
tatattgccagagacacacgtcgtc

SEQ ID NO: 4485 - DNA, 25 bp, Mus musculus
tattgccagagacacacgtcgtctt

SEQ ID NO: 4486 - DNA, 25 bp, Mus musculus
gccagagacacacgtcgtcttggtg

SEQ ID NO: 4487 - DNA, 25 bp, Mus musculus
cagagacacacgtcgtcttggtgca

SEQ ID NO: 4488 - DNA, 25 bp, Mus musculus
gacacacgtcgtcttggtgcaacaa

SEQ ID NO: 4489 - DNA, 25 bp, Mus musculus
cacgtcgtcttggtgcaacaatact

SEQ ID NO: 4490 - DNA, 25 bp, Mus musculus
cgtcgtcttggtgcaacaatactag

SEQ ID NO: 4491 - DNA, 25 bp, Mus musculus
atcatctaagggctttgctaaacaa

SEQ ID NO: 4492 - DNA, 25 bp, Mus musculus
ctttgctaaacaagcatatgaaatc

SEQ ID NO: 4493 - DNA, 25 bp, Mus musculus
cccacatccacttagagatgaaaaa

SEQ ID NO: 4494 - DNA, 25 bp, Mus musculus
ccattctcagttcctattgaacggc

SEQ ID NO: 4495 - DNA, 25 bp, Mus musculus
tcagttcctattgaacggcacatgt

SEQ ID NO: 4496 - DNA, 25 bp, Mus musculus
cctattgaacggcacatgtggaact

SEQ ID NO: 4497 - DNA, 25 bp, Mus musculus
atactttatgctgacatcaactctt

SEQ ID NO: 4498 - DNA, 25 bp, Mus musculus
tatgctgacatcaactctttgatgt

SEQ ID NO: 4499 - DNA, 25 bp, Mus musculus
gacatcaactctttgatgttgtctt

SEQ ID NO: 4500 - DNA, 25 bp, Mus musculus
aactctttgatgttgtcttgctaga

SEQ ID NO: 4501 - DNA, 25 bp, Mus musculus
atgttgtcttgctagaaggatttta

SEQ ID NO: 4502 - DNA, 25 bp, Mus musculus
ttttgcgagtgcatcatgcaatgga

SEQ ID NO: 4503 - DNA, 25 bp, Mus musculus
gttcattctaatctctgggagatga

SEQ ID NO: 4504 - DNA, 25 bp, Mus musculus
tctaatctctgggagatgactcttc

SEQ ID NO: 4505 - DNA, 25 bp, Mus musculus
gagatgactcttcaatccagggtgc

SEQ ID NO: 4506 - DNA, 25 bp, Mus musculus
actcttcaatccagggtgccatcag

SEQ ID NO: 4507 - DNA, 25 bp, Mus musculus
ccatcagtaatcatgccactgttca

SEQ ID NO: 4508 - DNA, 25 bp, Mus musculus
gtaatcatgccactgttcacgagtg

SEQ ID NO: 4509 - DNA, 25 bp, Mus musculus
atgccactgttcacgagtgttgtta

SEQ ID NO: 4510 - DNA, 25 bp, Mus musculus
attgactagcctcagtccctctaga

SEQ ID NO: 4511 - DNA, 25 bp, Mus musculus
tggcctcttgcattggctccataat

SEQ ID NO: 4512 - DNA, 25 bp, Mus musculus
cctcttgcattggctccataatgat

SEQ ID NO: 4513 - DNA, 25 bp, Mus musculus
gagtacacgcatttcaacacatgac

SEQ ID NO: 4514 - DNA, 25 bp, Mus musculus
ttcaacacatgactgatgagattta

SEQ ID NO: 4515 - DNA, 25 bp, Mus musculus
taatgtgaatccacgcaccaaaagg

SEQ ID NO: 4516 - DNA, 25 bp, Mus musculus
gaatccacgcaccaaaaggacgaat

SEQ ID NO: 4517 - DNA, 25 bp, Mus musculus
gacgaatctgagccctaatgattgt

SEQ ID NO: 4518 - DNA, 25 bp, Mus musculus
gaatctgagccctaatgattgtgat

SEQ ID NO: 4519 - DNA, 25 bp, Mus musculus
tctgagccctaatgattgtgatcct

SEQ ID NO: 4520 - DNA, 25 bp, Mus musculus
taatgatgttcgttggctcaaagaa

SEQ ID NO: 4521 - DNA, 25 bp, Mus musculus
tgttcgttggctcaaagaagcttct

SEQ ID NO: 4522 - DNA, 25 bp, Mus musculus
agaagcttctagggcatcttaggag

SEQ ID NO: 4523 - DNA, 25 bp, Mus musculus
gcattggctccataatgatagtgct

SEQ ID NO: 4524 - DNA, 25 bp, Mus musculus
ttggctccataatgatagtgctgca

SEQ ID NO: 4525 - DNA, 25 bp, Mus musculus
catcaattctgttcccatgatctaa

SEQ ID NO: 4526 - DNA, 25 bp, Mus musculus
ttctgttcccatgatctaaacgcgt

SEQ ID NO: 4527 - DNA, 25 bp, Mus musculus
tgttcccatgatctaaacgcgtagt

SEQ ID NO: 4528 - DNA, 25 bp, Mus musculus
tcccatgatctaaacgcgtagtcag

SEQ ID NO: 4529 - DNA, 25 bp, Mus musculus
ctaaacgcgtagtcagcaacggagt

SEQ ID NO: 4530 - DNA, 25 bp, Mus musculus
aacgcgtagtcagcaacggagtaca

SEQ ID NO: 4531 - DNA, 25 bp, Mus musculus
tagtctaactttctcatgtggtgct

SEQ ID NO: 4532 - DNA, 25 bp, Mus musculus
aactttctcatgtggtgcttctgta

SEQ ID NO: 4533 - DNA, 25 bp, Mus musculus
aatggccaatcaaacttcccattag

SEQ ID NO: 4534 - DNA, 25 bp, Mus musculus
caatcaaacttcccattagacaaag

SEQ ID NO: 4535 - DNA, 25 bp, Mus musculus
ttcattcttcccacagatattcaca

SEQ ID NO: 4536 - DNA, 25 bp, Mus musculus
cttcccacagatattcacatggtaa

SEQ ID NO: 4537 - DNA, 25 bp, Mus musculus
attcacatggtaaacctgaggtcat

SEQ ID NO: 4538 - DNA, 25 bp, Mus musculus
cccacgtgccctgtgctttaatctt

SEQ ID NO: 4539 - DNA, 25 bp, Mus musculus
tgccctgtgctttaatctttaactc

SEQ ID NO: 4540 - DNA, 25 bp, Mus musculus
ttaactcaacacgtccctgataact

SEQ ID NO: 4541 - DNA, 25 bp, Mus musculus
caacacgtccctgataactttgagc

SEQ ID NO: 4542 - DNA, 25 bp, Mus musculus
gtccctgataactttgagcattctt

SEQ ID NO: 4543 - DNA, 25 bp, Mus musculus
ctctctctcaatgaggctgagaatc

SEQ ID NO: 4544 - DNA, 25 bp, Mus musculus
gagaatccaacctgagaactttcat

SEQ ID NO: 4545 - DNA, 25 bp, Mus musculus
ccaacctgagaactttcatacatgg

SEQ ID NO: 4546 - DNA, 25 bp, Mus musculus
ctttcatacatggtggataagccta

SEQ ID NO: 4547 - DNA, 25 bp, Mus musculus
aagcctatataccactgagctaaat

SEQ ID NO: 4548 - DNA, 25 bp, Mus musculus
atataccactgagctaaatcctcag

SEQ ID NO: 4549 - DNA, 25 bp, Mus musculus
gctaaatcctcagcacagctgataa

SEQ ID NO: 4550 - DNA, 25 bp, Mus musculus
tcctcagcacagctgataacatcat

SEQ ID NO: 4551 - DNA, 25 bp, Mus musculus
acctcaagctctggggtatcgaccg

SEQ ID NO: 4552 - DNA, 25 bp, Mus musculus
tcgaccgtgacagctacaggcgcat

SEQ ID NO: 4553 - DNA, 25 bp, Mus musculus
atgacttctacatcatcacagaggg

SEQ ID NO: 4554 - DNA, 25 bp, Mus musculus
tctacatcatcacagagggcactgc

SEQ ID NO: 4555 - DNA, 25 bp, Mus musculus
gcactgcttcagtcctccagcgacg

SEQ ID NO: 4556 - DNA, 25 bp, Mus musculus
cctctgactactttggggagattgc

SEQ ID NO: 4557 - DNA, 25 bp, Mus musculus
agattgccctgctgctgaatcggcc

SEQ ID NO: 4558 - DNA, 25 bp, Mus musculus
atcggccccgtgcagccactgtggt

SEQ ID NO: 4559 - DNA, 25 bp, Mus musculus
tagaccggcctcgttttgagcgtgt

SEQ ID NO: 4560 - DNA, 25 bp, Mus musculus
gctctgagatcctgaagaggaacat

SEQ ID NO: 4561 - DNA, 25 bp, Mus musculus
tccagcgttacaacagcttcatctc

SEQ ID NO: 4562 - DNA, 25 bp, Mus musculus
tcatctccctaactgtctgagcttg

SEQ ID NO: 4563 - DNA, 25 bp, Mus musculus
gctacaggcgcatcctcatgggaag

SEQ ID NO: 4564 - DNA, 25 bp, Mus musculus
agttcctcagcaaagtctccatcct

SEQ ID NO: 4565 - DNA, 25 bp, Mus musculus
tcagcaaagtctccatcctagaatc

SEQ ID NO: 4566 - DNA, 25 bp, Mus musculus
aagtctccatcctagaatccctgga

SEQ ID NO: 4567 - DNA, 25 bp, Mus musculus
tagaatccctggagaagtgggaacg

SEQ ID NO: 4568 - DNA, 25 bp, Mus musculus
ctgtagctgatgccctggagcctgt

SEQ ID NO: 4569 - DNA, 25 bp, Mus musculus
ctgatgccctggagcctgtgcagtt

SEQ ID NO: 4570 - DNA, 25 bp, Mus musculus
ccctggagcctgtgcagtttgaaga

SEQ ID NO: 4571 - DNA, 25 bp, Mus musculus
cggttttgcacattgtgggctttat

SEQ ID NO: 4572 - DNA, 25 bp, Mus musculus
ttttgcacattgtgggctttatatg

SEQ ID NO: 4573 - DNA, 25 bp, Mus musculus
ctttgcagcacgaggaaatttcaat

SEQ ID NO: 4574 - DNA, 25 bp, Mus musculus
gaaatttcaatgtgtcccttggtgg

SEQ ID NO: 4575 - DNA, 25 bp, Mus musculus
atttcaatgtgtcccttggtggatc

SEQ ID NO: 4576 - DNA, 25 bp, Mus musculus
tcaatgtgtcccttggtggatcaag

SEQ ID NO: 4577 - DNA, 25 bp, Mus musculus
caatgtgtcccttggtggatcaagc

SEQ ID NO: 4578 - DNA, 25 bp, Mus musculus
tgtgtcccttggtggatcaagcgag

SEQ ID NO: 4579 - DNA, 25 bp, Mus musculus
tgtcccttggtggatcaagcgagag

SEQ ID NO: 4580 - DNA, 25 bp, Mus musculus
gtcccttggtggatcaagcgagagt

SEQ ID NO: 4581 - DNA, 25 bp, Mus musculus
cccttggtggatcaagcgagagtct

SEQ ID NO: 4582 - DNA, 25 bp, Mus musculus
agagtctaaattctctgagggaaag

SEQ ID NO: 4583 - DNA, 25 bp, Mus musculus
ttgcacattgtgggctttatatgaa

SEQ ID NO: 4584 - DNA, 25 bp, Mus musculus
cacattgtgggctttatatgaaaaa

SEQ ID NO: 4585 - DNA, 25 bp, Mus musculus
aagcccattggaaagccggagagat

SEQ ID NO: 4586 - DNA, 25 bp, Mus musculus
agatctatgccaaagccgaagaaga

SEQ ID NO: 4587 - DNA, 25 bp, Mus musculus
atctatgccaaagccgaagaagaag

SEQ ID NO: 4588 - DNA, 25 bp, Mus musculus
tatgccaaagccgaagaagaagttt

SEQ ID NO: 4589 - DNA, 25 bp, Mus musculus
gaagccgatctttgcagcacgagga

SEQ ID NO: 4590 - DNA, 25 bp, Mus musculus
tctttgcagcacgaggaaatttcaa

SEQ ID NO: 4591 - DNA, 25 bp, Mus musculus
gacctgtacagagggctgcttgcca

SEQ ID NO: 4592 - DNA, 25 bp, Mus musculus
tccctaaatcaattctgatgagacc

SEQ ID NO: 4593 - DNA, 25 bp, Mus musculus
cagctgtccatcacctcttgccgtg

SEQ ID NO: 4594 - DNA, 25 bp, Mus musculus
actgcaaccccaagtctgattgtgc

SEQ ID NO: 4595 - DNA, 25 bp, Mus musculus
gcaaccccaagtctgattgtgcttt

SEQ ID NO: 4596 - DNA, 25 bp, Mus musculus
agtctgattgtgctttttctctcaa

SEQ ID NO: 4597 - DNA, 25 bp, Mus musculus
gtgctttttctctcaatagaaaggt

SEQ ID NO: 4598 - DNA, 25 bp, Mus musculus
gtcgtcaacctgtgtgcttcaaagg

SEQ ID NO: 4599 - DNA, 25 bp, Mus musculus
gatgagacttcctcttgaacagtgt

SEQ ID NO: 4600 - DNA, 25 bp, Mus musculus
acttcctcttgaacagtgtgctgtt

SEQ ID NO: 4601 - DNA, 25 bp, Mus musculus
tcctcttgaacagtgtgctgttgta

SEQ ID NO: 4602 - DNA, 25 bp, Mus musculus
tcttgaacagtgtgctgttgtaaac

SEQ ID NO: 4603 - DNA, 25 bp, Mus musculus
caattctgatgagacctgggtagcc

SEQ ID NO: 4604 - DNA, 25 bp, Mus musculus
agccaactgaccctgtcaaggaagg

SEQ ID NO: 4605 - DNA, 25 bp, Mus musculus
ctgaccctgtcaaggaaggaactgg

SEQ ID NO: 4606 - DNA, 25 bp, Mus musculus
cagtggtctcatgccaatttgtcct

SEQ ID NO: 4607 - DNA, 25 bp, Mus musculus
tggtctcatgccaatttgtcctgtg

SEQ ID NO: 4608 - DNA, 25 bp, Mus musculus
catgccaatttgtcctgtgcatcag

SEQ ID NO: 4609 - DNA, 25 bp, Mus musculus
ttctagcttagctgtcagctgtcca

SEQ ID NO: 4610 - DNA, 25 bp, Mus musculus
cttagctgtcagctgtccatcacct

SEQ ID NO: 4611 - DNA, 25 bp, Mus musculus
cctgcgtggttgactgcggcaccgg

SEQ ID NO: 4612 - DNA, 25 bp, Mus musculus
ttgactgcggcaccgggtacaccaa

SEQ ID NO: 4613 - DNA, 25 bp, Mus musculus
cacagttcattattccgtcatgtat

SEQ ID NO: 4614 - DNA, 25 bp, Mus musculus
agttcattattccgtcatgtattgc

SEQ ID NO: 4615 - DNA, 25 bp, Mus musculus
ttattccgtcatgtattgccatccg

SEQ ID NO: 4616 - DNA, 25 bp, Mus musculus
ttccgtcatgtattgccatccgaga

SEQ ID NO: 4617 - DNA, 25 bp, Mus musculus
cgtcatgtattgccatccgagagtc

SEQ ID NO: 4618 - DNA, 25 bp, Mus musculus
catgtattgccatccgagagtcggc

SEQ ID NO: 4619 - DNA, 25 bp, Mus musculus
ttgatgaccttgacttcttcatagg

SEQ ID NO: 4620 - DNA, 25 bp, Mus musculus
atgaccttgacttcttcatagggga

SEQ ID NO: 4621 - DNA, 25 bp, Mus musculus
accttgacttcttcataggggatga

SEQ ID NO: 4622 - DNA, 25 bp, Mus musculus
ttgacttcttcataggggatgaagc

SEQ ID NO: 4623 - DNA, 25 bp, Mus musculus
acaccaagctcggctacgcaggcaa

SEQ ID NO: 4624 - DNA, 25 bp, Mus musculus
agctcggctacgcaggcaacactga

SEQ ID NO: 4625 - DNA, 25 bp, Mus musculus
gctacgcaggcaacactgagccaca

SEQ ID NO: 4626 - DNA, 25 bp, Mus musculus
acgcaggcaacactgagccacagtt

SEQ ID NO: 4627 - DNA, 25 bp, Mus musculus
caggcaacactgagccacagttcat

SEQ ID NO: 4628 - DNA, 25 bp, Mus musculus
gcaacactgagccacagttcattat

SEQ ID NO: 4629 - DNA, 25 bp, Mus musculus
ctgagccacagttcattattccgtc

SEQ ID NO: 4630 - DNA, 25 bp, Mus musculus
agccacagttcattattccgtcatg

SEQ ID NO: 4631 - DNA, 25 bp, Mus musculus
ctaaggctcagactctccaaggtgg

SEQ ID NO: 4632 - DNA, 25 bp, Mus musculus
ggtgatctctacgtgggaaagacta

SEQ ID NO: 4633 - DNA, 25 bp, Mus musculus
gaaatcgagcgctttgagatcgcag

SEQ ID NO: 4634 - DNA, 25 bp, Mus musculus
gagatcgcagggattccctacagcc

SEQ ID NO: 4635 - DNA, 25 bp, Mus musculus
atcgcagggattccctacagcctcc

SEQ ID NO: 4636 - DNA, 25 bp, Mus musculus
gggattccctacagcctccagatct

SEQ ID NO: 4637 - DNA, 25 bp, Mus musculus
ccctacagcctccagatctgggaca

SEQ ID NO: 4638 - DNA, 25 bp, Mus musculus
gacacagccggacaggaaaagttca

SEQ ID NO: 4639 - DNA, 25 bp, Mus musculus
gcctactaccgcggtgcccagggtg

SEQ ID NO: 4640 - DNA, 25 bp, Mus musculus
taccgcggtgcccagggtgagcagc

SEQ ID NO: 4641 - DNA, 25 bp, Mus musculus
gagcagccgaatggagccggaactc

SEQ ID NO: 4642 - DNA, 25 bp, Mus musculus
aatggagccggaactctcaacccat

SEQ ID NO: 4643 - DNA, 25 bp, Mus musculus
gatctctacgtgggaaagactagcc

SEQ ID NO: 4644 - DNA, 25 bp, Mus musculus
ccatgccacctgcgtgaatactact

SEQ ID NO: 4645 - DNA, 25 bp, Mus musculus
ggaaagactagcctcattcacaggt

SEQ ID NO: 4646 - DNA, 25 bp, Mus musculus
actagcctcattcacaggttatgca

SEQ ID NO: 4647 - DNA, 25 bp, Mus musculus
agcctcattcacaggttatgcaaga

SEQ ID NO: 4648 - DNA, 25 bp, Mus musculus
ctcattcacaggttatgcaagaatg

SEQ ID NO: 4649 - DNA, 25 bp, Mus musculus
gattacaaggccacgattggcgtag

SEQ ID NO: 4650 - DNA, 25 bp, Mus musculus
aaggccacgattggcgtagactttg

SEQ ID NO: 4651 - DNA, 25 bp, Mus musculus
gccacgattggcgtagactttgaaa

SEQ ID NO: 4652 - DNA, 25 bp, Mus musculus
gccaccctttgatggggaagatgag

SEQ ID NO: 4653 - DNA, 25 bp, Mus musculus
tcaagccatcatggaacaaactgtc

SEQ ID NO: 4654 - DNA, 25 bp, Mus musculus
gccagaccgcttggttctagccagc

SEQ ID NO: 4655 - DNA, 25 bp, Mus musculus
ccgcttggttctagccagcatcgac

SEQ ID NO: 4656 - DNA, 25 bp, Mus musculus
agccagcatcgaccaagctgatttc

SEQ ID NO: 4657 - DNA, 25 bp, Mus musculus
catcgaccaagctgatttccagggc

SEQ ID NO: 4658 - DNA, 25 bp, Mus musculus
ccaagctgatttccagggctttact

SEQ ID NO: 4659 - DNA, 25 bp, Mus musculus
gaacccggacttcgtgcacccagat

SEQ ID NO: 4660 - DNA, 25 bp, Mus musculus
gcccgtgcctgtcatgtaatctcat

SEQ ID NO: 4661 - DNA, 25 bp, Mus musculus
gcctgtcatgtaatctcatctcgtg

SEQ ID NO: 4662 - DNA, 25 bp, Mus musculus
catgtaatctcatctcgtgccgcta

SEQ ID NO: 4663 - DNA, 25 bp, Mus musculus
gctgtaacacccatctaccctctag

SEQ ID NO: 4664 - DNA, 25 bp, Mus musculus
ggaacaaactgtcacctatcccaag

SEQ ID NO: 4665 - DNA, 25 bp, Mus musculus
aactgtcacctatcccaagtcactt

SEQ ID NO: 4666 - DNA, 25 bp, Mus musculus
ttcccgggaagctgtggccatctgc

SEQ ID NO: 4667 - DNA, 25 bp, Mus musculus
tgtggccatctgcaaagggttcctg

SEQ ID NO: 4668 - DNA, 25 bp, Mus musculus
catctgcaaagggttcctgaccaag

SEQ ID NO: 4669 - DNA, 25 bp, Mus musculus
gcacccaggaaaacgcctgggctca

SEQ ID NO: 4670 - DNA, 25 bp, Mus musculus
tcatggctttttccgttggatcgat

SEQ ID NO: 4671 - DNA, 25 bp, Mus musculus
actggaaattgcacctcctttcaga

SEQ ID NO: 4672 - DNA, 25 bp, Mus musculus
ccaagccagacagcgaacaggagac

SEQ ID NO: 4673 - DNA, 25 bp, Mus musculus
aagccagacagcgaacaggagactg

SEQ ID NO: 4674 - DNA, 25 bp, Mus musculus
gctgagtttcgtctcatggaagccg

SEQ ID NO: 4675 - DNA, 25 bp, Mus musculus
ctgagtttcgtctcatggaagccgt

SEQ ID NO: 4676 - DNA, 25 bp, Mus musculus
tgagtttcgtctcatggaagccgtg

SEQ ID NO: 4677 - DNA, 25 bp, Mus musculus
agtttcgtctcatggaagccgtgag

SEQ ID NO: 4678 - DNA, 25 bp, Mus musculus
gtttcgtctcatggaagccgtgagt

SEQ ID NO: 4679 - DNA, 25 bp, Mus musculus
tttcgtctcatggaagccgtgagta

SEQ ID NO: 4680 - DNA, 25 bp, Mus musculus
tcgtctcatggaagccgtgagtacc

SEQ ID NO: 4681 - DNA, 25 bp, Mus musculus
cgtctcatggaagccgtgagtacca

SEQ ID NO: 4682 - DNA, 25 bp, Mus musculus
agccgtgagtaccatgccgagacta

SEQ ID NO: 4683 - DNA, 25 bp, Mus musculus
gccgtgagtaccatgccgagactat

SEQ ID NO: 4684 - DNA, 25 bp, Mus musculus
agccagacagcgaacaggagactgc

SEQ ID NO: 4685 - DNA, 25 bp, Mus musculus
aacaggagactgccttcattcagac

SEQ ID NO: 4686 - DNA, 25 bp, Mus musculus
acaggagactgccttcattcagacc

SEQ ID NO: 4687 - DNA, 25 bp, Mus musculus
aatgtggctcggctgagtttcgtct

SEQ ID NO: 4688 - DNA, 25 bp, Mus musculus
tggctcggctgagtttcgtctcatg

SEQ ID NO: 4689 - DNA, 25 bp, Mus musculus
ggctcggctgagtttcgtctcatgg

SEQ ID NO: 4690 - DNA, 25 bp, Mus musculus
ctcggctgagtttcgtctcatggaa

SEQ ID NO: 4691 - DNA, 25 bp, Mus musculus
cggctgagtttcgtctcatggaagc

SEQ ID NO: 4692 - DNA, 25 bp, Mus musculus
cgagcatgcgagttcaccgaagctg

SEQ ID NO: 4693 - DNA, 25 bp, Mus musculus
agtaccaagatgctatcgcggacga

SEQ ID NO: 4694 - DNA, 25 bp, Mus musculus
ctcagctttctccatctgccctgtg

SEQ ID NO: 4695 - DNA, 25 bp, Mus musculus
cagctttctccatctgccctgtgta

SEQ ID NO: 4696 - DNA, 25 bp, Mus musculus
tccatctgccctgtgtactccagtg

SEQ ID NO: 4697 - DNA, 25 bp, Mus musculus
ccatctgccctgtgtactccagtgt

SEQ ID NO: 4698 - DNA, 25 bp, Mus musculus
catctgccctgtgtactccagtgtc

SEQ ID NO: 4699 - DNA, 25 bp, Mus musculus
gtgtactccagtgtctttctgctgg

SEQ ID NO: 4700 - DNA, 25 bp, Mus musculus
gtgttgttctgttttcgcaatggga

SEQ ID NO: 4701 - DNA, 25 bp, Mus musculus
tgttgttctgttttcgcaatgggag

SEQ ID NO: 4702 - DNA, 25 bp, Mus musculus
gttgttctgttttcgcaatgggagt

SEQ ID NO: 4703 - DNA, 25 bp, Mus musculus
tgttctgttttcgcaatgggagtaa

SEQ ID NO: 4704 - DNA, 25 bp, Mus musculus
taccaagatgctatcgcggacgagg

SEQ ID NO: 4705 - DNA, 25 bp, Mus musculus
ccaagatgctatcgcggacgaggaa

SEQ ID NO: 4706 - DNA, 25 bp, Mus musculus
aagatgctatcgcggacgaggaaga

SEQ ID NO: 4707 - DNA, 25 bp, Mus musculus
agatgctatcgcggacgaggaagag

SEQ ID NO: 4708 - DNA, 25 bp, Mus musculus
gattagatccctcagctttctccat

SEQ ID NO: 4709 - DNA, 25 bp, Mus musculus
attagatccctcagctttctccatc

SEQ ID NO: 4710 - DNA, 25 bp, Mus musculus
ttagatccctcagctttctccatct

SEQ ID NO: 4711 - DNA, 25 bp, Mus musculus
agatccctcagctttctccatctgc

SEQ ID NO: 4712 - DNA, 25 bp, Mus musculus
taggaactcgacctgagtctgtagt

SEQ ID NO: 4713 - DNA, 25 bp, Mus musculus
ctcgacctgagtctgtagttacaga

SEQ ID NO: 4714 - DNA, 25 bp, Mus musculus
ttgaaacaaatctacctattgatag

SEQ ID NO: 4715 - DNA, 25 bp, Mus musculus
tgaacctatggcctatttgagacaa

SEQ ID NO: 4716 - DNA, 25 bp, Mus musculus
atctccgataatctatttacaacat

SEQ ID NO: 4717 - DNA, 25 bp, Mus musculus
ctatttacaacatccaacagtttca

SEQ ID NO: 4718 - DNA, 25 bp, Mus musculus
acaacatccaacagtttcaatgtcc

SEQ ID NO: 4719 - DNA, 25 bp, Mus musculus
aatgtccttgtttaactatgctgat

SEQ ID NO: 4720 - DNA, 25 bp, Mus musculus
cactggtttcacatgcattttgtaa

SEQ ID NO: 4721 - DNA, 25 bp, Mus musculus
tgaaccagtgctaagactgtgtgga

SEQ ID NO: 4722 - DNA, 25 bp, Mus musculus
ataccccagagacatatactattac

SEQ ID NO: 4723 - DNA, 25 bp, Mus musculus
ctattactaatgcatgcggggccat

SEQ ID NO: 4724 - DNA, 25 bp, Mus musculus
aggaagtctgcctatatcttcccat

SEQ ID NO: 4725 - DNA, 25 bp, Mus musculus
tatatcttcccatagagtgctttca

SEQ ID NO: 4726 - DNA, 25 bp, Mus musculus
atgaatctcatttagccccaactgg

SEQ ID NO: 4727 - DNA, 25 bp, Mus musculus
ctcatttagccccaactggatgttt

SEQ ID NO: 4728 - DNA, 25 bp, Mus musculus
tgttaagtatgcctttctggatata

SEQ ID NO: 4729 - DNA, 25 bp, Mus musculus
gtatgcctttctggatatagaacag

SEQ ID NO: 4730 - DNA, 25 bp, Mus musculus
agaggccttgctttgatctaagtca

SEQ ID NO: 4731 - DNA, 25 bp, Mus musculus
ttgatctaagtcattggaggctagc

SEQ ID NO: 4732 - DNA, 25 bp, Mus musculus
tgtatcagtgacctaccttaaatag

SEQ ID NO: 4733 - DNA, 25 bp, Mus musculus
atatttcatttcatgatgaatctcc

SEQ ID NO: 4734 - DNA, 25 bp, Mus musculus
gcatggcaatgtcccacagtaacaa

SEQ ID NO: 4735 - DNA, 25 bp, Mus musculus
caatgtcccacagtaacaaataatg

SEQ ID NO: 4736 - DNA, 25 bp, Mus musculus
gatttcagttggtccacctgtattt

SEQ ID NO: 4737 - DNA, 25 bp, Mus musculus
ctgaaatactctgctgtagcaagtt

SEQ ID NO: 4738 - DNA, 25 bp, Mus musculus
tactctgctgtagcaagttctgtgt

SEQ ID NO: 4739 - DNA, 25 bp, Mus musculus
ttaaatccaagaacatgctaatcat

SEQ ID NO: 4740 - DNA, 25 bp, Mus musculus
ccaagaacatgctaatcatgtgttc

SEQ ID NO: 4741 - DNA, 25 bp, Mus musculus
taatcatgtgttctagtatgctaca

SEQ ID NO: 4742 - DNA, 25 bp, Mus musculus
tgctacaaattctctggtagtgttg

SEQ ID NO: 4743 - DNA, 25 bp, Mus musculus
aaattctctggtagtgttgttgtat

SEQ ID NO: 4744 - DNA, 25 bp, Mus musculus
ttaagtcagacaaaccctgtgtata

SEQ ID NO: 4745 - DNA, 25 bp, Mus musculus
tatctgcctccttactggtgcaggt

SEQ ID NO: 4746 - DNA, 25 bp, Mus musculus
attgacagcagtcctagtcatatgc

SEQ ID NO: 4747 - DNA, 25 bp, Mus musculus
agcagtcctagtcatatgcacacac

SEQ ID NO: 4748 - DNA, 25 bp, Mus musculus
attgaaaatcctatctgagaccttc

SEQ ID NO: 4749 - DNA, 25 bp, Mus musculus
aatcctatctgagaccttctctcca

SEQ ID NO: 4750 - DNA, 25 bp, Mus musculus
atctgagaccttctctccacctatc

SEQ ID NO: 4751 - DNA, 25 bp, Mus musculus
ctctccacctatctgcatgtgtttt

SEQ ID NO: 4752 - DNA, 25 bp, Mus musculus
atttccaatgtgaaacatgtcatca

SEQ ID NO: 4753 - DNA, 25 bp, Mus musculus
aacatgtcatcaatttcgacttgcc

SEQ ID NO: 4754 - DNA, 25 bp, Mus musculus
tcattcttcaacgagaggaacataa

SEQ ID NO: 4755 - DNA, 25 bp, Mus musculus
cattcttcaacgagaggaacataaa

SEQ ID NO: 4756 - DNA, 25 bp, Mus musculus
gtgccatcttggctagaaaacatgg

SEQ ID NO: 4757 - DNA, 25 bp, Mus musculus
agtcgtggacggtccaagagcagat

SEQ ID NO: 4758 - DNA, 25 bp, Mus musculus
ttcagcagtggccgtgctagcaaca

SEQ ID NO: 4759 - DNA, 25 bp, Mus musculus
tcagcagtggccgtgctagcaacag

SEQ ID NO: 4760 - DNA, 25 bp, Mus musculus
agtggccgtgctagcaacagtcgca

SEQ ID NO: 4761 - DNA, 25 bp, Mus musculus
ggccgtgctagcaacagtcgcagcg

SEQ ID NO: 4762 - DNA, 25 bp, Mus musculus
gcagccatggcagcagcagagggtt

SEQ ID NO: 4763 - DNA, 25 bp, Mus musculus
agccatggcagcagcagagggtttg

SEQ ID NO: 4764 - DNA, 25 bp, Mus musculus
catgtcatcaatttcgacttgccta

SEQ ID NO: 4765 - DNA, 25 bp, Mus musculus
atgtcatcaatttcgacttgcctag

SEQ ID NO: 4766 - DNA, 25 bp, Mus musculus
gtcatcaatttcgacttgcctagtg

SEQ ID NO: 4767 - DNA, 25 bp, Mus musculus
tcatcaatttcgacttgcctagtga

SEQ ID NO: 4768 - DNA, 25 bp, Mus musculus
atcaatttcgacttgcctagtgaca

SEQ ID NO: 4769 - DNA, 25 bp, Mus musculus
tcaatttcgacttgcctagtgacat

SEQ ID NO: 4770 - DNA, 25 bp, Mus musculus
acctcattcttcaacgagaggaaca

SEQ ID NO: 4771 - DNA, 25 bp, Mus musculus
cctcattcttcaacgagaggaacat

SEQ ID NO: 4772 - DNA, 25 bp, Mus musculus
ttaacgaaacaatcagtccgtcctg

SEQ ID NO: 4773 - DNA, 25 bp, Mus musculus
tcagtccgtcctgttttcgagtact

SEQ ID NO: 4774 - DNA, 25 bp, Mus musculus
atcttcggtgcaaatctgaggaaca

SEQ ID NO: 4775 - DNA, 25 bp, Mus musculus
ttttcatacagaggcatagtctcgg

SEQ ID NO: 4776 - DNA, 25 bp, Mus musculus
ggcatagtctcggtcgatttcactc

SEQ ID NO: 4777 - DNA, 25 bp, Mus musculus
atagtctcggtcgatttcactcact

SEQ ID NO: 4778 - DNA, 25 bp, Mus musculus
gtctcggtcgatttcactcacttac

SEQ ID NO: 4779 - DNA, 25 bp, Mus musculus
gtcgatttcactcacttacgacatc

SEQ ID NO: 4780 - DNA, 25 bp, Mus musculus
gatttcactcacttacgacatctga

SEQ ID NO: 4781 - DNA, 25 bp, Mus musculus
ttcactcacttacgacatctgaaca

SEQ ID NO: 4782 - DNA, 25 bp, Mus musculus
cacttacgacatctgaacagaatgt

SEQ ID NO: 4783 - DNA, 25 bp, Mus musculus
ttacgacatctgaacagaatgtaaa

SEQ ID NO: 4784 - DNA, 25 bp, Mus musculus
gagtactacagggtctcctcagtga

SEQ ID NO: 4785 - DNA, 25 bp, Mus musculus
agggtctcctcagtgactacagtgt

SEQ ID NO: 4786 - DNA, 25 bp, Mus musculus
ttaggccctcattattcttgtaagt

SEQ ID NO: 4787 - DNA, 25 bp, Mus musculus
cctcattattcttgtaagtataacg

SEQ ID NO: 4788 - DNA, 25 bp, Mus musculus
accttcaacacgttctggatcttcg

SEQ ID NO: 4789 - DNA, 25 bp, Mus musculus
ttcaacacgttctggatcttcggtg

SEQ ID NO: 4790 - DNA, 25 bp, Mus musculus
aacacgttctggatcttcggtgcaa

SEQ ID NO: 4791 - DNA, 25 bp, Mus musculus
tggatcttcggtgcaaatctgagga

SEQ ID NO: 4792 - DNA, 25 bp, Mus musculus
agcagtctggccttgaacttggtgg

SEQ ID NO: 4793 - DNA, 25 bp, Mus musculus
gccttgaacttggtggttctgatgt

SEQ ID NO: 4794 - DNA, 25 bp, Mus musculus
ctctgtccctcagtatagaccccaa

SEQ ID NO: 4795 - DNA, 25 bp, Mus musculus
ctgttgtgctctcaattttgaccac

SEQ ID NO: 4796 - DNA, 25 bp, Mus musculus
ttgtgctctcaattttgaccacttc

SEQ ID NO: 4797 - DNA, 25 bp, Mus musculus
tctcaattttgaccacttcctcttt

SEQ ID NO: 4798 - DNA, 25 bp, Mus musculus
ttccccatcacagccttgagggaaa

SEQ ID NO: 4799 - DNA, 25 bp, Mus musculus
cccatcacagccttgagggaaatca

SEQ ID NO: 4800 - DNA, 25 bp, Mus musculus
atcacagccttgagggaaatcaaga

SEQ ID NO: 4801 - DNA, 25 bp, Mus musculus
atcaagattctacagctcctaaaac

SEQ ID NO: 4802 - DNA, 25 bp, Mus musculus
aagattctacagctcctaaaacatg

SEQ ID NO: 4803 - DNA, 25 bp, Mus musculus
cagctcctaaaacatgagaatgtgg

SEQ ID NO: 4804 - DNA, 25 bp, Mus musculus
gttctgatgtctctgtctcctgata

SEQ ID NO: 4805 - DNA, 25 bp, Mus musculus
ctgatgtctctgtctcctgatacga

SEQ ID NO: 4806 - DNA, 25 bp, Mus musculus
ctgtctcctgatacgagaattggat

SEQ ID NO: 4807 - DNA, 25 bp, Mus musculus
tctcctgatacgagaattggattcc

SEQ ID NO: 4808 - DNA, 25 bp, Mus musculus
ggaaccatcacacaggaacgattct

SEQ ID NO: 4809 - DNA, 25 bp, Mus musculus
accatcacacaggaacgattctctc

SEQ ID NO: 4810 - DNA, 25 bp, Mus musculus
caggaacgattctctcgcctgtctt

SEQ ID NO: 4811 - DNA, 25 bp, Mus musculus
ttcaacctctgtccctcagtataga

SEQ ID NO: 4812 - DNA, 25 bp, Mus musculus
cactgtggttgcgcgtggccctttg

SEQ ID NO: 4813 - DNA, 25 bp, Mus musculus
tgaacgcgtccttggcccatgctca

SEQ ID NO: 4814 - DNA, 25 bp, Mus musculus
cagtctatgcttcactcacgcagac

SEQ ID NO: 4815 - DNA, 25 bp, Mus musculus
tctatgcttcactcacgcagactgc

SEQ ID NO: 4816 - DNA, 25 bp, Mus musculus
tctctgcagcgccaagtggccactg

SEQ ID NO: 4817 - DNA, 25 bp, Mus musculus
ctgcagcgccaagtggccactggct

SEQ ID NO: 4818 - DNA, 25 bp, Mus musculus
cgccaagtggccactggcttcacag

SEQ ID NO: 4819 - DNA, 25 bp, Mus musculus
actggcttcacagcttcttgtctct

SEQ ID NO: 4820 - DNA, 25 bp, Mus musculus
ggcttcacagcttcttgtctctgta

SEQ ID NO: 4821 - DNA, 25 bp, Mus musculus
gcttcttgtctctgtatactaaagg

SEQ ID NO: 4822 - DNA, 25 bp, Mus musculus
tcttgtctctgtatactaaaggttg

SEQ ID NO: 4823 - DNA, 25 bp, Mus musculus
tgtctctgtatactaaaggttgctt

SEQ ID NO: 4824 - DNA, 25 bp, Mus musculus
acgcgtccttggcccatgctcagat

SEQ ID NO: 4825 - DNA, 25 bp, Mus musculus
gttgctttattgcaccattttccat

SEQ ID NO: 4826 - DNA, 25 bp, Mus musculus
cgtccttggcccatgctcagatatc

SEQ ID NO: 4827 - DNA, 25 bp, Mus musculus
tggcccatgctcagatatcctcaag

SEQ ID NO: 4828 - DNA, 25 bp, Mus musculus
cccatgctcagatatcctcaagcga

SEQ ID NO: 4829 - DNA, 25 bp, Mus musculus
atgctcagatatcctcaagcgaaac

SEQ ID NO: 4830 - DNA, 25 bp, Mus musculus
tatcctcaagcgaaacatccagcag

SEQ ID NO: 4831 - DNA, 25 bp, Mus musculus
cctcaagcgaaacatccagcagtac

SEQ ID NO: 4832 - DNA, 25 bp, Mus musculus
gtacaacagctttgtgtcactgtcc

SEQ ID NO: 4833 - DNA, 25 bp, Mus musculus
aagatggatgccacagccaatgatg

SEQ ID NO: 4834 - DNA, 25 bp, Mus musculus
gatgccacagccaatgatgtgcctt

SEQ ID NO: 4835 - DNA, 25 bp, Mus musculus
tttattagctatctacaacgagaag

SEQ ID NO: 4836 - DNA, 25 bp, Mus musculus
gaggacctctaaagcaacagccaaa

SEQ ID NO: 4837 - DNA, 25 bp, Mus musculus
gacctctaaagcaacagccaaatgc

SEQ ID NO: 4838 - DNA, 25 bp, Mus musculus
ctctaaagcaacagccaaatgcacc

SEQ ID NO: 4839 - DNA, 25 bp, Mus musculus
aacagccaaatgcaccactttataa

SEQ ID NO: 4840 - DNA, 25 bp, Mus musculus
ggactcttacaccagagaaggcaaa

SEQ ID NO: 4841 - DNA, 25 bp, Mus musculus
ggataaactctgaatcctgttaaat

SEQ ID NO: 4842 - DNA, 25 bp, Mus musculus
tctctaaactgtttcttagctgcac

SEQ ID NO: 4843 - DNA, 25 bp, Mus musculus
tgtttcttagctgcactgtttgaaa

SEQ ID NO: 4844 - DNA, 25 bp, Mus musculus
ttagctgcactgtttgaaaatacaa

SEQ ID NO: 4845 - DNA, 25 bp, Mus musculus
gccacagccaatgatgtgccttctc

SEQ ID NO: 4846 - DNA, 25 bp, Mus musculus
acagccaatgatgtgccttctccat

SEQ ID NO: 4847 - DNA, 25 bp, Mus musculus
gtgccttctccatatgaagtcaagg

SEQ ID NO: 4848 - DNA, 25 bp, Mus musculus
tctccatatgaagtcaagggttttc

SEQ ID NO: 4849 - DNA, 25 bp, Mus musculus
ttctcaccagccaacaagaagctaa

SEQ ID NO: 4850 - DNA, 25 bp, Mus musculus
tcaccagccaacaagaagctaactc

SEQ ID NO: 4851 - DNA, 25 bp, Mus musculus
ccagccaacaagaagctaactccaa

SEQ ID NO: 4852 - DNA, 25 bp, Mus musculus
aagctaactccaaagaagtatgaag

SEQ ID NO: 4853 - DNA, 25 bp, Mus musculus
gcaatccttactccagaaaacagcg

SEQ ID NO: 4854 - DNA, 25 bp, Mus musculus
cttactccagaaaacagcgagcaag

SEQ ID NO: 4855 - DNA, 25 bp, Mus musculus
ttctggtctgcatggtcagatttgc

SEQ ID NO: 4856 - DNA, 25 bp, Mus musculus
aacagtgctcttagaaccttatggc

SEQ ID NO: 4857 - DNA, 25 bp, Mus musculus
agaaccttatggcggtgcgtgcgca

SEQ ID NO: 4858 - DNA, 25 bp, Mus musculus
tacctcaaggtcctgaagtgtcgtg

SEQ ID NO: 4859 - DNA, 25 bp, Mus musculus
gatgttcataacaacaactgctgaa

SEQ ID NO: 4860 - DNA, 25 bp, Mus musculus
tgctgaacatctatccctcttctct

SEQ ID NO: 4861 - DNA, 25 bp, Mus musculus
atccctcttctctgtctcttagaag

SEQ ID NO: 4862 - DNA, 25 bp, Mus musculus
tgtctcttagaaggtccctcgtgat

SEQ ID NO: 4863 - DNA, 25 bp, Mus musculus
tcgtgatctagaccttcaaagcacc

SEQ ID NO: 4864 - DNA, 25 bp, Mus musculus
ttggtgcctttctagattgagttgt

SEQ ID NO: 4865 - DNA, 25 bp, Mus musculus
aacagcgagcaagtccaccagacaa

SEQ ID NO: 4866 - DNA, 25 bp, Mus musculus
actgattctttgcaaatgctaaatt

SEQ ID NO: 4867 - DNA, 25 bp, Mus musculus
gtccaccagacaacatcggaagacc

SEQ ID NO: 4868 - DNA, 25 bp, Mus musculus
tccatcactattttacaagcctggg

SEQ ID NO: 4869 - DNA, 25 bp, Mus musculus
gctcttccacatgtacctgatactc

SEQ ID NO: 4870 - DNA, 25 bp, Mus musculus
ccacatgtacctgatactctgctgt

SEQ ID NO: 4871 - DNA, 25 bp, Mus musculus
gtacctgatactctgctgtcaagaa

SEQ ID NO: 4872 - DNA, 25 bp, Mus musculus
tacccaggagctgttgcaagtgact

SEQ ID NO: 4873 - DNA, 25 bp, Mus musculus
tatactttctggtctgcatggtcag

SEQ ID NO: 4874 - DNA, 25 bp, Mus musculus
agcctacagaaatccggcattcgta

SEQ ID NO: 4875 - DNA, 25 bp, Mus musculus
cctacagaaatccggcattcgtaca

SEQ ID NO: 4876 - DNA, 25 bp, Mus musculus
taagacaatggctgctttagccaag

SEQ ID NO: 4877 - DNA, 25 bp, Mus musculus
acaatggctgctttagccaaggcca

SEQ ID NO: 4878 - DNA, 25 bp, Mus musculus
gctgctttagccaaggccatcgaaa

SEQ ID NO: 4879 - DNA, 25 bp, Mus musculus
tgctttagccaaggccatcgaaaag

SEQ ID NO: 4880 - DNA, 25 bp, Mus musculus
ttagccaaggccatcgaaaagaacg

SEQ ID NO: 4881 - DNA, 25 bp, Mus musculus
gtgttattttcacaccttgatgaca

SEQ ID NO: 4882 - DNA, 25 bp, Mus musculus
gttattttcacaccttgatgacaat

SEQ ID NO: 4883 - DNA, 25 bp, Mus musculus
ttttcacaccttgatgacaatgaga

SEQ ID NO: 4884 - DNA, 25 bp, Mus musculus
cacaccttgatgacaatgagagaag

SEQ ID NO: 4885 - DNA, 25 bp, Mus musculus
atgcaatgtttccagtctcctttat

SEQ ID NO: 4886 - DNA, 25 bp, Mus musculus
cagaaatccggcattcgtacagact

SEQ ID NO: 4887 - DNA, 25 bp, Mus musculus
gaaatccggcattcgtacagactcg

SEQ ID NO: 4888 - DNA, 25 bp, Mus musculus
aatccggcattcgtacagactcgag

SEQ ID NO: 4889 - DNA, 25 bp, Mus musculus
gcggtgctatcagcgctgaggttta

SEQ ID NO: 4890 - DNA, 25 bp, Mus musculus
ggtgctatcagcgctgaggtttaca

SEQ ID NO: 4891 - DNA, 25 bp, Mus musculus
ctatcagcgctgaggtttacactga

SEQ ID NO: 4892 - DNA, 25 bp, Mus musculus
atcagcgctgaggtttacactgagg

SEQ ID NO: 4893 - DNA, 25 bp, Mus musculus
atgctgcgtcctacgttagaaaggt

SEQ ID NO: 4894 - DNA, 25 bp, Mus musculus
actcagtttatacttctgagttctg

SEQ ID NO: 4895 - DNA, 25 bp, Mus musculus
tcagtttatacttctgagttctgca

SEQ ID NO: 4896 - DNA, 25 bp, Mus musculus
tgcagttttcccaaagtgcctggaa

SEQ ID NO: 4897 - DNA, 25 bp, Mus musculus
tcccaaagtgcctggaagaccggag

SEQ ID NO: 4898 - DNA, 25 bp, Mus musculus
gaaacatggccgttgtggatgtcaa

SEQ ID NO: 4899 - DNA, 25 bp, Mus musculus
acatggccgttgtggatgtcaacac

SEQ ID NO: 4900 - DNA, 25 bp, Mus musculus
tggatgtcaacaccgtgttcaagga

SEQ ID NO: 4901 - DNA, 25 bp, Mus musculus
ggatgtcaacaccgtgttcaaggag

SEQ ID NO: 4902 - DNA, 25 bp, Mus musculus
gatgtcaacaccgtgttcaaggagt

SEQ ID NO: 4903 - DNA, 25 bp, Mus musculus
tgtcaacaccgtgttcaaggagtta

SEQ ID NO: 4904 - DNA, 25 bp, Mus musculus
gtcaacaccgtgttcaaggagttag

SEQ ID NO: 4905 - DNA, 25 bp, Mus musculus
tcaacaccgtgttcaaggagttagt

SEQ ID NO: 4906 - DNA, 25 bp, Mus musculus
agtttatacttctgagttctgcagt

SEQ ID NO: 4907 - DNA, 25 bp, Mus musculus
tacttctgagttctgcagttttccc

SEQ ID NO: 4908 - DNA, 25 bp, Mus musculus
acttctgagttctgcagttttccca

SEQ ID NO: 4909 - DNA, 25 bp, Mus musculus
cttctgagttctgcagttttcccaa

SEQ ID NO: 4910 - DNA, 25 bp, Mus musculus
tctgagttctgcagttttcccaaag

SEQ ID NO: 4911 - DNA, 25 bp, Mus musculus
ctgagttctgcagttttcccaaagt

SEQ ID NO: 4912 - DNA, 25 bp, Mus musculus
tgagttctgcagttttcccaaagtg

SEQ ID NO: 4913 - DNA, 25 bp, Mus musculus
ctgcagttttcccaaagtgcctgga

SEQ ID NO: 4914 - DNA, 25 bp, Mus musculus
tgtagagcagattcccttggtattg

SEQ ID NO: 4915 - DNA, 25 bp, Mus musculus
gcagattcccttggtattggtcaac

SEQ ID NO: 4916 - DNA, 25 bp, Mus musculus
tctttacatttatgctgtgcaggtt

SEQ ID NO: 4917 - DNA, 25 bp, Mus musculus
tgctgtgcaggttgtacagttagtt

SEQ ID NO: 4918 - DNA, 25 bp, Mus musculus
tgagggcacactgtcttgaactctg

SEQ ID NO: 4919 - DNA, 25 bp, Mus musculus
gaatatgctacatctggtccggtca

SEQ ID NO: 4920 - DNA, 25 bp, Mus musculus
gctacatctggtccggtcagtgtga

SEQ ID NO: 4921 - DNA, 25 bp, Mus musculus
gtcatggccgtggcaaaagcaacat

SEQ ID NO: 4922 - DNA, 25 bp, Mus musculus
ttattagctttgcaggaaagaggaa

SEQ ID NO: 4923 - DNA, 25 bp, Mus musculus
aacacagcaggaaccagtgctaggc

SEQ ID NO: 4924 - DNA, 25 bp, Mus musculus
ggtatacacattatatcccgactct

SEQ ID NO: 4925 - DNA, 25 bp, Mus musculus
agtcagcctagtctacgtgtaggaa

SEQ ID NO: 4926 - DNA, 25 bp, Mus musculus
tcccttggtattggtcaaccatcct

SEQ ID NO: 4927 - DNA, 25 bp, Mus musculus
ccatcctagtgtcttgtctatagct

SEQ ID NO: 4928 - DNA, 25 bp, Mus musculus
tagtgtcttgtctatagctgtatta

SEQ ID NO: 4929 - DNA, 25 bp, Mus musculus
taaactcaaaaccactgagttatct

SEQ ID NO: 4930 - DNA, 25 bp, Mus musculus
ttggtaatctcaaactcattgatag

SEQ ID NO: 4931 - DNA, 25 bp, Mus musculus
atctcaaactcattgatagtagagc

SEQ ID NO: 4932 - DNA, 25 bp, Mus musculus
cctctcgattttcatgagattcatt

SEQ ID NO: 4933 - DNA, 25 bp, Mus musculus
cgtgcatgatcatctttacatttat

SEQ ID NO: 4934 - DNA, 25 bp, Mus musculus
tatagaaaacaccctgtggtgaagg

SEQ ID NO: 4935 - DNA, 25 bp, Mus musculus
gccaggcagtctatcaggagacacc

SEQ ID NO: 4936 - DNA, 25 bp, Mus musculus
tatttcttccaagaccacagccttg

SEQ ID NO: 4937 - DNA, 25 bp, Mus musculus
ttccaagaccacagccttgactggg

SEQ ID NO: 4938 - DNA, 25 bp, Mus musculus
gaccacagccttgactgggaagaat

SEQ ID NO: 4939 - DNA, 25 bp, Mus musculus
gaagagcccacaatatcggggaaag

SEQ ID NO: 4940 - DNA, 25 bp, Mus musculus
tgagcacctgaaccaaaacctggag

SEQ ID NO: 4941 - DNA, 25 bp, Mus musculus
atcttgctttggcagcctggtggga

SEQ ID NO: 4942 - DNA, 25 bp, Mus musculus
tatgttccacaccttcgtgcccttc

SEQ ID NO: 4943 - DNA, 25 bp, Mus musculus
tatttctctgagaaccaatgtggtt

SEQ ID NO: 4944 - DNA, 25 bp, Mus musculus
tactacttggtggtctaccagacac

SEQ ID NO: 4945 - DNA, 25 bp, Mus musculus
cagacacaaacaagctaggtgctaa

SEQ ID NO: 4946 - DNA, 25 bp, Mus musculus
cagtctatcaggagacacctatgca

SEQ ID NO: 4947 - DNA, 25 bp, Mus musculus
ctatgcaccagagtaatacaggagt

SEQ ID NO: 4948 - DNA, 25 bp, Mus musculus
tgccaaccaggatacgcagcacttc

SEQ ID NO: 4949 - DNA, 25 bp, Mus musculus
ccaggatacgcagcacttcatcatt

SEQ ID NO: 4950 - DNA, 25 bp, Mus musculus
gcacttcatcattgtgaactataga

SEQ ID NO: 4951 - DNA, 25 bp, Mus musculus
ctatagaacatcaactctgcaaatg

SEQ ID NO: 4952 - DNA, 25 bp, Mus musculus
aacatcaactctgcaaatggtggat

SEQ ID NO: 4953 - DNA, 25 bp, Mus musculus
aactctgcaaatggtggatatttct

SEQ ID NO: 4954 - DNA, 25 bp, Mus musculus
gatttgtgctgtcattccccaaagt

SEQ ID NO: 4955 - DNA, 25 bp, Mus musculus
ttgtgctgtcattccccaaagtgct

SEQ ID NO: 4956 - DNA, 25 bp, Mus musculus
cattcccttaaaaatctcacatgca

SEQ ID NO: 4957 - DNA, 25 bp, Mus musculus
tcccttaaaaatctcacatgcacac

SEQ ID NO: 4958 - DNA, 25 bp, Mus musculus
cttaaaaatctcacatgcacacaca

SEQ ID NO: 4959 - DNA, 25 bp, Mus musculus
agttaatcaactgcaagtgtttcct

SEQ ID NO: 4960 - DNA, 25 bp, Mus musculus
taatcaactgcaagtgtttccttca

SEQ ID NO: 4961 - DNA, 25 bp, Mus musculus
tcaactgcaagtgtttccttcattt

SEQ ID NO: 4962 - DNA, 25 bp, Mus musculus
actgcaagtgtttccttcatttctg

SEQ ID NO: 4963 - DNA, 25 bp, Mus musculus
gcaagtgtttccttcatttctgata

SEQ ID NO: 4964 - DNA, 25 bp, Mus musculus
tccttcatttctgatagagaatttt

SEQ ID NO: 4965 - DNA, 25 bp, Mus musculus
tttagaaactcatcttacaaaatgt

SEQ ID NO: 4966 - DNA, 25 bp, Mus musculus
tgctgtcattccccaaagtgctttc

SEQ ID NO: 4967 - DNA, 25 bp, Mus musculus
cattccccaaagtgctttctgctgt

SEQ ID NO: 4968 - DNA, 25 bp, Mus musculus
ccaaagtgctttctgctgtgttgaa

SEQ ID NO: 4969 - DNA, 25 bp, Mus musculus
aagtgctttctgctgtgttgaaaga

SEQ ID NO: 4970 - DNA, 25 bp, Mus musculus
tgctttctgctgtgttgaaagagat

SEQ ID NO: 4971 - DNA, 25 bp, Mus musculus
acttgagacttgttcttgggccaat

SEQ ID NO: 4972 - DNA, 25 bp, Mus musculus
tgagacttgttcttgggccaatata

SEQ ID NO: 4973 - DNA, 25 bp, Mus musculus
gaaaccaatcaagatcaaggaaggt

SEQ ID NO: 4974 - DNA, 25 bp, Mus musculus
caagaagaacctctagcacagatct

SEQ ID NO: 4975 - DNA, 25 bp, Mus musculus
agaagaacctctagcacagatctag

SEQ ID NO: 4976 - DNA, 25 bp, Mus musculus
gctgactgcgaggttgcagatttgg

SEQ ID NO: 4977 - DNA, 25 bp, Mus musculus
ctgactgcgaggttgcagatttggt

SEQ ID NO: 4978 - DNA, 25 bp, Mus musculus
acttgctctcctaacctggatgctt

SEQ ID NO: 4979 - DNA, 25 bp, Mus musculus
taacctggatgcttgtcttgttgct

SEQ ID NO: 4980 - DNA, 25 bp, Mus musculus
aacctggatgcttgtcttgttgctg

SEQ ID NO: 4981 - DNA, 25 bp, Mus musculus
ctggatgcttgtcttgttgctgtat

SEQ ID NO: 4982 - DNA, 25 bp, Mus musculus
ttgtcttgttgctgtatccggaaag

SEQ ID NO: 4983 - DNA, 25 bp, Mus musculus
tgtcttgttgctgtatccggaaagc

SEQ ID NO: 4984 - DNA, 25 bp, Mus musculus
agtctatcaacagtgttggagattt

SEQ ID NO: 4985 - DNA, 25 bp, Mus musculus
gtctatcaacagtgttggagatttt

SEQ ID NO: 4986 - DNA, 25 bp, Mus musculus
gaagaacctctagcacagatctagc

SEQ ID NO: 4987 - DNA, 25 bp, Mus musculus
gaacctctagcacagatctagctga

SEQ ID NO: 4988 - DNA, 25 bp, Mus musculus
acctctagcacagatctagctgact

SEQ ID NO: 4989 - DNA, 25 bp, Mus musculus
tctagcacagatctagctgactgcg

SEQ ID NO: 4990 - DNA, 25 bp, Mus musculus
ctagcacagatctagctgactgcga

SEQ ID NO: 4991 - DNA, 25 bp, Mus musculus
gatctagctgactgcgaggttgcag

SEQ ID NO: 4992 - DNA, 25 bp, Mus musculus
ctagctgactgcgaggttgcagatt

SEQ ID NO: 4993 - DNA, 25 bp, Mus musculus
tagctgactgcgaggttgcagattt

SEQ ID NO: 4994 - DNA, 25 bp, Mus musculus
caagcgagcgctcgcccaatacttg

SEQ ID NO: 4995 - DNA, 25 bp, Mus musculus
agcgctcgcccaatacttgctgctc

SEQ ID NO: 4996 - DNA, 25 bp, Mus musculus
tctgctgctgttcttcttcgtcatg

SEQ ID NO: 4997 - DNA, 25 bp, Mus musculus
cagtgtctttgttgccaagatgagg

SEQ ID NO: 4998 - DNA, 25 bp, Mus musculus
gcccgctctgcaaatgaactggagg

SEQ ID NO: 4999 - DNA, 25 bp, Mus musculus
gatgtggacacctttgcagttcatc

SEQ ID NO: 5000 - DNA, 25 bp, Mus musculus
gacacctttgcagttcatcaacatc

SEQ ID NO: 5001 - DNA, 25 bp, Mus musculus
tttgcagttcatcaacatcaactat

SEQ ID NO: 5002 - DNA, 25 bp, Mus musculus
caacatcaactatgtgcccctgcag

SEQ ID NO: 5003 - DNA, 25 bp, Mus musculus
ggtgctctttgccaacatggcagct

SEQ ID NO: 5004 - DNA, 25 bp, Mus musculus
ctttgccaacatggcagctctgttc

SEQ ID NO: 5005 - DNA, 25 bp, Mus musculus
caacatggcagctctgttctggtat

SEQ ID NO: 5006 - DNA, 25 bp, Mus musculus
atacttgctgctcctaaagctctac

SEQ ID NO: 5007 - DNA, 25 bp, Mus musculus
gctctacccggtgctcaccaaagca

SEQ ID NO: 5008 - DNA, 25 bp, Mus musculus
gctcaccaaagcagtcagcagcggc

SEQ ID NO: 5009 - DNA, 25 bp, Mus musculus
caaagcagtcagcagcggcattttg

SEQ ID NO: 5010 - DNA, 25 bp, Mus musculus
agtcagcagcggcattttgtcagcc

SEQ ID NO: 5011 - DNA, 25 bp, Mus musculus
tctggcccagacgattgagaagaag

SEQ ID NO: 5012 - DNA, 25 bp, Mus musculus
tgtcacaggtccactgagtcactac

SEQ ID NO: 5013 - DNA, 25 bp, Mus musculus
tgccccaacttttctgctgctgttc

SEQ ID NO: 5014 - DNA, 25 bp, Mus musculus
tgcctctgcctgaaagacactcagg

SEQ ID NO: 5015 - DNA, 25 bp, Mus musculus
ctctgcctgaaagacactcaggaca

SEQ ID NO: 5016 - DNA, 25 bp, Mus musculus
agccttacgctcacatgaacggggg

SEQ ID NO: 5017 - DNA, 25 bp, Mus musculus
gcgccaacgagagggccttgcctct

SEQ ID NO: 5018 - DNA, 25 bp, Mus musculus
ccaacgagagggccttgcctctgcc

SEQ ID NO: 5019 - DNA, 25 bp, Mus musculus
agtcctcgacctgctgatcctcgga

SEQ ID NO: 5020 - DNA, 25 bp, Mus musculus
gctgatcctcggacacaccgtagca

SEQ ID NO: 5021 - DNA, 25 bp, Mus musculus
gatcctcggacacaccgtagcacgc

SEQ ID NO: 5022 - DNA, 25 bp, Mus musculus
acacaccgtagcacgcgccaacagt

SEQ ID NO: 5023 - DNA, 25 bp, Mus musculus
caccgtagcacgcgccaacagtaac

SEQ ID NO: 5024 - DNA, 25 bp, Mus musculus
agcacgcgccaacagtaacgtgtgt

SEQ ID NO: 5025 - DNA, 25 bp, Mus musculus
acgcgccaacagtaacgtgtgtgcg

SEQ ID NO: 5026 - DNA, 25 bp, Mus musculus
tgcctgaaagacactcaggacacaa

SEQ ID NO: 5027 - DNA, 25 bp, Mus musculus
cgccaacagtaacgtgtgtgcgccc

SEQ ID NO: 5028 - DNA, 25 bp, Mus musculus
gacactcaggacacaaggctgagaa

SEQ ID NO: 5029 - DNA, 25 bp, Mus musculus
actcaggacacaaggctgagaatgg

SEQ ID NO: 5030 - DNA, 25 bp, Mus musculus
tcgttctccgcgccagttttgatga

SEQ ID NO: 5031 - DNA, 25 bp, Mus musculus
ttctccgcgccagttttgatgagag

SEQ ID NO: 5032 - DNA, 25 bp, Mus musculus
tccgcgccagttttgatgagagaca

SEQ ID NO: 5033 - DNA, 25 bp, Mus musculus
agagacagccttacgctcacatgaa

SEQ ID NO: 5034 - DNA, 25 bp, Mus musculus
gacagccttacgctcacatgaacgg

SEQ ID NO: 5035 - DNA, 25 bp, Mus musculus
acgaagtctgcgtgacttcttagga

SEQ ID NO: 5036 - DNA, 25 bp, Mus musculus
agtctgcgtgacttcttaggaaata

SEQ ID NO: 5037 - DNA, 25 bp, Mus musculus
cgatcatcacacattctagtgcgta

SEQ ID NO: 5038 - DNA, 25 bp, Mus musculus
atcatcacacattctagtgcgtaat

SEQ ID NO: 5039 - DNA, 25 bp, Mus musculus
catcacacattctagtgcgtaatgg

SEQ ID NO: 5040 - DNA, 25 bp, Mus musculus
tcacacattctagtgcgtaatggac

SEQ ID NO: 5041 - DNA, 25 bp, Mus musculus
attggctcggttgtttgcagacgca

SEQ ID NO: 5042 - DNA, 25 bp, Mus musculus
ttgtttgcagacgcatgactacata

SEQ ID NO: 5043 - DNA, 25 bp, Mus musculus
gcagacgcatgactacatagcatga

SEQ ID NO: 5044 - DNA, 25 bp, Mus musculus
agacgcatgactacatagcatgaca

SEQ ID NO: 5045 - DNA, 25 bp, Mus musculus
gactacatagcatgacaaggtgcta

SEQ ID NO: 5046 - DNA, 25 bp, Mus musculus
ctacatagcatgacaaggtgctaag

SEQ ID NO: 5047 - DNA, 25 bp, Mus musculus
tctgcgtgacttcttaggaaatagt

SEQ ID NO: 5048 - DNA, 25 bp, Mus musculus
gctctgaagtcgctataccttgtag

SEQ ID NO: 5049 - DNA, 25 bp, Mus musculus
aagtcgctataccttgtagacatgg

SEQ ID NO: 5050 - DNA, 25 bp, Mus musculus
gtcgctataccttgtagacatggcg

SEQ ID NO: 5051 - DNA, 25 bp, Mus musculus
catggcggcacaggtcgctgcacag

SEQ ID NO: 5052 - DNA, 25 bp, Mus musculus
cacaggtcgctgcacagaatggctt

SEQ ID NO: 5053 - DNA, 25 bp, Mus musculus
ggtcgctgcacagaatggcttagat

SEQ ID NO: 5054 - DNA, 25 bp, Mus musculus
tcgctgcacagaatggcttagatcg

SEQ ID NO: 5055 - DNA, 25 bp, Mus musculus
gatctgggaaccacgttctgatttg

SEQ ID NO: 5056 - DNA, 25 bp, Mus musculus
tgatttgtggtccaaacggtcgtgg

SEQ ID NO: 5057 - DNA, 25 bp, Mus musculus
agtttgccattttggatgaatgcac

SEQ ID NO: 5058 - DNA, 25 bp, Mus musculus
aatgcacaagtgcggtcagtgtgga

SEQ ID NO: 5059 - DNA, 25 bp, Mus musculus
aggactacatttacagccactgtcg

SEQ ID NO: 5060 - DNA, 25 bp, Mus musculus
acagccactgtcggaaggttggcat

SEQ ID NO: 5061 - DNA, 25 bp, Mus musculus
tctttaccgtttctcacacgaaatg

SEQ ID NO: 5062 - DNA, 25 bp, Mus musculus
ccgtttctcacacgaaatgcctttg

SEQ ID NO: 5063 - DNA, 25 bp, Mus musculus
ctcacacgaaatgcctttggaagca

SEQ ID NO: 5064 - DNA, 25 bp, Mus musculus
gcctttggaagcaccacgagtacta

SEQ ID NO: 5065 - DNA, 25 bp, Mus musculus
ggaagcaccacgagtactacctgca

SEQ ID NO: 5066 - DNA, 25 bp, Mus musculus
accacgagtactacctgcatatgga

SEQ ID NO: 5067 - DNA, 25 bp, Mus musculus
agttatggcctctttttggaggcag

SEQ ID NO: 5068 - DNA, 25 bp, Mus musculus
tttatgttcctcagcgaccctatat

SEQ ID NO: 5069 - DNA, 25 bp, Mus musculus
ttcctcagcgaccctatatgaccct

SEQ ID NO: 5070 - DNA, 25 bp, Mus musculus
tgaccctgggaacactgagagacca

SEQ ID NO: 5071 - DNA, 25 bp, Mus musculus
ggatctctgaccaggtgctgaagga

SEQ ID NO: 5072 - DNA, 25 bp, Mus musculus
ctgaccaggtgctgaaggagtactt

SEQ ID NO: 5073 - DNA, 25 bp, Mus musculus
atgtacagttgggccacatccttga

SEQ ID NO: 5074 - DNA, 25 bp, Mus musculus
agttgggccacatccttgagcgaga

SEQ ID NO: 5075 - DNA, 25 bp, Mus musculus
tcggcgccactgctgagcagacacc

SEQ ID NO: 5076 - DNA, 25 bp, Mus musculus
cggcgccactgctgagcagacacca

SEQ ID NO: 5077 - DNA, 25 bp, Mus musculus
cagacaccatggcccgcggaaaagc

SEQ ID NO: 5078 - DNA, 25 bp, Mus musculus
gacaccatggcccgcggaaaagcca

SEQ ID NO: 5079 - DNA, 25 bp, Mus musculus
caccatggcccgcggaaaagccaag

SEQ ID NO: 5080 - DNA, 25 bp, Mus musculus
catggcccgcggaaaagccaaggag

SEQ ID NO: 5081 - DNA, 25 bp, Mus musculus
caaattcatctggaactcggagaag

SEQ ID NO: 5082 - DNA, 25 bp, Mus musculus
aaattcatctggaactcggagaaga

SEQ ID NO: 5083 - DNA, 25 bp, Mus musculus
aattcatctggaactcggagaagaa

SEQ ID NO: 5084 - DNA, 25 bp, Mus musculus
tcatctggaactcggagaagaagga

SEQ ID NO: 5085 - DNA, 25 bp, Mus musculus
catctggaactcggagaagaaggag

SEQ ID NO: 5086 - DNA, 25 bp, Mus musculus
gtttaagatccttctgttctacgtg

SEQ ID NO: 5087 - DNA, 25 bp, Mus musculus
gcgccactgctgagcagacaccatg

SEQ ID NO: 5088 - DNA, 25 bp, Mus musculus
cactgctgagcagacaccatggccc

SEQ ID NO: 5089 - DNA, 25 bp, Mus musculus
actgctgagcagacaccatggcccg

SEQ ID NO: 5090 - DNA, 25 bp, Mus musculus
ctgctgagcagacaccatggcccgc

SEQ ID NO: 5091 - DNA, 25 bp, Mus musculus
ctgagcagacaccatggcccgcgga

SEQ ID NO: 5092 - DNA, 25 bp, Mus musculus
tgagcagacaccatggcccgcggaa

SEQ ID NO: 5093 - DNA, 25 bp, Mus musculus
agcagacaccatggcccgcggaaaa

SEQ ID NO: 5094 - DNA, 25 bp, Mus musculus
gcagacaccatggcccgcggaaaag

SEQ ID NO: 5095 - DNA, 25 bp, Mus musculus
ctaccacctcaaggccagctcagag

SEQ ID NO: 5096 - DNA, 25 bp, Mus musculus
cctcaaggccagctcagaggtggac

SEQ ID NO: 5097 - DNA, 25 bp, Mus musculus
cactcagtcagatgactctggggac

SEQ ID NO: 5098 - DNA, 25 bp, Mus musculus
tcagtcagatgactctggggacgac

SEQ ID NO: 5099 - DNA, 25 bp, Mus musculus
gtcagatgactctggggacgacgac

SEQ ID NO: 5100 - DNA, 25 bp, Mus musculus
agatgactctggggacgacgacgaa

SEQ ID NO: 5101 - DNA, 25 bp, Mus musculus
tgactctggggacgacgacgaagag

SEQ ID NO: 5102 - DNA, 25 bp, Mus musculus
ctctggggacgacgacgaagagcct

SEQ ID NO: 5103 - DNA, 25 bp, Mus musculus
cgaagagcctgctgcccctgctgac

SEQ ID NO: 5104 - DNA, 25 bp, Mus musculus
agagcctgctgcccctgctgacaac

SEQ ID NO: 5105 - DNA, 25 bp, Mus musculus
tgctgcccctgctgacaacagtgat

SEQ ID NO: 5106 - DNA, 25 bp, Mus musculus
gctgcccctgctgacaacagtgatc

SEQ ID NO: 5107 - DNA, 25 bp, Mus musculus
caaggccagctcagaggtggaccgt

SEQ ID NO: 5108 - DNA, 25 bp, Mus musculus
ctgcccctgctgacaacagtgatct

SEQ ID NO: 5109 - DNA, 25 bp, Mus musculus
ccgtcagcaatggatcaccgttctg

SEQ ID NO: 5110 - DNA, 25 bp, Mus musculus
gcaatggatcaccgttctggagttg

SEQ ID NO: 5111 - DNA, 25 bp, Mus musculus
atggatcaccgttctggagttggcc

SEQ ID NO: 5112 - DNA, 25 bp, Mus musculus
gatcaccgttctggagttggccaag

SEQ ID NO: 5113 - DNA, 25 bp, Mus musculus
caaggctatccgtgtgatgaacact

SEQ ID NO: 5114 - DNA, 25 bp, Mus musculus
gatgaacactcagtcagatgactct

SEQ ID NO: 5115 - DNA, 25 bp, Mus musculus
gaacactcagtcagatgactctggg

SEQ ID NO: 5116 - DNA, 25 bp, Mus musculus
gagcactggcagtcccaccagcatt

SEQ ID NO: 5117 - DNA, 25 bp, Mus musculus
cactggcagtcccaccagcattgac

SEQ ID NO: 5118 - DNA, 25 bp, Mus musculus
ggacgatgtctactcgcaggtgggt

SEQ ID NO: 5119 - DNA, 25 bp, Mus musculus
cgatgtctactcgcaggtgggtacc

SEQ ID NO: 5120 - DNA, 25 bp, Mus musculus
ctactcgcaggtgggtaccgtgagc

SEQ ID NO: 5121 - DNA, 25 bp, Mus musculus
ctcgcaggtgggtaccgtgagcgct

SEQ ID NO: 5122 - DNA, 25 bp, Mus musculus
taccgtgagcgctgacacaccgcca

SEQ ID NO: 5123 - DNA, 25 bp, Mus musculus
cgggcttcagaccagcgtgcagtga

SEQ ID NO: 5124 - DNA, 25 bp, Mus musculus
gcttcagaccagcgtgcagtgaatg

SEQ ID NO: 5125 - DNA, 25 bp, Mus musculus
tcagaccagcgtgcagtgaatgccg

SEQ ID NO: 5126 - DNA, 25 bp, Mus musculus
gagaaccaccgctgctgctgctgcc

SEQ ID NO: 5127 - DNA, 25 bp, Mus musculus
gcacctggccagtgcgagcatctag

SEQ ID NO: 5128 - DNA, 25 bp, Mus musculus
tagcgtcaaaggcgcgctggagagc

SEQ ID NO: 5129 - DNA, 25 bp, Mus musculus
cgcccaaagacaggcgtgccacggc

SEQ ID NO: 5130 - DNA, 25 bp, Mus musculus
gcaggaaatcaccaacttggccgac

SEQ ID NO: 5131 - DNA, 25 bp, Mus musculus
ggaaatcaccaacttggccgacagc

SEQ ID NO: 5132 - DNA, 25 bp, Mus musculus
aatcaccaacttggccgacagccta

SEQ ID NO: 5133 - DNA, 25 bp, Mus musculus
caacttggccgacagcctacagctg

SEQ ID NO: 5134 - DNA, 25 bp, Mus musculus
cttggccgacagcctacagctggaa

SEQ ID NO: 5135 - DNA, 25 bp, Mus musculus
catccagcagcagacgccggacgat

SEQ ID NO: 5136 - DNA, 25 bp, Mus musculus
ccagcagcagacgccggacgatgtc

SEQ ID NO: 5137 - DNA, 25 bp, Mus musculus
attcatgaagactctcaaaatcgga

SEQ ID NO: 5138 - DNA, 25 bp, Mus musculus
catgaagactctcaaaatcggaaga

SEQ ID NO: 5139 - DNA, 25 bp, Mus musculus
atatgattgagccccattgtgagta

SEQ ID NO: 5140 - DNA, 25 bp, Mus musculus
tatgattgagccccattgtgagtat

SEQ ID NO: 5141 - DNA, 25 bp, Mus musculus
tgattgagccccattgtgagtattg

SEQ ID NO: 5142 - DNA, 25 bp, Mus musculus
gattgagccccattgtgagtattgt

SEQ ID NO: 5143 - DNA, 25 bp, Mus musculus
attgagccccattgtgagtattgtg

SEQ ID NO: 5144 - DNA, 25 bp, Mus musculus
ttgagccccattgtgagtattgtgt

SEQ ID NO: 5145 - DNA, 25 bp, Mus musculus
gagccccattgtgagtattgtgttc

SEQ ID NO: 5146 - DNA, 25 bp, Mus musculus
agccccattgtgagtattgtgttcc

SEQ ID NO: 5147 - DNA, 25 bp, Mus musculus
gccccattgtgagtattgtgttcca

SEQ ID NO: 5148 - DNA, 25 bp, Mus musculus
agtattgtgttccacagcttgaaga

SEQ ID NO: 5149 - DNA, 25 bp, Mus musculus
tgaagactctcaaaatcggaagaag

SEQ ID NO: 5150 - DNA, 25 bp, Mus musculus
gtattgtgttccacagcttgaagaa

SEQ ID NO: 5151 - DNA, 25 bp, Mus musculus
aagactctcaaaatcggaagaagct

SEQ ID NO: 5152 - DNA, 25 bp, Mus musculus
agactctcaaaatcggaagaagctt

SEQ ID NO: 5153 - DNA, 25 bp, Mus musculus
agaagctttcagagctgttgagata

SEQ ID NO: 5154 - DNA, 25 bp, Mus musculus
aagctttcagagctgttgagatact

SEQ ID NO: 5155 - DNA, 25 bp, Mus musculus
agctttcagagctgttgagatacta

SEQ ID NO: 5156 - DNA, 25 bp, Mus musculus
ctatatgattgagccccattgtgag

SEQ ID NO: 5157 - DNA, 25 bp, Mus musculus
tatatgattgagccccattgtgagt

SEQ ID NO: 5158 - DNA, 25 bp, Mus musculus
tgtgcaagctgaagcctttgttgaa

SEQ ID NO: 5159 - DNA, 25 bp, Mus musculus
gcaagctgaagcctttgttgaacaa

SEQ ID NO: 5160 - DNA, 25 bp, Mus musculus
ctctgccgggcgccgaggatgtgta

SEQ ID NO: 5161 - DNA, 25 bp, Mus musculus
agtagggacacgccaccacaccacg

SEQ ID NO: 5162 - DNA, 25 bp, Mus musculus
gtgcagacgcccgtccagtgaactc

SEQ ID NO: 5163 - DNA, 25 bp, Mus musculus
tgcagacgcccgtccagtgaactca

SEQ ID NO: 5164 - DNA, 25 bp, Mus musculus
agacgcccgtccagtgaactcaagc

SEQ ID NO: 5165 - DNA, 25 bp, Mus musculus
gcccgtccagtgaactcaagcgggg

SEQ ID NO: 5166 - DNA, 25 bp, Mus musculus
tggtccacagtctttcctgggacct

SEQ ID NO: 5167 - DNA, 25 bp, Mus musculus
gtccacagtctttcctgggacctct

SEQ ID NO: 5168 - DNA, 25 bp, Mus musculus
ccacagtctttcctgggacctctgt

SEQ ID NO: 5169 - DNA, 25 bp, Mus musculus
ctgttttccctctaacttctgattg

SEQ ID NO: 5170 - DNA, 25 bp, Mus musculus
caagctgaagcctttgttgaacaag

SEQ ID NO: 5171 - DNA, 25 bp, Mus musculus
aagaggcagactcatcctcgggcag

SEQ ID NO: 5172 - DNA, 25 bp, Mus musculus
cgtcaagggggctctggagagccat

SEQ ID NO: 5173 - DNA, 25 bp, Mus musculus
gtcaagggggctctggagagccatt

SEQ ID NO: 5174 - DNA, 25 bp, Mus musculus
ctaagccctcggcccaggagatcac

SEQ ID NO: 5175 - DNA, 25 bp, Mus musculus
tccctcgcggacagcttacagctgg

SEQ ID NO: 5176 - DNA, 25 bp, Mus musculus
tcgcggacagcttacagctggagaa

SEQ ID NO: 5177 - DNA, 25 bp, Mus musculus
cgcggacagcttacagctggagaag

SEQ ID NO: 5178 - DNA, 25 bp, Mus musculus
cccacaggccgccagcttagtcggg

SEQ ID NO: 5179 - DNA, 25 bp, Mus musculus
ggccgccagcttagtcgggttgaca

SEQ ID NO: 5180 - DNA, 25 bp, Mus musculus
gtaggcatcttcagcttcgtgcgga

SEQ ID NO: 5181 - DNA, 25 bp, Mus musculus
agcttcgtgcggagagacaataaaa

SEQ ID NO: 5182 - DNA, 25 bp, Mus musculus
ctccctcttgtacataccaaggtct

SEQ ID NO: 5183 - DNA, 25 bp, Mus musculus
cttgtacataccaaggtctgagtaa

SEQ ID NO: 5184 - DNA, 25 bp, Mus musculus
agctcttagggagcccttctcagtg

SEQ ID NO: 5185 - DNA, 25 bp, Mus musculus
gtctttgacaagcacagctggtgga

SEQ ID NO: 5186 - DNA, 25 bp, Mus musculus
gacaagcacagctggtggaagccca

SEQ ID NO: 5187 - DNA, 25 bp, Mus musculus
aagcccaaggcgcagatcgagcgag

SEQ ID NO: 5188 - DNA, 25 bp, Mus musculus
agatagctgtgtgtaccgtattact

SEQ ID NO: 5189 - DNA, 25 bp, Mus musculus
ctgtgtgtaccgtattactgtatac

SEQ ID NO: 5190 - DNA, 25 bp, Mus musculus
gttgacaacctgcgctaccctatgt

SEQ ID NO: 5191 - DNA, 25 bp, Mus musculus
aacctgcgctaccctatgtacactc

SEQ ID NO: 5192 - DNA, 25 bp, Mus musculus
tacactctcctagatgaaagacttg

SEQ ID NO: 5193 - DNA, 25 bp, Mus musculus
agacttggccttcacaaatggtggc

SEQ ID NO: 5194 - DNA, 25 bp, Mus musculus
acccaaagactctggcgccctattg

SEQ ID NO: 5195 - DNA, 25 bp, Mus musculus
agactctggcgccctattgggccag

SEQ ID NO: 5196 - DNA, 25 bp, Mus musculus
cccagttcagttcacctccagttcg

SEQ ID NO: 5197 - DNA, 25 bp, Mus musculus
gccgctcgctctcagggtgagaaac

SEQ ID NO: 5198 - DNA, 25 bp, Mus musculus
tctaccttcttcaatgtgttaacca

SEQ ID NO: 5199 - DNA, 25 bp, Mus musculus
taccttcttcaatgtgttaaccaat

SEQ ID NO: 5200 - DNA, 25 bp, Mus musculus
tgacttcctttgccagtgtcacaag

SEQ ID NO: 5201 - DNA, 25 bp, Mus musculus
gacttcctttgccagtgtcacaagc

SEQ ID NO: 5202 - DNA, 25 bp, Mus musculus
cttcctttgccagtgtcacaagcca

SEQ ID NO: 5203 - DNA, 25 bp, Mus musculus
ttcctttgccagtgtcacaagccag

SEQ ID NO: 5204 - DNA, 25 bp, Mus musculus
cctttgccagtgtcacaagccagca

SEQ ID NO: 5205 - DNA, 25 bp, Mus musculus
ctttgccagtgtcacaagccagcaa

SEQ ID NO: 5206 - DNA, 25 bp, Mus musculus
ttgccagtgtcacaagccagcaagc

SEQ ID NO: 5207 - DNA, 25 bp, Mus musculus
cagtgtcacaagccagcaagcaaga

SEQ ID NO: 5208 - DNA, 25 bp, Mus musculus
gtgtcacaagccagcaagcaagatt

SEQ ID NO: 5209 - DNA, 25 bp, Mus musculus
tgtcacaagccagcaagcaagattc

SEQ ID NO: 5210 - DNA, 25 bp, Mus musculus
cttcttcaatgtgttaaccaatagt

SEQ ID NO: 5211 - DNA, 25 bp, Mus musculus
ttcttcaatgtgttaaccaatagtc

SEQ ID NO: 5212 - DNA, 25 bp, Mus musculus
gttaaccaatagtcaggcctcagca

SEQ ID NO: 5213 - DNA, 25 bp, Mus musculus
ttaaccaatagtcaggcctcagcag

SEQ ID NO: 5214 - DNA, 25 bp, Mus musculus
caatagtcaggcctcagcagaaaac

SEQ ID NO: 5215 - DNA, 25 bp, Mus musculus
gcctcagcagaaaacttccctttct

SEQ ID NO: 5216 - DNA, 25 bp, Mus musculus
gcagaaaacttccctttctgcacta

SEQ ID NO: 5217 - DNA, 25 bp, Mus musculus
tttgacttcctttgccagtgtcaca

SEQ ID NO: 5218 - DNA, 25 bp, Mus musculus
ctttctcaagtgtcccaagccgtct

SEQ ID NO: 5219 - DNA, 25 bp, Mus musculus
gtcccaagccgtctgcgcacgagat

SEQ ID NO: 5220 - DNA, 25 bp, Mus musculus
cgcccatggacgacgtttatgcgcc

SEQ ID NO: 5221 - DNA, 25 bp, Mus musculus
gcccatggacgacgtttatgcgcct

SEQ ID NO: 5222 - DNA, 25 bp, Mus musculus
acgacgtttatgcgcctggggagct

SEQ ID NO: 5223 - DNA, 25 bp, Mus musculus
cgacgtttatgcgcctggggagctg

SEQ ID NO: 5224 - DNA, 25 bp, Mus musculus
cacactgcccggctctgtgcagtga

SEQ ID NO: 5225 - DNA, 25 bp, Mus musculus
cactgcccggctctgtgcagtgacc

SEQ ID NO: 5226 - DNA, 25 bp, Mus musculus
actgcccggctctgtgcagtgaccc

SEQ ID NO: 5227 - DNA, 25 bp, Mus musculus
tgtgcagtgaccctgcggactgggt

SEQ ID NO: 5228 - DNA, 25 bp, Mus musculus
tgcagtgaccctgcggactgggttc

SEQ ID NO: 5229 - DNA, 25 bp, Mus musculus
gcagtgaccctgcggactgggttcc

SEQ ID NO: 5230 - DNA, 25 bp, Mus musculus
tcccaagccgtctgcgcacgagatc

SEQ ID NO: 5231 - DNA, 25 bp, Mus musculus
ccaagccgtctgcgcacgagatcac

SEQ ID NO: 5232 - DNA, 25 bp, Mus musculus
caagccgtctgcgcacgagatcacc

SEQ ID NO: 5233 - DNA, 25 bp, Mus musculus
agccgtctgcgcacgagatcaccgg

SEQ ID NO: 5234 - DNA, 25 bp, Mus musculus
gtctgcgcacgagatcaccggcctg

SEQ ID NO: 5235 - DNA, 25 bp, Mus musculus
ctgcgcacgagatcaccggcctggc

SEQ ID NO: 5236 - DNA, 25 bp, Mus musculus
gcacgagatcaccggcctggccgac

SEQ ID NO: 5237 - DNA, 25 bp, Mus musculus
acgagatcaccggcctggccgacag

SEQ ID NO: 5238 - DNA, 25 bp, Mus musculus
ataagcgctcaatacgagaagcagg

SEQ ID NO: 5239 - DNA, 25 bp, Mus musculus
gtacaagagccgcatacacgatgct

SEQ ID NO: 5240 - DNA, 25 bp, Mus musculus
gcacaagacaccgacgcaaagcgcg

SEQ ID NO: 5241 - DNA, 25 bp, Mus musculus
acaagacaccgacgcaaagcgcgct

SEQ ID NO: 5242 - DNA, 25 bp, Mus musculus
gacaccgacgcaaagcgcgctgcac

SEQ ID NO: 5243 - DNA, 25 bp, Mus musculus
caccgacgcaaagcgcgctgcacag

SEQ ID NO: 5244 - DNA, 25 bp, Mus musculus
ccgacgcaaagcgcgctgcacagga

SEQ ID NO: 5245 - DNA, 25 bp, Mus musculus
gacgcaaagcgcgctgcacaggacg

SEQ ID NO: 5246 - DNA, 25 bp, Mus musculus
cgcaaagcgcgctgcacaggacgag

SEQ ID NO: 5247 - DNA, 25 bp, Mus musculus
caaagcgcgctgcacaggacgagga

SEQ ID NO: 5248 - DNA, 25 bp, Mus musculus
aagcgcgctgcacaggacgaggaga

SEQ ID NO: 5249 - DNA, 25 bp, Mus musculus
tgcacaggacgaggagacggaaagc

SEQ ID NO: 5250 - DNA, 25 bp, Mus musculus
aagagccgcatacacgatgctaacc

SEQ ID NO: 5251 - DNA, 25 bp, Mus musculus
gagccgcatacacgatgctaaccga

SEQ ID NO: 5252 - DNA, 25 bp, Mus musculus
gccgcatacacgatgctaaccgaga

SEQ ID NO: 5253 - DNA, 25 bp, Mus musculus
cgcatacacgatgctaaccgagagc

SEQ ID NO: 5254 - DNA, 25 bp, Mus musculus
cgatgctaaccgagagcgccgcaca

SEQ ID NO: 5255 - DNA, 25 bp, Mus musculus
atgctaaccgagagcgccgcacaag

SEQ ID NO: 5256 - DNA, 25 bp, Mus musculus
cgccgcacaagacaccgacgcaaag

SEQ ID NO: 5257 - DNA, 25 bp, Mus musculus
ccgcacaagacaccgacgcaaagcg

SEQ ID NO: 5258 - DNA, 25 bp, Mus musculus
tttctagtccagctgtgcagaaact

SEQ ID NO: 5259 - DNA, 25 bp, Mus musculus
cccatttcttcattaagttttgcat

SEQ ID NO: 5260 - DNA, 25 bp, Mus musculus
agagatcctgcttcgagatttctta

SEQ ID NO: 5261 - DNA, 25 bp, Mus musculus
gatcctgcttcgagatttcttaaag

SEQ ID NO: 5262 - DNA, 25 bp, Mus musculus
cctgcttcgagatttcttaaagctg

SEQ ID NO: 5263 - DNA, 25 bp, Mus musculus
agatttcttaaagctgcagacactg

SEQ ID NO: 5264 - DNA, 25 bp, Mus musculus
tttcttaaagctgcagacactgcac

SEQ ID NO: 5265 - DNA, 25 bp, Mus musculus
cttaaagctgcagacactgcactat

SEQ ID NO: 5266 - DNA, 25 bp, Mus musculus
gctgcagacactgcactattggttt

SEQ ID NO: 5267 - DNA, 25 bp, Mus musculus
gcagacactgcactattggttttgt

SEQ ID NO: 5268 - DNA, 25 bp, Mus musculus
tgaaactatacattcaaattgctat

SEQ ID NO: 5269 - DNA, 25 bp, Mus musculus
tatacattcaaattgctatgttcct

SEQ ID NO: 5270 - DNA, 25 bp, Mus musculus
tcttcattaagttttgcatgatcat

SEQ ID NO: 5271 - DNA, 25 bp, Mus musculus
agttttgcatgatcatcacacagat

SEQ ID NO: 5272 - DNA, 25 bp, Mus musculus
gcatgatcatcacacagattagtta

SEQ ID NO: 5273 - DNA, 25 bp, Mus musculus
tcatcacacagattagttaggtttt

SEQ ID NO: 5274 - DNA, 25 bp, Mus musculus
ccatacttctaggtcttttgctagt

SEQ ID NO: 5275 - DNA, 25 bp, Mus musculus
tacttctaggtcttttgctagtgag

SEQ ID NO: 5276 - DNA, 25 bp, Mus musculus
ttctaggtcttttgctagtgagttc

SEQ ID NO: 5277 - DNA, 25 bp, Mus musculus
ttcagagatcctgcttcgagatttc

SEQ ID NO: 5278 - DNA, 25 bp, Mus musculus
gaggctccaagatctcatccaccat

SEQ ID NO: 5279 - DNA, 25 bp, Mus musculus
ccaagatctcatccaccatcaagag

SEQ ID NO: 5280 - DNA, 25 bp, Mus musculus
ccaacaaccaagctgccgatagcct

SEQ ID NO: 5281 - DNA, 25 bp, Mus musculus
accaagctgccgatagcctctcctt

SEQ ID NO: 5282 - DNA, 25 bp, Mus musculus
aactctgcttctcaccatcagctaa

SEQ ID NO: 5283 - DNA, 25 bp, Mus musculus
gcttctcaccatcagctaaagggac

SEQ ID NO: 5284 - DNA, 25 bp, Mus musculus
ccagtccctaggggagccaagagct

SEQ ID NO: 5285 - DNA, 25 bp, Mus musculus
ggagccaagagctcccaaggaagga

SEQ ID NO: 5286 - DNA, 25 bp, Mus musculus
aggcaagcatcccaaccagatccaa

SEQ ID NO: 5287 - DNA, 25 bp, Mus musculus
cactgtccccatgctgaatgctcag

SEQ ID NO: 5288 - DNA, 25 bp, Mus musculus
tgctcaggactcttgggtcctgccc

SEQ ID NO: 5289 - DNA, 25 bp, Mus musculus
ctgtttacggatccctcattttgtg

SEQ ID NO: 5290 - DNA, 25 bp, Mus musculus
gcaccccatctggaaagcggtacaa

SEQ ID NO: 5291 - DNA, 25 bp, Mus musculus
tggccactggacatgggaagtacga

SEQ ID NO: 5292 - DNA, 25 bp, Mus musculus
agggctcagcaccatagaccatgtt

SEQ ID NO: 5293 - DNA, 25 bp, Mus musculus
cagcaccatagaccatgtttgcatc

SEQ ID NO: 5294 - DNA, 25 bp, Mus musculus
ccatgtttgcatcctggatagactc

SEQ ID NO: 5295 - DNA, 25 bp, Mus musculus
ttgcatcctggatagactccggccg

SEQ ID NO: 5296 - DNA, 25 bp, Mus musculus
cctggatagactccggccggatgcc

SEQ ID NO: 5297 - DNA, 25 bp, Mus musculus
cagccctgaccaagaaattgcttcc

SEQ ID NO: 5298 - DNA, 25 bp, Mus musculus
tgtcagaaccgtccgcgctgcaagg

SEQ ID NO: 5299 - DNA, 25 bp, Mus musculus
tcagaaccgtccgcgctgcaaggag

SEQ ID NO: 5300 - DNA, 25 bp, Mus musculus
atggctttgtgcacatagaggacaa

SEQ ID NO: 5301 - DNA, 25 bp, Mus musculus
aggacaagacggccgctgaggatgc

SEQ ID NO: 5302 - DNA, 25 bp, Mus musculus
caagacggccgctgaggatgccata

SEQ ID NO: 5303 - DNA, 25 bp, Mus musculus
agacggccgctgaggatgccatacg

SEQ ID NO: 5304 - DNA, 25 bp, Mus musculus
aggatgccatacgcaacctgcacca

SEQ ID NO: 5305 - DNA, 25 bp, Mus musculus
cctgcaccactacaagctgcacgga

SEQ ID NO: 5306 - DNA, 25 bp, Mus musculus
tgcaccactacaagctgcacggagt

SEQ ID NO: 5307 - DNA, 25 bp, Mus musculus
ccactacaagctgcacggagtgaac

SEQ ID NO: 5308 - DNA, 25 bp, Mus musculus
actacaagctgcacggagtgaacat

SEQ ID NO: 5309 - DNA, 25 bp, Mus musculus
tacaagctgcacggagtgaacatca

SEQ ID NO: 5310 - DNA, 25 bp, Mus musculus
gacctgcaggtatccatgcggctgt

SEQ ID NO: 5311 - DNA, 25 bp, Mus musculus
ggtatccatgcggctgtgtggagat

SEQ ID NO: 5312 - DNA, 25 bp, Mus musculus
tcattggaaatctgccccgggaggc

SEQ ID NO: 5313 - DNA, 25 bp, Mus musculus
ggagatccgctcactcttcgagcag

SEQ ID NO: 5314 - DNA, 25 bp, Mus musculus
agatccgctcactcttcgagcagta

SEQ ID NO: 5315 - DNA, 25 bp, Mus musculus
actcttcgagcagtacgggaaggtg

SEQ ID NO: 5316 - DNA, 25 bp, Mus musculus
tcttcgagcagtacgggaaggtgct

SEQ ID NO: 5317 - DNA, 25 bp, Mus musculus
ttatggctttgtgcacatagaggac

SEQ ID NO: 5318 - DNA, 25 bp, Mus musculus
gcccagacccagaatgtaaaccagg

SEQ ID NO: 5319 - DNA, 25 bp, Mus musculus
aatgtaaaccaggccaaaatggctg

SEQ ID NO: 5320 - DNA, 25 bp, Mus musculus
ggtgcagcagcccagacctcagcag

SEQ ID NO: 5321 - DNA, 25 bp, Mus musculus
gcagcagcccagacctcagcagatg

SEQ ID NO: 5322 - DNA, 25 bp, Mus musculus
gcagcccagacctcagcagatggct

SEQ ID NO: 5323 - DNA, 25 bp, Mus musculus
cagacctcagcagatggctcccagg

SEQ ID NO: 5324 - DNA, 25 bp, Mus musculus
acctcagcagatggctcccaggctc

SEQ ID NO: 5325 - DNA, 25 bp, Mus musculus
gatggctcccaggctcagaatgtgg

SEQ ID NO: 5326 - DNA, 25 bp, Mus musculus
ggctcccaggctcagaatgtggagt

SEQ ID NO: 5327 - DNA, 25 bp, Mus musculus
tcgctggcttccgggaactggaggt

SEQ ID NO: 5328 - DNA, 25 bp, Mus musculus
tctgctccggttccagtaaccactc

SEQ ID NO: 5329 - DNA, 25 bp, Mus musculus
gctccggttccagtaaccactcaga

SEQ ID NO: 5330 - DNA, 25 bp, Mus musculus
gtaaaccaggccaaaatggctgacg

SEQ ID NO: 5331 - DNA, 25 bp, Mus musculus
aaccaggccaaaatggctgacgtag

SEQ ID NO: 5332 - DNA, 25 bp, Mus musculus
atggctgacgtagggaccagtgcag

SEQ ID NO: 5333 - DNA, 25 bp, Mus musculus
accagtgcaggtatctctgaaactg

SEQ ID NO: 5334 - DNA, 25 bp, Mus musculus
ggtatctctgaaactgacggtgcag

SEQ ID NO: 5335 - DNA, 25 bp, Mus musculus
atctctgaaactgacggtgcagcag

SEQ ID NO: 5336 - DNA, 25 bp, Mus musculus
tctgaaactgacggtgcagcagccc

SEQ ID NO: 5337 - DNA, 25 bp, Mus musculus
gaaactgacggtgcagcagcccaga

SEQ ID NO: 5338 - DNA, 25 bp, Mus musculus
gatgtcagttctgtcagaagagaag

SEQ ID NO: 5339 - DNA, 25 bp, Mus musculus
gaagtcagcttagcgagcagggcag

SEQ ID NO: 5340 - DNA, 25 bp, Mus musculus
tactcatttacggtgcaattgcttc

SEQ ID NO: 5341 - DNA, 25 bp, Mus musculus
tcatttacggtgcaattgcttctgt

SEQ ID NO: 5342 - DNA, 25 bp, Mus musculus
gtgcaattgcttctgtttgctaatg

SEQ ID NO: 5343 - DNA, 25 bp, Mus musculus
caattgcttctgtttgctaatgctg

SEQ ID NO: 5344 - DNA, 25 bp, Mus musculus
cttctgtttgctaatgctgctttgc

SEQ ID NO: 5345 - DNA, 25 bp, Mus musculus
ctgtttgctaatgctgctttgcaaa

SEQ ID NO: 5346 - DNA, 25 bp, Mus musculus
tttgctaatgctgctttgcaaatta

SEQ ID NO: 5347 - DNA, 25 bp, Mus musculus
gctaatgctgctttgcaaattaaac

SEQ ID NO: 5348 - DNA, 25 bp, Mus musculus
aatgctgctttgcaaattaaacttg

SEQ ID NO: 5349 - DNA, 25 bp, Mus musculus
cacccacaggcgtaagaacaagagc

SEQ ID NO: 5350 - DNA, 25 bp, Mus musculus
gtcagcttagcgagcagggcaggtt

SEQ ID NO: 5351 - DNA, 25 bp, Mus musculus
caagagcatctcagcattgcttaga

SEQ ID NO: 5352 - DNA, 25 bp, Mus musculus
agcttagcgagcagggcaggttcct

SEQ ID NO: 5353 - DNA, 25 bp, Mus musculus
ttagcgagcagggcaggttccttac

SEQ ID NO: 5354 - DNA, 25 bp, Mus musculus
tccttacgatgtgtcacttgaaggc

SEQ ID NO: 5355 - DNA, 25 bp, Mus musculus
ttacgatgtgtcacttgaaggcaac

SEQ ID NO: 5356 - DNA, 25 bp, Mus musculus
tataattaccgataatttagagatt

SEQ ID NO: 5357 - DNA, 25 bp, Mus musculus
agagattactcatttacggtgcaat

SEQ ID NO: 5358 - DNA, 25 bp, Mus musculus
gattactcatttacggtgcaattgc

SEQ ID NO: 5359 - DNA, 25 bp, Mus musculus
tgatctgcgccgcacaaagacagag

SEQ ID NO: 5360 - DNA, 25 bp, Mus musculus
gcgccgcacaaagacagagatctcc

SEQ ID NO: 5361 - DNA, 25 bp, Mus musculus
aggactgagttcatcctatggggga

SEQ ID NO: 5362 - DNA, 25 bp, Mus musculus
gagttcatcctatgggggactcact

SEQ ID NO: 5363 - DNA, 25 bp, Mus musculus
atcctatgggggactcactagccct

SEQ ID NO: 5364 - DNA, 25 bp, Mus musculus
actcactagccctggcttcagctac

SEQ ID NO: 5365 - DNA, 25 bp, Mus musculus
tagccctggcttcagctacggaatg

SEQ ID NO: 5366 - DNA, 25 bp, Mus musculus
tggcttcagctacggaatgagctcc

SEQ ID NO: 5367 - DNA, 25 bp, Mus musculus
gtccgagtcttctgatgtcgtgtcc

SEQ ID NO: 5368 - DNA, 25 bp, Mus musculus
tgatgtcgtgtccaagtgaatggcc

SEQ ID NO: 5369 - DNA, 25 bp, Mus musculus
aatggccactgaagtccttgccagc

SEQ ID NO: 5370 - DNA, 25 bp, Mus musculus
cactgaagtccttgccagctagctc

SEQ ID NO: 5371 - DNA, 25 bp, Mus musculus
gaaccgcaacatcaaccgcctgcag

SEQ ID NO: 5372 - DNA, 25 bp, Mus musculus
actgaagtccttgccagctagctcc

SEQ ID NO: 5373 - DNA, 25 bp, Mus musculus
caacatcaaccgcctgcaggagatt

SEQ ID NO: 5374 - DNA, 25 bp, Mus musculus
caaccgcctgcaggagattgaagcc

SEQ ID NO: 5375 - DNA, 25 bp, Mus musculus
tgaagccctcaaaggccagagggca

SEQ ID NO: 5376 - DNA, 25 bp, Mus musculus
cctcaaaggccagagggcatcgttg

SEQ ID NO: 5377 - DNA, 25 bp, Mus musculus
tcatacgaagaccaccagcggctac

SEQ ID NO: 5378 - DNA, 25 bp, Mus musculus
gaagaccaccagcggctactcagga

SEQ ID NO: 5379 - DNA, 25 bp, Mus musculus
caccagcggctactcaggaggactg

SEQ ID NO: 5380 - DNA, 25 bp, Mus musculus
ccaacaccagccatggggaagatca

SEQ ID NO: 5381 - DNA, 25 bp, Mus musculus
aacaccagccatggggaagatcacc

SEQ ID NO: 5382 - DNA, 25 bp, Mus musculus
gctctatgagcagcccaacttcgca

SEQ ID NO: 5383 - DNA, 25 bp, Mus musculus
tctatgagcagcccaacttcgcagg

SEQ ID NO: 5384 - DNA, 25 bp, Mus musculus
tatgagcagcccaacttcgcaggct

SEQ ID NO: 5385 - DNA, 25 bp, Mus musculus
tgagcagcccaacttcgcaggctgc

SEQ ID NO: 5386 - DNA, 25 bp, Mus musculus
gcccaacttcgcaggctgccagtac

SEQ ID NO: 5387 - DNA, 25 bp, Mus musculus
ccaacttcgcaggctgccagtactt

SEQ ID NO: 5388 - DNA, 25 bp, Mus musculus
aacttcgcaggctgccagtacttcc

SEQ ID NO: 5389 - DNA, 25 bp, Mus musculus
cttcgcaggctgccagtacttcctg

SEQ ID NO: 5390 - DNA, 25 bp, Mus musculus
tcgcaggctgccagtacttcctgcg

SEQ ID NO: 5391 - DNA, 25 bp, Mus musculus
gcaggctgccagtacttcctgcgtc

SEQ ID NO: 5392 - DNA, 25 bp, Mus musculus
caccagccatggggaagatcacctt

SEQ ID NO: 5393 - DNA, 25 bp, Mus musculus
ggcttccagggccccactatgagtg

SEQ ID NO: 5394 - DNA, 25 bp, Mus musculus
cttccagggccccactatgagtgca

SEQ ID NO: 5395 - DNA, 25 bp, Mus musculus
tccagggccccactatgagtgcagc

SEQ ID NO: 5396 - DNA, 25 bp, Mus musculus
cagggccccactatgagtgcagcac

SEQ ID NO: 5397 - DNA, 25 bp, Mus musculus
gggccccactatgagtgcagcaccg

SEQ ID NO: 5398 - DNA, 25 bp, Mus musculus
gccccactatgagtgcagcaccgac

SEQ ID NO: 5399 - DNA, 25 bp, Mus musculus
atgctctatgagcagcccaacttcg

SEQ ID NO: 5400 - DNA, 25 bp, Mus musculus
gtatccacttgggtggctctgctgc

SEQ ID NO: 5401 - DNA, 25 bp, Mus musculus
ctgctgctgcagcccctgcagggga

SEQ ID NO: 5402 - DNA, 25 bp, Mus musculus
ccagttggcttgattccctgctctg

SEQ ID NO: 5403 - DNA, 25 bp, Mus musculus
tgctctgcgccctggagctgaaggc

SEQ ID NO: 5404 - DNA, 25 bp, Mus musculus
gctctgcccaatggacttgcagcct

SEQ ID NO: 5405 - DNA, 25 bp, Mus musculus
cccaatggacttgcagcctctcttg

SEQ ID NO: 5406 - DNA, 25 bp, Mus musculus
ggacttgcagcctctcttgtcttca

SEQ ID NO: 5407 - DNA, 25 bp, Mus musculus
agcccgtggctgtaggagagtacag

SEQ ID NO: 5408 - DNA, 25 bp, Mus musculus
agtacaggtccagctctttcctctg

SEQ ID NO: 5409 - DNA, 25 bp, Mus musculus
ggtccagctctttcctctgcagtct

SEQ ID NO: 5410 - DNA, 25 bp, Mus musculus
ttgcaacaacctgctcccttgcaaa

SEQ ID NO: 5411 - DNA, 25 bp, Mus musculus
gctcccttgcaaactaaataaagca

SEQ ID NO: 5412 - DNA, 25 bp, Mus musculus
atgtacccaggcgactatgcgacac

SEQ ID NO: 5413 - DNA, 25 bp, Mus musculus
gactatgcgacacctgagcagatgg

SEQ ID NO: 5414 - DNA, 25 bp, Mus musculus
tatgaaactcagctccgcagataca

SEQ ID NO: 5415 - DNA, 25 bp, Mus musculus
ctccgcagatacatcaacacactga

SEQ ID NO: 5416 - DNA, 25 bp, Mus musculus
agatacatcaacacactgaccaggc

SEQ ID NO: 5417 - DNA, 25 bp, Mus musculus
acactgaccaggcctaggtatggga

SEQ ID NO: 5418 - DNA, 25 bp, Mus musculus
aacacaggtggacttcctggagtgc

SEQ ID NO: 5419 - DNA, 25 bp, Mus musculus
ggtggacttcctggagtgcagctct

SEQ ID NO: 5420 - DNA, 25 bp, Mus musculus
atatcatcatgatgcagggaggatg

SEQ ID NO: 5421 - DNA, 25 bp, Mus musculus
tatcatcatgatgcagggaggatgc

SEQ ID NO: 5422 - DNA, 25 bp, Mus musculus
cctgtgcagcacagatgggtcccaa

SEQ ID NO: 5423 - DNA, 25 bp, Mus musculus
ccaaccctatgagcaaatcacattt

SEQ ID NO: 5424 - DNA, 25 bp, Mus musculus
caaccctatgagcaaatcacattta

SEQ ID NO: 5425 - DNA, 25 bp, Mus musculus
accctatgagcaaatcacatttatt

SEQ ID NO: 5426 - DNA, 25 bp, Mus musculus
atttgtaattcagtcgcatttattc

SEQ ID NO: 5427 - DNA, 25 bp, Mus musculus
ttgtaattcagtcgcatttattctg

SEQ ID NO: 5428 - DNA, 25 bp, Mus musculus
taattcagtcgcatttattctgtaa

SEQ ID NO: 5429 - DNA, 25 bp, Mus musculus
aattcagtcgcatttattctgtaag

SEQ ID NO: 5430 - DNA, 25 bp, Mus musculus
ttcagtcgcatttattctgtaagaa

SEQ ID NO: 5431 - DNA, 25 bp, Mus musculus
tcagtcgcatttattctgtaagaaa

SEQ ID NO: 5432 - DNA, 25 bp, Mus musculus
cacccacaggcgtcaagaaggaccg

SEQ ID NO: 5433 - DNA, 25 bp, Mus musculus
gaaagccctgtaatgactcagggcc

SEQ ID NO: 5434 - DNA, 25 bp, Mus musculus
agccctgtaatgactcagggccctg

SEQ ID NO: 5435 - DNA, 25 bp, Mus musculus
gccctgtaatgactcagggccctgt

SEQ ID NO: 5436 - DNA, 25 bp, Mus musculus
gtaatgactcagggccctgtgcagc

SEQ ID NO: 5437 - DNA, 25 bp, Mus musculus
taatgactcagggccctgtgcagca

SEQ ID NO: 5438 - DNA, 25 bp, Mus musculus
actcagggccctgtgcagcacagat

SEQ ID NO: 5439 - DNA, 25 bp, Mus musculus
agggccctgtgcagcacagatgggt

SEQ ID NO: 5440 - DNA, 25 bp, Mus musculus
cgtacaagcatgtcagtggacagat

SEQ ID NO: 5441 - DNA, 25 bp, Mus musculus
tgctatattttgcacctgatctaat

SEQ ID NO: 5442 - DNA, 25 bp, Mus musculus
gcttctaccaactcacaaaacttct

SEQ ID NO: 5443 - DNA, 25 bp, Mus musculus
tcacaaaacttctcgacagcttgca

SEQ ID NO: 5444 - DNA, 25 bp, Mus musculus
aacttctcgacagcttgcatgatct

SEQ ID NO: 5445 - DNA, 25 bp, Mus musculus
ttgtgaaacagctccacctgtactg

SEQ ID NO: 5446 - DNA, 25 bp, Mus musculus
tccacctgtactgcttgaatacatt

SEQ ID NO: 5447 - DNA, 25 bp, Mus musculus
aatcccggacactggctgtggaatt

SEQ ID NO: 5448 - DNA, 25 bp, Mus musculus
ttgctgcccagttgcccaagatcct

SEQ ID NO: 5449 - DNA, 25 bp, Mus musculus
tgcccaagatcctggcgggcatggt

SEQ ID NO: 5450 - DNA, 25 bp, Mus musculus
tgaagccgctcctctttcacaaaaa

SEQ ID NO: 5451 - DNA, 25 bp, Mus musculus
cgctcctctttcacaaaaagtgatg

SEQ ID NO: 5452 - DNA, 25 bp, Mus musculus
attttgcacctgatctaatcctaaa

SEQ ID NO: 5453 - DNA, 25 bp, Mus musculus
tcaaactccaggtgacccatgagga

SEQ ID NO: 5454 - DNA, 25 bp, Mus musculus
atgaggaattcctctgtatgaaagt

SEQ ID NO: 5455 - DNA, 25 bp, Mus musculus
aattcctctgtatgaaagtcttact

SEQ ID NO: 5456 - DNA, 25 bp, Mus musculus
caattcctttggaaggactgaggag

SEQ ID NO: 5457 - DNA, 25 bp, Mus musculus
gatcaagctatatccgcgaattgat

SEQ ID NO: 5458 - DNA, 25 bp, Mus musculus
gctatatccgcgaattgatcaaggc

SEQ ID NO: 5459 - DNA, 25 bp, Mus musculus
cacagcgcttctaccaactcacaaa

SEQ ID NO: 5460 - DNA, 25 bp, Mus musculus
gagcacagaagcagcaccagagctc

SEQ ID NO: 5461 - DNA, 25 bp, Mus musculus
agcacagaagcagcaccagagctcc

SEQ ID NO: 5462 - DNA, 25 bp, Mus musculus
ccccacagaaacccagctgaaggtg

SEQ ID NO: 5463 - DNA, 25 bp, Mus musculus
cccacagaaacccagctgaaggtga

SEQ ID NO: 5464 - DNA, 25 bp, Mus musculus
ccacagaaacccagctgaaggtgat

SEQ ID NO: 5465 - DNA, 25 bp, Mus musculus
cacagaaacccagctgaaggtgatc

SEQ ID NO: 5466 - DNA, 25 bp, Mus musculus
acagaaacccagctgaaggtgatca

SEQ ID NO: 5467 - DNA, 25 bp, Mus musculus
cagaaacccagctgaaggtgatcaa

SEQ ID NO: 5468 - DNA, 25 bp, Mus musculus
gaaacccagctgaaggtgatcaact

SEQ ID NO: 5469 - DNA, 25 bp, Mus musculus
aaacccagctgaaggtgatcaactg

SEQ ID NO: 5470 - DNA, 25 bp, Mus musculus
aacccagctgaaggtgatcaactgg

SEQ ID NO: 5471 - DNA, 25 bp, Mus musculus
gcacagaagcagcaccagagctcct

SEQ ID NO: 5472 - DNA, 25 bp, Mus musculus
accagagctcctggcacattctctg

SEQ ID NO: 5473 - DNA, 25 bp, Mus musculus
ccagagctcctggcacattctctgg

SEQ ID NO: 5474 - DNA, 25 bp, Mus musculus
cagagctcctggcacattctctggt

SEQ ID NO: 5475 - DNA, 25 bp, Mus musculus
ctcctggcacattctctggttggga

SEQ ID NO: 5476 - DNA, 25 bp, Mus musculus
tcctggcacattctctggttgggac

SEQ ID NO: 5477 - DNA, 25 bp, Mus musculus
ttgggcagccacctttctctggcgc

SEQ ID NO: 5478 - DNA, 25 bp, Mus musculus
tgggcagccacctttctctggcgcc

SEQ ID NO: 5479 - DNA, 25 bp, Mus musculus
tgaatgtaattcctctgcctcgtcc

SEQ ID NO: 5480 - DNA, 25 bp, Mus musculus
aatgtaattcctctgcctcgtcctt

SEQ ID NO: 5481 - DNA, 25 bp, Mus musculus
ccaggtctgcgtgggcagtcccaga

SEQ ID NO: 5482 - DNA, 25 bp, Mus musculus
caggtctgcgtgggcagtcccagaa

SEQ ID NO: 5483 - DNA, 25 bp, Mus musculus
gtctgcgtgggcagtcccagaaaga

SEQ ID NO: 5484 - DNA, 25 bp, Mus musculus
tctgcgtgggcagtcccagaaagaa

SEQ ID NO: 5485 - DNA, 25 bp, Mus musculus
aaagcctgacctgcgtgcaatcaga

SEQ ID NO: 5486 - DNA, 25 bp, Mus musculus
aagcctgacctgcgtgcaatcagag

SEQ ID NO: 5487 - DNA, 25 bp, Mus musculus
cctgacctgcgtgcaatcagagtct

SEQ ID NO: 5488 - DNA, 25 bp, Mus musculus
ctgacctgcgtgcaatcagagtctt

SEQ ID NO: 5489 - DNA, 25 bp, Mus musculus
gacctgcgtgcaatcagagtcttca

SEQ ID NO: 5490 - DNA, 25 bp, Mus musculus
acctgcgtgcaatcagagtcttcaa

SEQ ID NO: 5491 - DNA, 25 bp, Mus musculus
ctctgcctcgtccttctgactttat

SEQ ID NO: 5492 - DNA, 25 bp, Mus musculus
ctgcctcgtccttctgactttatca

SEQ ID NO: 5493 - DNA, 25 bp, Mus musculus
ctcgtccttctgactttatcaagcc

SEQ ID NO: 5494 - DNA, 25 bp, Mus musculus
tttatcaagccggggaagatgtgcc

SEQ ID NO: 5495 - DNA, 25 bp, Mus musculus
agtgacagaacctacctcagataca

SEQ ID NO: 5496 - DNA, 25 bp, Mus musculus
gtgacagaacctacctcagatacac

SEQ ID NO: 5497 - DNA, 25 bp, Mus musculus
tgacagaacctacctcagatacact

SEQ ID NO: 5498 - DNA, 25 bp, Mus musculus
acctccaggtctgcgtgggcagtcc

SEQ ID NO: 5499 - DNA, 25 bp, Mus musculus
atcagaaggaccatgctgtgtttac

SEQ ID NO: 5500 - DNA, 25 bp, Mus musculus
aggaccatgctgtgtttacaaggcg

SEQ ID NO: 5501 - DNA, 25 bp, Mus musculus
ctactcttgacaaccgaaccatgag

SEQ ID NO: 5502 - DNA, 25 bp, Mus musculus
ctcttgacaaccgaaccatgagtca

SEQ ID NO: 5503 - DNA, 25 bp, Mus musculus
ttgacaaccgaaccatgagtcatca

SEQ ID NO: 5504 - DNA, 25 bp, Mus musculus
acaaccgaaccatgagtcatcaccc

SEQ ID NO: 5505 - DNA, 25 bp, Mus musculus
accgaaccatgagtcatcaccctca

SEQ ID NO: 5506 - DNA, 25 bp, Mus musculus
gaaccatgagtcatcaccctcatcc

SEQ ID NO: 5507 - DNA, 25 bp, Mus musculus
ccatgagtcatcaccctcatccagg

SEQ ID NO: 5508 - DNA, 25 bp, Mus musculus
accctcatccaggtcagattgtcga

SEQ ID NO: 5509 - DNA, 25 bp, Mus musculus
ctcatccaggtcagattgtcgagca

SEQ ID NO: 5510 - DNA, 25 bp, Mus musculus
atccaggtcagattgtcgagcatgg

SEQ ID NO: 5511 - DNA, 25 bp, Mus musculus
accatgctgtgtttacaaggcgagg

SEQ ID NO: 5512 - DNA, 25 bp, Mus musculus
aagccttttcatgtgtataggcata

SEQ ID NO: 5513 - DNA, 25 bp, Mus musculus
atggcttccaaaagccaatatctac

SEQ ID NO: 5514 - DNA, 25 bp, Mus musculus
gcttccaaaagccaatatctactct

SEQ ID NO: 5515 - DNA, 25 bp, Mus musculus
tccaaaagccaatatctactcttga

SEQ ID NO: 5516 - DNA, 25 bp, Mus musculus
agccaatatctactcttgacaaccg

SEQ ID NO: 5517 - DNA, 25 bp, Mus musculus
caatatctactcttgacaaccgaac

SEQ ID NO: 5518 - DNA, 25 bp, Mus musculus
tatctactcttgacaaccgaaccat

SEQ ID NO: 5519 - DNA, 25 bp, Mus musculus
cagcttggtctttcttggactccct

SEQ ID NO: 5520 - DNA, 25 bp, Mus musculus
gcttggtctttcttggactccctgg

SEQ ID NO: 5521 - DNA, 25 bp, Mus musculus
gcttttggcaagtgagcggcccttt

SEQ ID NO: 5522 - DNA, 25 bp, Mus musculus
agcggccctttgcctgctgattggc

SEQ ID NO: 5523 - DNA, 25 bp, Mus musculus
cggccctttgcctgctgattggcct

SEQ ID NO: 5524 - DNA, 25 bp, Mus musculus
gccctttgcctgctgattggcctgg

SEQ ID NO: 5525 - DNA, 25 bp, Mus musculus
tttgcctgctgattggcctggctgt

SEQ ID NO: 5526 - DNA, 25 bp, Mus musculus
ctgattggcctggctgtgacaagaa

SEQ ID NO: 5527 - DNA, 25 bp, Mus musculus
gattggcctggctgtgacaagaagt

SEQ ID NO: 5528 - DNA, 25 bp, Mus musculus
ttggcctggctgtgacaagaagttc

SEQ ID NO: 5529 - DNA, 25 bp, Mus musculus
tgacaagaagttcgcccgttccgat

SEQ ID NO: 5530 - DNA, 25 bp, Mus musculus
acgcacacaggcgagaagcgcttcc

SEQ ID NO: 5531 - DNA, 25 bp, Mus musculus
tacccctctgggtagactgtgatac

SEQ ID NO: 5532 - DNA, 25 bp, Mus musculus
cccctctgggtagactgtgatactg

SEQ ID NO: 5533 - DNA, 25 bp, Mus musculus
gatactggagcacatctaggccagg

SEQ ID NO: 5534 - DNA, 25 bp, Mus musculus
ctggagcacatctaggccaggcttt

SEQ ID NO: 5535 - DNA, 25 bp, Mus musculus
cacatctaggccaggcttttggcaa

SEQ ID NO: 5536 - DNA, 25 bp, Mus musculus
catctaggccaggcttttggcaagt

SEQ ID NO: 5537 - DNA, 25 bp, Mus musculus
tctaggccaggcttttggcaagtga

SEQ ID NO: 5538 - DNA, 25 bp, Mus musculus
aggcttttggcaagtgagcggccct

SEQ ID NO: 5539 - DNA, 25 bp, Mus musculus
cagaaatcctgatgacattacgaat

SEQ ID NO: 5540 - DNA, 25 bp, Mus musculus
aaatcctgatgacattacgaatgaa

SEQ ID NO: 5541 - DNA, 25 bp, Mus musculus
gtcccaagacgcgctccttttgatc

SEQ ID NO: 5542 - DNA, 25 bp, Mus musculus
tcccaagacgcgctccttttgatct

SEQ ID NO: 5543 - DNA, 25 bp, Mus musculus
cccaagacgcgctccttttgatcta

SEQ ID NO: 5544 - DNA, 25 bp, Mus musculus
ccaagacgcgctccttttgatctat

SEQ ID NO: 5545 - DNA, 25 bp, Mus musculus
caagacgcgctccttttgatctatt

SEQ ID NO: 5546 - DNA, 25 bp, Mus musculus
aagacgcgctccttttgatctattt

SEQ ID NO: 5547 - DNA, 25 bp, Mus musculus
agacgcgctccttttgatctatttg

SEQ ID NO: 5548 - DNA, 25 bp, Mus musculus
gacgcgctccttttgatctatttga

SEQ ID NO: 5549 - DNA, 25 bp, Mus musculus
gcgctccttttgatctatttgaaaa

SEQ ID NO: 5550 - DNA, 25 bp, Mus musculus
ttgtatgttcgcagagtttttatca

SEQ ID NO: 5551 - DNA, 25 bp, Mus musculus
aatcctgatgacattacgaatgaag

SEQ ID NO: 5552 - DNA, 25 bp, Mus musculus
aagcatttttctgttgaaggacaat

SEQ ID NO: 5553 - DNA, 25 bp, Mus musculus
agcatttttctgttgaaggacaatt

SEQ ID NO: 5554 - DNA, 25 bp, Mus musculus
catttttctgttgaaggacaattag

SEQ ID NO: 5555 - DNA, 25 bp, Mus musculus
tctttttgtcccaagacgcgctcct

SEQ ID NO: 5556 - DNA, 25 bp, Mus musculus
tttgtcccaagacgcgctccttttg

SEQ ID NO: 5557 - DNA, 25 bp, Mus musculus
ttgtcccaagacgcgctccttttga

SEQ ID NO: 5558 - DNA, 25 bp, Mus musculus
tgtcccaagacgcgctccttttgat

SEQ ID NO: 5559 - DNA, 25 bp, Mus musculus
gtattcaagaagcccccgaatacat

SEQ ID NO: 5560 - DNA, 25 bp, Mus musculus
cccccgaatacatcctatcaagagc

SEQ ID NO: 5561 - DNA, 25 bp, Mus musculus
aaatcttgtctttgcgcaacaccat

SEQ ID NO: 5562 - DNA, 25 bp, Mus musculus
acaccattcgctgcctgcgcaggca

SEQ ID NO: 5563 - DNA, 25 bp, Mus musculus
gcctgcgcaggcattcccacaaggt

SEQ ID NO: 5564 - DNA, 25 bp, Mus musculus
ggtgccaaattgcccatcaaaacaa

SEQ ID NO: 5565 - DNA, 25 bp, Mus musculus
actgctaaacccacattcagtccat

SEQ ID NO: 5566 - DNA, 25 bp, Mus musculus
aaacccacattcagtccatctcttt

SEQ ID NO: 5567 - DNA, 25 bp, Mus musculus
acattcagtccatctctttctgaga

SEQ ID NO: 5568 - DNA, 25 bp, Mus musculus
agtccatctctttctgagatgatcc

SEQ ID NO: 5569 - DNA, 25 bp, Mus musculus
ttgctttatagttttcagtgcatgc

SEQ ID NO: 5570 - DNA, 25 bp, Mus musculus
tgcatgcttgggtgcaattggtctc

SEQ ID NO: 5571 - DNA, 25 bp, Mus musculus
aatacatcctatcaagagccaaaga

SEQ ID NO: 5572 - DNA, 25 bp, Mus musculus
agcagcttcttgagggagttgagaa

SEQ ID NO: 5573 - DNA, 25 bp, Mus musculus
agataattagccaggcctatcctga

SEQ ID NO: 5574 - DNA, 25 bp, Mus musculus
ttagccaggcctatcctgaagccaa

SEQ ID NO: 5575 - DNA, 25 bp, Mus musculus
atgggatctactttgtttggtcaca

SEQ ID NO: 5576 - DNA, 25 bp, Mus musculus
ttgtttggtcacaacttccatccct

SEQ ID NO: 5577 - DNA, 25 bp, Mus musculus
ggtcacaacttccatccctacaggg

SEQ ID NO: 5578 - DNA, 25 bp, Mus musculus
aatccaaaatcttgtctttgcgcaa

SEQ ID NO: 5579 - DNA, 25 bp, Mus musculus
agctagacgcccggactgtccagtg

SEQ ID NO: 5580 - DNA, 25 bp, Mus musculus
cgcagcgagccagcggcaggaaccc

SEQ ID NO: 5581 - DNA, 25 bp, Mus musculus
atcgagctcttcgtcaaggccggca

SEQ ID NO: 5582 - DNA, 25 bp, Mus musculus
cataggaaactgccccttttcacag

SEQ ID NO: 5583 - DNA, 25 bp, Mus musculus
taggaaactgccccttttcacagag

SEQ ID NO: 5584 - DNA, 25 bp, Mus musculus
ccttttcacagaggctcttcatgac

SEQ ID NO: 5585 - DNA, 25 bp, Mus musculus
ttcacagaggctcttcatgactcct

SEQ ID NO: 5586 - DNA, 25 bp, Mus musculus
cagaggctcttcatgactcctttgg

SEQ ID NO: 5587 - DNA, 25 bp, Mus musculus
gaggctcttcatgactcctttggct

SEQ ID NO: 5588 - DNA, 25 bp, Mus musculus
ctcttcatgactcctttggctcaaa

SEQ ID NO: 5589 - DNA, 25 bp, Mus musculus
cttcatgactcctttggctcaaagg

SEQ ID NO: 5590 - DNA, 25 bp, Mus musculus
tcatgactcctttggctcaaaggga

SEQ ID NO: 5591 - DNA, 25 bp, Mus musculus
cagcgagccagcggcaggaacccgc

SEQ ID NO: 5592 - DNA, 25 bp, Mus musculus
cggagccagcccaactggccatggc

SEQ ID NO: 5593 - DNA, 25 bp, Mus musculus
ccaactggccatggcgctgtcgatg

SEQ ID NO: 5594 - DNA, 25 bp, Mus musculus
cgctgtcgatgcccctgaacggact

SEQ ID NO: 5595 - DNA, 25 bp, Mus musculus
ctgtcgatgcccctgaacggactga

SEQ ID NO: 5596 - DNA, 25 bp, Mus musculus
cgatgcccctgaacggactgaagga

SEQ ID NO: 5597 - DNA, 25 bp, Mus musculus
atgcccctgaacggactgaaggagg

SEQ ID NO: 5598 - DNA, 25 bp, Mus musculus
tcatcgagctcttcgtcaaggccgg

SEQ ID NO: 5599 - DNA, 25 bp, Mus musculus
cgttcctgaaacagttgaggatgtc

SEQ ID NO: 5600 - DNA, 25 bp, Mus musculus
gctccatatgctgctagcctggaaa

SEQ ID NO: 5601 - DNA, 25 bp, Mus musculus
caatttcctaaaatctctgcttctt

SEQ ID NO: 5602 - DNA, 25 bp, Mus musculus
cctaaaatctctgcttctttatgat

SEQ ID NO: 5603 - DNA, 25 bp, Mus musculus
atctctgcttctttatgatgatgtc

SEQ ID NO: 5604 - DNA, 25 bp, Mus musculus
tgatgtctgctactctgaattttga

SEQ ID NO: 5605 - DNA, 25 bp, Mus musculus
ctgctactctgaattttgagatatt

SEQ ID NO: 5606 - DNA, 25 bp, Mus musculus
agatattacatgatccatcttttgg

SEQ ID NO: 5607 - DNA, 25 bp, Mus musculus
tacatgatccatcttttggaatctt

SEQ ID NO: 5608 - DNA, 25 bp, Mus musculus
atccatcttttggaatcttcttcta

SEQ ID NO: 5609 - DNA, 25 bp, Mus musculus
tcttctagtctttgcactttgaata

SEQ ID NO: 5610 - DNA, 25 bp, Mus musculus
agtctttgcactttgaatatatgat

SEQ ID NO: 5611 - DNA, 25 bp, Mus musculus
agaatgcccttataggatcctatca

SEQ ID NO: 5612 - DNA, 25 bp, Mus musculus
taggatcctatcaaaggccgaagcc

SEQ ID NO: 5613 - DNA, 25 bp, Mus musculus
agaccttctagagtacatcataaga

SEQ ID NO: 5614 - DNA, 25 bp, Mus musculus
tgaagactacccgacctggtcagat

SEQ ID NO: 5615 - DNA, 25 bp, Mus musculus
ctccctgaagtcagctgataaagaa

SEQ ID NO: 5616 - DNA, 25 bp, Mus musculus
cctgcgtattgacctagaaacagtt

SEQ ID NO: 5617 - DNA, 25 bp, Mus musculus
tattgacctagaaacagttgatttt

SEQ ID NO: 5618 - DNA, 25 bp, Mus musculus
tctagtcaatttcctaaaatctctg

SEQ ID NO: 5619 - DNA, 25 bp, Mus musculus
tgtagacaagctgcagcaagagttc

SEQ ID NO: 5620 - DNA, 25 bp, Mus musculus
agagttccactgctgtggcagcaac

SEQ ID NO: 5621 - DNA, 25 bp, Mus musculus
acacgcctccaacatctataaagtg

SEQ ID NO: 5622 - DNA, 25 bp, Mus musculus
cgcctccaacatctataaagtggaa

SEQ ID NO: 5623 - DNA, 25 bp, Mus musculus
ctgcatcactaagctggagtccttc

SEQ ID NO: 5624 - DNA, 25 bp, Mus musculus
catcactaagctggagtccttcatt

SEQ ID NO: 5625 - DNA, 25 bp, Mus musculus
cactaagctggagtccttcattcag

SEQ ID NO: 5626 - DNA, 25 bp, Mus musculus
gctggagtccttcattcaggagcac

SEQ ID NO: 5627 - DNA, 25 bp, Mus musculus
ggagtccttcattcaggagcacctg

SEQ ID NO: 5628 - DNA, 25 bp, Mus musculus
cttcattcaggagcacctgcgggtc

SEQ ID NO: 5629 - DNA, 25 bp, Mus musculus
cattcaggagcacctgcgggtcatc

SEQ ID NO: 5630 - DNA, 25 bp, Mus musculus
tcaggagcacctgcgggtcatcggg

SEQ ID NO: 5631 - DNA, 25 bp, Mus musculus
gttccactgctgtggcagcaacaac

SEQ ID NO: 5632 - DNA, 25 bp, Mus musculus
ccactgctgtggcagcaacaactct

SEQ ID NO: 5633 - DNA, 25 bp, Mus musculus
tggcagcaacaactctcgagactgg

SEQ ID NO: 5634 - DNA, 25 bp, Mus musculus
agacagccgtgctggtccctgacag

SEQ ID NO: 5635 - DNA, 25 bp, Mus musculus
tggtccctgacagctgctgtaagac

SEQ ID NO: 5636 - DNA, 25 bp, Mus musculus
tccctgacagctgctgtaagactgt

SEQ ID NO: 5637 - DNA, 25 bp, Mus musculus
ctgacagctgctgtaagactgtggt

SEQ ID NO: 5638 - DNA, 25 bp, Mus musculus
taactggctgtggtaagcgggacac

SEQ ID NO: 5639 - DNA, 25 bp, Mus musculus
actctgagaatccgtcgccatccgc

SEQ ID NO: 5640 - DNA, 25 bp, Mus musculus
ccaccatggtgaacttcacagtaga

SEQ ID NO: 5641 - DNA, 25 bp, Mus musculus
agtccacgctgaccgactcccttgt

SEQ ID NO: 5642 - DNA, 25 bp, Mus musculus
cccttgtgtgcaaggctggcatcat

SEQ ID NO: 5643 - DNA, 25 bp, Mus musculus
ttgtgtgcaaggctggcatcattgc

SEQ ID NO: 5644 - DNA, 25 bp, Mus musculus
aggctggcatcattgcctctgcccg

SEQ ID NO: 5645 - DNA, 25 bp, Mus musculus
ctggcatcattgcctctgcccgagc

SEQ ID NO: 5646 - DNA, 25 bp, Mus musculus
gcatcattgcctctgcccgagctgg

SEQ ID NO: 5647 - DNA, 25 bp, Mus musculus
ctgcccgagctggggagacgcgctt

SEQ ID NO: 5648 - DNA, 25 bp, Mus musculus
tcactgacactcgcaaggatgagca

SEQ ID NO: 5649 - DNA, 25 bp, Mus musculus
acactcgcaaggatgagcaggagcg

SEQ ID NO: 5650 - DNA, 25 bp, Mus musculus
gctgcatcacaatcaaatccaccgc

SEQ ID NO: 5651 - DNA, 25 bp, Mus musculus
tagatcagatccgtgccatcatgga

SEQ ID NO: 5652 - DNA, 25 bp, Mus musculus
atcagatccgtgccatcatggacaa

SEQ ID NO: 5653 - DNA, 25 bp, Mus musculus
agatccgtgccatcatggacaagaa

SEQ ID NO: 5654 - DNA, 25 bp, Mus musculus
acaagaaagccaacatccggaacat

SEQ ID NO: 5655 - DNA, 25 bp, Mus musculus
aagccaacatccggaacatgtcagt

SEQ ID NO: 5656 - DNA, 25 bp, Mus musculus
acatccggaacatgtcagtcatcgc

SEQ ID NO: 5657 - DNA, 25 bp, Mus musculus
tcatcgcccatgtggaccacggcaa

SEQ ID NO: 5658 - DNA, 25 bp, Mus musculus
tggaccacggcaagtccacgctgac

SEQ ID NO: 5659 - DNA, 25 bp, Mus musculus
aagccagcaccatggccagataccg

SEQ ID NO: 5660 - DNA, 25 bp, Mus musculus
ccagcaccatggccagataccgatg

SEQ ID NO: 5661 - DNA, 25 bp, Mus musculus
gccgccgctcatacaccataaggtg

SEQ ID NO: 5662 - DNA, 25 bp, Mus musculus
gccgctcatacaccataaggtgtaa

SEQ ID NO: 5663 - DNA, 25 bp, Mus musculus
gctcatacaccataaggtgtaaaaa

SEQ ID NO: 5664 - DNA, 25 bp, Mus musculus
tagcaagtccatcaaaactcctgcg

SEQ ID NO: 5665 - DNA, 25 bp, Mus musculus
caagtccatcaaaactcctgcgtga

SEQ ID NO: 5666 - DNA, 25 bp, Mus musculus
gtccatcaaaactcctgcgtgagaa

SEQ ID NO: 5667 - DNA, 25 bp, Mus musculus
catcaaaactcctgcgtgagaattt

SEQ ID NO: 5668 - DNA, 25 bp, Mus musculus
aactcctgcgtgagaattttaccag

SEQ ID NO: 5669 - DNA, 25 bp, Mus musculus
attttaccagacttcaagagcatct

SEQ ID NO: 5670 - DNA, 25 bp, Mus musculus
ttaccagacttcaagagcatctcgc

SEQ ID NO: 5671 - DNA, 25 bp, Mus musculus
gcaccatggccagataccgatgctg

SEQ ID NO: 5672 - DNA, 25 bp, Mus musculus
ccatggccagataccgatgctgccg

SEQ ID NO: 5673 - DNA, 25 bp, Mus musculus
tggccagataccgatgctgccgcag

SEQ ID NO: 5674 - DNA, 25 bp, Mus musculus
ccagataccgatgctgccgcagcaa

SEQ ID NO: 5675 - DNA, 25 bp, Mus musculus
gataccgatgctgccgcagcaaaag

SEQ ID NO: 5676 - DNA, 25 bp, Mus musculus
accgatgctgccgcagcaaaagcag

SEQ ID NO: 5677 - DNA, 25 bp, Mus musculus
gatgctgccgcagcaaaagcaggag

SEQ ID NO: 5678 - DNA, 25 bp, Mus musculus
gctgccgcagcaaaagcaggagcag

SEQ ID NO: 5679 - DNA, 25 bp, Mus musculus
accccagcagattctgagctgcagc

SEQ ID NO: 5680 - DNA, 25 bp, Mus musculus
gattctgagctgcagccctggtctc

SEQ ID NO: 5681 - DNA, 25 bp, Mus musculus
cagtagcaacagctctgccagccga

SEQ ID NO: 5682 - DNA, 25 bp, Mus musculus
gttgctgacccgcagatgttgatgt

SEQ ID NO: 5683 - DNA, 25 bp, Mus musculus
gctgacccgcagatgttgatgtcgt

SEQ ID NO: 5684 - DNA, 25 bp, Mus musculus
ttgatgtcgttctcgcaacagaaag

SEQ ID NO: 5685 - DNA, 25 bp, Mus musculus
tcgttctcgcaacagaaagcacgaa

SEQ ID NO: 5686 - DNA, 25 bp, Mus musculus
ttctcgcaacagaaagcacgaatga

SEQ ID NO: 5687 - DNA, 25 bp, Mus musculus
atctgcagagcacgtcccggtcgtc

SEQ ID NO: 5688 - DNA, 25 bp, Mus musculus
tgcagagcacgtcccggtcgtcatc

SEQ ID NO: 5689 - DNA, 25 bp, Mus musculus
catcttcatccgcagccagcaggac

SEQ ID NO: 5690 - DNA, 25 bp, Mus musculus
cttcatccgcagccagcaggacagg

SEQ ID NO: 5691 - DNA, 25 bp, Mus musculus
tctgagctgcagccctggtctctta

SEQ ID NO: 5692 - DNA, 25 bp, Mus musculus
ctgcagccctggtctcttaccgtca

SEQ ID NO: 5693 - DNA, 25 bp, Mus musculus
tctcttaccgtcaccagcacacagt

SEQ ID NO: 5694 - DNA, 25 bp, Mus musculus
accgtcaccagcacacagtgtaagt

SEQ ID NO: 5695 - DNA, 25 bp, Mus musculus
accagcacacagtgtaagtccgggg

SEQ ID NO: 5696 - DNA, 25 bp, Mus musculus
cttgtcgttctccagtagcaacagc

SEQ ID NO: 5697 - DNA, 25 bp, Mus musculus
gttctccagtagcaacagctctgcc

SEQ ID NO: 5698 - DNA, 25 bp, Mus musculus
ctccagtagcaacagctctgccagc

SEQ ID NO: 5699 - DNA, 25 bp, Mus musculus
gcaccgaatcactgagtcgcccagg

SEQ ID NO: 5700 - DNA, 25 bp, Mus musculus
cactgagtcgcccaggtgtcgggaa

SEQ ID NO: 5701 - DNA, 25 bp, Mus musculus
ttgaaaatgtcccacctgtcatttc

SEQ ID NO: 5702 - DNA, 25 bp, Mus musculus
atgtcccacctgtcatttcaacacc

SEQ ID NO: 5703 - DNA, 25 bp, Mus musculus
ctcaccactacctcattagtatcta

SEQ ID NO: 5704 - DNA, 25 bp, Mus musculus
accactacctcattagtatctaccg

SEQ ID NO: 5705 - DNA, 25 bp, Mus musculus
tcattagtatctaccgggataagct

SEQ ID NO: 5706 - DNA, 25 bp, Mus musculus
ttagtatctaccgggataagctctt

SEQ ID NO: 5707 - DNA, 25 bp, Mus musculus
gtatctaccgggataagctcttctt

SEQ ID NO: 5708 - DNA, 25 bp, Mus musculus
gggataagctcttctttgtgtctgt

SEQ ID NO: 5709 - DNA, 25 bp, Mus musculus
ataagctcttctttgtgtctgtgat

SEQ ID NO: 5710 - DNA, 25 bp, Mus musculus
tcttctttgtgtctgtgatacagac

SEQ ID NO: 5711 - DNA, 25 bp, Mus musculus
tgagtcgcccaggtgtcgggaaaat

SEQ ID NO: 5712 - DNA, 25 bp, Mus musculus
tgatccacagtctatttctcataaa

SEQ ID NO: 5713 - DNA, 25 bp, Mus musculus
tccacagtctatttctcataaactg

SEQ ID NO: 5714 - DNA, 25 bp, Mus musculus
gtctatttctcataaactgctctgg

SEQ ID NO: 5715 - DNA, 25 bp, Mus musculus
ttctcataaactgctctggcgacat

SEQ ID NO: 5716 - DNA, 25 bp, Mus musculus
taaactgctctggcgacatttttct

SEQ ID NO: 5717 - DNA, 25 bp, Mus musculus
actgctctggcgacatttttctaga

SEQ ID NO: 5718 - DNA, 25 bp, Mus musculus
gcgttgtaagccagtcagtgtgtga

SEQ ID NO: 5719 - DNA, 25 bp, Mus musculus
cggacacatggtccccacggacaag

SEQ ID NO: 5720 - DNA, 25 bp, Mus musculus
catggtccccacggacaagcctcga

SEQ ID NO: 5721 - DNA, 25 bp, Mus musculus
gcaacccatggaaatcctcagtacc

SEQ ID NO: 5722 - DNA, 25 bp, Mus musculus
catggaaatcctcagtacctgatca

SEQ ID NO: 5723 - DNA, 25 bp, Mus musculus
tcctgtactaaaactgcccagactt

SEQ ID NO: 5724 - DNA, 25 bp, Mus musculus
actaaaactgcccagacttctcaca

SEQ ID NO: 5725 - DNA, 25 bp, Mus musculus
cagacttctcacagcctggtgcatc

SEQ ID NO: 5726 - DNA, 25 bp, Mus musculus
agcctggtgcatcccagcctgggcc

SEQ ID NO: 5727 - DNA, 25 bp, Mus musculus
gcgtcacagacagcctaggaccaag

SEQ ID NO: 5728 - DNA, 25 bp, Mus musculus
cagacagcctaggaccaagtgagca

SEQ ID NO: 5729 - DNA, 25 bp, Mus musculus
gtgagcactttgttccggccatcgt

SEQ ID NO: 5730 - DNA, 25 bp, Mus musculus
ccaggaccccaacagagctagagaa

SEQ ID NO: 5731 - DNA, 25 bp, Mus musculus
ggacaagcctcgagctgcttttacc

SEQ ID NO: 5732 - DNA, 25 bp, Mus musculus
gcctcgagctgcttttaccatgttc

SEQ ID NO: 5733 - DNA, 25 bp, Mus musculus
agctgcttttaccatgttctcgagg

SEQ ID NO: 5734 - DNA, 25 bp, Mus musculus
ctcgaggttcctgaacaaagagcct

SEQ ID NO: 5735 - DNA, 25 bp, Mus musculus
gttcctgaacaaagagccttactga

SEQ ID NO: 5736 - DNA, 25 bp, Mus musculus
agagccttactgatagcttccgctg

SEQ ID NO: 5737 - DNA, 25 bp, Mus musculus
atagcttccgctgcaacccatggaa

SEQ ID NO: 5738 - DNA, 25 bp, Mus musculus
tccgctgcaacccatggaaatcctc

SEQ ID NO: 5739 - DNA, 25 bp, Mus musculus
gttagagaccctgcggtggatcgtt

SEQ ID NO: 5740 - DNA, 25 bp, Mus musculus
tagagaccctgcggtggatcgttct

SEQ ID NO: 5741 - DNA, 25 bp, Mus musculus
gaaggacatcttctctgaggttggg

SEQ ID NO: 5742 - DNA, 25 bp, Mus musculus
gacatcttctctgaggttgggcctg

SEQ ID NO: 5743 - DNA, 25 bp, Mus musculus
tcttctctgaggttgggcctgttgt

SEQ ID NO: 5744 - DNA, 25 bp, Mus musculus
ttctctgaggttgggcctgttgtta

SEQ ID NO: 5745 - DNA, 25 bp, Mus musculus
cgaataaccaaggaccaatgagacg

SEQ ID NO: 5746 - DNA, 25 bp, Mus musculus
gcactttatgtcgccatgcgggaac

SEQ ID NO: 5747 - DNA, 25 bp, Mus musculus
actttatgtcgccatgcgggaactt

SEQ ID NO: 5748 - DNA, 25 bp, Mus musculus
tttatgtcgccatgcgggaactttg

SEQ ID NO: 5749 - DNA, 25 bp, Mus musculus
tcgccatgcgggaactttgaattgg

SEQ ID NO: 5750 - DNA, 25 bp, Mus musculus
acttcgagtggacaatgctgccagt

SEQ ID NO: 5751 - DNA, 25 bp, Mus musculus
gagaccctgcggtggatcgttctct

SEQ ID NO: 5752 - DNA, 25 bp, Mus musculus
gatcgttctctgcgttctgtattcg

SEQ ID NO: 5753 - DNA, 25 bp, Mus musculus
tcgttctctgcgttctgtattcgtg

SEQ ID NO: 5754 - DNA, 25 bp, Mus musculus
gttctctgcgttctgtattcgtggg

SEQ ID NO: 5755 - DNA, 25 bp, Mus musculus
aacattccttatgaagctactgaag

SEQ ID NO: 5756 - DNA, 25 bp, Mus musculus
cattccttatgaagctactgaagaa

SEQ ID NO: 5757 - DNA, 25 bp, Mus musculus
ttccttatgaagctactgaagaaca

SEQ ID NO: 5758 - DNA, 25 bp, Mus musculus
ctgaaggacatcttctctgaggttg

SEQ ID NO: 5759 - DNA, 25 bp, Mus musculus
tgttgtgatgctctgtccttaaact

SEQ ID NO: 5760 - DNA, 25 bp, Mus musculus
tgtgatgctctgtccttaaactgca

SEQ ID NO: 5761 - DNA, 25 bp, Mus musculus
gccccaacaaaatccactgtctatc

SEQ ID NO: 5762 - DNA, 25 bp, Mus musculus
tatatgcttaattctgtcttagtga

SEQ ID NO: 5763 - DNA, 25 bp, Mus musculus
atgcttaattctgtcttagtgagtt

SEQ ID NO: 5764 - DNA, 25 bp, Mus musculus
aattctgtcttagtgagttggaaca

SEQ ID NO: 5765 - DNA, 25 bp, Mus musculus
tttcaccatatttcctgtaaaatat

SEQ ID NO: 5766 - DNA, 25 bp, Mus musculus
tgtaacaacttaaacatctctagga

SEQ ID NO: 5767 - DNA, 25 bp, Mus musculus
aatgtattttccatctagcctgaat

SEQ ID NO: 5768 - DNA, 25 bp, Mus musculus
gtattttccatctagcctgaatgta

SEQ ID NO: 5769 - DNA, 25 bp, Mus musculus
atctagcctgaatgtactgtaaatt

SEQ ID NO: 5770 - DNA, 25 bp, Mus musculus
catatggacccacataacataaaat

SEQ ID NO: 5771 - DNA, 25 bp, Mus musculus
gctctgtccttaaactgcagcatga

SEQ ID NO: 5772 - DNA, 25 bp, Mus musculus
ctgtccttaaactgcagcatgatac

SEQ ID NO: 5773 - DNA, 25 bp, Mus musculus
tgttactttcaaattgcacccaagg

SEQ ID NO: 5774 - DNA, 25 bp, Mus musculus
tactttcaaattgcacccaaggaag

SEQ ID NO: 5775 - DNA, 25 bp, Mus musculus
attgcacccaaggaaggacacactg

SEQ ID NO: 5776 - DNA, 25 bp, Mus musculus
ggacacactgtttatgccccaacaa

SEQ ID NO: 5777 - DNA, 25 bp, Mus musculus
cacactgtttatgccccaacaaaat

SEQ ID NO: 5778 - DNA, 25 bp, Mus musculus
gtttatgccccaacaaaatccactg

SEQ ID NO: 5779 - DNA, 25 bp, Mus musculus
actccctatttattgcccttctgct

SEQ ID NO: 5780 - DNA, 25 bp, Mus musculus
tttcttggtagtttctggactgatg

SEQ ID NO: 5781 - DNA, 25 bp, Mus musculus
tatctgtctgattctgtaatgagca

SEQ ID NO: 5782 - DNA, 25 bp, Mus musculus
gtaatgagcacagcacctattttga

SEQ ID NO: 5783 - DNA, 25 bp, Mus musculus
agcacagcacctattttgaattgct

SEQ ID NO: 5784 - DNA, 25 bp, Mus musculus
acagcacctattttgaattgctatt

SEQ ID NO: 5785 - DNA, 25 bp, Mus musculus
tatttggagggccagtgcttattta

SEQ ID NO: 5786 - DNA, 25 bp, Mus musculus
ggtgccataatttctctttgttggt

SEQ ID NO: 5787 - DNA, 25 bp, Mus musculus
aaatgtatttctgtaccacaatgta

SEQ ID NO: 5788 - DNA, 25 bp, Mus musculus
tgtatttctgtaccacaatgtaagc

SEQ ID NO: 5789 - DNA, 25 bp, Mus musculus
atttctgtaccacaatgtaagcttc

SEQ ID NO: 5790 - DNA, 25 bp, Mus musculus
tctgtaccacaatgtaagcttcaat

SEQ ID NO: 5791 - DNA, 25 bp, Mus musculus
ttctaaacagagtctacttggtttg

SEQ ID NO: 5792 - DNA, 25 bp, Mus musculus
ttggaacactgtctggactctttct

SEQ ID NO: 5793 - DNA, 25 bp, Mus musculus
gaacactgtctggactctttctaca

SEQ ID NO: 5794 - DNA, 25 bp, Mus musculus
ttctacacggtgttgattgaaggct

SEQ ID NO: 5795 - DNA, 25 bp, Mus musculus
gctttcggtcagctttatctgtctg

SEQ ID NO: 5796 - DNA, 25 bp, Mus musculus
ttcggtcagctttatctgtctgatt

SEQ ID NO: 5797 - DNA, 25 bp, Mus musculus
ggtcagctttatctgtctgattctg

SEQ ID NO: 5798 - DNA, 25 bp, Mus musculus
ctttatctgtctgattctgtaatga

SEQ ID NO: 5799 - DNA, 25 bp, Mus musculus
acgcagttcaccagcgagcctgtgc

SEQ ID NO: 5800 - DNA, 25 bp, Mus musculus
aacccacttctgctgtctgctgagg

SEQ ID NO: 5801 - DNA, 25 bp, Mus musculus
ccaacaggcacttctagacagagca

SEQ ID NO: 5802 - DNA, 25 bp, Mus musculus
ggcacttctagacagagcaatctct

SEQ ID NO: 5803 - DNA, 25 bp, Mus musculus
ttgtgtccaggccccagaggctggc

SEQ ID NO: 5804 - DNA, 25 bp, Mus musculus
cccagaggctggctttgtgctggag

SEQ ID NO: 5805 - DNA, 25 bp, Mus musculus
ggaaccgcttcctgtgcacagaggc

SEQ ID NO: 5806 - DNA, 25 bp, Mus musculus
gtgagacagccagccacgccgtttg

SEQ ID NO: 5807 - DNA, 25 bp, Mus musculus
gtgcacatcttccacagaaacagaa

SEQ ID NO: 5808 - DNA, 25 bp, Mus musculus
aacagaactcgatgcactgacccgc

SEQ ID NO: 5809 - DNA, 25 bp, Mus musculus
ttagcgtgtaatgccctgaggaata

SEQ ID NO: 5810 - DNA, 25 bp, Mus musculus
tgtaatgccctgaggaataaagtgt

SEQ ID NO: 5811 - DNA, 25 bp, Mus musculus
ggccatgagcatctctgttgtggac

SEQ ID NO: 5812 - DNA, 25 bp, Mus musculus
gagcatctctgttgtggacacgcct

SEQ ID NO: 5813 - DNA, 25 bp, Mus musculus
tgtggacacgcctgtgaatgaccct

SEQ ID NO: 5814 - DNA, 25 bp, Mus musculus
cacgcctgtgaatgaccctgtcact

SEQ ID NO: 5815 - DNA, 25 bp, Mus musculus
tgtgaatgaccctgtcactttaccc

SEQ ID NO: 5816 - DNA, 25 bp, Mus musculus
tttacccttaactacagcatatgca

SEQ ID NO: 5817 - DNA, 25 bp, Mus musculus
tacagcatatgcatgccaggccggg

SEQ ID NO: 5818 - DNA, 25 bp, Mus musculus
tgctggccaccaagaccgaagaggg

SEQ ID NO: 5819 - DNA, 25 bp, Mus musculus
tggttgatctggtggctctgagaat

SEQ ID NO: 5820 - DNA, 25 bp, Mus musculus
tgatctggtggctctgagaatcatt

SEQ ID NO: 5821 - DNA, 25 bp, Mus musculus
gcttcagacaccataggagtggcaa

SEQ ID NO: 5822 - DNA, 25 bp, Mus musculus
ttcagacaccataggagtggcaaga

SEQ ID NO: 5823 - DNA, 25 bp, Mus musculus
gtggcaagatcccacctgccaggtg

SEQ ID NO: 5824 - DNA, 25 bp, Mus musculus
atcccacctgccaggtgaagggcgg

SEQ ID NO: 5825 - DNA, 25 bp, Mus musculus
tcagtgactttgacctgtacctgct

SEQ ID NO: 5826 - DNA, 25 bp, Mus musculus
agtgactttgacctgtacctgctgg

SEQ ID NO: 5827 - DNA, 25 bp, Mus musculus
tgactttgacctgtacctgctggtc

SEQ ID NO: 5828 - DNA, 25 bp, Mus musculus
actttgacctgtacctgctggtcct

SEQ ID NO: 5829 - DNA, 25 bp, Mus musculus
tggtcctgacttccagaggcccagg

SEQ ID NO: 5830 - DNA, 25 bp, Mus musculus
gtcctgacttccagaggcccaggat

SEQ ID NO: 5831 - DNA, 25 bp, Mus musculus
atctggtggctctgagaatcattct

SEQ ID NO: 5832 - DNA, 25 bp, Mus musculus
agaatcattctgattactgcttcag

SEQ ID NO: 5833 - DNA, 25 bp, Mus musculus
tcattctgattactgcttcagacac

SEQ ID NO: 5834 - DNA, 25 bp, Mus musculus
attctgattactgcttcagacacca

SEQ ID NO: 5835 - DNA, 25 bp, Mus musculus
tctgattactgcttcagacaccata

SEQ ID NO: 5836 - DNA, 25 bp, Mus musculus
tgattactgcttcagacaccatagg

SEQ ID NO: 5837 - DNA, 25 bp, Mus musculus
tactgcttcagacaccataggagtg

SEQ ID NO: 5838 - DNA, 25 bp, Mus musculus
ctgcttcagacaccataggagtggc

SEQ ID NO: 5839 - DNA, 25 bp, Mus musculus
gaggtcttttcctgtcagagaaatt

SEQ ID NO: 5840 - DNA, 25 bp, Mus musculus
agcagtgcacacatcgcttcagaga

SEQ ID NO: 5841 - DNA, 25 bp, Mus musculus
aatacctgtgccagaaaatctagaa

SEQ ID NO: 5842 - DNA, 25 bp, Mus musculus
gaaatgggaccacgcatttgcaaac

SEQ ID NO: 5843 - DNA, 25 bp, Mus musculus
atgggaccacgcatttgcaaacatg

SEQ ID NO: 5844 - DNA, 25 bp, Mus musculus
ggaccacgcatttgcaaacatgacc

SEQ ID NO: 5845 - DNA, 25 bp, Mus musculus
cgcatttgcaaacatgaccttcaaa

SEQ ID NO: 5846 - DNA, 25 bp, Mus musculus
tgcaaacatgaccttcaaagcacag

SEQ ID NO: 5847 - DNA, 25 bp, Mus musculus
catgaccttcaaagcacagtggatc

SEQ ID NO: 5848 - DNA, 25 bp, Mus musculus
gaccttcaaagcacagtggatccct

SEQ ID NO: 5849 - DNA, 25 bp, Mus musculus
agcacagtggatccctgtctattca

SEQ ID NO: 5850 - DNA, 25 bp, Mus musculus
gtggatccctgtctattcaaaaagt

SEQ ID NO: 5851 - DNA, 25 bp, Mus musculus
agtgcacacatcgcttcagagacac

SEQ ID NO: 5852 - DNA, 25 bp, Mus musculus
cacatcgcttcagagacacagcaac

SEQ ID NO: 5853 - DNA, 25 bp, Mus musculus
atcgcttcagagacacagcaactat

SEQ ID NO: 5854 - DNA, 25 bp, Mus musculus
gagacacagcaactatagcacagcg

SEQ ID NO: 5855 - DNA, 25 bp, Mus musculus
acacagcaactatagcacagcgcgg

SEQ ID NO: 5856 - DNA, 25 bp, Mus musculus
cagcaactatagcacagcgcggtgt

SEQ ID NO: 5857 - DNA, 25 bp, Mus musculus
ctatagcacagcgcggtgtataaac

SEQ ID NO: 5858 - DNA, 25 bp, Mus musculus
tagcacagcgcggtgtataaacacc

SEQ ID NO: 5859 - DNA, 25 bp, Mus musculus
tatcacaaaggtctcatcacaggtg

SEQ ID NO: 5860 - DNA, 25 bp, Mus musculus
aaaggtctcatcacaggtgacaatg

SEQ ID NO: 5861 - DNA, 25 bp, Mus musculus
gttcctcccagcatgctgcttcctg

SEQ ID NO: 5862 - DNA, 25 bp, Mus musculus
atgctgcttcctgcccgggtggcat

SEQ ID NO: 5863 - DNA, 25 bp, Mus musculus
catcctgagtcccaattcttctgcc

SEQ ID NO: 5864 - DNA, 25 bp, Mus musculus
caattcttctgccttccactcaagt

SEQ ID NO: 5865 - DNA, 25 bp, Mus musculus
ttctgccttccactcaagtagctac

SEQ ID NO: 5866 - DNA, 25 bp, Mus musculus
cttccactcaagtagctacactgag

SEQ ID NO: 5867 - DNA, 25 bp, Mus musculus
tagctacactgagcaggcgccgctc

SEQ ID NO: 5868 - DNA, 25 bp, Mus musculus
gccgctctctgctatgcctcaataa

SEQ ID NO: 5869 - DNA, 25 bp, Mus musculus
ctctgctatgcctcaataaaatgcg

SEQ ID NO: 5870 - DNA, 25 bp, Mus musculus
tatgcctcaataaaatgcgttaaag

SEQ ID NO: 5871 - DNA, 25 bp, Mus musculus
gacaatgtccacattgtccgagatg

SEQ ID NO: 5872 - DNA, 25 bp, Mus musculus
atgcctcaataaaatgcgttaaagc

SEQ ID NO: 5873 - DNA, 25 bp, Mus musculus
gtccacattgtccgagatgacatgc

SEQ ID NO: 5874 - DNA, 25 bp, Mus musculus
gacatgctgtgtgctgggaatgaag

SEQ ID NO: 5875 - DNA, 25 bp, Mus musculus
gtcacctattacttggactggatcc

SEQ ID NO: 5876 - DNA, 25 bp, Mus musculus
caccactatgtccccaaggacttct

SEQ ID NO: 5877 - DNA, 25 bp, Mus musculus
tatgtccccaaggacttctgagtca

SEQ ID NO: 5878 - DNA, 25 bp, Mus musculus
gacttctgagtcacatccaggatga

SEQ ID NO: 5879 - DNA, 25 bp, Mus musculus
acatccaggatgacctccgttcctc

SEQ ID NO: 5880 - DNA, 25 bp, Mus musculus
tacaggcccaagccgtgcaaacttc

SEQ ID NO: 5881 - DNA, 25 bp, Mus musculus
ccgtgcaaacttcttctactagcta

SEQ ID NO: 5882 - DNA, 25 bp, Mus musculus
gcaagcctacagaacgtgttcagcc

SEQ ID NO: 5883 - DNA, 25 bp, Mus musculus
ttcagccaaaaaattccagctcctt

SEQ ID NO: 5884 - DNA, 25 bp, Mus musculus
attccagctcctttctgaattttgg

SEQ ID NO: 5885 - DNA, 25 bp, Mus musculus
ggaacccgccatcagcttggaatat

SEQ ID NO: 5886 - DNA, 25 bp, Mus musculus
tgtaacgcacctctggatttataag

SEQ ID NO: 5887 - DNA, 25 bp, Mus musculus
gcacctctggatttataagaatatt

SEQ ID NO: 5888 - DNA, 25 bp, Mus musculus
aaattgtacctgcagataaagctac

SEQ ID NO: 5889 - DNA, 25 bp, Mus musculus
ttccagcaaacttgtattttcatat

SEQ ID NO: 5890 - DNA, 25 bp, Mus musculus
ttccttatatttcactgggaactgc

SEQ ID NO: 5891 - DNA, 25 bp, Mus musculus
atatttcactgggaactgccaataa

SEQ ID NO: 5892 - DNA, 25 bp, Mus musculus
ctagctatcctgaaaccacagagaa

SEQ ID NO: 5893 - DNA, 25 bp, Mus musculus
atcctgaaaccacagagaactccac

SEQ ID NO: 5894 - DNA, 25 bp, Mus musculus
aaaccacagagaactccacatcttc

SEQ ID NO: 5895 - DNA, 25 bp, Mus musculus
cagagaactccacatcttctaaaca

SEQ ID NO: 5896 - DNA, 25 bp, Mus musculus
catcttctaaacaaacattgaggac

SEQ ID NO: 5897 - DNA, 25 bp, Mus musculus
gtaattcttcctcaccaagcaagcc

SEQ ID NO: 5898 - DNA, 25 bp, Mus musculus
cttcctcaccaagcaagcctacaga

SEQ ID NO: 5899 - DNA, 25 bp, Mus musculus
caccaagcaagcctacagaacgtgt

SEQ ID NO: 5900 - DNA, 25 bp, Mus musculus
ctgtacttctatttgaactggataa

SEQ ID NO: 5901 - DNA, 25 bp, Mus musculus
agacaatctaaacattctcttaggc

SEQ ID NO: 5902 - DNA, 25 bp, Mus musculus
gttccatccagtactaaatgcttac

SEQ ID NO: 5903 - DNA, 25 bp, Mus musculus
tgcttaccgtgtgacccttgggctt

SEQ ID NO: 5904 - DNA, 25 bp, Mus musculus
ttcagcgtgcactcagttccgtagg

SEQ ID NO: 5905 - DNA, 25 bp, Mus musculus
gtgcactcagttccgtaggattcca

SEQ ID NO: 5906 - DNA, 25 bp, Mus musculus
tcagttccgtaggattccaaagcag

SEQ ID NO: 5907 - DNA, 25 bp, Mus musculus
aaagcagacccctagctggtctttg

SEQ ID NO: 5908 - DNA, 25 bp, Mus musculus
gacccctagctggtctttgaatctg

SEQ ID NO: 5909 - DNA, 25 bp, Mus musculus
tagctggtctttgaatctgcatgta

SEQ ID NO: 5910 - DNA, 25 bp, Mus musculus
gcatgtacttcacgttttctatatt

SEQ ID NO: 5911 - DNA, 25 bp, Mus musculus
gtttgctatcagactgacattaaat

SEQ ID NO: 5912 - DNA, 25 bp, Mus musculus
tctaaacattctcttaggctgcaga

SEQ ID NO: 5913 - DNA, 25 bp, Mus musculus
gaagtaggctccattccaaagtggg

SEQ ID NO: 5914 - DNA, 25 bp, Mus musculus
aattctgctagcattgtttaaatca

SEQ ID NO: 5915 - DNA, 25 bp, Mus musculus
accccagcagacataaactgcgata

SEQ ID NO: 5916 - DNA, 25 bp, Mus musculus
tgcgatagcttcagcttgcactgtg

SEQ ID NO: 5917 - DNA, 25 bp, Mus musculus
agcttgcactgtggattttctgtat

SEQ ID NO: 5918 - DNA, 25 bp, Mus musculus
atataaaacataacttcaagcttat

SEQ ID NO: 5919 - DNA, 25 bp, Mus musculus
ctggccgttccatccagtactaaat

SEQ ID NO: 5920 - DNA, 25 bp, Mus musculus
ggtcctgttcacagcggtcttgctg

SEQ ID NO: 5921 - DNA, 25 bp, Mus musculus
gttcacagcggtcttgctgaccctg

SEQ ID NO: 5922 - DNA, 25 bp, Mus musculus
tccccaattcggcagaccacaggga

SEQ ID NO: 5923 - DNA, 25 bp, Mus musculus
attcggcagaccacagggatctttc

SEQ ID NO: 5924 - DNA, 25 bp, Mus musculus
cagaccacagggatctttccagagt

SEQ ID NO: 5925 - DNA, 25 bp, Mus musculus
atctttccagagtttgggtcctcag

SEQ ID NO: 5926 - DNA, 25 bp, Mus musculus
tcctcagtaaaccagaagcctctga

SEQ ID NO: 5927 - DNA, 25 bp, Mus musculus
tcagtaaaccagaagcctctgaaag

SEQ ID NO: 5928 - DNA, 25 bp, Mus musculus
aaccagaagcctctgaaagaaagtg

SEQ ID NO: 5929 - DNA, 25 bp, Mus musculus
tccctcctgtttttcaactgtcacg

SEQ ID NO: 5930 - DNA, 25 bp, Mus musculus
ttcaactgtcacggcagggtcagaa

SEQ ID NO: 5931 - DNA, 25 bp, Mus musculus
aactgtcacggcagggtcagaactg

SEQ ID NO: 5932 - DNA, 25 bp, Mus musculus
gagctatgctcaggaagcaggtgat

SEQ ID NO: 5933 - DNA, 25 bp, Mus musculus
ctatgctcaggaagcaggtgatgaa

SEQ ID NO: 5934 - DNA, 25 bp, Mus musculus
tgatgaacttcagagcctagaccag

SEQ ID NO: 5935 - DNA, 25 bp, Mus musculus
tgaacttcagagcctagaccagaca

SEQ ID NO: 5936 - DNA, 25 bp, Mus musculus
tcagagcctagaccagacaccaaat

SEQ ID NO: 5937 - DNA, 25 bp, Mus musculus
gagcctagaccagacaccaaatcag

SEQ ID NO: 5938 - DNA, 25 bp, Mus musculus
cctagaccagacaccaaatcagaaa

SEQ ID NO: 5939 - DNA, 25 bp, Mus musculus
aggtccccaattcggcagaccacag

SEQ ID NO: 5940 - DNA, 25 bp, Mus musculus
gcagcttaccaagagccctctggca

SEQ ID NO: 5941 - DNA, 25 bp, Mus musculus
agcttaccaagagccctctggcaca

SEQ ID NO: 5942 - DNA, 25 bp, Mus musculus
gccctctggcacagatggaagaaga

SEQ ID NO: 5943 - DNA, 25 bp, Mus musculus
ccctctggcacagatggaagaagaa

SEQ ID NO: 5944 - DNA, 25 bp, Mus musculus
cctctggcacagatggaagaagaaa

SEQ ID NO: 5945 - DNA, 25 bp, Mus musculus
cagagctccagcggcgccatgagca

SEQ ID NO: 5946 - DNA, 25 bp, Mus musculus
agagctccagcggcgccatgagcaa

SEQ ID NO: 5947 - DNA, 25 bp, Mus musculus
agctccagcggcgccatgagcaaat

SEQ ID NO: 5948 - DNA, 25 bp, Mus musculus
ccagcggcgccatgagcaaatgaaa

SEQ ID NO: 5949 - DNA, 25 bp, Mus musculus
cagcggcgccatgagcaaatgaaaa

SEQ ID NO: 5950 - DNA, 25 bp, Mus musculus
agcggcgccatgagcaaatgaaaaa

SEQ ID NO: 5951 - DNA, 25 bp, Mus musculus
tttagaagcacagcacaaagaatta

SEQ ID NO: 5952 - DNA, 25 bp, Mus musculus
gcttaccaagagccctctggcacag

SEQ ID NO: 5953 - DNA, 25 bp, Mus musculus
cttaccaagagccctctggcacaga

SEQ ID NO: 5954 - DNA, 25 bp, Mus musculus
taccaagagccctctggcacagatg

SEQ ID NO: 5955 - DNA, 25 bp, Mus musculus
accaagagccctctggcacagatgg

SEQ ID NO: 5956 - DNA, 25 bp, Mus musculus
ccaagagccctctggcacagatgga

SEQ ID NO: 5957 - DNA, 25 bp, Mus musculus
aagagccctctggcacagatggaag

SEQ ID NO: 5958 - DNA, 25 bp, Mus musculus
agagccctctggcacagatggaaga

SEQ ID NO: 5959 - DNA, 25 bp, Mus musculus
gagccctctggcacagatggaagaa

SEQ ID NO: 5960 - DNA, 25 bp, Mus musculus
gaggcccacagcagagaccccctca

SEQ ID NO: 5961 - DNA, 25 bp, Mus musculus
cacagcagagaccccctcaaggccc

SEQ ID NO: 5962 - DNA, 25 bp, Mus musculus
gcccacagccgagacccactcaagg

SEQ ID NO: 5963 - DNA, 25 bp, Mus musculus
ccccaacaggaggcccacagcagcg

SEQ ID NO: 5964 - DNA, 25 bp, Mus musculus
gcccacagccgagaccccctcaagg

SEQ ID NO: 5965 - DNA, 25 bp, Mus musculus
caacaggcccacagccgagacccac

SEQ ID NO: 5966 - DNA, 25 bp, Mus musculus
gcccacagccgagacccactcaagg

SEQ ID NO: 5967 - DNA, 25 bp, Mus musculus
agccgagacccactcaaggcccaca

SEQ ID NO: 5968 - DNA, 25 bp, Mus musculus
gcccacacccaacaggaggcccaca

SEQ ID NO: 5969 - DNA, 25 bp, Mus musculus
caggaggcccacagcaaacacctcc

SEQ ID NO: 5970 - DNA, 25 bp, Mus musculus
gcccacagcaaacacctcctctggc

SEQ ID NO: 5971 - DNA, 25 bp, Mus musculus
cacctcctctggctggaaacccaca

SEQ ID NO: 5972 - DNA, 25 bp, Mus musculus
gaggcccacagccgagaccccctca

SEQ ID NO: 5973 - DNA, 25 bp, Mus musculus
caccagcaggtccacagccgagacc

SEQ ID NO: 5974 - DNA, 25 bp, Mus musculus
cacccccaacaggaggcccacagca

SEQ ID NO: 5975 - DNA, 25 bp, Mus musculus
caacaggaggcccacagcagcgata

SEQ ID NO: 5976 - DNA, 25 bp, Mus musculus
gaggcccacagcagcgataccctca

SEQ ID NO: 5977 - DNA, 25 bp, Mus musculus
cacagcagcgataccctcaaagccc

SEQ ID NO: 5978 - DNA, 25 bp, Mus musculus
gaggcccacagccgagaccccctca

SEQ ID NO: 5979 - DNA, 25 bp, Mus musculus
caacaggcccacagccgagacccac

SEQ ID NO: 5980 - DNA, 25 bp, Mus musculus
cacagcaaacacctcctctggctgg

SEQ ID NO: 5981 - DNA, 25 bp, Mus musculus
acagcaaacacctcctctggctgga

SEQ ID NO: 5982 - DNA, 25 bp, Mus musculus
cctcctctggctggaaacccacaag

SEQ ID NO: 5983 - DNA, 25 bp, Mus musculus
ctcctctggctggaaacccacaagg

SEQ ID NO: 5984 - DNA, 25 bp, Mus musculus
tcctctggctggaaacccacaaggc

SEQ ID NO: 5985 - DNA, 25 bp, Mus musculus
cacaaggcagaccccagggacctca

SEQ ID NO: 5986 - DNA, 25 bp, Mus musculus
acaaggcagaccccagggacctcag

SEQ ID NO: 5987 - DNA, 25 bp, Mus musculus
ggcccacagcaaacacctcctctgg

SEQ ID NO: 5988 - DNA, 25 bp, Mus musculus
gcccacagcaaacacctcctctggc

SEQ ID NO: 5989 - DNA, 25 bp, Mus musculus
acaaggcagaccccagggacctcag

SEQ ID NO: 5990 - DNA, 25 bp, Mus musculus
cacagcaaacacctcctctggctgg

SEQ ID NO: 5991 - DNA, 25 bp, Mus musculus
acagcaaacacctcctctggctgga

SEQ ID NO: 5992 - DNA, 25 bp, Mus musculus
cacctcctctggctggaaacccaca

SEQ ID NO: 5993 - DNA, 25 bp, Mus musculus
cctcctctggctggaaacccacaag

SEQ ID NO: 5994 - DNA, 25 bp, Mus musculus
ctcctctggctggaaacccacaagg

SEQ ID NO: 5995 - DNA, 25 bp, Mus musculus
tcctctggctggaaacccacaaggc

SEQ ID NO: 5996 - DNA, 25 bp, Mus musculus
aggcccaccacaaggcagaccccag

SEQ ID NO: 5997 - DNA, 25 bp, Mus musculus
cacaaggcagaccccagggacctca

SEQ ID NO: 5998 - DNA, 25 bp, Mus musculus
gcgaaccatggacagccagggaagg

SEQ ID NO: 5999 - DNA, 25 bp, Mus musculus
gtgcgacaacggcactgggtttgtg

SEQ ID NO: 6000 - DNA, 25 bp, Mus musculus
cagcttcccagctttggttggaaga

SEQ ID NO: 6001 - DNA, 25 bp, Mus musculus
aagacctattatcagatcaaccacc

SEQ ID NO: 6002 - DNA, 25 bp, Mus musculus
acctattatcagatcaaccaccaaa

SEQ ID NO: 6003 - DNA, 25 bp, Mus musculus
caaggatctcatggttggcgatgag

SEQ ID NO: 6004 - DNA, 25 bp, Mus musculus
ggatctcatggttggcgatgaggca

SEQ ID NO: 6005 - DNA, 25 bp, Mus musculus
tctcatggttggcgatgaggcaagt

SEQ ID NO: 6006 - DNA, 25 bp, Mus musculus
aagtgagctgcgctccatgttggag

SEQ ID NO: 6007 - DNA, 25 bp, Mus musculus
tgagctgcgctccatgttggaggtg

SEQ ID NO: 6008 - DNA, 25 bp, Mus musculus
gcgctccatgttggaggtgaactac

SEQ ID NO: 6009 - DNA, 25 bp, Mus musculus
gaactacccgatggagaacggcatc

SEQ ID NO: 6010 - DNA, 25 bp, Mus musculus
caacggcactgggtttgtgaagtgt

SEQ ID NO: 6011 - DNA, 25 bp, Mus musculus
atatgcaggctctaactttccagaa

SEQ ID NO: 6012 - DNA, 25 bp, Mus musculus
tgcaggctctaactttccagaacac

SEQ ID NO: 6013 - DNA, 25 bp, Mus musculus
ctctaactttccagaacacagcttc

SEQ ID NO: 6014 - DNA, 25 bp, Mus musculus
taactttccagaacacagcttccca

SEQ ID NO: 6015 - DNA, 25 bp, Mus musculus
ctttccagaacacagcttcccagct

SEQ ID NO: 6016 - DNA, 25 bp, Mus musculus
agaacacagcttcccagctttggtt

SEQ ID NO: 6017 - DNA, 25 bp, Mus musculus
acacagcttcccagctttggttgga

SEQ ID NO: 6018 - DNA, 25 bp, Mus musculus
tacagggcctctccaatttgaggga

SEQ ID NO: 6019 - DNA, 25 bp, Mus musculus
aatagtacccaggcctatgagtgtt

SEQ ID NO: 6020 - DNA, 25 bp, Mus musculus
agagcacacactgttcagctgtatg

SEQ ID NO: 6021 - DNA, 25 bp, Mus musculus
gagcacacactgttcagctgtatgg

SEQ ID NO: 6022 - DNA, 25 bp, Mus musculus
gcacacactgttcagctgtatggct

SEQ ID NO: 6023 - DNA, 25 bp, Mus musculus
cacacactgttcagctgtatggctt

SEQ ID NO: 6024 - DNA, 25 bp, Mus musculus
cacactgttcagctgtatggctttg

SEQ ID NO: 6025 - DNA, 25 bp, Mus musculus
acactgttcagctgtatggctttgg

SEQ ID NO: 6026 - DNA, 25 bp, Mus musculus
actgttcagctgtatggctttggcc

SEQ ID NO: 6027 - DNA, 25 bp, Mus musculus
ctgttcagctgtatggctttggccc

SEQ ID NO: 6028 - DNA, 25 bp, Mus musculus
agctgtatggctttggccctgggtg

SEQ ID NO: 6029 - DNA, 25 bp, Mus musculus
cttgaccctgccatgttggtttgat

SEQ ID NO: 6030 - DNA, 25 bp, Mus musculus
tagtacccaggcctatgagtgttgg

SEQ ID NO: 6031 - DNA, 25 bp, Mus musculus
agtacccaggcctatgagtgttggc

SEQ ID NO: 6032 - DNA, 25 bp, Mus musculus
tacccaggcctatgagtgttggcct

SEQ ID NO: 6033 - DNA, 25 bp, Mus musculus
acccaggcctatgagtgttggcctg

SEQ ID NO: 6034 - DNA, 25 bp, Mus musculus
ctatgagtgttggcctgtgaggcaa

SEQ ID NO: 6035 - DNA, 25 bp, Mus musculus
tatgagtgttggcctgtgaggcaag

SEQ ID NO: 6036 - DNA, 25 bp, Mus musculus
gcaagagcacacactgttcagctgt

SEQ ID NO: 6037 - DNA, 25 bp, Mus musculus
caagagcacacactgttcagctgta

SEQ ID NO: 6038 - DNA, 25 bp, Mus musculus
ctttccacttgagccaacaccttca

SEQ ID NO: 6039 - DNA, 25 bp, Mus musculus
acttgagccaacaccttcactgaaa

SEQ ID NO: 6040 - DNA, 25 bp, Mus musculus
agttcatagttgtctttcatattgg

SEQ ID NO: 6041 - DNA, 25 bp, Mus musculus
aagttacatgttctatctttgtaat

SEQ ID NO: 6042 - DNA, 25 bp, Mus musculus
ttacatgttctatctttgtaatgaa

SEQ ID NO: 6043 - DNA, 25 bp, Mus musculus
catgttctatctttgtaatgaaaga

SEQ ID NO: 6044 - DNA, 25 bp, Mus musculus
ttgatcgtttcaggggtgcatcagc

SEQ ID NO: 6045 - DNA, 25 bp, Mus musculus
atcgtttcaggggtgcatcagccgc

SEQ ID NO: 6046 - DNA, 25 bp, Mus musculus
gtgcatcagccgcttcgttgccatt

SEQ ID NO: 6047 - DNA, 25 bp, Mus musculus
catcagccgcttcgttgccattgga

SEQ ID NO: 6048 - DNA, 25 bp, Mus musculus
agatattgtgcatcacatgaaacat

SEQ ID NO: 6049 - DNA, 25 bp, Mus musculus
tgtgcatcacatgaaacataataaa

SEQ ID NO: 6050 - DNA, 25 bp, Mus musculus
tgagccaacaccttcactgaaatat

SEQ ID NO: 6051 - DNA, 25 bp, Mus musculus
gccaacaccttcactgaaatataga

SEQ ID NO: 6052 - DNA, 25 bp, Mus musculus
agattttccacgggagcagcacatg

SEQ ID NO: 6053 - DNA, 25 bp, Mus musculus
tgttgtctcaatcaggtttctatca

SEQ ID NO: 6054 - DNA, 25 bp, Mus musculus
agatcactcaacctaagctgctgag

SEQ ID NO: 6055 - DNA, 25 bp, Mus musculus
aacctaagctgctgagagcacacaa

SEQ ID NO: 6056 - DNA, 25 bp, Mus musculus
agctgctgagagcacacaaggtcag

SEQ ID NO: 6057 - DNA, 25 bp, Mus musculus
tggcggccatccttaatggtgggaa

SEQ ID NO: 6058 - DNA, 25 bp, Mus musculus
catactgagatggtccttgagatga

SEQ ID NO: 6059 - DNA, 25 bp, Mus musculus
agcatcggagcaccggaaactcaga

SEQ ID NO: 6060 - DNA, 25 bp, Mus musculus
gctttcgctagaaaactccagaact

SEQ ID NO: 6061 - DNA, 25 bp, Mus musculus
gctagaaaactccagaacttcaggg

SEQ ID NO: 6062 - DNA, 25 bp, Mus musculus
cagaacttcagggccaagccctcca

SEQ ID NO: 6063 - DNA, 25 bp, Mus musculus
acctctaagctgggccaggaggaag

SEQ ID NO: 6064 - DNA, 25 bp, Mus musculus
gatactggttccgagtccgattctt

SEQ ID NO: 6065 - DNA, 25 bp, Mus musculus
ctggctttcctaggccttgctgtga

SEQ ID NO: 6066 - DNA, 25 bp, Mus musculus
ggagagctaccactctactatatct

SEQ ID NO: 6067 - DNA, 25 bp, Mus musculus
ctaccactctactatatctagcatc

SEQ ID NO: 6068 - DNA, 25 bp, Mus musculus
tagcatccacagggtcggtagaaac

SEQ ID NO: 6069 - DNA, 25 bp, Mus musculus
tgcccagaaaccggtggaagtctgt

SEQ ID NO: 6070 - DNA, 25 bp, Mus musculus
accatcgctaccttttccatcggct

SEQ ID NO: 6071 - DNA, 25 bp, Mus musculus
gctaccttttccatcggctccactg

SEQ ID NO: 6072 - DNA, 25 bp, Mus musculus
ttttccatcggctccactggcatcg

SEQ ID NO: 6073 - DNA, 25 bp, Mus musculus
atcggctccactggcatcgttgtgt

SEQ ID NO: 6074 - DNA, 25 bp, Mus musculus
tatgactaccagcggctcctgacgg

SEQ ID NO: 6075 - DNA, 25 bp, Mus musculus
cggctcctgacggcctataagccag

SEQ ID NO: 6076 - DNA, 25 bp, Mus musculus
agcatccctagtcttgaggctttcg

SEQ ID NO: 6077 - DNA, 25 bp, Mus musculus
cctagtcttgaggctttcgctagaa

SEQ ID NO: 6078 - DNA, 25 bp, Mus musculus
catggtgccccacattggcttcaag

SEQ ID NO: 6079 - DNA, 25 bp, Mus musculus
tggtgccccacattggcttcaaggg

SEQ ID NO: 6080 - DNA, 25 bp, Mus musculus
acctgggccaaggtctcagaagagc

SEQ ID NO: 6081 - DNA, 25 bp, Mus musculus
ctgggccaaggtctcagaagagctg

SEQ ID NO: 6082 - DNA, 25 bp, Mus musculus
gtatgctgagcaacaccacgagcca

SEQ ID NO: 6083 - DNA, 25 bp, Mus musculus
atgctgagcaacaccacgagccatt

SEQ ID NO: 6084 - DNA, 25 bp, Mus musculus
tgagcaacaccacgagccattgctg

SEQ ID NO: 6085 - DNA, 25 bp, Mus musculus
agcaacaccacgagccattgctgta

SEQ ID NO: 6086 - DNA, 25 bp, Mus musculus
caacaccacgagccattgctgtagg

SEQ ID NO: 6087 - DNA, 25 bp, Mus musculus
acaccacgagccattgctgtaggct

SEQ ID NO: 6088 - DNA, 25 bp, Mus musculus
agccattgctgtaggcttgggctcg

SEQ ID NO: 6089 - DNA, 25 bp, Mus musculus
acatggctgcctagagaaggatatg

SEQ ID NO: 6090 - DNA, 25 bp, Mus musculus
gtgccccacattggcttcaagggtt

SEQ ID NO: 6091 - DNA, 25 bp, Mus musculus
ggcattaattacccagcatcccacc

SEQ ID NO: 6092 - DNA, 25 bp, Mus musculus
cattaattacccagcatcccacctg

SEQ ID NO: 6093 - DNA, 25 bp, Mus musculus
ttaattacccagcatcccacctgtg

SEQ ID NO: 6094 - DNA, 25 bp, Mus musculus
agcatcccacctgtggtacacctgg

SEQ ID NO: 6095 - DNA, 25 bp, Mus musculus
catcccacctgtggtacacctggtg

SEQ ID NO: 6096 - DNA, 25 bp, Mus musculus
cacctggtggcgacctgggccaagg

SEQ ID NO: 6097 - DNA, 25 bp, Mus musculus
cgacctgggccaaggtctcagaaga

SEQ ID NO: 6098 - DNA, 25 bp, Mus musculus
ctgtttctgcaatgtgcaggcagag

SEQ ID NO: 6099 - DNA, 25 bp, Mus musculus
gtcttggagccgctggacactggca

SEQ ID NO: 6100 - DNA, 25 bp, Mus musculus
cgctccagccattgagaacgaaacc

SEQ ID NO: 6101 - DNA, 25 bp, Mus musculus
gaacgaaaccataccagttactatg

SEQ ID NO: 6102 - DNA, 25 bp, Mus musculus
aaccataccagttactatgacagtt

SEQ ID NO: 6103 - DNA, 25 bp, Mus musculus
cataccagttactatgacagttccc

SEQ ID NO: 6104 - DNA, 25 bp, Mus musculus
aacagtcatgtgactgggcatcaag

SEQ ID NO: 6105 - DNA, 25 bp, Mus musculus
gccagagtttggctggctgtctatt

SEQ ID NO: 6106 - DNA, 25 bp, Mus musculus
agagtttggctggctgtctattcag

SEQ ID NO: 6107 - DNA, 25 bp, Mus musculus
ctggctgtctattcaggactggacc

SEQ ID NO: 6108 - DNA, 25 bp, Mus musculus
gctgtctattcaggactggaccagg

SEQ ID NO: 6109 - DNA, 25 bp, Mus musculus
gtctattcaggactggaccaggttg

SEQ ID NO: 6110 - DNA, 25 bp, Mus musculus
ccgctggacactggcattggacttc

SEQ ID NO: 6111 - DNA, 25 bp, Mus musculus
ctggacactggcattggacttcaag

SEQ ID NO: 6112 - DNA, 25 bp, Mus musculus
tagcagctacagctatggcccaatg

SEQ ID NO: 6113 - DNA, 25 bp, Mus musculus
cagctacagctatggcccaatggtg

SEQ ID NO: 6114 - DNA, 25 bp, Mus musculus
tggcccaatggtgtcacacacgagt

SEQ ID NO: 6115 - DNA, 25 bp, Mus musculus
cccaatggtgtcacacacgagtgtg

SEQ ID NO: 6116 - DNA, 25 bp, Mus musculus
gtcacacacgagtgtgaccaatgtg

SEQ ID NO: 6117 - DNA, 25 bp, Mus musculus
gaccaatgtgggcccccgtgcagga

SEQ ID NO: 6118 - DNA, 25 bp, Mus musculus
aagatcctgatttttgggctgctag

SEQ ID NO: 6119 - DNA, 25 bp, Mus musculus
atttttgggctgctagaagagacgg

SEQ ID NO: 6120 - DNA, 25 bp, Mus musculus
tggttctgtgcctttccttacagtc

SEQ ID NO: 6121 - DNA, 25 bp, Mus musculus
gcctttccttacagtctcctcatct

SEQ ID NO: 6122 - DNA, 25 bp, Mus musculus
tttccttacagtctcctcatcttca

SEQ ID NO: 6123 - DNA, 25 bp, Mus musculus
tacagtctcctcatcttcatctatg

SEQ ID NO: 6124 - DNA, 25 bp, Mus musculus
agtctcctcatcttcatctatgatg

SEQ ID NO: 6125 - DNA, 25 bp, Mus musculus
ctcctcatcttcatctatgatgaag

SEQ ID NO: 6126 - DNA, 25 bp, Mus musculus
atcttcatctatgatgaagtccgaa

SEQ ID NO: 6127 - DNA, 25 bp, Mus musculus
gaagtccgaaagctcatcctgcggc

SEQ ID NO: 6128 - DNA, 25 bp, Mus musculus
gtccgaaagctcatcctgcggcggt

SEQ ID NO: 6129 - DNA, 25 bp, Mus musculus
aagctcatcctgcggcggtaccctg

SEQ ID NO: 6130 - DNA, 25 bp, Mus musculus
acggctctggctgccttcctgtctt

SEQ ID NO: 6131 - DNA, 25 bp, Mus musculus
ctggctgccttcctgtcttactgcc

SEQ ID NO: 6132 - DNA, 25 bp, Mus musculus
gttggcctccgaatgtacccactca

SEQ ID NO: 6133 - DNA, 25 bp, Mus musculus
ctccgaatgtacccactcaaggtca

SEQ ID NO: 6134 - DNA, 25 bp, Mus musculus
cgaatgtacccactcaaggtcacgt

SEQ ID NO: 6135 - DNA, 25 bp, Mus musculus
atgtacccactcaaggtcacgtggt

SEQ ID NO: 6136 - DNA, 25 bp, Mus musculus
ccactcaaggtcacgtggtggttct

SEQ ID NO: 6137 - DNA, 25 bp, Mus musculus
aaggtcacgtggtggttctgtgcct

SEQ ID NO: 6138 - DNA, 25 bp, Mus musculus
agacccctttaagcatgtggtgttg

SEQ ID NO: 6139 - DNA, 25 bp, Mus musculus
gacccctttaagcatgtggtgttgt

SEQ ID NO: 6140 - DNA, 25 bp, Mus musculus
tttgctttgcttttaaggccattgg

SEQ ID NO: 6141 - DNA, 25 bp, Mus musculus
ttgctttgcttttaaggccattggg

SEQ ID NO: 6142 - DNA, 25 bp, Mus musculus
atattgcaaggtgtgatggtctggt

SEQ ID NO: 6143 - DNA, 25 bp, Mus musculus
tgatggtctggtttgggtgaatttc

SEQ ID NO: 6144 - DNA, 25 bp, Mus musculus
catctctttccttaggccttttgca

SEQ ID NO: 6145 - DNA, 25 bp, Mus musculus
atctctttccttaggccttttgcat

SEQ ID NO: 6146 - DNA, 25 bp, Mus musculus
tctttccttaggccttttgcattga

SEQ ID NO: 6147 - DNA, 25 bp, Mus musculus
ccttaggccttttgcattgaaaatg

SEQ ID NO: 6148 - DNA, 25 bp, Mus musculus
cttaggccttttgcattgaaaatgc

SEQ ID NO: 6149 - DNA, 25 bp, Mus musculus
taggccttttgcattgaaaatgcac

SEQ ID NO: 6150 - DNA, 25 bp, Mus musculus
cccctttaagcatgtggtgttgtct

SEQ ID NO: 6151 - DNA, 25 bp, Mus musculus
ttgtcttagcatggtacctgctggg

SEQ ID NO: 6152 - DNA, 25 bp, Mus musculus
tcttagcatggtacctgctgggttt

SEQ ID NO: 6153 - DNA, 25 bp, Mus musculus
ttagcatggtacctgctgggttttg

SEQ ID NO: 6154 - DNA, 25 bp, Mus musculus
tagcatggtacctgctgggttttgt

SEQ ID NO: 6155 - DNA, 25 bp, Mus musculus
catggtacctgctgggttttgttgt

SEQ ID NO: 6156 - DNA, 25 bp, Mus musculus
tggtacctgctgggttttgttgttg

SEQ ID NO: 6157 - DNA, 25 bp, Mus musculus
tgctttgctttgcttttaaggccat

SEQ ID NO: 6158 - DNA, 25 bp, Mus musculus
tgttttccatgcagtaaagacgctg

SEQ ID NO: 6159 - DNA, 25 bp, Mus musculus
cagcaagccaaacatggtggaagcc

SEQ ID NO: 6160 - DNA, 25 bp, Mus musculus
gagccagcagctgttgtacctgtta

SEQ ID NO: 6161 - DNA, 25 bp, Mus musculus
cctgttactgcaccgagagatttta

SEQ ID NO: 6162 - DNA, 25 bp, Mus musculus
acttgatcagtttctgtgactgtat

SEQ ID NO: 6163 - DNA, 25 bp, Mus musculus
tcagtttctgtgactgtatgagagc

SEQ ID NO: 6164 - DNA, 25 bp, Mus musculus
tgagagcatccacatttcatgccac

SEQ ID NO: 6165 - DNA, 25 bp, Mus musculus
catccacatttcatgccacctaatt

SEQ ID NO: 6166 - DNA, 25 bp, Mus musculus
ctcctgctttctgtagagcagctac

SEQ ID NO: 6167 - DNA, 25 bp, Mus musculus
gtagagcagctaccacacattgcat

SEQ ID NO: 6168 - DNA, 25 bp, Mus musculus
cagctaccacacattgcatgcactt

SEQ ID NO: 6169 - DNA, 25 bp, Mus musculus
ccacacattgcatgcactttgtaag

SEQ ID NO: 6170 - DNA, 25 bp, Mus musculus
tcgtttttgctatgatgtggcgtta

SEQ ID NO: 6171 - DNA, 25 bp, Mus musculus
ttgctatgatgtggcgttagagtac

SEQ ID NO: 6172 - DNA, 25 bp, Mus musculus
agagtacctggagtcctcatagttc

SEQ ID NO: 6173 - DNA, 25 bp, Mus musculus
cctggagtcctcatagttcgctgag

SEQ ID NO: 6174 - DNA, 25 bp, Mus musculus
gtcctcatagttcgctgagactatt

SEQ ID NO: 6175 - DNA, 25 bp, Mus musculus
atagttcgctgagactatttgcaga

SEQ ID NO: 6176 - DNA, 25 bp, Mus musculus
ttgcagagcatccaagcagaaatcc

SEQ ID NO: 6177 - DNA, 25 bp, Mus musculus
cattcgtctgttgagccagcagctg

SEQ ID NO: 6178 - DNA, 25 bp, Mus musculus
caatgtcacctacaaccactctggc

SEQ ID NO: 6179 - DNA, 25 bp, Mus musculus
tgtcacctacaaccactctggcgac

SEQ ID NO: 6180 - DNA, 25 bp, Mus musculus
cctcttctttgataattacgagcac

SEQ ID NO: 6181 - DNA, 25 bp, Mus musculus
ttacgagcacaacaccagcgtcgtc

SEQ ID NO: 6182 - DNA, 25 bp, Mus musculus
cgagcacaacaccagcgtcgtcaag

SEQ ID NO: 6183 - DNA, 25 bp, Mus musculus
gcacaacaccagcgtcgtcaagaag

SEQ ID NO: 6184 - DNA, 25 bp, Mus musculus
caacaccagcgtcgtcaagaagatc

SEQ ID NO: 6185 - DNA, 25 bp, Mus musculus
caccagcgtcgtcaagaagatccac

SEQ ID NO: 6186 - DNA, 25 bp, Mus musculus
cgtcaagaagatccacctggaggtg

SEQ ID NO: 6187 - DNA, 25 bp, Mus musculus
agatatggcatccatcgtgtcagag

SEQ ID NO: 6188 - DNA, 25 bp, Mus musculus
cgtgctcattgtggtgttaacatat

SEQ ID NO: 6189 - DNA, 25 bp, Mus musculus
gttaacatatggctcgtggcggaga

SEQ ID NO: 6190 - DNA, 25 bp, Mus musculus
ctacaaccactctggcgactacgaa

SEQ ID NO: 6191 - DNA, 25 bp, Mus musculus
caaccactctggcgactacgaatgt

SEQ ID NO: 6192 - DNA, 25 bp, Mus musculus
ccactctggcgactacgaatgtcac

SEQ ID NO: 6193 - DNA, 25 bp, Mus musculus
ctctggcgactacgaatgtcacgtc

SEQ ID NO: 6194 - DNA, 25 bp, Mus musculus
cgactacgaatgtcacgtctaccgt

SEQ ID NO: 6195 - DNA, 25 bp, Mus musculus
ctacgaatgtcacgtctaccgtctc

SEQ ID NO: 6196 - DNA, 25 bp, Mus musculus
atgtcacgtctaccgtctcctcttc

SEQ ID NO: 6197 - DNA, 25 bp, Mus musculus
tctcctcttctttgataattacgag

SEQ ID NO: 6198 - DNA, 25 bp, Mus musculus
tgaggcctttactgtcaccctcatc

SEQ ID NO: 6199 - DNA, 25 bp, Mus musculus
ctttactgtcaccctcatcagcaaa

SEQ ID NO: 6200 - DNA, 25 bp, Mus musculus
agcagtttctgcaggaatgttgtgt

SEQ ID NO: 6201 - DNA, 25 bp, Mus musculus
taccaccttgtcccagcagctagag

SEQ ID NO: 6202 - DNA, 25 bp, Mus musculus
tgtgttccaggtggcaaaaatgatc

SEQ ID NO: 6203 - DNA, 25 bp, Mus musculus
acaataccagtttgtctacaaagca

SEQ ID NO: 6204 - DNA, 25 bp, Mus musculus
tgtctacaaagcaatgctcagcttg

SEQ ID NO: 6205 - DNA, 25 bp, Mus musculus
caaagcaatgctcagcttgatcagt

SEQ ID NO: 6206 - DNA, 25 bp, Mus musculus
agaggaatcagaccctgcagagagc

SEQ ID NO: 6207 - DNA, 25 bp, Mus musculus
atcagaccctgcagagagcatggag

SEQ ID NO: 6208 - DNA, 25 bp, Mus musculus
catggagtctctggtgtgactagtc

SEQ ID NO: 6209 - DNA, 25 bp, Mus musculus
acttcatttgtaaacttctgagact

SEQ ID NO: 6210 - DNA, 25 bp, Mus musculus
cctcatcagcaaagacaggctatgc

SEQ ID NO: 6211 - DNA, 25 bp, Mus musculus
agacaggctatgcctctcgaatgaa

SEQ ID NO: 6212 - DNA, 25 bp, Mus musculus
gctatgcctctcgaatgaagaacaa

SEQ ID NO: 6213 - DNA, 25 bp, Mus musculus
agaacaaattatcatccatgacttc

SEQ ID NO: 6214 - DNA, 25 bp, Mus musculus
aattatcatccatgacttcatcctt

SEQ ID NO: 6215 - DNA, 25 bp, Mus musculus
atggcctaacccagatgcccctata

SEQ ID NO: 6216 - DNA, 25 bp, Mus musculus
taacccagatgcccctataagtagt

SEQ ID NO: 6217 - DNA, 25 bp, Mus musculus
taccttcgaactgatcaatgtcatc

SEQ ID NO: 6218 - DNA, 25 bp, Mus musculus
cgcaccgctggggcatccagaaggg

SEQ ID NO: 6219 - DNA, 25 bp, Mus musculus
accagaagatggcgcgcgcgctgcg

SEQ ID NO: 6220 - DNA, 25 bp, Mus musculus
ctcaaccgagggtcagcctggctta

SEQ ID NO: 6221 - DNA, 25 bp, Mus musculus
gggtcagcctggcttagtggccacg

SEQ ID NO: 6222 - DNA, 25 bp, Mus musculus
tcagcctggcttagtggccacggtg

SEQ ID NO: 6223 - DNA, 25 bp, Mus musculus
gcctggcttagtggccacggtgctt

SEQ ID NO: 6224 - DNA, 25 bp, Mus musculus
tggcttagtggccacggtgcttcct

SEQ ID NO: 6225 - DNA, 25 bp, Mus musculus
cttagtggccacggtgcttccttgg

SEQ ID NO: 6226 - DNA, 25 bp, Mus musculus
gtctggcgctggcacctttttgtat

SEQ ID NO: 6227 - DNA, 25 bp, Mus musculus
tggcgctggcacctttttgtatatt

SEQ ID NO: 6228 - DNA, 25 bp, Mus musculus
cgctggcacctttttgtatattgaa

SEQ ID NO: 6229 - DNA, 25 bp, Mus musculus
tggcacctttttgtatattgaatgc

SEQ ID NO: 6230 - DNA, 25 bp, Mus musculus
tgcgcaactacggcaagacaggcga

SEQ ID NO: 6231 - DNA, 25 bp, Mus musculus
gcaactacggcaagacaggcgaggt

SEQ ID NO: 6232 - DNA, 25 bp, Mus musculus
agaagaagctcacctaccagttcag

SEQ ID NO: 6233 - DNA, 25 bp, Mus musculus
agctcacctaccagttcagcggcga

SEQ ID NO: 6234 - DNA, 25 bp, Mus musculus
tcacctaccagttcagcggcgaggt

SEQ ID NO: 6235 - DNA, 25 bp, Mus musculus
actgatcgcccgcagagaccgccag

SEQ ID NO: 6236 - DNA, 25 bp, Mus musculus
gcctgggcctcggacctcaaccgag

SEQ ID NO: 6237 - DNA, 25 bp, Mus musculus
gacctcaaccgagggtcagcctggc

SEQ ID NO: 6238 - DNA, 25 bp, Mus musculus
agagtgaagccaccttggatcaacg

SEQ ID NO: 6239 - DNA, 25 bp, Mus musculus
tgaagccaccttggatcaacgttga

SEQ ID NO: 6240 - DNA, 25 bp, Mus musculus
gcctgaggtgctgggagtgacacat

SEQ ID NO: 6241 - DNA, 25 bp, Mus musculus
ttgagttcttgctaccagaatgggg

SEQ ID NO: 6242 - DNA, 25 bp, Mus musculus
gagttcttgctaccagaatggggaa

SEQ ID NO: 6243 - DNA, 25 bp, Mus musculus
tcttgctaccagaatggggaaacag

SEQ ID NO: 6244 - DNA, 25 bp, Mus musculus
acagcaagctgcgccctgaagtcat

SEQ ID NO: 6245 - DNA, 25 bp, Mus musculus
caagctgcgccctgaagtcatgcag

SEQ ID NO: 6246 - DNA, 25 bp, Mus musculus
agctgcgccctgaagtcatgcagga

SEQ ID NO: 6247 - DNA, 25 bp, Mus musculus
gcgccctgaagtcatgcaggactta

SEQ ID NO: 6248 - DNA, 25 bp, Mus musculus
gcggacactttgtcaactggaacga

SEQ ID NO: 6249 - DNA, 25 bp, Mus musculus
ggacactttgtcaactggaacgagt

SEQ ID NO: 6250 - DNA, 25 bp, Mus musculus
gccaccttggatcaacgttgagccg

SEQ ID NO: 6251 - DNA, 25 bp, Mus musculus
caccttggatcaacgttgagccgca

SEQ ID NO: 6252 - DNA, 25 bp, Mus musculus
ttggatcaacgttgagccgcagccc

SEQ ID NO: 6253 - DNA, 25 bp, Mus musculus
atcaacgttgagccgcagcccactg

SEQ ID NO: 6254 - DNA, 25 bp, Mus musculus
caacgttgagccgcagcccactgct

SEQ ID NO: 6255 - DNA, 25 bp, Mus musculus
gcagcccactgctcgagaggacctg

SEQ ID NO: 6256 - DNA, 25 bp, Mus musculus
agcccactgctcgagaggacctgcc

SEQ ID NO: 6257 - DNA, 25 bp, Mus musculus
cactgctcgagaggacctgcctggg

SEQ ID NO: 6258 - DNA, 25 bp, Mus musculus
tcacatgacggcgctgtgcacaagc

SEQ ID NO: 6259 - DNA, 25 bp, Mus musculus
gctgtgcacaagccctacaactgct

SEQ ID NO: 6260 - DNA, 25 bp, Mus musculus
atgctgagctcggcttatatttccg

SEQ ID NO: 6261 - DNA, 25 bp, Mus musculus
atttccgaccacatgaaggtgcaca

SEQ ID NO: 6262 - DNA, 25 bp, Mus musculus
tgtccaatggcggcagcggcagcag

SEQ ID NO: 6263 - DNA, 25 bp, Mus musculus
ccttggtgagctccaagttgatggg

SEQ ID NO: 6264 - DNA, 25 bp, Mus musculus
ggaaagctcttcttggtacagtctc

SEQ ID NO: 6265 - DNA, 25 bp, Mus musculus
tcacgactcttcatcaaccaaggag

SEQ ID NO: 6266 - DNA, 25 bp, Mus musculus
ctcttcatcaaccaaggagcctcca

SEQ ID NO: 6267 - DNA, 25 bp, Mus musculus
atcaaccaaggagcctccagacaga

SEQ ID NO: 6268 - DNA, 25 bp, Mus musculus
caaggagcctccagacagagaggag

SEQ ID NO: 6269 - DNA, 25 bp, Mus musculus
gcctccagacagagaggaggaagaa

SEQ ID NO: 6270 - DNA, 25 bp, Mus musculus
aactgctcccactgtggcaagagct

SEQ ID NO: 6271 - DNA, 25 bp, Mus musculus
tgtggcaagagcttctcccggccgg

SEQ ID NO: 6272 - DNA, 25 bp, Mus musculus
gatcacctcaacagtcacgtcagac

SEQ ID NO: 6273 - DNA, 25 bp, Mus musculus
caagtgcactcaacagagcggccct

SEQ ID NO: 6274 - DNA, 25 bp, Mus musculus
cactcaacagagcggcccttcaaat

SEQ ID NO: 6275 - DNA, 25 bp, Mus musculus
acagagcggcccttcaaatgtgaga

SEQ ID NO: 6276 - DNA, 25 bp, Mus musculus
gctacgaaggatcgcctccgagcgc

SEQ ID NO: 6277 - DNA, 25 bp, Mus musculus
gtgccatgtcatgtctgtggcaaga

SEQ ID NO: 6278 - DNA, 25 bp, Mus musculus
agatgacaagagctcgcccaagaag

SEQ ID NO: 6279 - DNA, 25 bp, Mus musculus
gatgacaagagctcgcccaagaaga

SEQ ID NO: 6280 - DNA, 25 bp, Mus musculus
atacaataccgactgcgtgcagggt

SEQ ID NO: 6281 - DNA, 25 bp, Mus musculus
tacaataccgactgcgtgcagggtc

SEQ ID NO: 6282 - DNA, 25 bp, Mus musculus
aataccgactgcgtgcagggtctga

SEQ ID NO: 6283 - DNA, 25 bp, Mus musculus
taccgactgcgtgcagggtctgaca

SEQ ID NO: 6284 - DNA, 25 bp, Mus musculus
accgactgcgtgcagggtctgacac

SEQ ID NO: 6285 - DNA, 25 bp, Mus musculus
cgactgcgtgcagggtctgacacac

SEQ ID NO: 6286 - DNA, 25 bp, Mus musculus
gactgcgtgcagggtctgacacaca

SEQ ID NO: 6287 - DNA, 25 bp, Mus musculus
tctgacacacagtaaagcccaggag

SEQ ID NO: 6288 - DNA, 25 bp, Mus musculus
ctgacacacagtaaagcccaggaga

SEQ ID NO: 6289 - DNA, 25 bp, Mus musculus
gacacacagtaaagcccaggagatc

SEQ ID NO: 6290 - DNA, 25 bp, Mus musculus
gacaagagctcgcccaagaagagca

SEQ ID NO: 6291 - DNA, 25 bp, Mus musculus
acacacagtaaagcccaggagatcc

SEQ ID NO: 6292 - DNA, 25 bp, Mus musculus
caagagctcgcccaagaagagcaag

SEQ ID NO: 6293 - DNA, 25 bp, Mus musculus
aagagctcgcccaagaagagcaagg

SEQ ID NO: 6294 - DNA, 25 bp, Mus musculus
caaagagcgccgggacctggatgac

SEQ ID NO: 6295 - DNA, 25 bp, Mus musculus
gacctggatgacctcaagaaggaag

SEQ ID NO: 6296 - DNA, 25 bp, Mus musculus
cctggatgacctcaagaaggaagtg

SEQ ID NO: 6297 - DNA, 25 bp, Mus musculus
cggaaatacaataccgactgcgtgc

SEQ ID NO: 6298 - DNA, 25 bp, Mus musculus
gaaatacaataccgactgcgtgcag

SEQ ID NO: 6299 - DNA, 25 bp, Mus musculus
cagttcacccacggctgtactcttg

SEQ ID NO: 6300 - DNA, 25 bp, Mus musculus
gttcacccacggctgtactcttgga

SEQ ID NO: 6301 - DNA, 25 bp, Mus musculus
cagtggacaccctctacagctactg

SEQ ID NO: 6302 - DNA, 25 bp, Mus musculus
tctacagctactgcccttggctcag

SEQ ID NO: 6303 - DNA, 25 bp, Mus musculus
tacagctactgcccttggctcagtg

SEQ ID NO: 6304 - DNA, 25 bp, Mus musculus
cagctactgcccttggctcagtgtc

SEQ ID NO: 6305 - DNA, 25 bp, Mus musculus
gctactgcccttggctcagtgtcaa

SEQ ID NO: 6306 - DNA, 25 bp, Mus musculus
tactgcccttggctcagtgtcaaca

SEQ ID NO: 6307 - DNA, 25 bp, Mus musculus
gcccttggctcagtgtcaacagtaa

SEQ ID NO: 6308 - DNA, 25 bp, Mus musculus
ccttggctcagtgtcaacagtaagg

SEQ ID NO: 6309 - DNA, 25 bp, Mus musculus
ttggctcagtgtcaacagtaagggc

SEQ ID NO: 6310 - DNA, 25 bp, Mus musculus
ctcagtgtcaacagtaagggccact

SEQ ID NO: 6311 - DNA, 25 bp, Mus musculus
tcacccacggctgtactcttggaga

SEQ ID NO: 6312 - DNA, 25 bp, Mus musculus
tggcttcctctttctgttctaatac

SEQ ID NO: 6313 - DNA, 25 bp, Mus musculus
gcttcctctttctgttctaatactg

SEQ ID NO: 6314 - DNA, 25 bp, Mus musculus
tctttctgttctaatactggtaatc

SEQ ID NO: 6315 - DNA, 25 bp, Mus musculus
tttctgttctaatactggtaatcag

SEQ ID NO: 6316 - DNA, 25 bp, Mus musculus
ttctaatactggtaatcagtggaca

SEQ ID NO: 6317 - DNA, 25 bp, Mus musculus
taatcagtggacaccctctacagct

SEQ ID NO: 6318 - DNA, 25 bp, Mus musculus
atcagtggacaccctctacagctac

SEQ ID NO: 6319 - DNA, 25 bp, Mus musculus
acatgttcaaactgctcttgatcgg

SEQ ID NO: 6320 - DNA, 25 bp, Mus musculus
aactgctcttgatcgggaacagcag

SEQ ID NO: 6321 - DNA, 25 bp, Mus musculus
acaatgcccaggtaatcctcgtggg

SEQ ID NO: 6322 - DNA, 25 bp, Mus musculus
taatcctcgtggggaacaagtgtga

SEQ ID NO: 6323 - DNA, 25 bp, Mus musculus
tcgtacctgctgaggatggccggag

SEQ ID NO: 6324 - DNA, 25 bp, Mus musculus
tacctgctgaggatggccggaggct

SEQ ID NO: 6325 - DNA, 25 bp, Mus musculus
agttctttgaggccagcgccaagga

SEQ ID NO: 6326 - DNA, 25 bp, Mus musculus
aggtgttcgagcgcctggtggacat

SEQ ID NO: 6327 - DNA, 25 bp, Mus musculus
tcgagcgcctggtggacatcatctg

SEQ ID NO: 6328 - DNA, 25 bp, Mus musculus
tggacatcatctgtgacaagatgaa

SEQ ID NO: 6329 - DNA, 25 bp, Mus musculus
atgaatccctggaacccagctccag

SEQ ID NO: 6330 - DNA, 25 bp, Mus musculus
gctccagcccaggcagcaatggaaa

SEQ ID NO: 6331 - DNA, 25 bp, Mus musculus
ctgccttcgtgagcacagtgggcat

SEQ ID NO: 6332 - DNA, 25 bp, Mus musculus
acagccgagcagctgcagctgttag

SEQ ID NO: 6333 - DNA, 25 bp, Mus musculus
ccttcgtgagcacagtgggcatcga

SEQ ID NO: 6334 - DNA, 25 bp, Mus musculus
gcatcgacttcaaggtcaagacggt

SEQ ID NO: 6335 - DNA, 25 bp, Mus musculus
tcaagacggtctaccgacatgacaa

SEQ ID NO: 6336 - DNA, 25 bp, Mus musculus
cagcaggccaggagcgctaccggac

SEQ ID NO: 6337 - DNA, 25 bp, Mus musculus
cctactatcgcggagctatgggttt

SEQ ID NO: 6338 - DNA, 25 bp, Mus musculus
accaggagtccttcaccgcggtgca

SEQ ID NO: 6339 - DNA, 25 bp, Mus musculus
cgcagatcaaaacctattcctggga

SEQ ID NO: 6340 - DNA, 25 bp, Mus musculus
tatacctctgaggaatattccaagc

SEQ ID NO: 6341 - DNA, 25 bp, Mus musculus
gctaaggtctcactattttcacagg

SEQ ID NO: 6342 - DNA, 25 bp, Mus musculus
gagactctccaatgccagcctttgg

SEQ ID NO: 6343 - DNA, 25 bp, Mus musculus
ctccaatgccagcctttgggtaact

SEQ ID NO: 6344 - DNA, 25 bp, Mus musculus
tgatacattttgttcaatggcttcc

SEQ ID NO: 6345 - DNA, 25 bp, Mus musculus
attttgttcaatggcttccacgagt

SEQ ID NO: 6346 - DNA, 25 bp, Mus musculus
ttgttcaatggcttccacgagtcta

SEQ ID NO: 6347 - DNA, 25 bp, Mus musculus
cacgagtctacttttcctctctgag

SEQ ID NO: 6348 - DNA, 25 bp, Mus musculus
gagtctacttttcctctctgagggg

SEQ ID NO: 6349 - DNA, 25 bp, Mus musculus
gtttagacaccaggatgcaatgtac

SEQ ID NO: 6350 - DNA, 25 bp, Mus musculus
tagacaccaggatgcaatgtactat

SEQ ID NO: 6351 - DNA, 25 bp, Mus musculus
aggacctatatttccatgttaaatg

SEQ ID NO: 6352 - DNA, 25 bp, Mus musculus
aaggtctcactattttcacaggctg

SEQ ID NO: 6353 - DNA, 25 bp, Mus musculus
gtctcactattttcacaggctgacc

SEQ ID NO: 6354 - DNA, 25 bp, Mus musculus
tcactattttcacaggctgaccttg

SEQ ID NO: 6355 - DNA, 25 bp, Mus musculus
ttttcacaggctgaccttgaatttg

SEQ ID NO: 6356 - DNA, 25 bp, Mus musculus
tcacaggctgaccttgaatttgaga

SEQ ID NO: 6357 - DNA, 25 bp, Mus musculus
caggctgaccttgaatttgagactc

SEQ ID NO: 6358 - DNA, 25 bp, Mus musculus
gaatttgagactctccaatgccagc

SEQ ID NO: 6359 - DNA, 25 bp, Mus musculus
tttgagactctccaatgccagcctt

SEQ ID NO: 6360 - DNA, 25 bp, Mus musculus
gagctactgcggagtttcggtcacc

SEQ ID NO: 6361 - DNA, 25 bp, Mus musculus
agatctcaggagcatgttgtcagaa

SEQ ID NO: 6362 - DNA, 25 bp, Mus musculus
taagcaggtctgggatgtggccaca

SEQ ID NO: 6363 - DNA, 25 bp, Mus musculus
atgtggccacacttcagctgctgga

SEQ ID NO: 6364 - DNA, 25 bp, Mus musculus
ccacacttcagctgctggacacagg

SEQ ID NO: 6365 - DNA, 25 bp, Mus musculus
acttcagctgctggacacaggcttt

SEQ ID NO: 6366 - DNA, 25 bp, Mus musculus
ttcagctgctggacacaggctttct

SEQ ID NO: 6367 - DNA, 25 bp, Mus musculus
cagctgctggacacaggctttcttg

SEQ ID NO: 6368 - DNA, 25 bp, Mus musculus
tgctggacacaggctttcttgagca

SEQ ID NO: 6369 - DNA, 25 bp, Mus musculus
ctggacacaggctttcttgagcaag

SEQ ID NO: 6370 - DNA, 25 bp, Mus musculus
acacaggctttcttgagcaaggcga

SEQ ID NO: 6371 - DNA, 25 bp, Mus musculus
acaggctttcttgagcaaggcgatg

SEQ ID NO: 6372 - DNA, 25 bp, Mus musculus
atctcaggagcatgttgtcagaagt

SEQ ID NO: 6373 - DNA, 25 bp, Mus musculus
aggctttcttgagcaaggcgatgtc

SEQ ID NO: 6374 - DNA, 25 bp, Mus musculus
cagaagtcctgctggtgtctgccgg

SEQ ID NO: 6375 - DNA, 25 bp, Mus musculus
ctgctggtgtctgccggggaaagtc

SEQ ID NO: 6376 - DNA, 25 bp, Mus musculus
tggtgtctgccggggaaagtcatct

SEQ ID NO: 6377 - DNA, 25 bp, Mus musculus
gtgtctgccggggaaagtcatctca

SEQ ID NO: 6378 - DNA, 25 bp, Mus musculus
aagtcatctcatggagaacatgctg

SEQ ID NO: 6379 - DNA, 25 bp, Mus musculus
gtcatctcatggagaacatgctgtg

SEQ ID NO: 6380 - DNA, 25 bp, Mus musculus
tccatggcaaggtagctctggggtg

SEQ ID NO: 6381 - DNA, 25 bp, Mus musculus
cccccaaacacgactcaggagcagg

SEQ ID NO: 6382 - DNA, 25 bp, Mus musculus
caggtttaccacgcctgtgccatgc

SEQ ID NO: 6383 - DNA, 25 bp, Mus musculus
aagctgcacgaccctcagctcatgg

SEQ ID NO: 6384 - DNA, 25 bp, Mus musculus
cacgaccctcagctcatgggcatca

SEQ ID NO: 6385 - DNA, 25 bp, Mus musculus
atgggcatcattccccggatcgccc

SEQ ID NO: 6386 - DNA, 25 bp, Mus musculus
attccccggatcgcccgagacatct

SEQ ID NO: 6387 - DNA, 25 bp, Mus musculus
cggatcgcccgagacatcttcaacc

SEQ ID NO: 6388 - DNA, 25 bp, Mus musculus
ttcaaccacatctactccatggatg

SEQ ID NO: 6389 - DNA, 25 bp, Mus musculus
aaccacatctactccatggatgaga

SEQ ID NO: 6390 - DNA, 25 bp, Mus musculus
aaccttgagttccacattagaggtg

SEQ ID NO: 6391 - DNA, 25 bp, Mus musculus
ttacctggataagatccgtgacctt

SEQ ID NO: 6392 - DNA, 25 bp, Mus musculus
taagatccgtgaccttttggatgtg

SEQ ID NO: 6393 - DNA, 25 bp, Mus musculus
gtttaccacgcctgtgccatgcaga

SEQ ID NO: 6394 - DNA, 25 bp, Mus musculus
taccacgcctgtgccatgcagatcg

SEQ ID NO: 6395 - DNA, 25 bp, Mus musculus
tgtgccatgcagatcgtcaaagacg

SEQ ID NO: 6396 - DNA, 25 bp, Mus musculus
gtcaaagacgtccttgctggctaca

SEQ ID NO: 6397 - DNA, 25 bp, Mus musculus
ggctacaacggcacaatttttgctt

SEQ ID NO: 6398 - DNA, 25 bp, Mus musculus
atttttgcttatggacagacatcct

SEQ ID NO: 6399 - DNA, 25 bp, Mus musculus
cagacatcctcagggaaaacgcaca

SEQ ID NO: 6400 - DNA, 25 bp, Mus musculus
ggaaagctgcacgaccctcagctca

SEQ ID NO: 6401 - DNA, 25 bp, Mus musculus
ttgagaaagcccaggacttagctga

SEQ ID NO: 6402 - DNA, 25 bp, Mus musculus
aagcccaggacttagctgaagaggt

SEQ ID NO: 6403 - DNA, 25 bp, Mus musculus
atctcagatgcctgcaaaacaatgg

SEQ ID NO: 6404 - DNA, 25 bp, Mus musculus
gatgcctgcaaaacaatggcactag

SEQ ID NO: 6405 - DNA, 25 bp, Mus musculus
acaatggcactaggagctgccccaa

SEQ ID NO: 6406 - DNA, 25 bp, Mus musculus
ttgtgtgacttcagcggccatcttg

SEQ ID NO: 6407 - DNA, 25 bp, Mus musculus
gacttcagcggccatcttgggtttc

SEQ ID NO: 6408 - DNA, 25 bp, Mus musculus
agcggccatcttgggtttccacaca

SEQ ID NO: 6409 - DNA, 25 bp, Mus musculus
ggtcctccatagccaactcagcgca

SEQ ID NO: 6410 - DNA, 25 bp, Mus musculus
ccatagccaactcagcgcagaggcc

SEQ ID NO: 6411 - DNA, 25 bp, Mus musculus
ccaactcagcgcagaggcctgcttg

SEQ ID NO: 6412 - DNA, 25 bp, Mus musculus
ggcctgcttgctgctcctctgggcc

SEQ ID NO: 6413 - DNA, 25 bp, Mus musculus
agctcaagctgcattgcctgagtga

SEQ ID NO: 6414 - DNA, 25 bp, Mus musculus
agctgcattgcctgagtgagagcat

SEQ ID NO: 6415 - DNA, 25 bp, Mus musculus
agagcatctaccgcagcaaagggct

SEQ ID NO: 6416 - DNA, 25 bp, Mus musculus
tgcagcgtgacgtgcgcacgcacgt

SEQ ID NO: 6417 - DNA, 25 bp, Mus musculus
tgcgcacgcacgtagtgaggttcca

SEQ ID NO: 6418 - DNA, 25 bp, Mus musculus
ctgagctctactgcggcctctgtgg

SEQ ID NO: 6419 - DNA, 25 bp, Mus musculus
cccacatctttcatctcagatgcct

SEQ ID NO: 6420 - DNA, 25 bp, Mus musculus
tctttcatctcagatgcctgcaaaa

SEQ ID NO: 6421 - DNA, 25 bp, Mus musculus
cctgtatcagctgtggtcacctgca

SEQ ID NO: 6422 - DNA, 25 bp, Mus musculus
tgtatcagctgtggtcacctgcaac

SEQ ID NO: 6423 - DNA, 25 bp, Mus musculus
gtacccgcactgagaaaaatgcagg

SEQ ID NO: 6424 - DNA, 25 bp, Mus musculus
ttggatcctcggccaaccatcatca

SEQ ID NO: 6425 - DNA, 25 bp, Mus musculus
atcctcggccaaccatcatcaaagc

SEQ ID NO: 6426 - DNA, 25 bp, Mus musculus
cctcggccaaccatcatcaaagcta

SEQ ID NO: 6427 - DNA, 25 bp, Mus musculus
ggccaaccatcatcaaagctagggt

SEQ ID NO: 6428 - DNA, 25 bp, Mus musculus
ccaaccatcatcaaagctagggtaa

SEQ ID NO: 6429 - DNA, 25 bp, Mus musculus
aaccatcatcaaagctagggtaatg

SEQ ID NO: 6430 - DNA, 25 bp, Mus musculus
ccatcatcaaagctagggtaatgtt

SEQ ID NO: 6431 - DNA, 25 bp, Mus musculus
tgaacctgctaacaatttccaactg

SEQ ID NO: 6432 - DNA, 25 bp, Mus musculus
tgctaacaatttccaactgccaaaa

SEQ ID NO: 6433 - DNA, 25 bp, Mus musculus
ctgtggtcacctgcaacctctttgt

SEQ ID NO: 6434 - DNA, 25 bp, Mus musculus
gtggtcacctgcaacctctttgttg

SEQ ID NO: 6435 - DNA, 25 bp, Mus musculus
tcacctgcaacctctttgttgtacc

SEQ ID NO: 6436 - DNA, 25 bp, Mus musculus
ctgcaacctctttgttgtacccgca

SEQ ID NO: 6437 - DNA, 25 bp, Mus musculus
gcaacctctttgttgtacccgcact

SEQ ID NO: 6438 - DNA, 25 bp, Mus musculus
cctctttgttgtacccgcactgaga

SEQ ID NO: 6439 - DNA, 25 bp, Mus musculus
tctttgttgtacccgcactgagaaa

SEQ ID NO: 6440 - DNA, 25 bp, Mus musculus
tgttgtacccgcactgagaaaaatg

SEQ ID NO: 6441 - DNA, 25 bp, Mus musculus
aaggctgcctgcctggatatcctga

SEQ ID NO: 6442 - DNA, 25 bp, Mus musculus
gctgcctgcctggatatcctgattc

SEQ ID NO: 6443 - DNA, 25 bp, Mus musculus
acgcggtacacgcctgagcaagaca

SEQ ID NO: 6444 - DNA, 25 bp, Mus musculus
cggtacacgcctgagcaagacacaa

SEQ ID NO: 6445 - DNA, 25 bp, Mus musculus
gacacaatgaccttctcagatggac

SEQ ID NO: 6446 - DNA, 25 bp, Mus musculus
acaatgaccttctcagatggactga

SEQ ID NO: 6447 - DNA, 25 bp, Mus musculus
atgaccttctcagatggactgaccc

SEQ ID NO: 6448 - DNA, 25 bp, Mus musculus
actggactgctcagtgccatctgcc

SEQ ID NO: 6449 - DNA, 25 bp, Mus musculus
ggactgctcagtgccatctgcctca

SEQ ID NO: 6450 - DNA, 25 bp, Mus musculus
gaccgacaggacctggagcagccag

SEQ ID NO: 6451 - DNA, 25 bp, Mus musculus
atgaagatcacagaccttcggagca

SEQ ID NO: 6452 - DNA, 25 bp, Mus musculus
aagatcacagaccttcggagcatca

SEQ ID NO: 6453 - DNA, 25 bp, Mus musculus
gcctgcctggatatcctgattctgc

SEQ ID NO: 6454 - DNA, 25 bp, Mus musculus
ctggatatcctgattctgcgaatct

SEQ ID NO: 6455 - DNA, 25 bp, Mus musculus
gatatcctgattctgcgaatctgca

SEQ ID NO: 6456 - DNA, 25 bp, Mus musculus
atcctgattctgcgaatctgcacgc

SEQ ID NO: 6457 - DNA, 25 bp, Mus musculus
attctgcgaatctgcacgcggtaca

SEQ ID NO: 6458 - DNA, 25 bp, Mus musculus
ctgcgaatctgcacgcggtacacgc

SEQ ID NO: 6459 - DNA, 25 bp, Mus musculus
cgaatctgcacgcggtacacgcctg

SEQ ID NO: 6460 - DNA, 25 bp, Mus musculus
tgcacgcggtacacgcctgagcaag

SEQ ID NO: 6461 - DNA, 25 bp, Mus musculus
cccgtctgtacctctgctgaagtac

SEQ ID NO: 6462 - DNA, 25 bp, Mus musculus
tgtacctctgctgaagtacagcact

SEQ ID NO: 6463 - DNA, 25 bp, Mus musculus
gcttagctgatcccaccttgaccca

SEQ ID NO: 6464 - DNA, 25 bp, Mus musculus
tagctgatcccaccttgacccagag

SEQ ID NO: 6465 - DNA, 25 bp, Mus musculus
ccaccttgacccagaggaagcctct

SEQ ID NO: 6466 - DNA, 25 bp, Mus musculus
ccttgacccagaggaagcctctatt

SEQ ID NO: 6467 - DNA, 25 bp, Mus musculus
tgacccagaggaagcctctatttat

SEQ ID NO: 6468 - DNA, 25 bp, Mus musculus
atatttagctgccaaataagattcc

SEQ ID NO: 6469 - DNA, 25 bp, Mus musculus
ctaccccgctgttcgcatattgctg

SEQ ID NO: 6470 - DNA, 25 bp, Mus musculus
ccccgctgttcgcatattgctgagt

SEQ ID NO: 6471 - DNA, 25 bp, Mus musculus
cgctgttcgcatattgctgagtttt

SEQ ID NO: 6472 - DNA, 25 bp, Mus musculus
tgttcgcatattgctgagttttcta

SEQ ID NO: 6473 - DNA, 25 bp, Mus musculus
acctctgctgaagtacagcactcat

SEQ ID NO: 6474 - DNA, 25 bp, Mus musculus
gaagtacagcactcatcctgggccc

SEQ ID NO: 6475 - DNA, 25 bp, Mus musculus
tcccttacttctgtctcgtgccttg

SEQ ID NO: 6476 - DNA, 25 bp, Mus musculus
ccctcatctcagccatcaggcaggg

SEQ ID NO: 6477 - DNA, 25 bp, Mus musculus
tcatctcagccatcaggcagggccc

SEQ ID NO: 6478 - DNA, 25 bp, Mus musculus
gccctcctacactacagaggggcca

SEQ ID NO: 6479 - DNA, 25 bp, Mus musculus
tctcctagtgccttctacccttgat

SEQ ID NO: 6480 - DNA, 25 bp, Mus musculus
gctgcttagctgatcccaccttgac

SEQ ID NO: 6481 - DNA, 25 bp, Mus musculus
gctgaccatccagttcatccagtcc

SEQ ID NO: 6482 - DNA, 25 bp, Mus musculus
catccagttcatccagtcctacttt

SEQ ID NO: 6483 - DNA, 25 bp, Mus musculus
cacaaagatctgcactgtggacggc

SEQ ID NO: 6484 - DNA, 25 bp, Mus musculus
cactgtggacggcatccctgcacgg

SEQ ID NO: 6485 - DNA, 25 bp, Mus musculus
tgcacggctggacatcctggacact

SEQ ID NO: 6486 - DNA, 25 bp, Mus musculus
tggtgccatgcgggacgagtacatg

SEQ ID NO: 6487 - DNA, 25 bp, Mus musculus
cgagtacatgcgtgctggcaacggc

SEQ ID NO: 6488 - DNA, 25 bp, Mus musculus
gtacatgcgtgctggcaacggcttc

SEQ ID NO: 6489 - DNA, 25 bp, Mus musculus
tgctggcaacggcttcctgctggtg

SEQ ID NO: 6490 - DNA, 25 bp, Mus musculus
cggcttcctgctggtgtttgccatt

SEQ ID NO: 6491 - DNA, 25 bp, Mus musculus
cctgctggtgtttgccattaacgac

SEQ ID NO: 6492 - DNA, 25 bp, Mus musculus
gtttgccattaacgacaggcagagt

SEQ ID NO: 6493 - DNA, 25 bp, Mus musculus
ccagttcatccagtcctactttgtg

SEQ ID NO: 6494 - DNA, 25 bp, Mus musculus
ccagtcctactttgtgtctgactat

SEQ ID NO: 6495 - DNA, 25 bp, Mus musculus
gtcctactttgtgtctgactatgat

SEQ ID NO: 6496 - DNA, 25 bp, Mus musculus
ctactttgtgtctgactatgatccc

SEQ ID NO: 6497 - DNA, 25 bp, Mus musculus
tcccaccattgaagattcctacaca

SEQ ID NO: 6498 - DNA, 25 bp, Mus musculus
caccattgaagattcctacacaaag

SEQ ID NO: 6499 - DNA, 25 bp, Mus musculus
tgaagattcctacacaaagatctgc

SEQ ID NO: 6500 - DNA, 25 bp, Mus musculus
ttcctacacaaagatctgcactgtg

SEQ ID NO: 6501 - DNA, 25 bp, Mus musculus
cccggctcggctgcaaccatgatca

SEQ ID NO: 6502 - DNA, 25 bp, Mus musculus
ccggctcggctgcaaccatgatcaa

SEQ ID NO: 6503 - DNA, 25 bp, Mus musculus
aaccatgatcaagcacttcctggag

SEQ ID NO: 6504 - DNA, 25 bp, Mus musculus
accatgatcaagcacttcctggagg

SEQ ID NO: 6505 - DNA, 25 bp, Mus musculus
tggagttcagagccacgttgtggtc

SEQ ID NO: 6506 - DNA, 25 bp, Mus musculus
gagttcagagccacgttgtggtccc

SEQ ID NO: 6507 - DNA, 25 bp, Mus musculus
agttcagagccacgttgtggtccca

SEQ ID NO: 6508 - DNA, 25 bp, Mus musculus
gttcagagccacgttgtggtcccag

SEQ ID NO: 6509 - DNA, 25 bp, Mus musculus
ttcagagccacgttgtggtcccagc

SEQ ID NO: 6510 - DNA, 25 bp, Mus musculus
cagtcagcagtacttctgtacccag

SEQ ID NO: 6511 - DNA, 25 bp, Mus musculus
agtcagcagtacttctgtacccagc

SEQ ID NO: 6512 - DNA, 25 bp, Mus musculus
gtcagcagtacttctgtacccagcc

SEQ ID NO: 6513 - DNA, 25 bp, Mus musculus
cggctcggctgcaaccatgatcaag

SEQ ID NO: 6514 - DNA, 25 bp, Mus musculus
gctcggctgcaaccatgatcaagca

SEQ ID NO: 6515 - DNA, 25 bp, Mus musculus
tcggctgcaaccatgatcaagcact

SEQ ID NO: 6516 - DNA, 25 bp, Mus musculus
cggctgcaaccatgatcaagcactt

SEQ ID NO: 6517 - DNA, 25 bp, Mus musculus
gctgcaaccatgatcaagcacttcc

SEQ ID NO: 6518 - DNA, 25 bp, Mus musculus
ctgcaaccatgatcaagcacttcct

SEQ ID NO: 6519 - DNA, 25 bp, Mus musculus
tgcaaccatgatcaagcacttcctg

SEQ ID NO: 6520 - DNA, 25 bp, Mus musculus
gcaaccatgatcaagcacttcctgg

SEQ ID NO: 6521 - DNA, 25 bp, Mus musculus
ggcatcactctatgggcaaagtgtt

SEQ ID NO: 6522 - DNA, 25 bp, Mus musculus
aagtgttactcagacatgggcacct

SEQ ID NO: 6523 - DNA, 25 bp, Mus musculus
catagcgcgttccaggttcagtgag

SEQ ID NO: 6524 - DNA, 25 bp, Mus musculus
tcagccatgtgcactcatgcaaatg

SEQ ID NO: 6525 - DNA, 25 bp, Mus musculus
atgtgcactcatgcaaatgccatac

SEQ ID NO: 6526 - DNA, 25 bp, Mus musculus
actcatgcaaatgccatacatgcag

SEQ ID NO: 6527 - DNA, 25 bp, Mus musculus
gcaaatgccatacatgcagaagtat

SEQ ID NO: 6528 - DNA, 25 bp, Mus musculus
tgtgcacacacacgcacacattaac

SEQ ID NO: 6529 - DNA, 25 bp, Mus musculus
cacacacgcacacattaaccaacga

SEQ ID NO: 6530 - DNA, 25 bp, Mus musculus
cgcacacattaaccaacgactagca

SEQ ID NO: 6531 - DNA, 25 bp, Mus musculus
tcgtactgaaactcactacaatgta

SEQ ID NO: 6532 - DNA, 25 bp, Mus musculus
tgaaactcactacaatgtatactta

SEQ ID NO: 6533 - DNA, 25 bp, Mus musculus
tactcagacatgggcacctgagttc

SEQ ID NO: 6534 - DNA, 25 bp, Mus musculus
gacatgggcacctgagttcagatcc

SEQ ID NO: 6535 - DNA, 25 bp, Mus musculus
cctaccacctaagtaagcagacaag

SEQ ID NO: 6536 - DNA, 25 bp, Mus musculus
ttgtaatgccagtgctagaggcaga

SEQ ID NO: 6537 - DNA, 25 bp, Mus musculus
cagatcctgcaggctcagtggctgg

SEQ ID NO: 6538 - DNA, 25 bp, Mus musculus
ctgcaggctcagtggctggccaaac

SEQ ID NO: 6539 - DNA, 25 bp, Mus musculus
tggctggccaaacagcctagccaac

SEQ ID NO: 6540 - DNA, 25 bp, Mus musculus
gccaaacagcctagccaacatagcg

SEQ ID NO: 6541 - DNA, 25 bp, Mus musculus
ctatagtcagatgcccaccatccct

SEQ ID NO: 6542 - DNA, 25 bp, Mus musculus
catccctactgaaagacgcacagct

SEQ ID NO: 6543 - DNA, 25 bp, Mus musculus
tcctatacactataggtctctgcct

SEQ ID NO: 6544 - DNA, 25 bp, Mus musculus
acactataggtctctgcctcccagg

SEQ ID NO: 6545 - DNA, 25 bp, Mus musculus
caaagcgtggctcctctatgattag

SEQ ID NO: 6546 - DNA, 25 bp, Mus musculus
gtggctcctctatgattagaaatac

SEQ ID NO: 6547 - DNA, 25 bp, Mus musculus
gaaatacctgcaggatgaagggacc

SEQ ID NO: 6548 - DNA, 25 bp, Mus musculus
agggatggccctagtctgggctgtt

SEQ ID NO: 6549 - DNA, 25 bp, Mus musculus
ctgtccctgaggaacaacacgtcac

SEQ ID NO: 6550 - DNA, 25 bp, Mus musculus
acgtcacatttccttcatggctgga

SEQ ID NO: 6551 - DNA, 25 bp, Mus musculus
catttccttcatggctggattaacg

SEQ ID NO: 6552 - DNA, 25 bp, Mus musculus
cttcatggctggattaacgtatgtg

SEQ ID NO: 6553 - DNA, 25 bp, Mus musculus
ttctctgccatcagagggacacaaa

SEQ ID NO: 6554 - DNA, 25 bp, Mus musculus
tactttctagcatctcagcagcaca

SEQ ID NO: 6555 - DNA, 25 bp, Mus musculus
ctagcatctcagcagcacagactag

SEQ ID NO: 6556 - DNA, 25 bp, Mus musculus
tctcagcagcacagactagcagcag

SEQ ID NO: 6557 - DNA, 25 bp, Mus musculus
cagcacagactagcagcaggaaaga

SEQ ID NO: 6558 - DNA, 25 bp, Mus musculus
ggttgcccatctcctttctcctata

SEQ ID NO: 6559 - DNA, 25 bp, Mus musculus
ccatctcctttctcctatacactat

SEQ ID NO: 6560 - DNA, 25 bp, Mus musculus
cctttctcctatacactataggtct

SEQ ID NO: 6561 - DNA, 25 bp, Mus musculus
gccgctgacgaccggaacgaaaatg

SEQ ID NO: 6562 - DNA, 25 bp, Mus musculus
cgctgacgaccggaacgaaaatgag

SEQ ID NO: 6563 - DNA, 25 bp, Mus musculus
tgtctctccagatgaacttaaagac

SEQ ID NO: 6564 - DNA, 25 bp, Mus musculus
gtctctccagatgaacttaaagacg

SEQ ID NO: 6565 - DNA, 25 bp, Mus musculus
ctctccagatgaacttaaagacgaa

SEQ ID NO: 6566 - DNA, 25 bp, Mus musculus
agacgaactacccgagcggcacgct

SEQ ID NO: 6567 - DNA, 25 bp, Mus musculus
taaataccaacatgatgatggcaga

SEQ ID NO: 6568 - DNA, 25 bp, Mus musculus
aataccaacatgatgatggcagagt

SEQ ID NO: 6569 - DNA, 25 bp, Mus musculus
ataccaacatgatgatggcagagtc

SEQ ID NO: 6570 - DNA, 25 bp, Mus musculus
atggcagagtctcgtacccgctctg

SEQ ID NO: 6571 - DNA, 25 bp, Mus musculus
ggcagagtctcgtacccgctctgct

SEQ ID NO: 6572 - DNA, 25 bp, Mus musculus
gcagagtctcgtacccgctctgctt

SEQ ID NO: 6573 - DNA, 25 bp, Mus musculus
gagtctttggtggtttgtgatgttg

SEQ ID NO: 6574 - DNA, 25 bp, Mus musculus
gaaacccacaatgctgctattataa

SEQ ID NO: 6575 - DNA, 25 bp, Mus musculus
caaggatgaacgcctggtggtgctg

SEQ ID NO: 6576 - DNA, 25 bp, Mus musculus
atgaacgcctggtggtgctggatga

SEQ ID NO: 6577 - DNA, 25 bp, Mus musculus
agctcgagggtgtctctccagatga

SEQ ID NO: 6578 - DNA, 25 bp, Mus musculus
gggtgtctctccagatgaacttaaa

SEQ ID NO: 6579 - DNA, 25 bp, Mus musculus
ggtgtctctccagatgaacttaaag

SEQ ID NO: 6580 - DNA, 25 bp, Mus musculus
gtgtctctccagatgaacttaaaga

SEQ ID NO: 6581 - DNA, 25 bp, Mus musculus
cctcaggtccactggataaaggatg

SEQ ID NO: 6582 - DNA, 25 bp, Mus musculus
ggcacctatagctgcgtggccaccc

SEQ ID NO: 6583 - DNA, 25 bp, Mus musculus
taagagcacccagatcgagcctgtg

SEQ ID NO: 6584 - DNA, 25 bp, Mus musculus
cacccagatcgagcctgtgtgatgg

SEQ ID NO: 6585 - DNA, 25 bp, Mus musculus
gatcgagcctgtgtgatggccctag

SEQ ID NO: 6586 - DNA, 25 bp, Mus musculus
gcctgtgtgatggccctagagcagc

SEQ ID NO: 6587 - DNA, 25 bp, Mus musculus
caattcctccttgaggcacttcctt

SEQ ID NO: 6588 - DNA, 25 bp, Mus musculus
ctccttgaggcacttccttctccaa

SEQ ID NO: 6589 - DNA, 25 bp, Mus musculus
gaggcacttccttctccaaccagag

SEQ ID NO: 6590 - DNA, 25 bp, Mus musculus
accagagcccacatgatccatgctg

SEQ ID NO: 6591 - DNA, 25 bp, Mus musculus
gcccacatgatccatgctgagtaaa

SEQ ID NO: 6592 - DNA, 25 bp, Mus musculus
atgatccatgctgagtaaacatttg

SEQ ID NO: 6593 - DNA, 25 bp, Mus musculus
ggacctcaggaaagccctcctgtca

SEQ ID NO: 6594 - DNA, 25 bp, Mus musculus
caggaaagccctcctgtcagcatca

SEQ ID NO: 6595 - DNA, 25 bp, Mus musculus
agccctcctgtcagcatcagggtca

SEQ ID NO: 6596 - DNA, 25 bp, Mus musculus
cctgtcagcatcagggtcacagaaa

SEQ ID NO: 6597 - DNA, 25 bp, Mus musculus
acagaaaccggcgatgaggggccag

SEQ ID NO: 6598 - DNA, 25 bp, Mus musculus
ctagccctggccttggggatcctgg

SEQ ID NO: 6599 - DNA, 25 bp, Mus musculus
gccctgctcgtcggggctatcctgt

SEQ ID NO: 6600 - DNA, 25 bp, Mus musculus
ggaccgtaagagcacccagatcgag

SEQ ID NO: 6601 - DNA, 25 bp, Mus musculus
agaggaacctgaatcccatcttcaa

SEQ ID NO: 6602 - DNA, 25 bp, Mus musculus
ggaacctgaatcccatcttcaatga

SEQ ID NO: 6603 - DNA, 25 bp, Mus musculus
tcatcatcactgtcatggacaaaga

SEQ ID NO: 6604 - DNA, 25 bp, Mus musculus
aagacaagctcatgtgcaatgacgt

SEQ ID NO: 6605 - DNA, 25 bp, Mus musculus
acaagctcatgtgcaatgacgtcat

SEQ ID NO: 6606 - DNA, 25 bp, Mus musculus
gcaatgacgtcattggcaagatcta

SEQ ID NO: 6607 - DNA, 25 bp, Mus musculus
tcattggcaagatctacctgtcctg

SEQ ID NO: 6608 - DNA, 25 bp, Mus musculus
ttggcaagatctacctgtcctggaa

SEQ ID NO: 6609 - DNA, 25 bp, Mus musculus
gcaagatctacctgtcctggaagat

SEQ ID NO: 6610 - DNA, 25 bp, Mus musculus
agatcggaccaggcgaggtgaagca

SEQ ID NO: 6611 - DNA, 25 bp, Mus musculus
aagacatgatcgctcgtccccggca

SEQ ID NO: 6612 - DNA, 25 bp, Mus musculus
ctcgtccccggcatgctgttgctca

SEQ ID NO: 6613 - DNA, 25 bp, Mus musculus
acctgaatcccatcttcaatgagtc

SEQ ID NO: 6614 - DNA, 25 bp, Mus musculus
tgaatcccatcttcaatgagtcttt

SEQ ID NO: 6615 - DNA, 25 bp, Mus musculus
tttacatacccactgattttctgag

SEQ ID NO: 6616 - DNA, 25 bp, Mus musculus
tacccactgattttctgagggagtc

SEQ ID NO: 6617 - DNA, 25 bp, Mus musculus
attttctgagggagtccatcatcat

SEQ ID NO: 6618 - DNA, 25 bp, Mus musculus
gggagtccatcatcatcatcactgt

SEQ ID NO: 6619 - DNA, 25 bp, Mus musculus
agtccatcatcatcatcactgtcat

SEQ ID NO: 6620 - DNA, 25 bp, Mus musculus
ccatcatcatcatcactgtcatgga

SEQ ID NO: 6621 - DNA, 25 bp, Mus musculus
ctcttcactatgttggacctgctgc

SEQ ID NO: 6622 - DNA, 25 bp, Mus musculus
gcaccaccacttgccagtgctgtgg

SEQ ID NO: 6623 - DNA, 25 bp, Mus musculus
cactccattccgaagccaaccttga

SEQ ID NO: 6624 - DNA, 25 bp, Mus musculus
attccgaagccaaccttgatcagtc

SEQ ID NO: 6625 - DNA, 25 bp, Mus musculus
atcagtcttccagcttcctcatcct

SEQ ID NO: 6626 - DNA, 25 bp, Mus musculus
cttccagcttcctcatcctgaatcg

SEQ ID NO: 6627 - DNA, 25 bp, Mus musculus
tcatcctgaatcggacatctgcagc

SEQ ID NO: 6628 - DNA, 25 bp, Mus musculus
tgagcccattttacagaatgctgag

SEQ ID NO: 6629 - DNA, 25 bp, Mus musculus
gctcctgcagatggaccccttctca

SEQ ID NO: 6630 - DNA, 25 bp, Mus musculus
gcagatggaccccttctcaggacag

SEQ ID NO: 6631 - DNA, 25 bp, Mus musculus
ggaccccttctcaggacagattctc

SEQ ID NO: 6632 - DNA, 25 bp, Mus musculus
cttctcaggacagattctcagagat

SEQ ID NO: 6633 - DNA, 25 bp, Mus musculus
ctggactcttttgcagcgccgggcc

SEQ ID NO: 6634 - DNA, 25 bp, Mus musculus
ggtactgctagccttgtgggcagca

SEQ ID NO: 6635 - DNA, 25 bp, Mus musculus
ggcagcaacatgtttcccaaccagt

SEQ ID NO: 6636 - DNA, 25 bp, Mus musculus
ggcctcctatctccagggcctgaag

SEQ ID NO: 6637 - DNA, 25 bp, Mus musculus
ccagggcctgaagccacgtagcctc

SEQ ID NO: 6638 - DNA, 25 bp, Mus musculus
cctgaagccacgtagcctctgaggt

SEQ ID NO: 6639 - DNA, 25 bp, Mus musculus
tagcctctgaggtaacagaggaggc

SEQ ID NO: 6640 - DNA, 25 bp, Mus musculus
gtatagcactccattccgaagccaa

SEQ ID NO: 6641 - DNA, 25 bp, Mus musculus
gaagacactgactgaaccattgttc

SEQ ID NO: 6642 - DNA, 25 bp, Mus musculus
actgactgaaccattgttcctgttc

SEQ ID NO: 6643 - DNA, 25 bp, Mus musculus
atgcaagtattccactccttggtca

SEQ ID NO: 6644 - DNA, 25 bp, Mus musculus
aacttacctgttctggtatgtccag

SEQ ID NO: 6645 - DNA, 25 bp, Mus musculus
cctgttctggtatgtccagtaccca

SEQ ID NO: 6646 - DNA, 25 bp, Mus musculus
ctggtatgtccagtacccacagcag

SEQ ID NO: 6647 - DNA, 25 bp, Mus musculus
tgtccagtacccacagcagaggctc

SEQ ID NO: 6648 - DNA, 25 bp, Mus musculus
gtacccacagcagaggctccagctg

SEQ ID NO: 6649 - DNA, 25 bp, Mus musculus
acagcagaggctccagctgctcctc

SEQ ID NO: 6650 - DNA, 25 bp, Mus musculus
gaggctccagctgctcctcaagtac

SEQ ID NO: 6651 - DNA, 25 bp, Mus musculus
ccagctgctcctcaagtactattca

SEQ ID NO: 6652 - DNA, 25 bp, Mus musculus
ctattcaggagacccagttgttcaa

SEQ ID NO: 6653 - DNA, 25 bp, Mus musculus
cctgttcttctggctgcagctgaat

SEQ ID NO: 6654 - DNA, 25 bp, Mus musculus
cttctggctgcagctgaattgagtt

SEQ ID NO: 6655 - DNA, 25 bp, Mus musculus
ttgagttgcccaagctcagtcagtg

SEQ ID NO: 6656 - DNA, 25 bp, Mus musculus
tgcccaagctcagtcagtgactcaa

SEQ ID NO: 6657 - DNA, 25 bp, Mus musculus
gtcagtgactcaacctgatgctcat

SEQ ID NO: 6658 - DNA, 25 bp, Mus musculus
gactcaacctgatgctcatgtcact

SEQ ID NO: 6659 - DNA, 25 bp, Mus musculus
acctgatgctcatgtcactgtctct

SEQ ID NO: 6660 - DNA, 25 bp, Mus musculus
tgctcatgtcactgtctctgaagaa

SEQ ID NO: 6661 - DNA, 25 bp, Mus musculus
ggacactggttcatcctttatctcg

SEQ ID NO: 6662 - DNA, 25 bp, Mus musculus
atcctttatctcggctcctacgagc

SEQ ID NO: 6663 - DNA, 25 bp, Mus musculus
ggctctccatgccatggacatccca

SEQ ID NO: 6664 - DNA, 25 bp, Mus musculus
tgccaccttcatccgcaagttctat

SEQ ID NO: 6665 - DNA, 25 bp, Mus musculus
cttcatccgcaagttctatacagag

SEQ ID NO: 6666 - DNA, 25 bp, Mus musculus
tcggcataacaatcgcgttggattc

SEQ ID NO: 6667 - DNA, 25 bp, Mus musculus
taacaatcgcgttggattcgccttg

SEQ ID NO: 6668 - DNA, 25 bp, Mus musculus
cagtaaccctaggccaagccaagct

SEQ ID NO: 6669 - DNA, 25 bp, Mus musculus
ccctaggccaagccaagctggcact

SEQ ID NO: 6670 - DNA, 25 bp, Mus musculus
gccaagccaagctggcactcttggg

SEQ ID NO: 6671 - DNA, 25 bp, Mus musculus
tggcactcttgggggccatttgtct

SEQ ID NO: 6672 - DNA, 25 bp, Mus musculus
tttgtctggctttgtcccaacatag

SEQ ID NO: 6673 - DNA, 25 bp, Mus musculus
tacgagctccctgaagttgatcatg

SEQ ID NO: 6674 - DNA, 25 bp, Mus musculus
ctccctgaagttgatcatgcaagcc

SEQ ID NO: 6675 - DNA, 25 bp, Mus musculus
cagggcctacacactcagcagtacg

SEQ ID NO: 6676 - DNA, 25 bp, Mus musculus
ctacacactcagcagtacggactac

SEQ ID NO: 6677 - DNA, 25 bp, Mus musculus
actcagcagtacggactacgtgcta

SEQ ID NO: 6678 - DNA, 25 bp, Mus musculus
cagtacggactacgtgctacagtat

SEQ ID NO: 6679 - DNA, 25 bp, Mus musculus
cgtgctacagtatcccaacaggaga

SEQ ID NO: 6680 - DNA, 25 bp, Mus musculus
acagtatcccaacaggagagacaag

SEQ ID NO: 6681 - DNA, 25 bp, Mus musculus
cttagggacactggctgtgctccct

SEQ ID NO: 6682 - DNA, 25 bp, Mus musculus
tgtgtctgctctgctcatggacaag

SEQ ID NO: 6683 - DNA, 25 bp, Mus musculus
agtcagtattgcatcctggaacgcg

SEQ ID NO: 6684 - DNA, 25 bp, Mus musculus
cagtattgcatcctggaacgcgctg

SEQ ID NO: 6685 - DNA, 25 bp, Mus musculus
tattgcatcctggaacgcgctggac

SEQ ID NO: 6686 - DNA, 25 bp, Mus musculus
atcctggaacgcgctggacgtgctg

SEQ ID NO: 6687 - DNA, 25 bp, Mus musculus
ctggaacgcgctggacgtgctgact

SEQ ID NO: 6688 - DNA, 25 bp, Mus musculus
gaacgcgctggacgtgctgactgtt

SEQ ID NO: 6689 - DNA, 25 bp, Mus musculus
gctggacgtgctgactgttgaactc

SEQ ID NO: 6690 - DNA, 25 bp, Mus musculus
tgttgaactctacccttccgacaag

SEQ ID NO: 6691 - DNA, 25 bp, Mus musculus
ggccttcggcttcctgaatgccctg

SEQ ID NO: 6692 - DNA, 25 bp, Mus musculus
cggcttcctgaatgccctgtgtaag

SEQ ID NO: 6693 - DNA, 25 bp, Mus musculus
tctgctcatggacaagattggcagg

SEQ ID NO: 6694 - DNA, 25 bp, Mus musculus
cctgaatgccctgtgtaagctggca

SEQ ID NO: 6695 - DNA, 25 bp, Mus musculus
gtcctgtgtttcctgcttcttcctg

SEQ ID NO: 6696 - DNA, 25 bp, Mus musculus
cttcctgtcttttgggaacagtgag

SEQ ID NO: 6697 - DNA, 25 bp, Mus musculus
cctgtcttttgggaacagtgagtca

SEQ ID NO: 6698 - DNA, 25 bp, Mus musculus
gtcagccatgatcgctctgctctgc

SEQ ID NO: 6699 - DNA, 25 bp, Mus musculus
agccatgatcgctctgctctgcctt

SEQ ID NO: 6700 - DNA, 25 bp, Mus musculus
catgatcgctctgctctgccttttt

SEQ ID NO: 6701 - DNA, 25 bp, Mus musculus
cgctctgctctgcctttttggggga

SEQ ID NO: 6702 - DNA, 25 bp, Mus musculus
tctcccacattaaaatgaaaactgc

SEQ ID NO: 6703 - DNA, 25 bp, Mus musculus
gattcaaactgtacaaaacaactct

SEQ ID NO: 6704 - DNA, 25 bp, Mus musculus
aggttcttggtgcctacattatcag

SEQ ID NO: 6705 - DNA, 25 bp, Mus musculus
ttggtgcctacattatcagaggggc

SEQ ID NO: 6706 - DNA, 25 bp, Mus musculus
cagtgcctatttaggttcagacaat

SEQ ID NO: 6707 - DNA, 25 bp, Mus musculus
ttgacaacaggctaatctgacagga

SEQ ID NO: 6708 - DNA, 25 bp, Mus musculus
taatctgacaggaacctacttttgt

SEQ ID NO: 6709 - DNA, 25 bp, Mus musculus
ataatgccagggtttgctcaccaaa

SEQ ID NO: 6710 - DNA, 25 bp, Mus musculus
tttgctcaccaaacacataaacgtt

SEQ ID NO: 6711 - DNA, 25 bp, Mus musculus
agaagccagagcacaggaaggaaag

SEQ ID NO: 6712 - DNA, 25 bp, Mus musculus
aatgtcgtcatctttttaacagctt

SEQ ID NO: 6713 - DNA, 25 bp, Mus musculus
gtcatctttttaacagcttgaaggt

SEQ ID NO: 6714 - DNA, 25 bp, Mus musculus
aactgtacaaaacaactctgtggca

SEQ ID NO: 6715 - DNA, 25 bp, Mus musculus
caactctgtggcaacagccgtctct

SEQ ID NO: 6716 - DNA, 25 bp, Mus musculus
tgtggtcttccttttgagatggctt

SEQ ID NO: 6717 - DNA, 25 bp, Mus musculus
cttccttttgagatggcttctgctc

SEQ ID NO: 6718 - DNA, 25 bp, Mus musculus
atggcttctgctctgtgaagggagc

SEQ ID NO: 6719 - DNA, 25 bp, Mus musculus
cttttcaggctcttgtcctcctgct

SEQ ID NO: 6720 - DNA, 25 bp, Mus musculus
gtctcaattttcctaggcagtacat

SEQ ID NO: 6721 - DNA, 25 bp, Mus musculus
attttcctaggcagtacatttcata

SEQ ID NO: 6722 - DNA, 25 bp, Mus musculus
gctttgctcaccaagaaggctttga

SEQ ID NO: 6723 - DNA, 25 bp, Mus musculus
tttgctcaccaagaaggctttgagg

SEQ ID NO: 6724 - DNA, 25 bp, Mus musculus
agcccagagccagtgccccaggagg

SEQ ID NO: 6725 - DNA, 25 bp, Mus musculus
gaacgccaatccagggatcaagtgt

SEQ ID NO: 6726 - DNA, 25 bp, Mus musculus
acgccaatccagggatcaagtgttt

SEQ ID NO: 6727 - DNA, 25 bp, Mus musculus
atcaagtgtttcgctgtgcgctccc

SEQ ID NO: 6728 - DNA, 25 bp, Mus musculus
tgtgcgctccctaggctgggtagag

SEQ ID NO: 6729 - DNA, 25 bp, Mus musculus
tgcgctccctaggctgggtagagat

SEQ ID NO: 6730 - DNA, 25 bp, Mus musculus
cgctccctaggctgggtagagatga

SEQ ID NO: 6731 - DNA, 25 bp, Mus musculus
ctccctaggctgggtagagatgact

SEQ ID NO: 6732 - DNA, 25 bp, Mus musculus
ccctaggctgggtagagatgactga

SEQ ID NO: 6733 - DNA, 25 bp, Mus musculus
ggccccaggacgcagcagtgtggca

SEQ ID NO: 6734 - DNA, 25 bp, Mus musculus
tgctcaccaagaaggctttgaggaa

SEQ ID NO: 6735 - DNA, 25 bp, Mus musculus
agaggccccaatggagttgggactg

SEQ ID NO: 6736 - DNA, 25 bp, Mus musculus
cattgcccttctcagctcagagcct

SEQ ID NO: 6737 - DNA, 25 bp, Mus musculus
ttgcccttctcagctcagagcctca

SEQ ID NO: 6738 - DNA, 25 bp, Mus musculus
ttctcagctcagagcctcagcccag

SEQ ID NO: 6739 - DNA, 25 bp, Mus musculus
ctcagctcagagcctcagcccagag

SEQ ID NO: 6740 - DNA, 25 bp, Mus musculus
tcagagcctcagcccagagccagtg

SEQ ID NO: 6741 - DNA, 25 bp, Mus musculus
agagcctcagcccagagccagtgcc

SEQ ID NO: 6742 - DNA, 25 bp, Mus musculus
tgtcctagagagcacacccgtgggc

SEQ ID NO: 6743 - DNA, 25 bp, Mus musculus
agagagcacacccgtgggcacagtt

SEQ ID NO: 6744 - DNA, 25 bp, Mus musculus
cgagaaccattactcactgctcacc

SEQ ID NO: 6745 - DNA, 25 bp, Mus musculus
gctcaccagccagcctttggaccga

SEQ ID NO: 6746 - DNA, 25 bp, Mus musculus
cagccagcctttggaccgagagtca

SEQ ID NO: 6747 - DNA, 25 bp, Mus musculus
gcctttggaccgagagtcacatccc

SEQ ID NO: 6748 - DNA, 25 bp, Mus musculus
ggaccgagagtcacatcccattaca

SEQ ID NO: 6749 - DNA, 25 bp, Mus musculus
agagtcacatcccattacaccatcg

SEQ ID NO: 6750 - DNA, 25 bp, Mus musculus
cattacaccatcgacctgctggcca

SEQ ID NO: 6751 - DNA, 25 bp, Mus musculus
gacctgctggccagtgatgctggat

SEQ ID NO: 6752 - DNA, 25 bp, Mus musculus
catctcaccatcaggctgaacattt

SEQ ID NO: 6753 - DNA, 25 bp, Mus musculus
accatcaggctgaacatttcagatg

SEQ ID NO: 6754 - DNA, 25 bp, Mus musculus
taatgtgcgggaccgagactcaggt

SEQ ID NO: 6755 - DNA, 25 bp, Mus musculus
cctggagacaactccaaacctgcca

SEQ ID NO: 6756 - DNA, 25 bp, Mus musculus
gacaactccaaacctgccatttcag

SEQ ID NO: 6757 - DNA, 25 bp, Mus musculus
tccaaacctgccatttcagatcaag

SEQ ID NO: 6758 - DNA, 25 bp, Mus musculus
cctgccatttcagatcaagccttcc

SEQ ID NO: 6759 - DNA, 25 bp, Mus musculus
atttcagatcaagccttccgagaac

SEQ ID NO: 6760 - DNA, 25 bp, Mus musculus
gatcaagccttccgagaaccattac

SEQ ID NO: 6761 - DNA, 25 bp, Mus musculus
gccttccgagaaccattactcactg

SEQ ID NO: 6762 - DNA, 25 bp, Mus musculus
tcttttctcctgacttaaactgagt

SEQ ID NO: 6763 - DNA, 25 bp, Mus musculus
ctcctgacttaaactgagttcctga

SEQ ID NO: 6764 - DNA, 25 bp, Mus musculus
gcatctgtagtgacgattggagagg

SEQ ID NO: 6765 - DNA, 25 bp, Mus musculus
ccgagtccaggcagctagccagcca

SEQ ID NO: 6766 - DNA, 25 bp, Mus musculus
gagtccaggcagctagccagccacg

SEQ ID NO: 6767 - DNA, 25 bp, Mus musculus
agctagccagccacgcgccacaaag

SEQ ID NO: 6768 - DNA, 25 bp, Mus musculus
agccacgcgccacaaagggagcgcc

SEQ ID NO: 6769 - DNA, 25 bp, Mus musculus
cccaatgtcctcggccatcgaaagg

SEQ ID NO: 6770 - DNA, 25 bp, Mus musculus
caatgtcctcggccatcgaaaggaa

SEQ ID NO: 6771 - DNA, 25 bp, Mus musculus
atgtcctcggccatcgaaaggaaga

SEQ ID NO: 6772 - DNA, 25 bp, Mus musculus
gtcctcggccatcgaaaggaagagc

SEQ ID NO: 6773 - DNA, 25 bp, Mus musculus
cctcggccatcgaaaggaagagcct

SEQ ID NO: 6774 - DNA, 25 bp, Mus musculus
tgacttaaactgagttcctgacatt

SEQ ID NO: 6775 - DNA, 25 bp, Mus musculus
actgagttcctgacattttctggaa

SEQ ID NO: 6776 - DNA, 25 bp, Mus musculus
tgagttcctgacattttctggaaag

SEQ ID NO: 6777 - DNA, 25 bp, Mus musculus
aggcatttctacctgcatctgtagt

SEQ ID NO: 6778 - DNA, 25 bp, Mus musculus
gcatttctacctgcatctgtagtga

SEQ ID NO: 6779 - DNA, 25 bp, Mus musculus
atttctacctgcatctgtagtgacg

SEQ ID NO: 6780 - DNA, 25 bp, Mus musculus
ttctacctgcatctgtagtgacgat

SEQ ID NO: 6781 - DNA, 25 bp, Mus musculus
acctgcatctgtagtgacgattgga

SEQ ID NO: 6782 - DNA, 25 bp, Mus musculus
gagattgattcctctatgagggaat

SEQ ID NO: 6783 - DNA, 25 bp, Mus musculus
gattcctctatgagggaattgactt

SEQ ID NO: 6784 - DNA, 25 bp, Mus musculus
ccttcgagatgccaactagacaagt

SEQ ID NO: 6785 - DNA, 25 bp, Mus musculus
tgccaactagacaagtcacagatca

SEQ ID NO: 6786 - DNA, 25 bp, Mus musculus
caactagacaagtcacagatcatga

SEQ ID NO: 6787 - DNA, 25 bp, Mus musculus
tggtctacagaatcccaagatcaga

SEQ ID NO: 6788 - DNA, 25 bp, Mus musculus
tctacagaatcccaagatcagaaac

SEQ ID NO: 6789 - DNA, 25 bp, Mus musculus
acagaatcccaagatcagaaactct

SEQ ID NO: 6790 - DNA, 25 bp, Mus musculus
gaatcccaagatcagaaactctgaa

SEQ ID NO: 6791 - DNA, 25 bp, Mus musculus
tcccaagatcagaaactctgaagat

SEQ ID NO: 6792 - DNA, 25 bp, Mus musculus
aaactctgaagattctcaatggaaa

SEQ ID NO: 6793 - DNA, 25 bp, Mus musculus
actctgaagattctcaatggaaaga

SEQ ID NO: 6794 - DNA, 25 bp, Mus musculus
gaattgacttctacactccattacc

SEQ ID NO: 6795 - DNA, 25 bp, Mus musculus
ttgacttctacactccattacccgt

SEQ ID NO: 6796 - DNA, 25 bp, Mus musculus
acttctacactccattacccgtgct

SEQ ID NO: 6797 - DNA, 25 bp, Mus musculus
tgtgactgttccgtggcacatggac

SEQ ID NO: 6798 - DNA, 25 bp, Mus musculus
gactgttccgtggcacatggaccct

SEQ ID NO: 6799 - DNA, 25 bp, Mus musculus
tgttccgtggcacatggaccctgta

SEQ ID NO: 6800 - DNA, 25 bp, Mus musculus
gtggcacatggaccctgtagagaag

SEQ ID NO: 6801 - DNA, 25 bp, Mus musculus
ggcccttcgagatgccaactagaca

SEQ ID NO: 6802 - DNA, 25 bp, Mus musculus
acctgaaacacatcaccaagttgaa

SEQ ID NO: 6803 - DNA, 25 bp, Mus musculus
aacacatcaccaagttgaagccttg

SEQ ID NO: 6804 - DNA, 25 bp, Mus musculus
tgcccatgttggagctcatgcctga

SEQ ID NO: 6805 - DNA, 25 bp, Mus musculus
tggagctcatgcctgagaagagagc

SEQ ID NO: 6806 - DNA, 25 bp, Mus musculus
agctcatgcctgagaagagagccac

SEQ ID NO: 6807 - DNA, 25 bp, Mus musculus
ccactgccgctgagtgtctccggca

SEQ ID NO: 6808 - DNA, 25 bp, Mus musculus
ccgctgagtgtctccggcatccttg

SEQ ID NO: 6809 - DNA, 25 bp, Mus musculus
agtgtctccggcatccttggctgaa

SEQ ID NO: 6810 - DNA, 25 bp, Mus musculus
gtctccggcatccttggctgaatcc

SEQ ID NO: 6811 - DNA, 25 bp, Mus musculus
tccggcatccttggctgaatcctaa

SEQ ID NO: 6812 - DNA, 25 bp, Mus musculus
atccttggctgaatcctaagccagc

SEQ ID NO: 6813 - DNA, 25 bp, Mus musculus
ggctgaatcctaagccagccctgcc

SEQ ID NO: 6814 - DNA, 25 bp, Mus musculus
acatcaccaagttgaagccttgggg

SEQ ID NO: 6815 - DNA, 25 bp, Mus musculus
tcaccaagttgaagccttggggtct

SEQ ID NO: 6816 - DNA, 25 bp, Mus musculus
tgaagccttggggtcttctggaggt

SEQ ID NO: 6817 - DNA, 25 bp, Mus musculus
gtcttctggaggttctggtggagaa

SEQ ID NO: 6818 - DNA, 25 bp, Mus musculus
ttctggaggttctggtggagaagta

SEQ ID NO: 6819 - DNA, 25 bp, Mus musculus
tcacagatttcctgctgcccatgtt

SEQ ID NO: 6820 - DNA, 25 bp, Mus musculus
cagatttcctgctgcccatgttgga

SEQ ID NO: 6821 - DNA, 25 bp, Mus musculus
tgctgcccatgttggagctcatgcc

SEQ ID NO: 6822 - DNA, 25 bp, Mus musculus
catcctcagagtaccatatagcaag

SEQ ID NO: 6823 - DNA, 25 bp, Mus musculus
aagatgctggattctactggtgtga

SEQ ID NO: 6824 - DNA, 25 bp, Mus musculus
tgaacacggttctctatgtgaaaat

SEQ ID NO: 6825 - DNA, 25 bp, Mus musculus
tgaaaatacacaggctgcagagaga

SEQ ID NO: 6826 - DNA, 25 bp, Mus musculus
aagcaaattcctttcagcaagttag

SEQ ID NO: 6827 - DNA, 25 bp, Mus musculus
attcctttcagcaagttagaagcga

SEQ ID NO: 6828 - DNA, 25 bp, Mus musculus
taacagccactgcgagccagaccac

SEQ ID NO: 6829 - DNA, 25 bp, Mus musculus
cgcccgatggacctcgaagctcagt

SEQ ID NO: 6830 - DNA, 25 bp, Mus musculus
atggacctcgaagctcagtgggtga

SEQ ID NO: 6831 - DNA, 25 bp, Mus musculus
cccttcctcccagtgacagtactgg

SEQ ID NO: 6832 - DNA, 25 bp, Mus musculus
gttgaccctgaaactgtgggaccat

SEQ ID NO: 6833 - DNA, 25 bp, Mus musculus
ggaccatggcatgcaactcttaaat

SEQ ID NO: 6834 - DNA, 25 bp, Mus musculus
ctggattctactggtgtgaggtagc

SEQ ID NO: 6835 - DNA, 25 bp, Mus musculus
aggtagccacggaggacagcagtgt

SEQ ID NO: 6836 - DNA, 25 bp, Mus musculus
gcagtgtccttaagcgcagccctga

SEQ ID NO: 6837 - DNA, 25 bp, Mus musculus
agttggagctccaagtgcttggtcc

SEQ ID NO: 6838 - DNA, 25 bp, Mus musculus
agctccaagtgcttggtccccagtc

SEQ ID NO: 6839 - DNA, 25 bp, Mus musculus
ttcacatcctgttttatctgtcagt

SEQ ID NO: 6840 - DNA, 25 bp, Mus musculus
tttatctgtcagtgggaataatgtt

SEQ ID NO: 6841 - DNA, 25 bp, Mus musculus
tttcgttgaacacggttctctatgt

SEQ ID NO: 6842 - DNA, 25 bp, Mus musculus
gcgcggcaacgacttccagtggtgc

SEQ ID NO: 6843 - DNA, 25 bp, Mus musculus
caacgacttccagtggtgcttctcg

SEQ ID NO: 6844 - DNA, 25 bp, Mus musculus
tttaactactctggagaccttcttg

SEQ ID NO: 6845 - DNA, 25 bp, Mus musculus
aactactctggagaccttcttgcaa

SEQ ID NO: 6846 - DNA, 25 bp, Mus musculus
tactctggagaccttcttgcaacag

SEQ ID NO: 6847 - DNA, 25 bp, Mus musculus
ggagaccttcttgcaacaggagaca

SEQ ID NO: 6848 - DNA, 25 bp, Mus musculus
gaccttcttgcaacaggagacaaag

SEQ ID NO: 6849 - DNA, 25 bp, Mus musculus
cttcttgcaacaggagacaaaggtg

SEQ ID NO: 6850 - DNA, 25 bp, Mus musculus
aaaggccgcgctcactctaggggag

SEQ ID NO: 6851 - DNA, 25 bp, Mus musculus
gtttacagtacctttcagagtcatg

SEQ ID NO: 6852 - DNA, 25 bp, Mus musculus
agtacctttcagagtcatgagccag

SEQ ID NO: 6853 - DNA, 25 bp, Mus musculus
acctttcagagtcatgagccagagt

SEQ ID NO: 6854 - DNA, 25 bp, Mus musculus
cttccagtggtgcttctcgcaggtc

SEQ ID NO: 6855 - DNA, 25 bp, Mus musculus
tttcagagtcatgagccagagtttg

SEQ ID NO: 6856 - DNA, 25 bp, Mus musculus
gtgcttctcgcaggtcaagggcgct

SEQ ID NO: 6857 - DNA, 25 bp, Mus musculus
cttctcgcaggtcaagggcgctgtc

SEQ ID NO: 6858 - DNA, 25 bp, Mus musculus
ctcgcaggtcaagggcgctgtcgac

SEQ ID NO: 6859 - DNA, 25 bp, Mus musculus
acgacattcatatctatcgttgagt

SEQ ID NO: 6860 - DNA, 25 bp, Mus musculus
acattcatatctatcgttgagttta

SEQ ID NO: 6861 - DNA, 25 bp, Mus musculus
ttcatatctatcgttgagtttaact

SEQ ID NO: 6862 - DNA, 25 bp, Mus musculus
atatctatcgttgagtttaactact

SEQ ID NO: 6863 - DNA, 25 bp, Mus musculus
tgaaatcctcctgtaacagacctca

SEQ ID NO: 6864 - DNA, 25 bp, Mus musculus
gtaacagacctcaagaaggagacag

SEQ ID NO: 6865 - DNA, 25 bp, Mus musculus
tgtacttgggagccctttcatcatg

SEQ ID NO: 6866 - DNA, 25 bp, Mus musculus
tgggagccctttcatcatgatctta

SEQ ID NO: 6867 - DNA, 25 bp, Mus musculus
catcatgatcttaatctgtactgtt

SEQ ID NO: 6868 - DNA, 25 bp, Mus musculus
aaagctgtctgggtattcttacatc

SEQ ID NO: 6869 - DNA, 25 bp, Mus musculus
ttacatcattcagtctcacctgtaa

SEQ ID NO: 6870 - DNA, 25 bp, Mus musculus
cattcagtctcacctgtaactaaca

SEQ ID NO: 6871 - DNA, 25 bp, Mus musculus
gcttaactgtgacaaccacatcact

SEQ ID NO: 6872 - DNA, 25 bp, Mus musculus
ctgtgacaaccacatcactgttacc

SEQ ID NO: 6873 - DNA, 25 bp, Mus musculus
caaccacatcactgttacctgaagt

SEQ ID NO: 6874 - DNA, 25 bp, Mus musculus
accacagtatcatgtaactatcaac

SEQ ID NO: 6875 - DNA, 25 bp, Mus musculus
taaatcctctgagcttgacaggcat

SEQ ID NO: 6876 - DNA, 25 bp, Mus musculus
gcttgacaggcatcctcacagcagg

SEQ ID NO: 6877 - DNA, 25 bp, Mus musculus
caggcatcctcacagcaggattttc

SEQ ID NO: 6878 - DNA, 25 bp, Mus musculus
atagtttcctctagagcaccatgct

SEQ ID NO: 6879 - DNA, 25 bp, Mus musculus
tcctctagagcaccatgctacagac

SEQ ID NO: 6880 - DNA, 25 bp, Mus musculus
tccacagccacgaagctctctgtac

SEQ ID NO: 6881 - DNA, 25 bp, Mus musculus
gccacgaagctctctgtacattcct

SEQ ID NO: 6882 - DNA, 25 bp, Mus musculus
tctgtacattcctgtacttgggagc

SEQ ID NO: 6883 - DNA, 25 bp, Mus musculus
aggccgagctgcaggacatctgcag

SEQ ID NO: 6884 - DNA, 25 bp, Mus musculus
acatctgcagtgacgttctggaact

SEQ ID NO: 6885 - DNA, 25 bp, Mus musculus
cttctgaagttgcatctggagataa

SEQ ID NO: 6886 - DNA, 25 bp, Mus musculus
tgtcaaactcccagcaggcgtacca

SEQ ID NO: 6887 - DNA, 25 bp, Mus musculus
caaactcccagcaggcgtaccaaga

SEQ ID NO: 6888 - DNA, 25 bp, Mus musculus
actcccagcaggcgtaccaagaagc

SEQ ID NO: 6889 - DNA, 25 bp, Mus musculus
gcctggctctgaatttctcagtctt

SEQ ID NO: 6890 - DNA, 25 bp, Mus musculus
tggctctgaatttctcagtctttta

SEQ ID NO: 6891 - DNA, 25 bp, Mus musculus
ctctgaatttctcagtcttttacta

SEQ ID NO: 6892 - DNA, 25 bp, Mus musculus
tgaatttctcagtcttttactatga

SEQ ID NO: 6893 - DNA, 25 bp, Mus musculus
atttctcagtcttttactatgagat

SEQ ID NO: 6894 - DNA, 25 bp, Mus musculus
tctcagtcttttactatgagattct

SEQ ID NO: 6895 - DNA, 25 bp, Mus musculus
tctgcagtgacgttctggaactgtt

SEQ ID NO: 6896 - DNA, 25 bp, Mus musculus
tactcattctcaatgctaaccatgc

SEQ ID NO: 6897 - DNA, 25 bp, Mus musculus
tcattctcaatgctaaccatgcaga

SEQ ID NO: 6898 - DNA, 25 bp, Mus musculus
tcaatgctaaccatgcagaaagcaa

SEQ ID NO: 6899 - DNA, 25 bp, Mus musculus
atgctaaccatgcagaaagcaaagt

SEQ ID NO: 6900 - DNA, 25 bp, Mus musculus
ctaaccatgcagaaagcaaagtgtt

SEQ ID NO: 6901 - DNA, 25 bp, Mus musculus
ggtatccttctgaagttgcatctgg

SEQ ID NO: 6902 - DNA, 25 bp, Mus musculus
atccttctgaagttgcatctggaga

SEQ ID NO: 6903 - DNA, 25 bp, Mus musculus
cattcccatcagcttgcgtgtgaac

SEQ ID NO: 6904 - DNA, 25 bp, Mus musculus
ttcccatcagcttgcgtgtgaactt

SEQ ID NO: 6905 - DNA, 25 bp, Mus musculus
ccagcacaatccccgagcagctggg

SEQ ID NO: 6906 - DNA, 25 bp, Mus musculus
cacaatccccgagcagctgggcagg

SEQ ID NO: 6907 - DNA, 25 bp, Mus musculus
caatccccgagcagctgggcaggat

SEQ ID NO: 6908 - DNA, 25 bp, Mus musculus
atccccgagcagctgggcaggatct

SEQ ID NO: 6909 - DNA, 25 bp, Mus musculus
gcaggatctcctacttgctcacaga

SEQ ID NO: 6910 - DNA, 25 bp, Mus musculus
aggatctcctacttgctcacagata

SEQ ID NO: 6911 - DNA, 25 bp, Mus musculus
gatctcctacttgctcacagataag

SEQ ID NO: 6912 - DNA, 25 bp, Mus musculus
tcctacttgctcacagataagacag

SEQ ID NO: 6913 - DNA, 25 bp, Mus musculus
ctacttgctcacagataagacaggg

SEQ ID NO: 6914 - DNA, 25 bp, Mus musculus
acttgctcacagataagacagggac

SEQ ID NO: 6915 - DNA, 25 bp, Mus musculus
cccatcagcttgcgtgtgaacttgg

SEQ ID NO: 6916 - DNA, 25 bp, Mus musculus
cttgctcacagataagacagggacc

SEQ ID NO: 6917 - DNA, 25 bp, Mus musculus
caagatcgtgtacagctgggtgatt

SEQ ID NO: 6918 - DNA, 25 bp, Mus musculus
agatcgtgtacagctgggtgattcg

SEQ ID NO: 6919 - DNA, 25 bp, Mus musculus
tgtacagctgggtgattcgcaggga

SEQ ID NO: 6920 - DNA, 25 bp, Mus musculus
tacagctgggtgattcgcagggatt

SEQ ID NO: 6921 - DNA, 25 bp, Mus musculus
cagctgggtgattcgcagggattcc

SEQ ID NO: 6922 - DNA, 25 bp, Mus musculus
tgattcgcagggattccaaaatccc

SEQ ID NO: 6923 - DNA, 25 bp, Mus musculus
gtggtccgttccagcacaatccccg

SEQ ID NO: 6924 - DNA, 25 bp, Mus musculus
atgagcccttggcagatgtccaggc

SEQ ID NO: 6925 - DNA, 25 bp, Mus musculus
cagatgtccaggccgtctgctccca

SEQ ID NO: 6926 - DNA, 25 bp, Mus musculus
ctcaataccagaagcacatcattgt

SEQ ID NO: 6927 - DNA, 25 bp, Mus musculus
accagaagcacatcattgtggcctg

SEQ ID NO: 6928 - DNA, 25 bp, Mus musculus
agcacatcattgtggcctgtgaagg

SEQ ID NO: 6929 - DNA, 25 bp, Mus musculus
tccactttgatgctactgtgtaggg

SEQ ID NO: 6930 - DNA, 25 bp, Mus musculus
ttgatgctactgtgtagggctccac

SEQ ID NO: 6931 - DNA, 25 bp, Mus musculus
cataggccaaaccagtgagatgtct

SEQ ID NO: 6932 - DNA, 25 bp, Mus musculus
gttcctgtcctgtgtcatgctccca

SEQ ID NO: 6933 - DNA, 25 bp, Mus musculus
gtcctgtgtcatgctcccagatccc

SEQ ID NO: 6934 - DNA, 25 bp, Mus musculus
tgtcatgctcccagatccctctctt

SEQ ID NO: 6935 - DNA, 25 bp, Mus musculus
gctcccagatccctctcttgctgta

SEQ ID NO: 6936 - DNA, 25 bp, Mus musculus
atgtcacctgcaagaacaggaagag

SEQ ID NO: 6937 - DNA, 25 bp, Mus musculus
gctacaagagcagctctgccctgca

SEQ ID NO: 6938 - DNA, 25 bp, Mus musculus
agagcagctctgccctgcacatcac

SEQ ID NO: 6939 - DNA, 25 bp, Mus musculus
acatcactgactgccacctgaaggg

SEQ ID NO: 6940 - DNA, 25 bp, Mus musculus
ctgactgccacctgaagggcaactc

SEQ ID NO: 6941 - DNA, 25 bp, Mus musculus
gcaactccaagtatcccaactgtga

SEQ ID NO: 6942 - DNA, 25 bp, Mus musculus
actgtgactacaagaccactcaata

SEQ ID NO: 6943 - DNA, 25 bp, Mus musculus
agaccactcaataccagaagcacat

SEQ ID NO: 6944 - DNA, 25 bp, Mus musculus
taaaccgttggcttcaatgggtgtg

SEQ ID NO: 6945 - DNA, 25 bp, Mus musculus
tggcttcaatgggtgtgtgattcca

SEQ ID NO: 6946 - DNA, 25 bp, Mus musculus
gcctgatggccagttgccgagcgaa

SEQ ID NO: 6947 - DNA, 25 bp, Mus musculus
ctgatggccagttgccgagcgaaaa

SEQ ID NO: 6948 - DNA, 25 bp, Mus musculus
tggccagttgccgagcgaaaagatc

SEQ ID NO: 6949 - DNA, 25 bp, Mus musculus
gccagttgccgagcgaaaagatcat

SEQ ID NO: 6950 - DNA, 25 bp, Mus musculus
agtagagatcgcacccactatttat

SEQ ID NO: 6951 - DNA, 25 bp, Mus musculus
tagagatcgcacccactatttattg

SEQ ID NO: 6952 - DNA, 25 bp, Mus musculus
gagatcgcacccactatttattgat

SEQ ID NO: 6953 - DNA, 25 bp, Mus musculus
tcgcacccactatttattgatgaag

SEQ ID NO: 6954 - DNA, 25 bp, Mus musculus
gcacccactatttattgatgaagtt

SEQ ID NO: 6955 - DNA, 25 bp, Mus musculus
acccactatttattgatgaagttcg

SEQ ID NO: 6956 - DNA, 25 bp, Mus musculus
gtgattccatatccagttcgccagg

SEQ ID NO: 6957 - DNA, 25 bp, Mus musculus
gattccatatccagttcgccagggt

SEQ ID NO: 6958 - DNA, 25 bp, Mus musculus
ttccatatccagttcgccagggttg

SEQ ID NO: 6959 - DNA, 25 bp, Mus musculus
ccatatccagttcgccagggttggt

SEQ ID NO: 6960 - DNA, 25 bp, Mus musculus
atccagttcgccagggttggtgtca

SEQ ID NO: 6961 - DNA, 25 bp, Mus musculus
ccagttcgccagggttggtgtcaat

SEQ ID NO: 6962 - DNA, 25 bp, Mus musculus
agttcgccagggttggtgtcaatat

SEQ ID NO: 6963 - DNA, 25 bp, Mus musculus
ttcgccagggttggtgtcaatatgg

SEQ ID NO: 6964 - DNA, 25 bp, Mus musculus
ctgagtctgcagtcctcgaggagat

SEQ ID NO: 6965 - DNA, 25 bp, Mus musculus
agtctgcagtcctcgaggagatccc

SEQ ID NO: 6966 - DNA, 25 bp, Mus musculus
tacagaagatctgggcccgagagat

SEQ ID NO: 6967 - DNA, 25 bp, Mus musculus
agatctgggcccgagagatcttgga

SEQ ID NO: 6968 - DNA, 25 bp, Mus musculus
tctgggcccgagagatcttggactc

SEQ ID NO: 6969 - DNA, 25 bp, Mus musculus
aggtggatctccatactgccaaagg

SEQ ID NO: 6970 - DNA, 25 bp, Mus musculus
tggatctccatactgccaaaggtct

SEQ ID NO: 6971 - DNA, 25 bp, Mus musculus
atctccatactgccaaaggtctttt

SEQ ID NO: 6972 - DNA, 25 bp, Mus musculus
tccatactgccaaaggtcttttccg

SEQ ID NO: 6973 - DNA, 25 bp, Mus musculus
gtcttttccgggctgcagtccccag

SEQ ID NO: 6974 - DNA, 25 bp, Mus musculus
tccccagtgggccgtccactggcat

SEQ ID NO: 6975 - DNA, 25 bp, Mus musculus
ggccgtccactggcatctatgaggc

SEQ ID NO: 6976 - DNA, 25 bp, Mus musculus
ctgcagtcctcgaggagatcccagc

SEQ ID NO: 6977 - DNA, 25 bp, Mus musculus
gcatctatgaggccctggagctaag

SEQ ID NO: 6978 - DNA, 25 bp, Mus musculus
cagtcctcgaggagatcccagccat

SEQ ID NO: 6979 - DNA, 25 bp, Mus musculus
tcctcgaggagatcccagccatcat

SEQ ID NO: 6980 - DNA, 25 bp, Mus musculus
aggagatcccagccatcatgtctat

SEQ ID NO: 6981 - DNA, 25 bp, Mus musculus
agatcccagccatcatgtctataca

SEQ ID NO: 6982 - DNA, 25 bp, Mus musculus
tcccagccatcatgtctatacagaa

SEQ ID NO: 6983 - DNA, 25 bp, Mus musculus
cagccatcatgtctatacagaagat

SEQ ID NO: 6984 - DNA, 25 bp, Mus musculus
ccatcatgtctatacagaagatctg

SEQ ID NO: 6985 - DNA, 25 bp, Mus musculus
cctgcactcgtgtcccaaaacgatg

SEQ ID NO: 6986 - DNA, 25 bp, Mus musculus
tcccaaaacgatggtctttatcatc

SEQ ID NO: 6987 - DNA, 25 bp, Mus musculus
acctgggacagcgagtctggcttgt

SEQ ID NO: 6988 - DNA, 25 bp, Mus musculus
gagtctggcttgtgttgggcagcct

SEQ ID NO: 6989 - DNA, 25 bp, Mus musculus
ggcttgtgttgggcagccttcctac

SEQ ID NO: 6990 - DNA, 25 bp, Mus musculus
accagtgcctttctaagagagatat

SEQ ID NO: 6991 - DNA, 25 bp, Mus musculus
gtacacagaagccattccgagcctg

SEQ ID NO: 6992 - DNA, 25 bp, Mus musculus
agaagccattccgagcctgggacct

SEQ ID NO: 6993 - DNA, 25 bp, Mus musculus
ggcctctaagccaccctgagatctc

SEQ ID NO: 6994 - DNA, 25 bp, Mus musculus
taagccaccctgagatctctgcagc

SEQ ID NO: 6995 - DNA, 25 bp, Mus musculus
agatctctgcagctggagtcttctg

SEQ ID NO: 6996 - DNA, 25 bp, Mus musculus
ctggagtcttctgggtcagtggcaa

SEQ ID NO: 6997 - DNA, 25 bp, Mus musculus
gctcttggcctagaagctgtcagat

SEQ ID NO: 6998 - DNA, 25 bp, Mus musculus
tgcaccagccctgaagaggatcgtt

SEQ ID NO: 6999 - DNA, 25 bp, Mus musculus
tgtccttctgctgactgcctgctcg

SEQ ID NO: 7000 - DNA, 25 bp, Mus musculus
tctgctgactgcctgctcgtctggg

SEQ ID NO: 7001 - DNA, 25 bp, Mus musculus
gggcctcagagaccagcctgaggaa

SEQ ID NO: 7002 - DNA, 25 bp, Mus musculus
cagagaccagcctgaggaagcagaa

SEQ ID NO: 7003 - DNA, 25 bp, Mus musculus
agcagaactcagacctgggacagcg

SEQ ID NO: 7004 - DNA, 25 bp, Mus musculus
actcagacctgggacagcgagtctg

SEQ ID NO: 7005 - DNA, 25 bp, Mus musculus
tccaatccagttcactctgaacaag

SEQ ID NO: 7006 - DNA, 25 bp, Mus musculus
gaacacagcagccatggtgtgctct

SEQ ID NO: 7007 - DNA, 25 bp, Mus musculus
aaagccagctttgatattaggaatc

SEQ ID NO: 7008 - DNA, 25 bp, Mus musculus
aatactaaagagccttcctgcaaat

SEQ ID NO: 7009 - DNA, 25 bp, Mus musculus
ccttcctgcaaatagtgaggagact

SEQ ID NO: 7010 - DNA, 25 bp, Mus musculus
agtctcgtctctccagctttccctg

SEQ ID NO: 7011 - DNA, 25 bp, Mus musculus
ttccctgcctggccattctcagttt

SEQ ID NO: 7012 - DNA, 25 bp, Mus musculus
gcctggccattctcagtttgggcaa

SEQ ID NO: 7013 - DNA, 25 bp, Mus musculus
ccattctcagtttgggcaaagagat

SEQ ID NO: 7014 - DNA, 25 bp, Mus musculus
caagcaattactcatcagctaaaga

SEQ ID NO: 7015 - DNA, 25 bp, Mus musculus
attactcatcagctaaagacctttg

SEQ ID NO: 7016 - DNA, 25 bp, Mus musculus
gtctagacaaacttctataagtcat

SEQ ID NO: 7017 - DNA, 25 bp, Mus musculus
agcagccatggtgtgctctttggag

SEQ ID NO: 7018 - DNA, 25 bp, Mus musculus
catggtgtgctctttggagaacaga

SEQ ID NO: 7019 - DNA, 25 bp, Mus musculus
ttatcagcagctctgcttggacgtg

SEQ ID NO: 7020 - DNA, 25 bp, Mus musculus
gcagctctgcttggacgtgcctgcc

SEQ ID NO: 7021 - DNA, 25 bp, Mus musculus
agggagccacgacttacagtactgt

SEQ ID NO: 7022 - DNA, 25 bp, Mus musculus
cttacagtactgtttctacacagtg

SEQ ID NO: 7023 - DNA, 25 bp, Mus musculus
gtactgtttctacacagtgtaaata

SEQ ID NO: 7024 - DNA, 25 bp, Mus musculus
tttctacacagtgtaaatatcattt

SEQ ID NO: 7025 - DNA, 25 bp, Mus musculus
gtgcaccggattccagctgttttcg

SEQ ID NO: 7026 - DNA, 25 bp, Mus musculus
gcaccggattccagctgttttcgcc

SEQ ID NO: 7027 - DNA, 25 bp, Mus musculus
acccgcgtcctggccagcaaagctg

SEQ ID NO: 7028 - DNA, 25 bp, Mus musculus
ccgcgtcctggccagcaaagctgcg

SEQ ID NO: 7029 - DNA, 25 bp, Mus musculus
tggccagcaaagctgcgaggagaat

SEQ ID NO: 7030 - DNA, 25 bp, Mus musculus
gccagcaaagctgcgaggagaatct

SEQ ID NO: 7031 - DNA, 25 bp, Mus musculus
aatcttccaggactccgccgagctg

SEQ ID NO: 7032 - DNA, 25 bp, Mus musculus
gcgcctactaaccccagcgttgagg

SEQ ID NO: 7033 - DNA, 25 bp, Mus musculus
gcctactaaccccagcgttgaggat

SEQ ID NO: 7034 - DNA, 25 bp, Mus musculus
ctactaaccccagcgttgaggatga

SEQ ID NO: 7035 - DNA, 25 bp, Mus musculus
actaaccccagcgttgaggatgagc

SEQ ID NO: 7036 - DNA, 25 bp, Mus musculus
accccagcgttgaggatgagccgtt

SEQ ID NO: 7037 - DNA, 25 bp, Mus musculus
ttccagctgttttcgcctgctcctc

SEQ ID NO: 7038 - DNA, 25 bp, Mus musculus
catcgctgaccagcagcagctgcag

SEQ ID NO: 7039 - DNA, 25 bp, Mus musculus
gctgaccagcagcagctgcagttgt

SEQ ID NO: 7040 - DNA, 25 bp, Mus musculus
tgaccagcagcagctgcagttgtcg

SEQ ID NO: 7041 - DNA, 25 bp, Mus musculus
gaagcgactcaccctggctgacaag

SEQ ID NO: 7042 - DNA, 25 bp, Mus musculus
agcgactcaccctggctgacaagga

SEQ ID NO: 7043 - DNA, 25 bp, Mus musculus
tcaccctggctgacaaggagaacac

SEQ ID NO: 7044 - DNA, 25 bp, Mus musculus
accctggctgacaaggagaacacgc

SEQ ID NO: 7045 - DNA, 25 bp, Mus musculus
gctgcctcaccttatcgatgtagcc

SEQ ID NO: 7046 - DNA, 25 bp, Mus musculus
gcctcaccttatcgatgtagcccgc

SEQ ID NO: 7047 - DNA, 25 bp, Mus musculus
ttgagcgcctgcagctgctccttct

SEQ ID NO: 7048 - DNA, 25 bp, Mus musculus
gcagccctctgcgcattgcttaggg

SEQ ID NO: 7049 - DNA, 25 bp, Mus musculus
gccctctgcgcattgcttagggtgt

SEQ ID NO: 7050 - DNA, 25 bp, Mus musculus
ctctgcgcattgcttagggtgtcta

SEQ ID NO: 7051 - DNA, 25 bp, Mus musculus
tgcgcattgcttagggtgtctagcg

SEQ ID NO: 7052 - DNA, 25 bp, Mus musculus
gcattgcttagggtgtctagcgagt

SEQ ID NO: 7053 - DNA, 25 bp, Mus musculus
ttgcttagggtgtctagcgagtcgg

SEQ ID NO: 7054 - DNA, 25 bp, Mus musculus
ggacacggatctcatcgacgtccgc

SEQ ID NO: 7055 - DNA, 25 bp, Mus musculus
ggatctcatcgacgtccgcgctcac

SEQ ID NO: 7056 - DNA, 25 bp, Mus musculus
catcgacgtccgcgctcacgaatgg

SEQ ID NO: 7057 - DNA, 25 bp, Mus musculus
tcaccttatcgatgtagcccgcgaa

SEQ ID NO: 7058 - DNA, 25 bp, Mus musculus
cgtccgcgctcacgaatggaagtcg

SEQ ID NO: 7059 - DNA, 25 bp, Mus musculus
tatcgatgtagcccgcgaacgtcgt

SEQ ID NO: 7060 - DNA, 25 bp, Mus musculus
cgatgtagcccgcgaacgtcgttga

SEQ ID NO: 7061 - DNA, 25 bp, Mus musculus
tgtagcccgcgaacgtcgttgagcg

SEQ ID NO: 7062 - DNA, 25 bp, Mus musculus
agcccgcgaacgtcgttgagcgcct

SEQ ID NO: 7063 - DNA, 25 bp, Mus musculus
ccgcgaacgtcgttgagcgcctgca

SEQ ID NO: 7064 - DNA, 25 bp, Mus musculus
cgaacgtcgttgagcgcctgcagct

SEQ ID NO: 7065 - DNA, 25 bp, Mus musculus
acgtcgttgagcgcctgcagctgct

SEQ ID NO: 7066 - DNA, 25 bp, Mus musculus
cggagcagctatccgcttccatccg

SEQ ID NO: 7067 - DNA, 25 bp, Mus musculus
ggagcagctatccgcttccatccga

SEQ ID NO: 7068 - DNA, 25 bp, Mus musculus
aaaccctgccggagccgatgaagct

SEQ ID NO: 7069 - DNA, 25 bp, Mus musculus
aaccctgccggagccgatgaagcta

SEQ ID NO: 7070 - DNA, 25 bp, Mus musculus
accctgccggagccgatgaagctat

SEQ ID NO: 7071 - DNA, 25 bp, Mus musculus
ccctgccggagccgatgaagctatg

SEQ ID NO: 7072 - DNA, 25 bp, Mus musculus
ctgccggagccgatgaagctatgga

SEQ ID NO: 7073 - DNA, 25 bp, Mus musculus
tgccggagccgatgaagctatggat

SEQ ID NO: 7074 - DNA, 25 bp, Mus musculus
tgtaccagacgaactggaaaaagca

SEQ ID NO: 7075 - DNA, 25 bp, Mus musculus
agagcgaaaccttatgtctgatgca

SEQ ID NO: 7076 - DNA, 25 bp, Mus musculus
agcgaaaccttatgtctgatgcata

SEQ ID NO: 7077 - DNA, 25 bp, Mus musculus
gcgaaaccttatgtctgatgcatat

SEQ ID NO: 7078 - DNA, 25 bp, Mus musculus
gagcagctatccgcttccatccgac

SEQ ID NO: 7079 - DNA, 25 bp, Mus musculus
agcagctatccgcttccatccgacg

SEQ ID NO: 7080 - DNA, 25 bp, Mus musculus
gcagctatccgcttccatccgacgt

SEQ ID NO: 7081 - DNA, 25 bp, Mus musculus
tatccgcttccatccgacgtgcaaa

SEQ ID NO: 7082 - DNA, 25 bp, Mus musculus
atccgcttccatccgacgtgcaaac

SEQ ID NO: 7083 - DNA, 25 bp, Mus musculus
gcttccatccgacgtgcaaaccctg

SEQ ID NO: 7084 - DNA, 25 bp, Mus musculus
tgcaaaccctgccggagccgatgaa

SEQ ID NO: 7085 - DNA, 25 bp, Mus musculus
caaaccctgccggagccgatgaagc

SEQ ID NO: 7086 - DNA, 25 bp, Mus musculus
gaacacctgcagggtttatcaggca

SEQ ID NO: 7087 - DNA, 25 bp, Mus musculus
ggtttatcaggcacactgggaagta

SEQ ID NO: 7088 - DNA, 25 bp, Mus musculus
tatctttttcctggtgggctgaaag

SEQ ID NO: 7089 - DNA, 25 bp, Mus musculus
tttcctggtgggctgaaagacatac

SEQ ID NO: 7090 - DNA, 25 bp, Mus musculus
gcccacaagccagcacctgaggagg

SEQ ID NO: 7091 - DNA, 25 bp, Mus musculus
aagccagcacctgaggaggccccac

SEQ ID NO: 7092 - DNA, 25 bp, Mus musculus
cctcccaaggaagttctagctgagg

SEQ ID NO: 7093 - DNA, 25 bp, Mus musculus
acaattcgttactcagactcaggga

SEQ ID NO: 7094 - DNA, 25 bp, Mus musculus
agtccaggtgtcctggaacccagct

SEQ ID NO: 7095 - DNA, 25 bp, Mus musculus
aaccaccaaggttgagaacagatga

SEQ ID NO: 7096 - DNA, 25 bp, Mus musculus
atgtttctagcatccagattctaca

SEQ ID NO: 7097 - DNA, 25 bp, Mus musculus
ctagcatccagattctacaataaag

SEQ ID NO: 7098 - DNA, 25 bp, Mus musculus
tcaggcacactgggaagtattctgg

SEQ ID NO: 7099 - DNA, 25 bp, Mus musculus
gctgtcaccttattgctgcagattc

SEQ ID NO: 7100 - DNA, 25 bp, Mus musculus
accttattgctgcagattctagtgc

SEQ ID NO: 7101 - DNA, 25 bp, Mus musculus
cagattctagtgctccttggtttgc

SEQ ID NO: 7102 - DNA, 25 bp, Mus musculus
ctagtgctccttggtttgcggtatt

SEQ ID NO: 7103 - DNA, 25 bp, Mus musculus
ctccttggtttgcggtatttgcaga

SEQ ID NO: 7104 - DNA, 25 bp, Mus musculus
ttgcagacagcgctggagggccttg

SEQ ID NO: 7105 - DNA, 25 bp, Mus musculus
gaggcccagggctatctttttcctg

SEQ ID NO: 7106 - DNA, 25 bp, Mus musculus
ctatacagtcgggaaacgcttcaag

SEQ ID NO: 7107 - DNA, 25 bp, Mus musculus
cttcctgtggcccttcaagttatct

SEQ ID NO: 7108 - DNA, 25 bp, Mus musculus
tgacggcttttctgttgagtgcgga

SEQ ID NO: 7109 - DNA, 25 bp, Mus musculus
cggcttttctgttgagtgcggattg

SEQ ID NO: 7110 - DNA, 25 bp, Mus musculus
ttctgttgagtgcggattgggtata

SEQ ID NO: 7111 - DNA, 25 bp, Mus musculus
ctgtataactcaaatccgcctcgcc

SEQ ID NO: 7112 - DNA, 25 bp, Mus musculus
gtgctgatgtgcggcttggaagaca

SEQ ID NO: 7113 - DNA, 25 bp, Mus musculus
gaagacagtctctaactcgtgtgtt

SEQ ID NO: 7114 - DNA, 25 bp, Mus musculus
tgtttttcctttcagtgtcacccat

SEQ ID NO: 7115 - DNA, 25 bp, Mus musculus
tcctttcagtgtcacccattgtatt

SEQ ID NO: 7116 - DNA, 25 bp, Mus musculus
cagtgtcacccattgtatttttgta

SEQ ID NO: 7117 - DNA, 25 bp, Mus musculus
tgtcacccattgtatttttgtaatc

SEQ ID NO: 7118 - DNA, 25 bp, Mus musculus
agaatctatttctggcaatcgcaaa

SEQ ID NO: 7119 - DNA, 25 bp, Mus musculus
atctatttctggcaatcgcaaaact

SEQ ID NO: 7120 - DNA, 25 bp, Mus musculus
tatttctggcaatcgcaaaactatg

SEQ ID NO: 7121 - DNA, 25 bp, Mus musculus
ttctggcaatcgcaaaactatgtgt

SEQ ID NO: 7122 - DNA, 25 bp, Mus musculus
gtgtagactcacctagttttgaatt

SEQ ID NO: 7123 - DNA, 25 bp, Mus musculus
tagactcacctagttttgaattcaa

SEQ ID NO: 7124 - DNA, 25 bp, Mus musculus
cttgattgacggcttttctgttgag

SEQ ID NO: 7125 - DNA, 25 bp, Mus musculus
gattgacggcttttctgttgagtgc

SEQ ID NO: 7126 - DNA, 25 bp, Mus musculus
cctggtgttgcctatctatgaaggc

SEQ ID NO: 7127 - DNA, 25 bp, Mus musculus
gttgcctatctatgaaggcatccca

SEQ ID NO: 7128 - DNA, 25 bp, Mus musculus
tgttgacactggtgcagctaaagga

SEQ ID NO: 7129 - DNA, 25 bp, Mus musculus
gagccttccctcagtgatgggttca

SEQ ID NO: 7130 - DNA, 25 bp, Mus musculus
ccttccctcagtgatgggttcagtt

SEQ ID NO: 7131 - DNA, 25 bp, Mus musculus
agttccagaaggtgtgctagaagat

SEQ ID NO: 7132 - DNA, 25 bp, Mus musculus
tattaaagtgcgcacgtgctttgtc

SEQ ID NO: 7133 - DNA, 25 bp, Mus musculus
gcgcacgtgctttgtcagtgatctg

SEQ ID NO: 7134 - DNA, 25 bp, Mus musculus
cacgtgctttgtcagtgatctgaag

SEQ ID NO: 7135 - DNA, 25 bp, Mus musculus
gtgctttgtcagtgatctgaagcgt

SEQ ID NO: 7136 - DNA, 25 bp, Mus musculus
tgtcagtgatctgaagcgtggactg

SEQ ID NO: 7137 - DNA, 25 bp, Mus musculus
tgatctgaagcgtggactgcaaatc

SEQ ID NO: 7138 - DNA, 25 bp, Mus musculus
tgaaggcatcccaatactgaattgc

SEQ ID NO: 7139 - DNA, 25 bp, Mus musculus
aggcatcccaatactgaattgctgg

SEQ ID NO: 7140 - DNA, 25 bp, Mus musculus
aatactgaattgctggggagcactg

SEQ ID NO: 7141 - DNA, 25 bp, Mus musculus
gaattgctggggagcactgccgtta

SEQ ID NO: 7142 - DNA, 25 bp, Mus musculus
agcactgccgttagcaggaaaagct

SEQ ID NO: 7143 - DNA, 25 bp, Mus musculus
agctctccacaaggagttggaaact

SEQ ID NO: 7144 - DNA, 25 bp, Mus musculus
gttggaaactcagctgttggaacaa

SEQ ID NO: 7145 - DNA, 25 bp, Mus musculus
acaatgtactgttgacactggtgca

SEQ ID NO: 7146 - DNA, 25 bp, Mus musculus
taaagactctgaggctggaagaggg

SEQ ID NO: 7147 - DNA, 25 bp, Mus musculus
gggtgtcaaatgcccctggaactgg

SEQ ID NO: 7148 - DNA, 25 bp, Mus musculus
tggagccatttcttcagccaaacat

SEQ ID NO: 7149 - DNA, 25 bp, Mus musculus
ggagccatttcttcagccaaacatc

SEQ ID NO: 7150 - DNA, 25 bp, Mus musculus
gagccatttcttcagccaaacatcc

SEQ ID NO: 7151 - DNA, 25 bp, Mus musculus
ccatttcttcagccaaacatcccat

SEQ ID NO: 7152 - DNA, 25 bp, Mus musculus
catttcttcagccaaacatcccata

SEQ ID NO: 7153 - DNA, 25 bp, Mus musculus
atttcttcagccaaacatcccatat

SEQ ID NO: 7154 - DNA, 25 bp, Mus musculus
tttcttcagccaaacatcccatatt

SEQ ID NO: 7155 - DNA, 25 bp, Mus musculus
ttcttcagccaaacatcccatattt

SEQ ID NO: 7156 - DNA, 25 bp, Mus musculus
tcttcagccaaacatcccatatttt

SEQ ID NO: 7157 - DNA, 25 bp, Mus musculus
cttcagccaaacatcccatatttta

SEQ ID NO: 7158 - DNA, 25 bp, Mus musculus
ggtgtcaaatgcccctggaactgga

SEQ ID NO: 7159 - DNA, 25 bp, Mus musculus
tgtcaaatgcccctggaactggagt

SEQ ID NO: 7160 - DNA, 25 bp, Mus musculus
gtcaaatgcccctggaactggagtt

SEQ ID NO: 7161 - DNA, 25 bp, Mus musculus
tcaaatgcccctggaactggagtta

SEQ ID NO: 7162 - DNA, 25 bp, Mus musculus
aattatggagccatttcttcagcca

SEQ ID NO: 7163 - DNA, 25 bp, Mus musculus
attatggagccatttcttcagccaa

SEQ ID NO: 7164 - DNA, 25 bp, Mus musculus
ttatggagccatttcttcagccaaa

SEQ ID NO: 7165 - DNA, 25 bp, Mus musculus
atggagccatttcttcagccaaaca

SEQ ID NO: 7166 - DNA, 25 bp, Mus musculus
gaccaagtcgtctctagaagttgct

SEQ ID NO: 7167 - DNA, 25 bp, Mus musculus
caagtcgtctctagaagttgctgac

SEQ ID NO: 7168 - DNA, 25 bp, Mus musculus
gagctccgcaaacaatcgatctgct

SEQ ID NO: 7169 - DNA, 25 bp, Mus musculus
agctccgcaaacaatcgatctgctt

SEQ ID NO: 7170 - DNA, 25 bp, Mus musculus
gctccgcaaacaatcgatctgcttc

SEQ ID NO: 7171 - DNA, 25 bp, Mus musculus
tccgcaaacaatcgatctgcttccc

SEQ ID NO: 7172 - DNA, 25 bp, Mus musculus
cgcaaacaatcgatctgcttcccct

SEQ ID NO: 7173 - DNA, 25 bp, Mus musculus
gcaaacaatcgatctgcttcccctt

SEQ ID NO: 7174 - DNA, 25 bp, Mus musculus
acaatcgatctgcttcccctttggc

SEQ ID NO: 7175 - DNA, 25 bp, Mus musculus
tctgccaccgtggacatcatgccgt

SEQ ID NO: 7176 - DNA, 25 bp, Mus musculus
ctgccaccgtggacatcatgccgtc

SEQ ID NO: 7177 - DNA, 25 bp, Mus musculus
accgtggacatcatgccgtcccaca

SEQ ID NO: 7178 - DNA, 25 bp, Mus musculus
aagtcgtctctagaagttgctgacc

SEQ ID NO: 7179 - DNA, 25 bp, Mus musculus
ccgtggacatcatgccgtcccacag

SEQ ID NO: 7180 - DNA, 25 bp, Mus musculus
gtcgtctctagaagttgctgaccct

SEQ ID NO: 7181 - DNA, 25 bp, Mus musculus
agttgctgaccctaaatgcttctgt

SEQ ID NO: 7182 - DNA, 25 bp, Mus musculus
gttgctgaccctaaatgcttctgtt

SEQ ID NO: 7183 - DNA, 25 bp, Mus musculus
ttgctgaccctaaatgcttctgtta

SEQ ID NO: 7184 - DNA, 25 bp, Mus musculus
ctgaccctaaatgcttctgttagtc

SEQ ID NO: 7185 - DNA, 25 bp, Mus musculus
cctaaatgcttctgttagtccacag

SEQ ID NO: 7186 - DNA, 25 bp, Mus musculus
cgagctccgcaaacaatcgatctgc

SEQ ID NO: 7187 - DNA, 25 bp, Mus musculus
ttgtataacacacctccatgcttca

SEQ ID NO: 7188 - DNA, 25 bp, Mus musculus
tataacacacctccatgcttcagca

SEQ ID NO: 7189 - DNA, 25 bp, Mus musculus
gagaagctcagctccgtcaaatccc

SEQ ID NO: 7190 - DNA, 25 bp, Mus musculus
aagctcagctccgtcaaatcccaaa

SEQ ID NO: 7191 - DNA, 25 bp, Mus musculus
ctcagctccgtcaaatcccaaatga

SEQ ID NO: 7192 - DNA, 25 bp, Mus musculus
agctccgtcaaatcccaaatgattt

SEQ ID NO: 7193 - DNA, 25 bp, Mus musculus
tccgtcaaatcccaaatgatttatg

SEQ ID NO: 7194 - DNA, 25 bp, Mus musculus
gtcaaatcccaaatgatttatgaga

SEQ ID NO: 7195 - DNA, 25 bp, Mus musculus
aaatcccaaatgatttatgagatta

SEQ ID NO: 7196 - DNA, 25 bp, Mus musculus
atgaacattccgtttcgcattggta

SEQ ID NO: 7197 - DNA, 25 bp, Mus musculus
attccgtttcgcattggtaacagca

SEQ ID NO: 7198 - DNA, 25 bp, Mus musculus
ccgtttcgcattggtaacagcaaag

SEQ ID NO: 7199 - DNA, 25 bp, Mus musculus
acacctccatgcttcagcatctacg

SEQ ID NO: 7200 - DNA, 25 bp, Mus musculus
cctccatgcttcagcatctacgtca

SEQ ID NO: 7201 - DNA, 25 bp, Mus musculus
tgcttcagcatctacgtcatgggca

SEQ ID NO: 7202 - DNA, 25 bp, Mus musculus
ttcagcatctacgtcatgggcatgg

SEQ ID NO: 7203 - DNA, 25 bp, Mus musculus
agcatctacgtcatgggcatggtcc

SEQ ID NO: 7204 - DNA, 25 bp, Mus musculus
tacgtcatgggcatggtcctggaat

SEQ ID NO: 7205 - DNA, 25 bp, Mus musculus
gtcatgggcatggtcctggaatgga

SEQ ID NO: 7206 - DNA, 25 bp, Mus musculus
atgggcatggtcctggaatggatca

SEQ ID NO: 7207 - DNA, 25 bp, Mus musculus
cagaggtacccatttcatttccagt

SEQ ID NO: 7208 - DNA, 25 bp, Mus musculus
tacccatttcatttccagtttgctc

SEQ ID NO: 7209 - DNA, 25 bp, Mus musculus
tgctcggtagctggtgattggaaga

SEQ ID NO: 7210 - DNA, 25 bp, Mus musculus
agacactctgcaacattactcactg

SEQ ID NO: 7211 - DNA, 25 bp, Mus musculus
acactctgcaacattactcactgaa

SEQ ID NO: 7212 - DNA, 25 bp, Mus musculus
actctgcaacattactcactgaagg

SEQ ID NO: 7213 - DNA, 25 bp, Mus musculus
tctgcaacattactcactgaaggcc

SEQ ID NO: 7214 - DNA, 25 bp, Mus musculus
tgcaacattactcactgaaggcctg

SEQ ID NO: 7215 - DNA, 25 bp, Mus musculus
caacattactcactgaaggcctgag

SEQ ID NO: 7216 - DNA, 25 bp, Mus musculus
attactcactgaaggcctgagacgc

SEQ ID NO: 7217 - DNA, 25 bp, Mus musculus
ctcactgaaggcctgagacgcagcc

SEQ ID NO: 7218 - DNA, 25 bp, Mus musculus
cactgaaggcctgagacgcagcccc

SEQ ID NO: 7219 - DNA, 25 bp, Mus musculus
cccatttcatttccagtttgctcgg

SEQ ID NO: 7220 - DNA, 25 bp, Mus musculus
catttcatttccagtttgctcggta

SEQ ID NO: 7221 - DNA, 25 bp, Mus musculus
tttcatttccagtttgctcggtagc

SEQ ID NO: 7222 - DNA, 25 bp, Mus musculus
tcatttccagtttgctcggtagctg

SEQ ID NO: 7223 - DNA, 25 bp, Mus musculus
atttccagtttgctcggtagctggt

SEQ ID NO: 7224 - DNA, 25 bp, Mus musculus
ccagtttgctcggtagctggtgatt

SEQ ID NO: 7225 - DNA, 25 bp, Mus musculus
agtttgctcggtagctggtgattgg

SEQ ID NO: 7226 - DNA, 25 bp, Mus musculus
tttgctcggtagctggtgattggaa

SEQ ID NO: 7227 - DNA, 25 bp, Mus musculus
gttgcttacccactactatgacgat

SEQ ID NO: 7228 - DNA, 25 bp, Mus musculus
tgcttacccactactatgacgatgc

SEQ ID NO: 7229 - DNA, 25 bp, Mus musculus
cgatgtaccaggtgttccgacgtgg

SEQ ID NO: 7230 - DNA, 25 bp, Mus musculus
tgttccgacgtgggcttagcatctc

SEQ ID NO: 7231 - DNA, 25 bp, Mus musculus
ttccgacgtgggcttagcatctcag

SEQ ID NO: 7232 - DNA, 25 bp, Mus musculus
ggcttagcatctcagggaatggacc

SEQ ID NO: 7233 - DNA, 25 bp, Mus musculus
atctcagggaatggaccctgtcttg

SEQ ID NO: 7234 - DNA, 25 bp, Mus musculus
gaatggaccctgtcttggcttccgt

SEQ ID NO: 7235 - DNA, 25 bp, Mus musculus
atggaccctgtcttggcttccgtat

SEQ ID NO: 7236 - DNA, 25 bp, Mus musculus
ggaccctgtcttggcttccgtatag

SEQ ID NO: 7237 - DNA, 25 bp, Mus musculus
tcttggcttccgtatagcagatgaa

SEQ ID NO: 7238 - DNA, 25 bp, Mus musculus
ttggcttccgtatagcagatgaatc

SEQ ID NO: 7239 - DNA, 25 bp, Mus musculus
cttacccactactatgacgatgccc

SEQ ID NO: 7240 - DNA, 25 bp, Mus musculus
tacccactactatgacgatgcccgg

SEQ ID NO: 7241 - DNA, 25 bp, Mus musculus
ctactatgacgatgcccggacgatg

SEQ ID NO: 7242 - DNA, 25 bp, Mus musculus
actatgacgatgcccggacgatgta

SEQ ID NO: 7243 - DNA, 25 bp, Mus musculus
tatgacgatgcccggacgatgtacc

SEQ ID NO: 7244 - DNA, 25 bp, Mus musculus
acgatgcccggacgatgtaccaggt

SEQ ID NO: 7245 - DNA, 25 bp, Mus musculus
gatgcccggacgatgtaccaggtgt

SEQ ID NO: 7246 - DNA, 25 bp, Mus musculus
tgcccggacgatgtaccaggtgttc

SEQ ID NO: 7247 - DNA, 25 bp, Mus musculus
gcccagccatcagcccagatgacag

SEQ ID NO: 7248 - DNA, 25 bp, Mus musculus
tcagcccagatgacagcgatgagga

SEQ ID NO: 7249 - DNA, 25 bp, Mus musculus
ggactcactgacccagctgcagggt

SEQ ID NO: 7250 - DNA, 25 bp, Mus musculus
actgacccagctgcagggttttgtt

SEQ ID NO: 7251 - DNA, 25 bp, Mus musculus
ccagctgcagggttttgttaccctg

SEQ ID NO: 7252 - DNA, 25 bp, Mus musculus
tccaccatgaaggtctctgctttcc

SEQ ID NO: 7253 - DNA, 25 bp, Mus musculus
accatgaaggtctctgctttcctgt

SEQ ID NO: 7254 - DNA, 25 bp, Mus musculus
atgaaggtctctgctttcctgtgac

SEQ ID NO: 7255 - DNA, 25 bp, Mus musculus
gctttcctgtgacttgattgggata

SEQ ID NO: 7256 - DNA, 25 bp, Mus musculus
gtgcctgctctgggtcatacacctg

SEQ ID NO: 7257 - DNA, 25 bp, Mus musculus
cctgctctgggtcatacacctgatc

SEQ ID NO: 7258 - DNA, 25 bp, Mus musculus
catacacctgatctggaagtaacaa

SEQ ID NO: 7259 - DNA, 25 bp, Mus musculus
cagacaacctcggtggcctgtgtgt

SEQ ID NO: 7260 - DNA, 25 bp, Mus musculus
acaacctcggtggcctgtgtgtcac

SEQ ID NO: 7261 - DNA, 25 bp, Mus musculus
tcggtggcctgtgtgtcacttccct

SEQ ID NO: 7262 - DNA, 25 bp, Mus musculus
tcccttgtacataactccttgtgac

SEQ ID NO: 7263 - DNA, 25 bp, Mus musculus
tgacaaaaccctctggaagttctgg

SEQ ID NO: 7264 - DNA, 25 bp, Mus musculus
cttgtcctctactcatgctgtcttg

SEQ ID NO: 7265 - DNA, 25 bp, Mus musculus
ctctactcatgctgtcttggactca

SEQ ID NO: 7266 - DNA, 25 bp, Mus musculus
tactcatgctgtcttggactcactg

SEQ ID NO: 7267 - DNA, 25 bp, Mus musculus
cttacttcacaaatatgctacagaa

SEQ ID NO: 7268 - DNA, 25 bp, Mus musculus
atatgctacagaacatctaggctga

SEQ ID NO: 7269 - DNA, 25 bp, Mus musculus
ctgccgccaagactattctaatgtg

SEQ ID NO: 7270 - DNA, 25 bp, Mus musculus
ctattctaatgtgttgtggatatat

SEQ ID NO: 7271 - DNA, 25 bp, Mus musculus
ctatgattttccattcacaataaat

SEQ ID NO: 7272 - DNA, 25 bp, Mus musculus
caatgatacccataactgaaccttc

SEQ ID NO: 7273 - DNA, 25 bp, Mus musculus
tacccataactgaaccttctgttat

SEQ ID NO: 7274 - DNA, 25 bp, Mus musculus
taactgaaccttctgttatgttgtg

SEQ ID NO: 7275 - DNA, 25 bp, Mus musculus
aaccttctgttatgttgtgaaatgt

SEQ ID NO: 7276 - DNA, 25 bp, Mus musculus
ctcatattgcttctagcagatagaa

SEQ ID NO: 7277 - DNA, 25 bp, Mus musculus
ttgcttctagcagatagaaggtatc

SEQ ID NO: 7278 - DNA, 25 bp, Mus musculus
ttctaccctttgttgtgaccacaat

SEQ ID NO: 7279 - DNA, 25 bp, Mus musculus
acatctaggctgaaactcatacaaa

SEQ ID NO: 7280 - DNA, 25 bp, Mus musculus
atgtgtccagtgcacactctgtaag

SEQ ID NO: 7281 - DNA, 25 bp, Mus musculus
ccagtgcacactctgtaagtgggga

SEQ ID NO: 7282 - DNA, 25 bp, Mus musculus
cacactctgtaagtggggattgtgc

SEQ ID NO: 7283 - DNA, 25 bp, Mus musculus
tgctgtactgatgttctatgtggca

SEQ ID NO: 7284 - DNA, 25 bp, Mus musculus
gttctatgtggcactgaggaaacta

SEQ ID NO: 7285 - DNA, 25 bp, Mus musculus
tagatcttctcatgtctggatatta

SEQ ID NO: 7286 - DNA, 25 bp, Mus musculus
ttctcatgtctggatattagatcct

SEQ ID NO: 7287 - DNA, 25 bp, Mus musculus
acacactgaatgcactgctgcagaa

SEQ ID NO: 7288 - DNA, 25 bp, Mus musculus
tgaatgcactgctgcagaagtttac

SEQ ID NO: 7289 - DNA, 25 bp, Mus musculus
cgaactatctataccgcaagatcga

SEQ ID NO: 7290 - DNA, 25 bp, Mus musculus
actatctataccgcaagatcgagaa

SEQ ID NO: 7291 - DNA, 25 bp, Mus musculus
atctataccgcaagatcgagaagac

SEQ ID NO: 7292 - DNA, 25 bp, Mus musculus
tataccgcaagatcgagaagacgtt

SEQ ID NO: 7293 - DNA, 25 bp, Mus musculus
agaagacgtttccccagctgtatgc

SEQ ID NO: 7294 - DNA, 25 bp, Mus musculus
agacgtttccccagctgtatgcctt

SEQ ID NO: 7295 - DNA, 25 bp, Mus musculus
cgtttccccagctgtatgccttcac

SEQ ID NO: 7296 - DNA, 25 bp, Mus musculus
ttccccagctgtatgccttcaccat

SEQ ID NO: 7297 - DNA, 25 bp, Mus musculus
cccagctgtatgccttcaccatctg

SEQ ID NO: 7298 - DNA, 25 bp, Mus musculus
agctgtatgccttcaccatctgcct

SEQ ID NO: 7299 - DNA, 25 bp, Mus musculus
atgcactgctgcagaagtttactga

SEQ ID NO: 7300 - DNA, 25 bp, Mus musculus
tgccttcaccatctgcctgtggctg

SEQ ID NO: 7301 - DNA, 25 bp, Mus musculus
agtttactgagcttgagagaggcaa

SEQ ID NO: 7302 - DNA, 25 bp, Mus musculus
ttactgagcttgagagaggcaacaa

SEQ ID NO: 7303 - DNA, 25 bp, Mus musculus
acaatgcattcaagtcaccagatgc

SEQ ID NO: 7304 - DNA, 25 bp, Mus musculus
atgcattcaagtcaccagatgcatt

SEQ ID NO: 7305 - DNA, 25 bp, Mus musculus
tcaagtcaccagatgcattcgaagt

SEQ ID NO: 7306 - DNA, 25 bp, Mus musculus
tccctacgaactatctataccgcaa

SEQ ID NO: 7307 - DNA, 25 bp, Mus musculus
ctacgaactatctataccgcaagat

SEQ ID NO: 7308 - DNA, 25 bp, Mus musculus
cctgcattttgttcagcacggccac

SEQ ID NO: 7309 - DNA, 25 bp, Mus musculus
cggccacatgttgtcatgactcagg

SEQ ID NO: 7310 - DNA, 25 bp, Mus musculus
gatatggctcttcaaatggggtaga

SEQ ID NO: 7311 - DNA, 25 bp, Mus musculus
gctcttcaaatggggtagagggtga

SEQ ID NO: 7312 - DNA, 25 bp, Mus musculus
gtgcagagcctgagctgccttgatt

SEQ ID NO: 7313 - DNA, 25 bp, Mus musculus
agctgccttgattggcagggtagcc

SEQ ID NO: 7314 - DNA, 25 bp, Mus musculus
ctgctgtcctccgctgtcagtgagt

SEQ ID NO: 7315 - DNA, 25 bp, Mus musculus
tcaggcctcctgctctgcagtcaga

SEQ ID NO: 7316 - DNA, 25 bp, Mus musculus
ctcctgctctgcagtcagactaaca

SEQ ID NO: 7317 - DNA, 25 bp, Mus musculus
agtcagactaacagtacccagaggc

SEQ ID NO: 7318 - DNA, 25 bp, Mus musculus
tcttaaccctgagataggttccatc

SEQ ID NO: 7319 - DNA, 25 bp, Mus musculus
gataggttccatccctgatacatct

SEQ ID NO: 7320 - DNA, 25 bp, Mus musculus
catgttgtcatgactcagggtaagt

SEQ ID NO: 7321 - DNA, 25 bp, Mus musculus
tccatccctgatacatcttcaactc

SEQ ID NO: 7322 - DNA, 25 bp, Mus musculus
ctggaagaccatcctgtttgtttct

SEQ ID NO: 7323 - DNA, 25 bp, Mus musculus
tcctgaaacactctacataaaacct

SEQ ID NO: 7324 - DNA, 25 bp, Mus musculus
aacactctacataaaacctcaagat

SEQ ID NO: 7325 - DNA, 25 bp, Mus musculus
ttaatatctgatatcttctagaggt

SEQ ID NO: 7326 - DNA, 25 bp, Mus musculus
tctgatatcttctagaggttttcta

SEQ ID NO: 7327 - DNA, 25 bp, Mus musculus
aacagctctcatgttctagatttct

SEQ ID NO: 7328 - DNA, 25 bp, Mus musculus
gttctagatttctctggagtgctac

SEQ ID NO: 7329 - DNA, 25 bp, Mus musculus
cactggcattgtctctgctcctgtg

SEQ ID NO: 7330 - DNA, 25 bp, Mus musculus
cattgtctctgctcctgtgcccaag

SEQ ID NO: 7331 - DNA, 25 bp, Mus musculus
ctttgctaaggccacctttgatgcc

SEQ ID NO: 7332 - DNA, 25 bp, Mus musculus
taaggccacctttgatgccatctcc

SEQ ID NO: 7333 - DNA, 25 bp, Mus musculus
tgatgccatctccaagacttacagc

SEQ ID NO: 7334 - DNA, 25 bp, Mus musculus
catctccaagacttacagctacctg

SEQ ID NO: 7335 - DNA, 25 bp, Mus musculus
caccaagtctccttatcaggaattc

SEQ ID NO: 7336 - DNA, 25 bp, Mus musculus
gtctccttatcaggaattctcggat

SEQ ID NO: 7337 - DNA, 25 bp, Mus musculus
ggaattctcggatcatcttgtgaaa

SEQ ID NO: 7338 - DNA, 25 bp, Mus musculus
caccagagtctctgttcagaggacc

SEQ ID NO: 7339 - DNA, 25 bp, Mus musculus
agtctctgttcagaggacccaggct

SEQ ID NO: 7340 - DNA, 25 bp, Mus musculus
tccagctgtggctaccacataaggg

SEQ ID NO: 7341 - DNA, 25 bp, Mus musculus
ctctgctcctgtgcccaagaagctc

SEQ ID NO: 7342 - DNA, 25 bp, Mus musculus
tcctgtgcccaagaagctcctgatg

SEQ ID NO: 7343 - DNA, 25 bp, Mus musculus
gaagctcctgatgatggccggtata

SEQ ID NO: 7344 - DNA, 25 bp, Mus musculus
cctgatgatggccggtatagatgac

SEQ ID NO: 7345 - DNA, 25 bp, Mus musculus
ctgctacacttcagccagaggctgc

SEQ ID NO: 7346 - DNA, 25 bp, Mus musculus
cacttcagccagaggctgcactgcc

SEQ ID NO: 7347 - DNA, 25 bp, Mus musculus
agccagaggctgcactgccaccctg

SEQ ID NO: 7348 - DNA, 25 bp, Mus musculus
aggctgcactgccaccctgggcaac

SEQ ID NO: 7349 - DNA, 25 bp, Mus musculus
gcctggtgctcttcatcgttgggca

SEQ ID NO: 7350 - DNA, 25 bp, Mus musculus
cctggtgctcttcatcgttgggcac

SEQ ID NO: 7351 - DNA, 25 bp, Mus musculus
cttcatcgttgggcactagccgtgc

SEQ ID NO: 7352 - DNA, 25 bp, Mus musculus
ttcatcgttgggcactagccgtgcc

SEQ ID NO: 7353 - DNA, 25 bp, Mus musculus
tcatcgttgggcactagccgtgccg

SEQ ID NO: 7354 - DNA, 25 bp, Mus musculus
catcgttgggcactagccgtgccgc

SEQ ID NO: 7355 - DNA, 25 bp, Mus musculus
tcgttgggcactagccgtgccgcct

SEQ ID NO: 7356 - DNA, 25 bp, Mus musculus
cggtgacgctcttggtgcgacaact

SEQ ID NO: 7357 - DNA, 25 bp, Mus musculus
ggtgacgctcttggtgcgacaactg

SEQ ID NO: 7358 - DNA, 25 bp, Mus musculus
gtgacgctcttggtgcgacaactgc

SEQ ID NO: 7359 - DNA, 25 bp, Mus musculus
tgacgctcttggtgcgacaactgcg

SEQ ID NO: 7360 - DNA, 25 bp, Mus musculus
gacgctcttggtgcgacaactgcgg

SEQ ID NO: 7361 - DNA, 25 bp, Mus musculus
ctggtgctcttcatcgttgggcact

SEQ ID NO: 7362 - DNA, 25 bp, Mus musculus
tggtgctcttcatcgttgggcacta

SEQ ID NO: 7363 - DNA, 25 bp, Mus musculus
ggtgctcttcatcgttgggcactag

SEQ ID NO: 7364 - DNA, 25 bp, Mus musculus
gtgctcttcatcgttgggcactagc

SEQ ID NO: 7365 - DNA, 25 bp, Mus musculus
tgctcttcatcgttgggcactagcc

SEQ ID NO: 7366 - DNA, 25 bp, Mus musculus
gctcttcatcgttgggcactagccg

SEQ ID NO: 7367 - DNA, 25 bp, Mus musculus
ctcttcatcgttgggcactagccgt

SEQ ID NO: 7368 - DNA, 25 bp, Mus musculus
tcttcatcgttgggcactagccgtg

SEQ ID NO: 7369 - DNA, 25 bp, Mus musculus
atcttcaatattccagatgaaaagg

SEQ ID NO: 7370 - DNA, 25 bp, Mus musculus
agtaacacatttgagccactgatta

SEQ ID NO: 7371 - DNA, 25 bp, Mus musculus
ctataccaaggacaggtgttagtga

SEQ ID NO: 7372 - DNA, 25 bp, Mus musculus
tctgctcctaagtccccaggtgcat

SEQ ID NO: 7373 - DNA, 25 bp, Mus musculus
gctcctaagtccccaggtgcatcca

SEQ ID NO: 7374 - DNA, 25 bp, Mus musculus
tccccaggtgcatccaatttttcaa

SEQ ID NO: 7375 - DNA, 25 bp, Mus musculus
ccaggtgcatccaatttttcaactt

SEQ ID NO: 7376 - DNA, 25 bp, Mus musculus
tcaactttaccaaagatctctcctt

SEQ ID NO: 7377 - DNA, 25 bp, Mus musculus
ttaccaaagatctctccttcatctc

SEQ ID NO: 7378 - DNA, 25 bp, Mus musculus
ccaaagatctctccttcatctctat

SEQ ID NO: 7379 - DNA, 25 bp, Mus musculus
aagatctctccttcatctctatcaa

SEQ ID NO: 7380 - DNA, 25 bp, Mus musculus
atctctccttcatctctatcaaata

SEQ ID NO: 7381 - DNA, 25 bp, Mus musculus
aacacatttgagccactgattaagc

SEQ ID NO: 7382 - DNA, 25 bp, Mus musculus
tctccttcatctctatcaaataatt

SEQ ID NO: 7383 - DNA, 25 bp, Mus musculus
ccagacagcaccatccaggatgccg

SEQ ID NO: 7384 - DNA, 25 bp, Mus musculus
gacagcaccatccaggatgccggcc

SEQ ID NO: 7385 - DNA, 25 bp, Mus musculus
agcaccatccaggatgccggcctat

SEQ ID NO: 7386 - DNA, 25 bp, Mus musculus
atccaggatgccggcctataccaag

SEQ ID NO: 7387 - DNA, 25 bp, Mus musculus
caggatgccggcctataccaaggac

SEQ ID NO: 7388 - DNA, 25 bp, Mus musculus
gatgccggcctataccaaggacagg

SEQ ID NO: 7389 - DNA, 25 bp, Mus musculus
gccggcctataccaaggacaggtgt

SEQ ID NO: 7390 - DNA, 25 bp, Mus musculus
ctctcttacactttcgcaggaattg

SEQ ID NO: 7391 - DNA, 25 bp, Mus musculus
tcttacactttcgcaggaattgatt

SEQ ID NO: 7392 - DNA, 25 bp, Mus musculus
cagggtcctttgtttctccatctga

SEQ ID NO: 7393 - DNA, 25 bp, Mus musculus
ggtcctttgtttctccatctgagga

SEQ ID NO: 7394 - DNA, 25 bp, Mus musculus
ttgtttctccatctgaggagatgcg

SEQ ID NO: 7395 - DNA, 25 bp, Mus musculus
tttctccatctgaggagatgcgagc

SEQ ID NO: 7396 - DNA, 25 bp, Mus musculus
ctccatctgaggagatgcgagcaga

SEQ ID NO: 7397 - DNA, 25 bp, Mus musculus
gagcagactttgcctcaggtttctg

SEQ ID NO: 7398 - DNA, 25 bp, Mus musculus
tgtcgggcttttgatcacagtaagg

SEQ ID NO: 7399 - DNA, 25 bp, Mus musculus
gtgatcatccttcaaaggggatgtc

SEQ ID NO: 7400 - DNA, 25 bp, Mus musculus
ggatgtcatggtcgtgccgtagaat

SEQ ID NO: 7401 - DNA, 25 bp, Mus musculus
catggtcgtgccgtagaatcaactt

SEQ ID NO: 7402 - DNA, 25 bp, Mus musculus
tacactttcgcaggaattgattccg

SEQ ID NO: 7403 - DNA, 25 bp, Mus musculus
ttaaaaccaaatgacattcattttg

SEQ ID NO: 7404 - DNA, 25 bp, Mus musculus
gattccgagatacctagttaaagag

SEQ ID NO: 7405 - DNA, 25 bp, Mus musculus
tgtgagaggactcccacttgctccc

SEQ ID NO: 7406 - DNA, 25 bp, Mus musculus
gagaggactcccacttgctccctgg

SEQ ID NO: 7407 - DNA, 25 bp, Mus musculus
tccctggttggtagccattttggca

SEQ ID NO: 7408 - DNA, 25 bp, Mus musculus
gttggtagccattttggcaggttgt

SEQ ID NO: 7409 - DNA, 25 bp, Mus musculus
ttaactctgtgccagcagggtcctt

SEQ ID NO: 7410 - DNA, 25 bp, Mus musculus
actctgtgccagcagggtcctttgt

SEQ ID NO: 7411 - DNA, 25 bp, Mus musculus
gtagctgtctgtacacaatgactaa

SEQ ID NO: 7412 - DNA, 25 bp, Mus musculus
atcacaatgaggcaacgcctctgcc

SEQ ID NO: 7413 - DNA, 25 bp, Mus musculus
acatgacacaacatgccagtcacca

SEQ ID NO: 7414 - DNA, 25 bp, Mus musculus
ctagaacctaagacaccagctgctg

SEQ ID NO: 7415 - DNA, 25 bp, Mus musculus
cctaagacaccagctgctgttctga

SEQ ID NO: 7416 - DNA, 25 bp, Mus musculus
cctcactgtgggtctttcctctaga

SEQ ID NO: 7417 - DNA, 25 bp, Mus musculus
tctttcctctagagcctggatctga

SEQ ID NO: 7418 - DNA, 25 bp, Mus musculus
ctctagagcctggatctgattgtct

SEQ ID NO: 7419 - DNA, 25 bp, Mus musculus
agcctggatctgattgtctgtggat

SEQ ID NO: 7420 - DNA, 25 bp, Mus musculus
gatctgattgtctgtggattctgtc

SEQ ID NO: 7421 - DNA, 25 bp, Mus musculus
attgtctgtggattctgtcaaggaa

SEQ ID NO: 7422 - DNA, 25 bp, Mus musculus
tcaaacctctgtcctgaacgatccc

SEQ ID NO: 7423 - DNA, 25 bp, Mus musculus
ctctgcccctgagtgttgagaagaa

SEQ ID NO: 7424 - DNA, 25 bp, Mus musculus
cagaagatcgggcgctgttgtaaag

SEQ ID NO: 7425 - DNA, 25 bp, Mus musculus
gaatttactcatcaaaagatcatct

SEQ ID NO: 7426 - DNA, 25 bp, Mus musculus
actcatcaaaagatcatctggaaaa

SEQ ID NO: 7427 - DNA, 25 bp, Mus musculus
agaagcccaatcaataactgttcta

SEQ ID NO: 7428 - DNA, 25 bp, Mus musculus
ccaatcaataactgttctagatcct

SEQ ID NO: 7429 - DNA, 25 bp, Mus musculus
tgttctagatcctagtccccaataa

SEQ ID NO: 7430 - DNA, 25 bp, Mus musculus
agatcctagtccccaataactgaag

SEQ ID NO: 7431 - DNA, 25 bp, Mus musculus
ggtcacagctgggcagacgatgaat

SEQ ID NO: 7432 - DNA, 25 bp, Mus musculus
tagctgctttgggagagcagagcat

SEQ ID NO: 7433 - DNA, 25 bp, Mus musculus
agacatctttgtccattcgcaaaag

SEQ ID NO: 7434 - DNA, 25 bp, Mus musculus
ctttgtccattcgcaaaagctcttg

SEQ ID NO: 7435 - DNA, 25 bp, Mus musculus
ccattcgcaaaagctcttgtcggct

SEQ ID NO: 7436 - DNA, 25 bp, Mus musculus
gcaaaagctcttgtcggctgcagtg

SEQ ID NO: 7437 - DNA, 25 bp, Mus musculus
tgagaacagcagcctgaggtttctc

SEQ ID NO: 7438 - DNA, 25 bp, Mus musculus
cagcagcctgaggtttctcatccag

SEQ ID NO: 7439 - DNA, 25 bp, Mus musculus
cctgaggtttctcatccagatatcc

SEQ ID NO: 7440 - DNA, 25 bp, Mus musculus
cgggattctctggttctgcttaaag

SEQ ID NO: 7441 - DNA, 25 bp, Mus musculus
tctctggttctgcttaaagacttag

SEQ ID NO: 7442 - DNA, 25 bp, Mus musculus
gacttagctttggagcctatgaaag

SEQ ID NO: 7443 - DNA, 25 bp, Mus musculus
agagcatgctagccacttaattctc

SEQ ID NO: 7444 - DNA, 25 bp, Mus musculus
ctgaccgggccagcatcatgggtac

SEQ ID NO: 7445 - DNA, 25 bp, Mus musculus
ttaaggttttctgtctgatgagact

SEQ ID NO: 7446 - DNA, 25 bp, Mus musculus
cccagtgcaatccccactgagacag

SEQ ID NO: 7447 - DNA, 25 bp, Mus musculus
gcaatccccactgagacagcctgca

SEQ ID NO: 7448 - DNA, 25 bp, Mus musculus
ctgtggctcttggtgcactcaccag

SEQ ID NO: 7449 - DNA, 25 bp, Mus musculus
ctcttggtgcactcaccagccagga

SEQ ID NO: 7450 - DNA, 25 bp, Mus musculus
gtgcactcaccagccaggactagac

SEQ ID NO: 7451 - DNA, 25 bp, Mus musculus
aggcaccacatcaagccacctaggc

SEQ ID NO: 7452 - DNA, 25 bp, Mus musculus
tgccctttctgatggcccgtgtgga

SEQ ID NO: 7453 - DNA, 25 bp, Mus musculus
acatggcacctctgtttggagtgcc

SEQ ID NO: 7454 - DNA, 25 bp, Mus musculus
cacctctgtttggagtgccccatct

SEQ ID NO: 7455 - DNA, 25 bp, Mus musculus
tgtttggagtgccccatcttggcct

SEQ ID NO: 7456 - DNA, 25 bp, Mus musculus
gagtgccccatcttggcctgttcag

SEQ ID NO: 7457 - DNA, 25 bp, Mus musculus
cccatcttggcctgttcagagtcct

SEQ ID NO: 7458 - DNA, 25 bp, Mus musculus
tgttcagagtcctggtacccagtta

SEQ ID NO: 7459 - DNA, 25 bp, Mus musculus
ggaatccacctgggatcaagaagga

SEQ ID NO: 7460 - DNA, 25 bp, Mus musculus
aggccgtatcctcctgggtcatagc

SEQ ID NO: 7461 - DNA, 25 bp, Mus musculus
tatcctcctgggtcatagctaacct

SEQ ID NO: 7462 - DNA, 25 bp, Mus musculus
tcatagctaacctataaaggcgccg

SEQ ID NO: 7463 - DNA, 25 bp, Mus musculus
ccttatgggcccaaaagatgcatca

SEQ ID NO: 7464 - DNA, 25 bp, Mus musculus
ctcgccatctttactcatgcttgcc

SEQ ID NO: 7465 - DNA, 25 bp, Mus musculus
atctttactcatgcttgcctttggc

SEQ ID NO: 7466 - DNA, 25 bp, Mus musculus
gctctaaggctatgctgctgtcacc

SEQ ID NO: 7467 - DNA, 25 bp, Mus musculus
aggctatgctgctgtcaccccgagg

SEQ ID NO: 7468 - DNA, 25 bp, Mus musculus
ttcagcacctggagctgcaagagct

SEQ ID NO: 7469 - DNA, 25 bp, Mus musculus
gctggttctcgacatcccacatggc

SEQ ID NO: 7470 - DNA, 25 bp, Mus musculus
catcccacatggcacctctgtttgg

SEQ ID NO: 7471 - DNA, 25 bp, Mus musculus
ggtttccgtccaggatggcatcctg

SEQ ID NO: 7472 - DNA, 25 bp, Mus musculus
ttccgtccaggatggcatcctgctg

SEQ ID NO: 7473 - DNA, 25 bp, Mus musculus
cccctctgaggtggagactcttcga

SEQ ID NO: 7474 - DNA, 25 bp, Mus musculus
tgccaccctggaggcctataccaag

SEQ ID NO: 7475 - DNA, 25 bp, Mus musculus
caccctggaggcctataccaagcag

SEQ ID NO: 7476 - DNA, 25 bp, Mus musculus
ggcctataccaagcagaagtatccg

SEQ ID NO: 7477 - DNA, 25 bp, Mus musculus
gaagtatccggaacagccaggcagg

SEQ ID NO: 7478 - DNA, 25 bp, Mus musculus
tccggaacagccaggcaggtttgcc

SEQ ID NO: 7479 - DNA, 25 bp, Mus musculus
caagcttctgctgcgtctccctgct

SEQ ID NO: 7480 - DNA, 25 bp, Mus musculus
cattggagacactcccatcgacagc

SEQ ID NO: 7481 - DNA, 25 bp, Mus musculus
tggagacactcccatcgacagcttc

SEQ ID NO: 7482 - DNA, 25 bp, Mus musculus
cctgtccccaaaatgtgatgcttgt

SEQ ID NO: 7483 - DNA, 25 bp, Mus musculus
ccacgtgcacaggagcagcgctcac

SEQ ID NO: 7484 - DNA, 25 bp, Mus musculus
agtcggctccatcttcgacagagtc

SEQ ID NO: 7485 - DNA, 25 bp, Mus musculus
cggctccatcttcgacagagtcctt

SEQ ID NO: 7486 - DNA, 25 bp, Mus musculus
cttcgacagagtccttacagagttg

SEQ ID NO: 7487 - DNA, 25 bp, Mus musculus
cgacagagtccttacagagttggtg

SEQ ID NO: 7488 - DNA, 25 bp, Mus musculus
agtccttacagagttggtgtccaag

SEQ ID NO: 7489 - DNA, 25 bp, Mus musculus
catcgtgctgtttaacccagatgcc

SEQ ID NO: 7490 - DNA, 25 bp, Mus musculus
cgtgctgtttaacccagatgccaag

SEQ ID NO: 7491 - DNA, 25 bp, Mus musculus
gggcattcctcgaaggattaccaag

SEQ ID NO: 7492 - DNA, 25 bp, Mus musculus
agtgtttcctatactgggttctctg

SEQ ID NO: 7493 - DNA, 25 bp, Mus musculus
taccaggatcataccaaagtacacc

SEQ ID NO: 7494 - DNA, 25 bp, Mus musculus
gatcataccaaagtacaccatgagc

SEQ ID NO: 7495 - DNA, 25 bp, Mus musculus
accaaagtacaccatgagcttcgtg

SEQ ID NO: 7496 - DNA, 25 bp, Mus musculus
gtacaccatgagcttcgtgcccatc

SEQ ID NO: 7497 - DNA, 25 bp, Mus musculus
catgagcttcgtgcccatctgattc

SEQ ID NO: 7498 - DNA, 25 bp, Mus musculus
cttcgtgcccatctgattctgggtt

SEQ ID NO: 7499 - DNA, 25 bp, Mus musculus
ctgattctgggttgagccaagatgg

SEQ ID NO: 7500 - DNA, 25 bp, Mus musculus
aagggaccacgtgcatggaagaaat

SEQ ID NO: 7501 - DNA, 25 bp, Mus musculus
tagaaaacactactcaccttgataa

SEQ ID NO: 7502 - DNA, 25 bp, Mus musculus
acactactcaccttgataaaattgt

SEQ ID NO: 7503 - DNA, 25 bp, Mus musculus
tcctatactgggttctctgatgaca

SEQ ID NO: 7504 - DNA, 25 bp, Mus musculus
actgggttctctgatgacagaccca

SEQ ID NO: 7505 - DNA, 25 bp, Mus musculus
ttctctgatgacagacccaaagttc

SEQ ID NO: 7506 - DNA, 25 bp, Mus musculus
gatgacagacccaaagttcttctct

SEQ ID NO: 7507 - DNA, 25 bp, Mus musculus
cttcctgttcaccaccatcttgcag

SEQ ID NO: 7508 - DNA, 25 bp, Mus musculus
gttcaccaccatcttgcagaacttc

SEQ ID NO: 7509 - DNA, 25 bp, Mus musculus
caccatcttgcagaacttccgtttc

SEQ ID NO: 7510 - DNA, 25 bp, Mus musculus
tatcaatgagtcccctacaccagag

SEQ ID NO: 7511 - DNA, 25 bp, Mus musculus
tggactgcctgacaaatactgagcg

SEQ ID NO: 7512 - DNA, 25 bp, Mus musculus
ggactgcctgacaaatactgagcgt

SEQ ID NO: 7513 - DNA, 25 bp, Mus musculus
ctattagctcagtaggttgtgctgg

SEQ ID NO: 7514 - DNA, 25 bp, Mus musculus
tattagctcagtaggttgtgctggg

SEQ ID NO: 7515 - DNA, 25 bp, Mus musculus
ggcttcttcctacctaggaacactg

SEQ ID NO: 7516 - DNA, 25 bp, Mus musculus
gcttcttcctacctaggaacactga

SEQ ID NO: 7517 - DNA, 25 bp, Mus musculus
gactgcctgacaaatactgagcgtc

SEQ ID NO: 7518 - DNA, 25 bp, Mus musculus
actgcctgacaaatactgagcgtcc

SEQ ID NO: 7519 - DNA, 25 bp, Mus musculus
gcgtcctcctattagctcagtaggt

SEQ ID NO: 7520 - DNA, 25 bp, Mus musculus
cgtcctcctattagctcagtaggtt

SEQ ID NO: 7521 - DNA, 25 bp, Mus musculus
gtcctcctattagctcagtaggttg

SEQ ID NO: 7522 - DNA, 25 bp, Mus musculus
ctcctattagctcagtaggttgtgc

SEQ ID NO: 7523 - DNA, 25 bp, Mus musculus
tcctattagctcagtaggttgtgct

SEQ ID NO: 7524 - DNA, 25 bp, Mus musculus
cctattagctcagtaggttgtgctg

SEQ ID NO: 7525 - DNA, 25 bp, Mus musculus
ctctcaccccagcaggatgaagcta

SEQ ID NO: 7526 - DNA, 25 bp, Mus musculus
tctcaccccagcaggatgaagctac

SEQ ID NO: 7527 - DNA, 25 bp, Mus musculus
tcctattagctcagtaggttgtgct

SEQ ID NO: 7528 - DNA, 25 bp, Mus musculus
cctattagctcagtaggttgtgctg

SEQ ID NO: 7529 - DNA, 25 bp, Mus musculus
ctattagctcagtaggttgtgctgg

SEQ ID NO: 7530 - DNA, 25 bp, Mus musculus
tattagctcagtaggttgtgctggg

SEQ ID NO: 7531 - DNA, 25 bp, Mus musculus
ggcttcttcctacctaggaacactg

SEQ ID NO: 7532 - DNA, 25 bp, Mus musculus
gcttcttcctacctaggaacactga

SEQ ID NO: 7533 - DNA, 25 bp, Mus musculus
tggactgcctgacaaatactgagcg

SEQ ID NO: 7534 - DNA, 25 bp, Mus musculus
ggactgcctgacaaatactgagcgt

SEQ ID NO: 7535 - DNA, 25 bp, Mus musculus
gactgcctgacaaatactgagcgtc

SEQ ID NO: 7536 - DNA, 25 bp, Mus musculus
actgcctgacaaatactgagcgtcc

SEQ ID NO: 7537 - DNA, 25 bp, Mus musculus
gcgtcctcctattagctcagtaggt

SEQ ID NO: 7538 - DNA, 25 bp, Mus musculus
cgtcctcctattagctcagtaggtt

SEQ ID NO: 7539 - DNA, 25 bp, Mus musculus
gtcctcctattagctcagtaggttg

SEQ ID NO: 7540 - DNA, 25 bp, Mus musculus
ctcctattagctcagtaggttgtgc

SEQ ID NO: 7541 - DNA, 25 bp, Mus musculus
tctcctcaaaggctggctcccacga

SEQ ID NO: 7542 - DNA, 25 bp, Mus musculus
ctggctcccacgactctatgctcag

SEQ ID NO: 7543 - DNA, 25 bp, Mus musculus
tgcacgcctggattccagcggaaag

SEQ ID NO: 7544 - DNA, 25 bp, Mus musculus
gtgttacacatccaccagcctgccg

SEQ ID NO: 7545 - DNA, 25 bp, Mus musculus
caccagcctgccgaattcatcgagg

SEQ ID NO: 7546 - DNA, 25 bp, Mus musculus
atcgaggaccagcctgtcctaaact

SEQ ID NO: 7547 - DNA, 25 bp, Mus musculus
gaccagcctgtcctaaacttgacct

SEQ ID NO: 7548 - DNA, 25 bp, Mus musculus
cagcctgtcctaaacttgaccttca

SEQ ID NO: 7549 - DNA, 25 bp, Mus musculus
cctgtcctaaacttgaccttcaatg

SEQ ID NO: 7550 - DNA, 25 bp, Mus musculus
gtcctaaacttgaccttcaatgact

SEQ ID NO: 7551 - DNA, 25 bp, Mus musculus
ctaaacttgaccttcaatgactgca

SEQ ID NO: 7552 - DNA, 25 bp, Mus musculus
aacttgaccttcaatgactgcaagg

SEQ ID NO: 7553 - DNA, 25 bp, Mus musculus
cccacgactctatgctcagtgcagc

SEQ ID NO: 7554 - DNA, 25 bp, Mus musculus
ttgaccttcaatgactgcaagggca

SEQ ID NO: 7555 - DNA, 25 bp, Mus musculus
actctatgctcagtgcagccgcgtg

SEQ ID NO: 7556 - DNA, 25 bp, Mus musculus
tgctcagtgcagccgcgtgtgtgaa

SEQ ID NO: 7557 - DNA, 25 bp, Mus musculus
gtgcagccgcgtgtgtgaatgcaaa

SEQ ID NO: 7558 - DNA, 25 bp, Mus musculus
ccacgtctcttctagtcgggcaaga

SEQ ID NO: 7559 - DNA, 25 bp, Mus musculus
ctcctggtcacgtctgcagatgatc

SEQ ID NO: 7560 - DNA, 25 bp, Mus musculus
gtcacgtctgcagatgatctggagt

SEQ ID NO: 7561 - DNA, 25 bp, Mus musculus
ctggagtgcacgcctggattccagc

SEQ ID NO: 7562 - DNA, 25 bp, Mus musculus
gaaatacgggcgcgtcgtcacgtgt

SEQ ID NO: 7563 - DNA, 25 bp, Mus musculus
atacgggcgcgtcgtcacgtgtaca

SEQ ID NO: 7564 - DNA, 25 bp, Mus musculus
ttcgtccggttgcacgacaactcga

SEQ ID NO: 7565 - DNA, 25 bp, Mus musculus
gttgcacgacaactcgacccgaaga

SEQ ID NO: 7566 - DNA, 25 bp, Mus musculus
ttgcacgacaactcgacccgaagag

SEQ ID NO: 7567 - DNA, 25 bp, Mus musculus
tgcacgacaactcgacccgaagagg

SEQ ID NO: 7568 - DNA, 25 bp, Mus musculus
gcacgacaactcgacccgaagaggc

SEQ ID NO: 7569 - DNA, 25 bp, Mus musculus
cacgacaactcgacccgaagaggca

SEQ ID NO: 7570 - DNA, 25 bp, Mus musculus
acgacaactcgacccgaagaggcat

SEQ ID NO: 7571 - DNA, 25 bp, Mus musculus
cgcgtcgtcacgtgtacattccgct

SEQ ID NO: 7572 - DNA, 25 bp, Mus musculus
gcgtcgtcacgtgtacattccgctg

SEQ ID NO: 7573 - DNA, 25 bp, Mus musculus
cgtcgtcacgtgtacattccgctgg

SEQ ID NO: 7574 - DNA, 25 bp, Mus musculus
gtcgtcacgtgtacattccgctgga

SEQ ID NO: 7575 - DNA, 25 bp, Mus musculus
tcgtcacgtgtacattccgctggac

SEQ ID NO: 7576 - DNA, 25 bp, Mus musculus
gtcacgtgtacattccgctggaccg

SEQ ID NO: 7577 - DNA, 25 bp, Mus musculus
tcacgtgtacattccgctggaccgc

SEQ ID NO: 7578 - DNA, 25 bp, Mus musculus
cacgtgtacattccgctggaccgct

SEQ ID NO: 7579 - DNA, 25 bp, Mus musculus
ctttccaaggggctggagacatgtg

SEQ ID NO: 7580 - DNA, 25 bp, Mus musculus
ggcgagcctacactgacatgaagga

SEQ ID NO: 7581 - DNA, 25 bp, Mus musculus
ccaattactacagacctcctggact

SEQ ID NO: 7582 - DNA, 25 bp, Mus musculus
actacagacctcctggactgcctgc

SEQ ID NO: 7583 - DNA, 25 bp, Mus musculus
actgagagtcctcctattagttcag

SEQ ID NO: 7584 - DNA, 25 bp, Mus musculus
tctgggcttcctatctaggaacact

SEQ ID NO: 7585 - DNA, 25 bp, Mus musculus
cttcctatctaggaacactgaagat

SEQ ID NO: 7586 - DNA, 25 bp, Mus musculus
tgaagatgctctctggggcaacata

SEQ ID NO: 7587 - DNA, 25 bp, Mus musculus
tgctctctggggcaacatagtatac

SEQ ID NO: 7588 - DNA, 25 bp, Mus musculus
atgtgtgtatcccacaagggtttca

SEQ ID NO: 7589 - DNA, 25 bp, Mus musculus
gtatcccacaagggtttcagaatgg

SEQ ID NO: 7590 - DNA, 25 bp, Mus musculus
taactgcttgaggaggagagggtaa

SEQ ID NO: 7591 - DNA, 25 bp, Mus musculus
cctacactgacatgaaggaagctgg

SEQ ID NO: 7592 - DNA, 25 bp, Mus musculus
gagacaaatacttccatgctcgggg

SEQ ID NO: 7593 - DNA, 25 bp, Mus musculus
gctttcaggaattcttcggcagagg

SEQ ID NO: 7594 - DNA, 25 bp, Mus musculus
tcttcggcagaggacacgaggacac

SEQ ID NO: 7595 - DNA, 25 bp, Mus musculus
gacacgaggacaccatggctgacca

SEQ ID NO: 7596 - DNA, 25 bp, Mus musculus
aggacaccatggctgaccaggaagc

SEQ ID NO: 7597 - DNA, 25 bp, Mus musculus
ccaacagacatggccgcagtggcaa

SEQ ID NO: 7598 - DNA, 25 bp, Mus musculus
gtggcaaagaccccaattactacag

SEQ ID NO: 7599 - DNA, 25 bp, Mus musculus
acctcctggactgcctgccaaatac

SEQ ID NO: 7600 - DNA, 25 bp, Mus musculus
cctggactgcctgccaaatactgag

SEQ ID NO: 7601 - DNA, 25 bp, Mus musculus
ctggactgcctgccaaatactgaga

SEQ ID NO: 7602 - DNA, 25 bp, Mus musculus
tggactgcctgccaaatactgagag

SEQ ID NO: 7603 - DNA, 25 bp, Mus musculus
ggactgcctgccaaatactgagagt

SEQ ID NO: 7604 - DNA, 25 bp, Mus musculus
gactgcctgccaaatactgagagtc

SEQ ID NO: 7605 - DNA, 25 bp, Mus musculus
actgcctgccaaatactgagagtcc

SEQ ID NO: 7606 - DNA, 25 bp, Mus musculus
ctctcaccccagcaggatgaagcta

SEQ ID NO: 7607 - DNA, 25 bp, Mus musculus
tctcaccccagcaggatgaagctac

SEQ ID NO: 7608 - DNA, 25 bp, Mus musculus
tcatttattggggaggctttccaag

SEQ ID NO: 7609 - DNA, 25 bp, Mus musculus
acctcctggactgcctgccaaatac

SEQ ID NO: 7610 - DNA, 25 bp, Mus musculus
cctggactgcctgccaaatactgag

SEQ ID NO: 7611 - DNA, 25 bp, Mus musculus
ctggactgcctgccaaatactgaga

SEQ ID NO: 7612 - DNA, 25 bp, Mus musculus
tggactgcctgccaaatactgagag

SEQ ID NO: 7613 - DNA, 25 bp, Mus musculus
ggactgcctgccaaatactgagagt

SEQ ID NO: 7614 - DNA, 25 bp, Mus musculus
gactgcctgccaaatactgagagtc

SEQ ID NO: 7615 - DNA, 25 bp, Mus musculus
actgcctgccaaatactgagagtcc

SEQ ID NO: 7616 - DNA, 25 bp, Mus musculus
gaccacactaactagggagctagtt

SEQ ID NO: 7617 - DNA, 25 bp, Mus musculus
gaaactcatcctgactctcacccat

SEQ ID NO: 7618 - DNA, 25 bp, Mus musculus
atgctgcctcatggttttcccctct

SEQ ID NO: 7619 - DNA, 25 bp, Mus musculus
cctcatggttttcccctctgacatt

SEQ ID NO: 7620 - DNA, 25 bp, Mus musculus
gatttttctggagatacggggcatc

SEQ ID NO: 7621 - DNA, 25 bp, Mus musculus
gggcatcagcctggacccagttcct

SEQ ID NO: 7622 - DNA, 25 bp, Mus musculus
catcagcctggacccagttcctact

SEQ ID NO: 7623 - DNA, 25 bp, Mus musculus
cagcctggacccagttcctactatg

SEQ ID NO: 7624 - DNA, 25 bp, Mus musculus
ggacccagttcctactatgtatgtg

SEQ ID NO: 7625 - DNA, 25 bp, Mus musculus
cccagttcctactatgtatgtggtt

SEQ ID NO: 7626 - DNA, 25 bp, Mus musculus
agttcctactatgtatgtggtttat

SEQ ID NO: 7627 - DNA, 25 bp, Mus musculus
gtatccaaagggtgctccaaggtca

SEQ ID NO: 7628 - DNA, 25 bp, Mus musculus
gactctcacccatggcagtgtggtg

SEQ ID NO: 7629 - DNA, 25 bp, Mus musculus
cacccatggcagtgtggtgagcact

SEQ ID NO: 7630 - DNA, 25 bp, Mus musculus
gagcactcggacttatgagaaggag

SEQ ID NO: 7631 - DNA, 25 bp, Mus musculus
cactcggacttatgagaaggaggcg

SEQ ID NO: 7632 - DNA, 25 bp, Mus musculus
gtgacctggctgctccgtcactgac

SEQ ID NO: 7633 - DNA, 25 bp, Mus musculus
acctggctgctccgtcactgaccgg

SEQ ID NO: 7634 - DNA, 25 bp, Mus musculus
ctcagcaccatgctgcctcatggtt

SEQ ID NO: 7635 - DNA, 25 bp, Mus musculus
agcaccatgctgcctcatggttttc

SEQ ID NO: 7636 - DNA, 25 bp, Mus musculus
cattgccatcattctttgcatcttg

SEQ ID NO: 7637 - DNA, 25 bp, Mus musculus
tgccatcattctttgcatcttgatc

SEQ ID NO: 7638 - DNA, 25 bp, Mus musculus
tttctcttcctgttgttcccagtca

SEQ ID NO: 7639 - DNA, 25 bp, Mus musculus
ctcttcctgttgttcccagtcatgc

SEQ ID NO: 7640 - DNA, 25 bp, Mus musculus
ttcctgttgttcccagtcatgctcc

SEQ ID NO: 7641 - DNA, 25 bp, Mus musculus
atctggatccctaaacatcccaatg

SEQ ID NO: 7642 - DNA, 25 bp, Mus musculus
tggatccctaaacatcccaatgtgc

SEQ ID NO: 7643 - DNA, 25 bp, Mus musculus
catcccaatgtgctgaataaatact

SEQ ID NO: 7644 - DNA, 25 bp, Mus musculus
aatgcactttgtcgctgtcactgtt

SEQ ID NO: 7645 - DNA, 25 bp, Mus musculus
gcactttgtcgctgtcactgttgtt

SEQ ID NO: 7646 - DNA, 25 bp, Mus musculus
cgctgtcactgttgttttgacagca

SEQ ID NO: 7647 - DNA, 25 bp, Mus musculus
tgtcactgttgttttgacagcacag

SEQ ID NO: 7648 - DNA, 25 bp, Mus musculus
catcttgatcctgggagttgacagc

SEQ ID NO: 7649 - DNA, 25 bp, Mus musculus
tgttttgacagcacagggcagtcac

SEQ ID NO: 7650 - DNA, 25 bp, Mus musculus
taaagtcatcagcgatgccagagag

SEQ ID NO: 7651 - DNA, 25 bp, Mus musculus
agtcatcagcgatgccagagaggct

SEQ ID NO: 7652 - DNA, 25 bp, Mus musculus
cagcgatgccagagaggctgttcag

SEQ ID NO: 7653 - DNA, 25 bp, Mus musculus
gaagttcacgggacatggagcagag

SEQ ID NO: 7654 - DNA, 25 bp, Mus musculus
gttcacgggacatggagcagaggac

SEQ ID NO: 7655 - DNA, 25 bp, Mus musculus
ctcaagagctgaccagtttgccaat

SEQ ID NO: 7656 - DNA, 25 bp, Mus musculus
aagagctgaccagtttgccaatgag

SEQ ID NO: 7657 - DNA, 25 bp, Mus musculus
tgacttcggcttctgtgcccagatc

SEQ ID NO: 7658 - DNA, 25 bp, Mus musculus
cttcggcttctgtgcccagatcact

SEQ ID NO: 7659 - DNA, 25 bp, Mus musculus
ggcatcatggctatcgagatggttg

SEQ ID NO: 7660 - DNA, 25 bp, Mus musculus
atcatggctatcgagatggttgaag

SEQ ID NO: 7661 - DNA, 25 bp, Mus musculus
tacctcaacgaaaatcctctgcggg

SEQ ID NO: 7662 - DNA, 25 bp, Mus musculus
aacgaaaatcctctgcgggcattat

SEQ ID NO: 7663 - DNA, 25 bp, Mus musculus
aatcctctgcgggcattatacctga

SEQ ID NO: 7664 - DNA, 25 bp, Mus musculus
cctctgcgggcattatacctgatag

SEQ ID NO: 7665 - DNA, 25 bp, Mus musculus
gcattatacctgatagctacaaatg

SEQ ID NO: 7666 - DNA, 25 bp, Mus musculus
ttatacctgatagctacaaatggaa

SEQ ID NO: 7667 - DNA, 25 bp, Mus musculus
tacctgatagctacaaatggaactc

SEQ ID NO: 7668 - DNA, 25 bp, Mus musculus
gctacaaatggaactcctgaacttc

SEQ ID NO: 7669 - DNA, 25 bp, Mus musculus
cggcttctgtgcccagatcactcct

SEQ ID NO: 7670 - DNA, 25 bp, Mus musculus
cttctgtgcccagatcactcctgaa

SEQ ID NO: 7671 - DNA, 25 bp, Mus musculus
ctgtgcccagatcactcctgaacag

SEQ ID NO: 7672 - DNA, 25 bp, Mus musculus
tgcccagatcactcctgaacagagc

SEQ ID NO: 7673 - DNA, 25 bp, Mus musculus
caaacgcagtactatggttggaaca

SEQ ID NO: 7674 - DNA, 25 bp, Mus musculus
ctggatggcaccagaggtgtgacac

SEQ ID NO: 7675 - DNA, 25 bp, Mus musculus
tctctgggcatcatggctatcgaga

SEQ ID NO: 7676 - DNA, 25 bp, Mus musculus
ctgggcatcatggctatcgagatgg

SEQ ID NO: 7677 - DNA, 25 bp, Mus musculus
aatacttccatgctcggggaactat

SEQ ID NO: 7678 - DNA, 25 bp, Mus musculus
atacttccatgctcggggaactatg

SEQ ID NO: 7679 - DNA, 25 bp, Mus musculus
caggcattcttcagcagtggacaca

SEQ ID NO: 7680 - DNA, 25 bp, Mus musculus
aggcattcttcagcagtggacacaa

SEQ ID NO: 7681 - DNA, 25 bp, Mus musculus
ggcattcttcagcagtggacacaag

SEQ ID NO: 7682 - DNA, 25 bp, Mus musculus
gcattcttcagcagtggacacaagg

SEQ ID NO: 7683 - DNA, 25 bp, Mus musculus
cattcttcagcagtggacacaagga

SEQ ID NO: 7684 - DNA, 25 bp, Mus musculus
tacttccatgctcggggaactatga

SEQ ID NO: 7685 - DNA, 25 bp, Mus musculus
acttccatgctcggggaactatgat

SEQ ID NO: 7686 - DNA, 25 bp, Mus musculus
cttccatgctcggggaactatgatg

SEQ ID NO: 7687 - DNA, 25 bp, Mus musculus
atgctcggggaactatgatgctgcc

SEQ ID NO: 7688 - DNA, 25 bp, Mus musculus
gggcattcaggcattcttcagcagt

SEQ ID NO: 7689 - DNA, 25 bp, Mus musculus
ggcattcaggcattcttcagcagtg

SEQ ID NO: 7690 - DNA, 25 bp, Mus musculus
gcattcaggcattcttcagcagtgg

SEQ ID NO: 7691 - DNA, 25 bp, Mus musculus
tcaggcattcttcagcagtggacac

SEQ ID NO: 7692 - DNA, 25 bp, Mus musculus
aatacttccatgctcggggaactat

SEQ ID NO: 7693 - DNA, 25 bp, Mus musculus
atacttccatgctcggggaactatg

SEQ ID NO: 7694 - DNA, 25 bp, Mus musculus
gggcattcaggcattcttcagcagt

SEQ ID NO: 7695 - DNA, 25 bp, Mus musculus
ggcattcaggcattcttcagcagtg

SEQ ID NO: 7696 - DNA, 25 bp, Mus musculus
gcattcaggcattcttcagcagtgg

SEQ ID NO: 7697 - DNA, 25 bp, Mus musculus
tcaggcattcttcagcagtggacac

SEQ ID NO: 7698 - DNA, 25 bp, Mus musculus
caggcattcttcagcagtggacaca

SEQ ID NO: 7699 - DNA, 25 bp, Mus musculus
aggcattcttcagcagtggacacaa

SEQ ID NO: 7700 - DNA, 25 bp, Mus musculus
ggcattcttcagcagtggacacaag

SEQ ID NO: 7701 - DNA, 25 bp, Mus musculus
gcattcttcagcagtggacacaagg

SEQ ID NO: 7702 - DNA, 25 bp, Mus musculus
cattcttcagcagtggacacaagga

SEQ ID NO: 7703 - DNA, 25 bp, Mus musculus
tacttccatgctcggggaactatga

SEQ ID NO: 7704 - DNA, 25 bp, Mus musculus
acttccatgctcggggaactatgat

SEQ ID NO: 7705 - DNA, 25 bp, Mus musculus
cttccatgctcggggaactatgatg

SEQ ID NO: 7706 - DNA, 25 bp, Mus musculus
atgctcggggaactatgatgctgcc

SEQ ID NO: 7707 - DNA, 25 bp, Mus musculus
gtatcaggggagcctgggcggctga

SEQ ID NO: 7708 - DNA, 25 bp, Mus musculus
tatcaggggagcctgggcggctgaa

SEQ ID NO: 7709 - DNA, 25 bp, Mus musculus
atcaggggagcctgggcggctgaag

SEQ ID NO: 7710 - DNA, 25 bp, Mus musculus
tcaggggagcctgggcggctgaagt

SEQ ID NO: 7711 - DNA, 25 bp, Mus musculus
gtctgttcaagatcttcaagacaca

SEQ ID NO: 7712 - DNA, 25 bp, Mus musculus
tcaagatcttcaagacacacaagct

SEQ ID NO: 7713 - DNA, 25 bp, Mus musculus
tacaacccactctgctggcatcaaa

SEQ ID NO: 7714 - DNA, 25 bp, Mus musculus
ccactctgctggcatcaaaccactg

SEQ ID NO: 7715 - DNA, 25 bp, Mus musculus
tgctggcatcaaaccactgaggttg

SEQ ID NO: 7716 - DNA, 25 bp, Mus musculus
catcaaaccactgaggttgggagtc

SEQ ID NO: 7717 - DNA, 25 bp, Mus musculus
ctcatctgttgacaatggttcccag

SEQ ID NO: 7718 - DNA, 25 bp, Mus musculus
caatggttcccaggaagcagctgga

SEQ ID NO: 7719 - DNA, 25 bp, Mus musculus
ttcccaggaagcagctggaaaagca

SEQ ID NO: 7720 - DNA, 25 bp, Mus musculus
cagcatgacggccatgctgcagctt

SEQ ID NO: 7721 - DNA, 25 bp, Mus musculus
catgctgcagcttggagagatgctc

SEQ ID NO: 7722 - DNA, 25 bp, Mus musculus
gatgctcttctgtctaacatcccat

SEQ ID NO: 7723 - DNA, 25 bp, Mus musculus
tcttcaagacacacaagcttctagg

SEQ ID NO: 7724 - DNA, 25 bp, Mus musculus
cttctgtctaacatcccattgccca

SEQ ID NO: 7725 - DNA, 25 bp, Mus musculus
agacacacaagcttctaggaccaca

SEQ ID NO: 7726 - DNA, 25 bp, Mus musculus
acaagcttctaggaccacatcaagt

SEQ ID NO: 7727 - DNA, 25 bp, Mus musculus
ttctaggaccacatcaagtccagga

SEQ ID NO: 7728 - DNA, 25 bp, Mus musculus
gaccacatcaagtccaggatctgca

SEQ ID NO: 7729 - DNA, 25 bp, Mus musculus
atcaagtccaggatctgcagagatt

SEQ ID NO: 7730 - DNA, 25 bp, Mus musculus
agagattattgccctagccaaaggt

SEQ ID NO: 7731 - DNA, 25 bp, Mus musculus
caaaggtacaacccactctgctggc

SEQ ID NO: 7732 - DNA, 25 bp, Mus musculus
gtcaagcctgtagcctcggaggaaa

SEQ ID NO: 7733 - DNA, 25 bp, Mus musculus
cctgtagcctcggaggaaacacaag

SEQ ID NO: 7734 - DNA, 25 bp, Mus musculus
aagctcacggtgtcgggctttctag

SEQ ID NO: 7735 - DNA, 25 bp, Mus musculus
ctcacatccagtgaagtggctaccg

SEQ ID NO: 7736 - DNA, 25 bp, Mus musculus
gctaccgaggtgccgttccgcctca

SEQ ID NO: 7737 - DNA, 25 bp, Mus musculus
atgcacccgcagcctgaggatccag

SEQ ID NO: 7738 - DNA, 25 bp, Mus musculus
ccgcagcctgaggatccagcaaaag

SEQ ID NO: 7739 - DNA, 25 bp, Mus musculus
tttgctcgccaaaatctgaaagata

SEQ ID NO: 7740 - DNA, 25 bp, Mus musculus
agacttagcctagatgcctagaaac

SEQ ID NO: 7741 - DNA, 25 bp, Mus musculus
aagcatgagcattcctcccagaaat

SEQ ID NO: 7742 - DNA, 25 bp, Mus musculus
gagcattcctcccagaaataaagtc

SEQ ID NO: 7743 - DNA, 25 bp, Mus musculus
tcctcccagaaataaagtctctggg

SEQ ID NO: 7744 - DNA, 25 bp, Mus musculus
gtgcagccaaacagcactttgacca

SEQ ID NO: 7745 - DNA, 25 bp, Mus musculus
agcactttgaccaagacactggtgc

SEQ ID NO: 7746 - DNA, 25 bp, Mus musculus
ttgaccaagacactggtgctggtgc

SEQ ID NO: 7747 - DNA, 25 bp, Mus musculus
aagacactggtgctggtgcccctac

SEQ ID NO: 7748 - DNA, 25 bp, Mus musculus
ggcatcgcgctggatgggaagatca

SEQ ID NO: 7749 - DNA, 25 bp, Mus musculus
ctggcctccagcaccatcatcaagg

SEQ ID NO: 7750 - DNA, 25 bp, Mus musculus
tccagcaccatcatcaaggagggca

SEQ ID NO: 7751 - DNA, 25 bp, Mus musculus
tcataccatatcaaggtgaagctca

SEQ ID NO: 7752 - DNA, 25 bp, Mus musculus
ccctccaactggcagctggactcgg

SEQ ID NO: 7753 - DNA, 25 bp, Mus musculus
tccaactggcagctggactcgggtc

SEQ ID NO: 7754 - DNA, 25 bp, Mus musculus
actctgaatggcctgagagggatac

SEQ ID NO: 7755 - DNA, 25 bp, Mus musculus
ctcttgacctcacttgcagtaccaa

SEQ ID NO: 7756 - DNA, 25 bp, Mus musculus
acctcacttgcagtaccaaggtgaa

SEQ ID NO: 7757 - DNA, 25 bp, Mus musculus
tcacttgcagtaccaaggtgaagac

SEQ ID NO: 7758 - DNA, 25 bp, Mus musculus
cttgcagtaccaaggtgaagactct

SEQ ID NO: 7759 - DNA, 25 bp, Mus musculus
tgaagactctgctgctaaatgctgc

SEQ ID NO: 7760 - DNA, 25 bp, Mus musculus
agactctgctgctaaatgctgctca

SEQ ID NO: 7761 - DNA, 25 bp, Mus musculus
tgctgctaaatgctgctcagaacac

SEQ ID NO: 7762 - DNA, 25 bp, Mus musculus
ctgctcagaacaccacggagccatg

SEQ ID NO: 7763 - DNA, 25 bp, Mus musculus
agaacaccacggagccatgcctggc

SEQ ID NO: 7764 - DNA, 25 bp, Mus musculus
tccttctaaaggctggtgctgacat

SEQ ID NO: 7765 - DNA, 25 bp, Mus musculus
ttctaaaggctggtgctgacatcca

SEQ ID NO: 7766 - DNA, 25 bp, Mus musculus
ctggtgctgacatccatgcagagaa

SEQ ID NO: 7767 - DNA, 25 bp, Mus musculus
gtgctgacatccatgcagagaatga

SEQ ID NO: 7768 - DNA, 25 bp, Mus musculus
ctgacatccatgcagagaatgagga

SEQ ID NO: 7769 - DNA, 25 bp, Mus musculus
gcgactccgactctgaatggcctga

SEQ ID NO: 7770 - DNA, 25 bp, Mus musculus
actccgactctgaatggcctgagag

SEQ ID NO: 7771 - DNA, 25 bp, Mus musculus
ccgactctgaatggcctgagaggga

SEQ ID NO: 7772 - DNA, 25 bp, Mus musculus
cagaaaaactcacagaccaggtgat

SEQ ID NO: 7773 - DNA, 25 bp, Mus musculus
aactcacagaccaggtgatgcagaa

SEQ ID NO: 7774 - DNA, 25 bp, Mus musculus
acgtcttgacaacgtctctcacact

SEQ ID NO: 7775 - DNA, 25 bp, Mus musculus
gtcttgacaacgtctctcacactcc

SEQ ID NO: 7776 - DNA, 25 bp, Mus musculus
cttgacaacgtctctcacactcctt

SEQ ID NO: 7777 - DNA, 25 bp, Mus musculus
tctctcacactccttctagttacat

SEQ ID NO: 7778 - DNA, 25 bp, Mus musculus
tcacactccttctagttacatagaa

SEQ ID NO: 7779 - DNA, 25 bp, Mus musculus
gaattaatgccctgaagcagctcca

SEQ ID NO: 7780 - DNA, 25 bp, Mus musculus
attaatgccctgaagcagctccagg

SEQ ID NO: 7781 - DNA, 25 bp, Mus musculus
taatgccctgaagcagctccaggtg

SEQ ID NO: 7782 - DNA, 25 bp, Mus musculus
atgccctgaagcagctccaggtgag

SEQ ID NO: 7783 - DNA, 25 bp, Mus musculus
tgaagcagctccaggtgaggtgtgc

SEQ ID NO: 7784 - DNA, 25 bp, Mus musculus
ctcacagaccaggtgatgcagaacc

SEQ ID NO: 7785 - DNA, 25 bp, Mus musculus
gatgcagaacccacaagtgctggca

SEQ ID NO: 7786 - DNA, 25 bp, Mus musculus
cagaacccacaagtgctggcagctt

SEQ ID NO: 7787 - DNA, 25 bp, Mus musculus
gaacccacaagtgctggcagctttg

SEQ ID NO: 7788 - DNA, 25 bp, Mus musculus
acccacaagtgctggcagctttgca

SEQ ID NO: 7789 - DNA, 25 bp, Mus musculus
aagtgctggcagctttgcaggaacg

SEQ ID NO: 7790 - DNA, 25 bp, Mus musculus
agctttgcaggaacgtcttgacaac

SEQ ID NO: 7791 - DNA, 25 bp, Mus musculus
gaacgtcttgacaacgtctctcaca

SEQ ID NO: 7792 - DNA, 25 bp, Mus musculus
gcctatacatcggacaatcaaaagt

SEQ ID NO: 7793 - DNA, 25 bp, Mus musculus
tatacatcggacaatcaaaagtcac

SEQ ID NO: 7794 - DNA, 25 bp, Mus musculus
atgtgctgaccccacaagacattct

SEQ ID NO: 7795 - DNA, 25 bp, Mus musculus
ccccacaagacattctatttgtgta

SEQ ID NO: 7796 - DNA, 25 bp, Mus musculus
cacaagacattctatttgtgtacag

SEQ ID NO: 7797 - DNA, 25 bp, Mus musculus
acattctatttgtgtacagagattc

SEQ ID NO: 7798 - DNA, 25 bp, Mus musculus
tgtacagagattcccctgtcaatcc

SEQ ID NO: 7799 - DNA, 25 bp, Mus musculus
acagagattcccctgtcaatcctaa

SEQ ID NO: 7800 - DNA, 25 bp, Mus musculus
atcttacaacaaaacctcatggaca

SEQ ID NO: 7801 - DNA, 25 bp, Mus musculus
caacaaaacctcatggacatcagat

SEQ ID NO: 7802 - DNA, 25 bp, Mus musculus
cagagttcactctatctggagcttt

SEQ ID NO: 7803 - DNA, 25 bp, Mus musculus
agttcactctatctggagctttttc

SEQ ID NO: 7804 - DNA, 25 bp, Mus musculus
tcacagtccgtggtatggaagaata

SEQ ID NO: 7805 - DNA, 25 bp, Mus musculus
ctccagtacacctatgtaccacttg

SEQ ID NO: 7806 - DNA, 25 bp, Mus musculus
tacacctatgtaccacttgggagtc

SEQ ID NO: 7807 - DNA, 25 bp, Mus musculus
ccacttgggagtcctcctctggcat

SEQ ID NO: 7808 - DNA, 25 bp, Mus musculus
cacccagtatagtcctgcgacagga

SEQ ID NO: 7809 - DNA, 25 bp, Mus musculus
gtatagtcctgcgacaggagcagga

SEQ ID NO: 7810 - DNA, 25 bp, Mus musculus
tcctgcgacaggagcaggataacta

SEQ ID NO: 7811 - DNA, 25 bp, Mus musculus
actatgtgctgaccccacaagacat

SEQ ID NO: 7812 - DNA, 25 bp, Mus musculus
taatgagttcactccttggataagg

SEQ ID NO: 7813 - DNA, 25 bp, Mus musculus
aatcagctcttactggacccagctg

SEQ ID NO: 7814 - DNA, 25 bp, Mus musculus
tagtaactgtccatcgtggacttga

SEQ ID NO: 7815 - DNA, 25 bp, Mus musculus
ctgtccatcgtggacttgacatgtg

SEQ ID NO: 7816 - DNA, 25 bp, Mus musculus
gcctatgtcccagatgacgttgtta

SEQ ID NO: 7817 - DNA, 25 bp, Mus musculus
gtcccagatgacgttgttaatctac

SEQ ID NO: 7818 - DNA, 25 bp, Mus musculus
aatctacatcattctcagaggttga

SEQ ID NO: 7819 - DNA, 25 bp, Mus musculus
tgtatactcactgctatgaaaacat

SEQ ID NO: 7820 - DNA, 25 bp, Mus musculus
ctcactgctatgaaaacatgcagga

SEQ ID NO: 7821 - DNA, 25 bp, Mus musculus
tgcaggactccgtttccttccttgg

SEQ ID NO: 7822 - DNA, 25 bp, Mus musculus
cctttattatgtgcaactgtagtta

SEQ ID NO: 7823 - DNA, 25 bp, Mus musculus
atttctactcatctgaggttgtgtt

SEQ ID NO: 7824 - DNA, 25 bp, Mus musculus
ctcttactggacccagctgtcaaca

SEQ ID NO: 7825 - DNA, 25 bp, Mus musculus
ctggacccagctgtcaacactgttg

SEQ ID NO: 7826 - DNA, 25 bp, Mus musculus
taagtttccaacccatgacttatgg

SEQ ID NO: 7827 - DNA, 25 bp, Mus musculus
attcaaaccgtagcactgggcattt

SEQ ID NO: 7828 - DNA, 25 bp, Mus musculus
gcactgggcatttcgcctaacaata

SEQ ID NO: 7829 - DNA, 25 bp, Mus musculus
ggcatttcgcctaacaatactgtga

SEQ ID NO: 7830 - DNA, 25 bp, Mus musculus
gggatcctctgcagaggagtattta

SEQ ID NO: 7831 - DNA, 25 bp, Mus musculus
gtatttaagtcctgcacatttttgt

SEQ ID NO: 7832 - DNA, 25 bp, Mus musculus
ttgtcctaccacattccttttctcg

SEQ ID NO: 7833 - DNA, 25 bp, Mus musculus
tgtcctaccacattccttttctcgt

SEQ ID NO: 7834 - DNA, 25 bp, Mus musculus
acattccttttctcgtgagctccat

SEQ ID NO: 7835 - DNA, 25 bp, Mus musculus
tccttttctcgtgagctccattgag

SEQ ID NO: 7836 - DNA, 25 bp, Mus musculus
ccttttctcgtgagctccattgagg

SEQ ID NO: 7837 - DNA, 25 bp, Mus musculus
ctgtcatcagctgctggattaccat

SEQ ID NO: 7838 - DNA, 25 bp, Mus musculus
gtcatcagctgctggattaccatgc

SEQ ID NO: 7839 - DNA, 25 bp, Mus musculus
tcatcagctgctggattaccatgcg

SEQ ID NO: 7840 - DNA, 25 bp, Mus musculus
catcagctgctggattaccatgcga

SEQ ID NO: 7841 - DNA, 25 bp, Mus musculus
atcagctgctggattaccatgcgag

SEQ ID NO: 7842 - DNA, 25 bp, Mus musculus
aatataagatccgcttgcctcctga

SEQ ID NO: 7843 - DNA, 25 bp, Mus musculus
atataagatccgcttgcctcctgat

SEQ ID NO: 7844 - DNA, 25 bp, Mus musculus
gtcctaccacattccttttctcgtg

SEQ ID NO: 7845 - DNA, 25 bp, Mus musculus
tataagatccgcttgcctcctgatg

SEQ ID NO: 7846 - DNA, 25 bp, Mus musculus
tcctaccacattccttttctcgtga

SEQ ID NO: 7847 - DNA, 25 bp, Mus musculus
cctaccacattccttttctcgtgag

SEQ ID NO: 7848 - DNA, 25 bp, Mus musculus
ctaccacattccttttctcgtgagc

SEQ ID NO: 7849 - DNA, 25 bp, Mus musculus
taccacattccttttctcgtgagct

SEQ ID NO: 7850 - DNA, 25 bp, Mus musculus
accacattccttttctcgtgagctc

SEQ ID NO: 7851 - DNA, 25 bp, Mus musculus
ccacattccttttctcgtgagctcc

SEQ ID NO: 7852 - DNA, 25 bp, Mus musculus
cacattccttttctcgtgagctcca

SEQ ID NO: 7853 - DNA, 25 bp, Mus musculus
gaaggtcctgggcatactggccatg

SEQ ID NO: 7854 - DNA, 25 bp, Mus musculus
cctgggcatactggccatgatcgac

SEQ ID NO: 7855 - DNA, 25 bp, Mus musculus
ggacgatccagacgcagccaattac

SEQ ID NO: 7856 - DNA, 25 bp, Mus musculus
cgatccagacgcagccaattaccat

SEQ ID NO: 7857 - DNA, 25 bp, Mus musculus
tccagacgcagccaattaccatgat

SEQ ID NO: 7858 - DNA, 25 bp, Mus musculus
agacgcagccaattaccatgatatt

SEQ ID NO: 7859 - DNA, 25 bp, Mus musculus
cgcagccaattaccatgatatttct

SEQ ID NO: 7860 - DNA, 25 bp, Mus musculus
agccaattaccatgatatttctgat

SEQ ID NO: 7861 - DNA, 25 bp, Mus musculus
caattaccatgatatttctgatgtg

SEQ ID NO: 7862 - DNA, 25 bp, Mus musculus
ttaccatgatatttctgatgtggaa

SEQ ID NO: 7863 - DNA, 25 bp, Mus musculus
tatttctgatgtggaacggctgaaa

SEQ ID NO: 7864 - DNA, 25 bp, Mus musculus
gctgaaacccggctacttagaagct

SEQ ID NO: 7865 - DNA, 25 bp, Mus musculus
gggcatactggccatgatcgacgag

SEQ ID NO: 7866 - DNA, 25 bp, Mus musculus
catactggccatgatcgacgagggt

SEQ ID NO: 7867 - DNA, 25 bp, Mus musculus
actggccatgatcgacgagggtgag

SEQ ID NO: 7868 - DNA, 25 bp, Mus musculus
ggccatgatcgacgagggtgagacc

SEQ ID NO: 7869 - DNA, 25 bp, Mus musculus
catgatcgacgagggtgagaccgac

SEQ ID NO: 7870 - DNA, 25 bp, Mus musculus
ggtcattgccattaatgtggacgat

SEQ ID NO: 7871 - DNA, 25 bp, Mus musculus
cattgccattaatgtggacgatcca

SEQ ID NO: 7872 - DNA, 25 bp, Mus musculus
tgtggacgatccagacgcagccaat

SEQ ID NO: 7873 - DNA, 25 bp, Mus musculus
attccaagaacaatatctgtacaaa

SEQ ID NO: 7874 - DNA, 25 bp, Mus musculus
atgaacataaccacagagagaatcc

SEQ ID NO: 7875 - DNA, 25 bp, Mus musculus
tgcctcagtctgtgtacatagcacg

SEQ ID NO: 7876 - DNA, 25 bp, Mus musculus
tgtacatagcacgccatgtctgtgg

SEQ ID NO: 7877 - DNA, 25 bp, Mus musculus
tagcacgccatgtctgtgggcaagc

SEQ ID NO: 7878 - DNA, 25 bp, Mus musculus
cccagcactttgcgtcagtgtcgta

SEQ ID NO: 7879 - DNA, 25 bp, Mus musculus
actttgcgtcagtgtcgtactgtat

SEQ ID NO: 7880 - DNA, 25 bp, Mus musculus
cgtcagtgtcgtactgtatgtaatg

SEQ ID NO: 7881 - DNA, 25 bp, Mus musculus
atttgtacagcctataggccaacac

SEQ ID NO: 7882 - DNA, 25 bp, Mus musculus
acagcctataggccaacactgcggg

SEQ ID NO: 7883 - DNA, 25 bp, Mus musculus
tataggccaacactgcgggcgtgtg

SEQ ID NO: 7884 - DNA, 25 bp, Mus musculus
ccaacactgcgggcgtgtgactctt

SEQ ID NO: 7885 - DNA, 25 bp, Mus musculus
ccacccttcaagaataattcatgtt

SEQ ID NO: 7886 - DNA, 25 bp, Mus musculus
caagggcacagcaactagagtgagc

SEQ ID NO: 7887 - DNA, 25 bp, Mus musculus
ctagccgtacttgggatcccagtgg

SEQ ID NO: 7888 - DNA, 25 bp, Mus musculus
gtacttgggatcccagtggtacatg

SEQ ID NO: 7889 - DNA, 25 bp, Mus musculus
gggatcccagtggtacatgaccctc

SEQ ID NO: 7890 - DNA, 25 bp, Mus musculus
gaccctctgccgaaggcttgcctca

SEQ ID NO: 7891 - DNA, 25 bp, Mus musculus
ctgccgaaggcttgcctcagtctgt

SEQ ID NO: 7892 - DNA, 25 bp, Mus musculus
aaggcttgcctcagtctgtgtacat

SEQ ID NO: 7893 - DNA, 25 bp, Mus musculus
gaagaaccatcactgcaagctgacc

SEQ ID NO: 7894 - DNA, 25 bp, Mus musculus
agaaccatcactgcaagctgaccca

SEQ ID NO: 7895 - DNA, 25 bp, Mus musculus
tgcagcacatttgagcagtggttta

SEQ ID NO: 7896 - DNA, 25 bp, Mus musculus
ttaatagctcggtttgccatgaccg

SEQ ID NO: 7897 - DNA, 25 bp, Mus musculus
aatagctcggtttgccatgaccggc

SEQ ID NO: 7898 - DNA, 25 bp, Mus musculus
aaaccattttgatcatcaggcgtca

SEQ ID NO: 7899 - DNA, 25 bp, Mus musculus
cattttgatcatcaggcgtcaacaa

SEQ ID NO: 7900 - DNA, 25 bp, Mus musculus
ttttgatcatcaggcgtcaacaaca

SEQ ID NO: 7901 - DNA, 25 bp, Mus musculus
ttgatcatcaggcgtcaacaacaag

SEQ ID NO: 7902 - DNA, 25 bp, Mus musculus
gatcatcaggcgtcaacaacaaggt

SEQ ID NO: 7903 - DNA, 25 bp, Mus musculus
tcatcaggcgtcaacaacaaggtgt

SEQ ID NO: 7904 - DNA, 25 bp, Mus musculus
caggcgtcaacaacaaggtgttgag

SEQ ID NO: 7905 - DNA, 25 bp, Mus musculus
aagctgacccaggtcctgaacacac

SEQ ID NO: 7906 - DNA, 25 bp, Mus musculus
cacacactacgtggcccccagaagg

SEQ ID NO: 7907 - DNA, 25 bp, Mus musculus
cacactacgtggcccccagaaggat

SEQ ID NO: 7908 - DNA, 25 bp, Mus musculus
ggcccccagaaggatccttctgact

SEQ ID NO: 7909 - DNA, 25 bp, Mus musculus
actgggaccccgctgcagaataagc

SEQ ID NO: 7910 - DNA, 25 bp, Mus musculus
ctgcagaataagctccccgaactct

SEQ ID NO: 7911 - DNA, 25 bp, Mus musculus
cctccctacaatcttcaagagttgc

SEQ ID NO: 7912 - DNA, 25 bp, Mus musculus
gttgcagcacatttgagcagtggtt

SEQ ID NO: 7913 - DNA, 25 bp, Mus musculus
gggccttcagcatgtacgacctgga

SEQ ID NO: 7914 - DNA, 25 bp, Mus musculus
tgtacgacctggacggcaacggcta

SEQ ID NO: 7915 - DNA, 25 bp, Mus musculus
atgaagatgcccgaggatgagtcca

SEQ ID NO: 7916 - DNA, 25 bp, Mus musculus
aagatgcccgaggatgagtccacac

SEQ ID NO: 7917 - DNA, 25 bp, Mus musculus
cgaacagacaagatcttcaggcaga

SEQ ID NO: 7918 - DNA, 25 bp, Mus musculus
aagatcttcaggcagatggacacaa

SEQ ID NO: 7919 - DNA, 25 bp, Mus musculus
atcttcaggcagatggacacaaaca

SEQ ID NO: 7920 - DNA, 25 bp, Mus musculus
gatggcaaactgtccctggaagaat

SEQ ID NO: 7921 - DNA, 25 bp, Mus musculus
aaactgtccctggaagaattcatca

SEQ ID NO: 7922 - DNA, 25 bp, Mus musculus
aggtgccaagagcgacccgtccatt

SEQ ID NO: 7923 - DNA, 25 bp, Mus musculus
tgccaagagcgacccgtccattgtc

SEQ ID NO: 7924 - DNA, 25 bp, Mus musculus
cgacccgtccattgtccggttgctg

SEQ ID NO: 7925 - DNA, 25 bp, Mus musculus
acgacctggacggcaacggctacat

SEQ ID NO: 7926 - DNA, 25 bp, Mus musculus
gcaacggctacatcagccgcagtga

SEQ ID NO: 7927 - DNA, 25 bp, Mus musculus
acggctacatcagccgcagtgaaat

SEQ ID NO: 7928 - DNA, 25 bp, Mus musculus
acatcagccgcagtgaaatgctgga

SEQ ID NO: 7929 - DNA, 25 bp, Mus musculus
tcagccgcagtgaaatgctggagat

SEQ ID NO: 7930 - DNA, 25 bp, Mus musculus
agattgtccaggccatctacaagat

SEQ ID NO: 7931 - DNA, 25 bp, Mus musculus
tccaggccatctacaagatggtgtc

SEQ ID NO: 7932 - DNA, 25 bp, Mus musculus
tggtgtcctcccgtgatgaagatgc

SEQ ID NO: 7933 - DNA, 25 bp, Mus musculus
tcggtatacgcttttccagctcaag

SEQ ID NO: 7934 - DNA, 25 bp, Mus musculus
tacgcttttccagctcaagaggttt

SEQ ID NO: 7935 - DNA, 25 bp, Mus musculus
gggctccgtttaccacagactggct

SEQ ID NO: 7936 - DNA, 25 bp, Mus musculus
ctccgtttaccacagactggcttgg

SEQ ID NO: 7937 - DNA, 25 bp, Mus musculus
cagactggcttggaacctcaccact

SEQ ID NO: 7938 - DNA, 25 bp, Mus musculus
actggcttggaacctcaccacttca

SEQ ID NO: 7939 - DNA, 25 bp, Mus musculus
ttggaacctcaccacttcaccttgc

SEQ ID NO: 7940 - DNA, 25 bp, Mus musculus
cacttcaccttgcagcccagtatgg

SEQ ID NO: 7941 - DNA, 25 bp, Mus musculus
ttcaccttgcagcccagtatggtca

SEQ ID NO: 7942 - DNA, 25 bp, Mus musculus
accttgcagcccagtatggtcacta

SEQ ID NO: 7943 - DNA, 25 bp, Mus musculus
cagcccagtatggtcactattccac

SEQ ID NO: 7944 - DNA, 25 bp, Mus musculus
agtatggtcactattccacagcaga

SEQ ID NO: 7945 - DNA, 25 bp, Mus musculus
gcttttccagctcaagaggttttca

SEQ ID NO: 7946 - DNA, 25 bp, Mus musculus
tttccagctcaagaggttttcagta

SEQ ID NO: 7947 - DNA, 25 bp, Mus musculus
aaatcagactcagagctacctggaa

SEQ ID NO: 7948 - DNA, 25 bp, Mus musculus
tcagactcagagctacctggaaact

SEQ ID NO: 7949 - DNA, 25 bp, Mus musculus
gactcagagctacctggaaacttct

SEQ ID NO: 7950 - DNA, 25 bp, Mus musculus
cctggaaacttctgtctctatgcat

SEQ ID NO: 7951 - DNA, 25 bp, Mus musculus
aacttctgtctctatgcataaagat

SEQ ID NO: 7952 - DNA, 25 bp, Mus musculus
tgtctctatgcataaagatgtctct

SEQ ID NO: 7953 - DNA, 25 bp, Mus musculus
gaaccttcagcttcagccgggcaaa

SEQ ID NO: 7954 - DNA, 25 bp, Mus musculus
tcagcttcagccgggcaaagctaag

SEQ ID NO: 7955 - DNA, 25 bp, Mus musculus
taacataggcctccctgcctgcact

SEQ ID NO: 7956 - DNA, 25 bp, Mus musculus
ctgcactgctgctttgaggacttgc

SEQ ID NO: 7957 - DNA, 25 bp, Mus musculus
tgctgctttgaggacttgcattctg

SEQ ID NO: 7958 - DNA, 25 bp, Mus musculus
tttgaggacttgcattctgactgtg

SEQ ID NO: 7959 - DNA, 25 bp, Mus musculus
cattctgactgtgcttgatgaagct

SEQ ID NO: 7960 - DNA, 25 bp, Mus musculus
ttggacactcggtgtgacatttctc

SEQ ID NO: 7961 - DNA, 25 bp, Mus musculus
tagtgcctcacactcaattacctgc

SEQ ID NO: 7962 - DNA, 25 bp, Mus musculus
ctcacactcaattacctgcatcagt

SEQ ID NO: 7963 - DNA, 25 bp, Mus musculus
tacctgcatcagtttctcactaata

SEQ ID NO: 7964 - DNA, 25 bp, Mus musculus
catcagtttctcactaatagttcct

SEQ ID NO: 7965 - DNA, 25 bp, Mus musculus
ccctttggcaacctcaggacatcaa

SEQ ID NO: 7966 - DNA, 25 bp, Mus musculus
ggcaacctcaggacatcaagatgag

SEQ ID NO: 7967 - DNA, 25 bp, Mus musculus
gatccacgtctcgtcgtcagggctt

SEQ ID NO: 7968 - DNA, 25 bp, Mus musculus
cgtctcgtcgtcagggcttagactg

SEQ ID NO: 7969 - DNA, 25 bp, Mus musculus
gtcgtcagggcttagactgacacct

SEQ ID NO: 7970 - DNA, 25 bp, Mus musculus
gttgctaattgggctgtggtcaatt

SEQ ID NO: 7971 - DNA, 25 bp, Mus musculus
aattgggctgtggtcaattgtgttt

SEQ ID NO: 7972 - DNA, 25 bp, Mus musculus
gtcaattgtgtttccccgaaggctg

SEQ ID NO: 7973 - DNA, 25 bp, Mus musculus
cttctttgcagacagaagcaactgt

SEQ ID NO: 7974 - DNA, 25 bp, Mus musculus
aagcaactgtgctcaaaatagaaac

SEQ ID NO: 7975 - DNA, 25 bp, Mus musculus
ttctgctgcagaactcagattcctg

SEQ ID NO: 7976 - DNA, 25 bp, Mus musculus
tgcagaactcagattcctgtgaaca

SEQ ID NO: 7977 - DNA, 25 bp, Mus musculus
actcagattcctgtgaacatagttc

SEQ ID NO: 7978 - DNA, 25 bp, Mus musculus
cagattcctgtgaacatagttcttc

SEQ ID NO: 7979 - DNA, 25 bp, Mus musculus
aacatagttcttcacacagcaagaa

SEQ ID NO: 7980 - DNA, 25 bp, Mus musculus
atagttcttcacacagcaagaagga

SEQ ID NO: 7981 - DNA, 25 bp, Mus musculus
cttcacacagcaagaaggacaaagt

SEQ ID NO: 7982 - DNA, 25 bp, Mus musculus
tagtaacttgccagagggtgagcca

SEQ ID NO: 7983 - DNA, 25 bp, Mus musculus
taacttgccagagggtgagccaaga

SEQ ID NO: 7984 - DNA, 25 bp, Mus musculus
cttgccagagggtgagccaagaaga

SEQ ID NO: 7985 - DNA, 25 bp, Mus musculus
tccgaatcccacagttaaacaagat

SEQ ID NO: 7986 - DNA, 25 bp, Mus musculus
gaatcccacagttaaacaagatgtg

SEQ ID NO: 7987 - DNA, 25 bp, Mus musculus
tcccacagttaaacaagatgtgcaa

SEQ ID NO: 7988 - DNA, 25 bp, Mus musculus
gcaaaggactcgctggtctgccggc

SEQ ID NO: 7989 - DNA, 25 bp, Mus musculus
aaggactcgctggtctgccggcttc

SEQ ID NO: 7990 - DNA, 25 bp, Mus musculus
cctgcctgaggagcgcaaaggatat

SEQ ID NO: 7991 - DNA, 25 bp, Mus musculus
tgaaacatcggctgggatttctgct

SEQ ID NO: 7992 - DNA, 25 bp, Mus musculus
atcggctgggatttctgctgcagaa

SEQ ID NO: 7993 - DNA, 25 bp, Mus musculus
ccatgcccaagccaagacagcgaca

SEQ ID NO: 7994 - DNA, 25 bp, Mus musculus
agccaagacagcgacaggagactcc

SEQ ID NO: 7995 - DNA, 25 bp, Mus musculus
gacggcccggcacactagagatcat

SEQ ID NO: 7996 - DNA, 25 bp, Mus musculus
ggcccggcacactagagatcatctg

SEQ ID NO: 7997 - DNA, 25 bp, Mus musculus
ccggcacactagagatcatctgtac

SEQ ID NO: 7998 - DNA, 25 bp, Mus musculus
gcacactagagatcatctgtacgaa

SEQ ID NO: 7999 - DNA, 25 bp, Mus musculus
agatcatctgtacgaattggccctg

SEQ ID NO: 8000 - DNA, 25 bp, Mus musculus
tcatctgtacgaattggccctgcgt

SEQ ID NO: 8001 - DNA, 25 bp, Mus musculus
tctgtacgaattggccctgcgttcc

SEQ ID NO: 8002 - DNA, 25 bp, Mus musculus
cgaattggccctgcgttccgaatct

SEQ ID NO: 8003 - DNA, 25 bp, Mus musculus
attggccctgcgttccgaatctgga

SEQ ID NO: 8004 - DNA, 25 bp, Mus musculus
ttccgaatctggaggagatgcatgg

SEQ ID NO: 8005 - DNA, 25 bp, Mus musculus
aggagactccttcattcagacccag

SEQ ID NO: 8006 - DNA, 25 bp, Mus musculus
ccagcagctccatgcaaccatgctg

SEQ ID NO: 8007 - DNA, 25 bp, Mus musculus
gctccatgcaaccatgctgacacct

SEQ ID NO: 8008 - DNA, 25 bp, Mus musculus
aaccatgctgacaccttcctggaac

SEQ ID NO: 8009 - DNA, 25 bp, Mus musculus
tgccacctagacattgactccgcag

SEQ ID NO: 8010 - DNA, 25 bp, Mus musculus
cacctagacattgactccgcagcgc

SEQ ID NO: 8011 - DNA, 25 bp, Mus musculus
ctagacattgactccgcagcgcatg

SEQ ID NO: 8012 - DNA, 25 bp, Mus musculus
gacattgactccgcagcgcatgacg

SEQ ID NO: 8013 - DNA, 25 bp, Mus musculus
agccactgaattgctatgttatcct

SEQ ID NO: 8014 - DNA, 25 bp, Mus musculus
gtatctgacagtctcacatctcaac

SEQ ID NO: 8015 - DNA, 25 bp, Mus musculus
gtttagtctacattgctcttcccag

SEQ ID NO: 8016 - DNA, 25 bp, Mus musculus
tctacattgctcttcccagagactg

SEQ ID NO: 8017 - DNA, 25 bp, Mus musculus
ttgctcttcccagagactgacagat

SEQ ID NO: 8018 - DNA, 25 bp, Mus musculus
ttcccagagactgacagatatgacc

SEQ ID NO: 8019 - DNA, 25 bp, Mus musculus
aagtgcaagactacctacccactgc

SEQ ID NO: 8020 - DNA, 25 bp, Mus musculus
acctacccactgccatgaaaaccat

SEQ ID NO: 8021 - DNA, 25 bp, Mus musculus
ccactgccatgaaaaccattgcagg

SEQ ID NO: 8022 - DNA, 25 bp, Mus musculus
ttaatatcaactcttgaagcctact

SEQ ID NO: 8023 - DNA, 25 bp, Mus musculus
tcaactcttgaagcctacttgtact

SEQ ID NO: 8024 - DNA, 25 bp, Mus musculus
cttgaagcctacttgtactgattga

SEQ ID NO: 8025 - DNA, 25 bp, Mus musculus
agtgtccatagcatcagctcaggag

SEQ ID NO: 8026 - DNA, 25 bp, Mus musculus
taatactgacctactacttcaaggg

SEQ ID NO: 8027 - DNA, 25 bp, Mus musculus
actacttcaagggcagttctgaggt

SEQ ID NO: 8028 - DNA, 25 bp, Mus musculus
tcaagggcagttctgaggtgattag

SEQ ID NO: 8029 - DNA, 25 bp, Mus musculus
atcctcagcagaggtattcatacag

SEQ ID NO: 8030 - DNA, 25 bp, Mus musculus
ggtattcatacagactcccaaagaa

SEQ ID NO: 8031 - DNA, 25 bp, Mus musculus
catacagactcccaaagaactatat

SEQ ID NO: 8032 - DNA, 25 bp, Mus musculus
tatgttcctgagaccatcgtttagt

SEQ ID NO: 8033 - DNA, 25 bp, Mus musculus
gcaactggctgcatggggacattcg

SEQ ID NO: 8034 - DNA, 25 bp, Mus musculus
acattcggcagtatgacatctctaa

SEQ ID NO: 8035 - DNA, 25 bp, Mus musculus
cagcactggctcacgagcttcgtta

SEQ ID NO: 8036 - DNA, 25 bp, Mus musculus
actgcagttctgacatctggatctg

SEQ ID NO: 8037 - DNA, 25 bp, Mus musculus
gttctgacatctggatctgaaggct

SEQ ID NO: 8038 - DNA, 25 bp, Mus musculus
acatctggatctgaaggctcgcact

SEQ ID NO: 8039 - DNA, 25 bp, Mus musculus
tccacattctgagcctgcctggctt

SEQ ID NO: 8040 - DNA, 25 bp, Mus musculus
ttctgagcctgcctggcttcactct

SEQ ID NO: 8041 - DNA, 25 bp, Mus musculus
caactctccaaggccactctgagac

SEQ ID NO: 8042 - DNA, 25 bp, Mus musculus
tccaaggccactctgagaccagcga

SEQ ID NO: 8043 - DNA, 25 bp, Mus musculus
ctgagaccagcgagatctgtagagc

SEQ ID NO: 8044 - DNA, 25 bp, Mus musculus
cagcatctctgtaccgttgcttgtt

SEQ ID NO: 8045 - DNA, 25 bp, Mus musculus
atgacatctctaacccacagaagcc

SEQ ID NO: 8046 - DNA, 25 bp, Mus musculus
tcgctgggcagatcttccttggggg

SEQ ID NO: 8047 - DNA, 25 bp, Mus musculus
taacctgtcagccggagcccctagt

SEQ ID NO: 8048 - DNA, 25 bp, Mus musculus
gtcagccggagcccctagtggtcaa

SEQ ID NO: 8049 - DNA, 25 bp, Mus musculus
atggcaagcgtctttacgccactac

SEQ ID NO: 8050 - DNA, 25 bp, Mus musculus
agcgtctttacgccactacatcact

SEQ ID NO: 8051 - DNA, 25 bp, Mus musculus
tttacgccactacatcactatacag

SEQ ID NO: 8052 - DNA, 25 bp, Mus musculus
ttggcgcagcactggctcacgagct

SEQ ID NO: 8053 - DNA, 25 bp, Mus musculus
ctctttgattaactgggatgatctc

SEQ ID NO: 8054 - DNA, 25 bp, Mus musculus
ttaacccaaatgtgagcgggcccag

SEQ ID NO: 8055 - DNA, 25 bp, Mus musculus
agtgaccttcggcactttgatcccg

SEQ ID NO: 8056 - DNA, 25 bp, Mus musculus
gtgaccttcggcactttgatcccga

SEQ ID NO: 8057 - DNA, 25 bp, Mus musculus
gaccttcggcactttgatcccgagt

SEQ ID NO: 8058 - DNA, 25 bp, Mus musculus
gagccggtctccagctctatatggc

SEQ ID NO: 8059 - DNA, 25 bp, Mus musculus
agccggtctccagctctatatggcg

SEQ ID NO: 8060 - DNA, 25 bp, Mus musculus
gccggtctccagctctatatggcga

SEQ ID NO: 8061 - DNA, 25 bp, Mus musculus
ccggtctccagctctatatggcgag

SEQ ID NO: 8062 - DNA, 25 bp, Mus musculus
cggtctccagctctatatggcgaga

SEQ ID NO: 8063 - DNA, 25 bp, Mus musculus
ggtctccagctctatatggcgagat

SEQ ID NO: 8064 - DNA, 25 bp, Mus musculus
tctccagctctatatggcgagatcc

SEQ ID NO: 8065 - DNA, 25 bp, Mus musculus
taacccaaatgtgagcgggcccagt

SEQ ID NO: 8066 - DNA, 25 bp, Mus musculus
ctccagctctatatggcgagatcct

SEQ ID NO: 8067 - DNA, 25 bp, Mus musculus
ccaaatgtgagcgggcccagtgacc

SEQ ID NO: 8068 - DNA, 25 bp, Mus musculus
caaatgtgagcgggcccagtgacct

SEQ ID NO: 8069 - DNA, 25 bp, Mus musculus
aatgtgagcgggcccagtgaccttc

SEQ ID NO: 8070 - DNA, 25 bp, Mus musculus
ggcccagtgaccttcggcactttga

SEQ ID NO: 8071 - DNA, 25 bp, Mus musculus
gcccagtgaccttcggcactttgat

SEQ ID NO: 8072 - DNA, 25 bp, Mus musculus
cccagtgaccttcggcactttgatc

SEQ ID NO: 8073 - DNA, 25 bp, Mus musculus
ccagtgaccttcggcactttgatcc

SEQ ID NO: 8074 - DNA, 25 bp, Mus musculus
atagagacgctgcagcgccggatcg

SEQ ID NO: 8075 - DNA, 25 bp, Mus musculus
tccttggtggaccagacaagtggtg

SEQ ID NO: 8076 - DNA, 25 bp, Mus musculus
ctggctggactgcctcttgagaagc

SEQ ID NO: 8077 - DNA, 25 bp, Mus musculus
ctgcctcttgagaagcgaagtttgg

SEQ ID NO: 8078 - DNA, 25 bp, Mus musculus
cacgtgcctaattggcacctccttt

SEQ ID NO: 8079 - DNA, 25 bp, Mus musculus
gtgcctaattggcacctcctttcct

SEQ ID NO: 8080 - DNA, 25 bp, Mus musculus
gagagactgctctgcgttcttgaca

SEQ ID NO: 8081 - DNA, 25 bp, Mus musculus
ctctgcgttcttgacaatgctattt

SEQ ID NO: 8082 - DNA, 25 bp, Mus musculus
tgcgttcttgacaatgctattttca

SEQ ID NO: 8083 - DNA, 25 bp, Mus musculus
attttctacattatgggactcaaat

SEQ ID NO: 8084 - DNA, 25 bp, Mus musculus
ttctacattatgggactcaaattct

SEQ ID NO: 8085 - DNA, 25 bp, Mus musculus
ttatgaccttaacagatctgatttt

SEQ ID NO: 8086 - DNA, 25 bp, Mus musculus
agcgcccgagtctatgagaacgtgg

SEQ ID NO: 8087 - DNA, 25 bp, Mus musculus
ctttctctctctttggggaatcatg

SEQ ID NO: 8088 - DNA, 25 bp, Mus musculus
ctcatgcagcagcagaggagtttca

SEQ ID NO: 8089 - DNA, 25 bp, Mus musculus
ttcagatgagcccacggcgacagaa

SEQ ID NO: 8090 - DNA, 25 bp, Mus musculus
agatgagcccacggcgacagaacgc

SEQ ID NO: 8091 - DNA, 25 bp, Mus musculus
tgagcccacggcgacagaacgcaga

SEQ ID NO: 8092 - DNA, 25 bp, Mus musculus
tagacgagcgttcccaggacccgtg

SEQ ID NO: 8093 - DNA, 25 bp, Mus musculus
gttcagaagccggcactggctggac

SEQ ID NO: 8094 - DNA, 25 bp, Mus musculus
cagaagccggcactggctggactgc

SEQ ID NO: 8095 - DNA, 25 bp, Mus musculus
cctgcagcctggtagcactggctgc

SEQ ID NO: 8096 - DNA, 25 bp, Mus musculus
gcagcctggtagcactggctgctac

SEQ ID NO: 8097 - DNA, 25 bp, Mus musculus
agatttgcgccagatcctgctccaa

SEQ ID NO: 8098 - DNA, 25 bp, Mus musculus
gatttgcgccagatcctgctccaaa

SEQ ID NO: 8099 - DNA, 25 bp, Mus musculus
tttgcgccagatcctgctccaaatc

SEQ ID NO: 8100 - DNA, 25 bp, Mus musculus
ttgcgccagatcctgctccaaatcc

SEQ ID NO: 8101 - DNA, 25 bp, Mus musculus
ccagatcctgctccaaatcccggta

SEQ ID NO: 8102 - DNA, 25 bp, Mus musculus
agatcctgctccaaatcccggtagc

SEQ ID NO: 8103 - DNA, 25 bp, Mus musculus
gatcctgctccaaatcccggtagcc

SEQ ID NO: 8104 - DNA, 25 bp, Mus musculus
atcctgctccaaatcccggtagccg

SEQ ID NO: 8105 - DNA, 25 bp, Mus musculus
ctgctccaaatcccggtagccggat

SEQ ID NO: 8106 - DNA, 25 bp, Mus musculus
tgctccaaatcccggtagccggatt

SEQ ID NO: 8107 - DNA, 25 bp, Mus musculus
cagcctggtagcactggctgctact

SEQ ID NO: 8108 - DNA, 25 bp, Mus musculus
agcctggtagcactggctgctactt

SEQ ID NO: 8109 - DNA, 25 bp, Mus musculus
gcctggtagcactggctgctacttc

SEQ ID NO: 8110 - DNA, 25 bp, Mus musculus
ggtagcactggctgctacttcagct

SEQ ID NO: 8111 - DNA, 25 bp, Mus musculus
gtagcactggctgctacttcagctt

SEQ ID NO: 8112 - DNA, 25 bp, Mus musculus
tagcactggctgctacttcagcttc

SEQ ID NO: 8113 - DNA, 25 bp, Mus musculus
ccagatttgcgccagatcctgctcc

SEQ ID NO: 8114 - DNA, 25 bp, Mus musculus
cagatttgcgccagatcctgctcca

SEQ ID NO: 8115 - DNA, 25 bp, Mus musculus
gacaatggccccgatggatggagcc

SEQ ID NO: 8116 - DNA, 25 bp, Mus musculus
acaatggccccgatggatggagccg

SEQ ID NO: 8117 - DNA, 25 bp, Mus musculus
gctacaatttgccatatccaatctt

SEQ ID NO: 8118 - DNA, 25 bp, Mus musculus
tacaatttgccatatccaatcttgg

SEQ ID NO: 8119 - DNA, 25 bp, Mus musculus
acaatttgccatatccaatcttgga

SEQ ID NO: 8120 - DNA, 25 bp, Mus musculus
caatttgccatatccaatcttggag

SEQ ID NO: 8121 - DNA, 25 bp, Mus musculus
aatttgccatatccaatcttggagg

SEQ ID NO: 8122 - DNA, 25 bp, Mus musculus
atttgccatatccaatcttggaggc

SEQ ID NO: 8123 - DNA, 25 bp, Mus musculus
gccatatccaatcttggaggcaaga

SEQ ID NO: 8124 - DNA, 25 bp, Mus musculus
ccatatccaatcttggaggcaagat

SEQ ID NO: 8125 - DNA, 25 bp, Mus musculus
catatccaatcttggaggcaagatt

SEQ ID NO: 8126 - DNA, 25 bp, Mus musculus
atatccaatcttggaggcaagatta

SEQ ID NO: 8127 - DNA, 25 bp, Mus musculus
caatggccccgatggatggagccgg

SEQ ID NO: 8128 - DNA, 25 bp, Mus musculus
aatggccccgatggatggagccgga

SEQ ID NO: 8129 - DNA, 25 bp, Mus musculus
agccggacgtcatcgagagtaactg

SEQ ID NO: 8130 - DNA, 25 bp, Mus musculus
ttttgagaagcctctgccatccagc

SEQ ID NO: 8131 - DNA, 25 bp, Mus musculus
aacagctacaatttgccatatccaa

SEQ ID NO: 8132 - DNA, 25 bp, Mus musculus
acagctacaatttgccatatccaat

SEQ ID NO: 8133 - DNA, 25 bp, Mus musculus
cagctacaatttgccatatccaatc

SEQ ID NO: 8134 - DNA, 25 bp, Mus musculus
agctacaatttgccatatccaatct

SEQ ID NO: 8135 - DNA, 25 bp, Mus musculus
ccgaccgatgtcgctatccagctga

SEQ ID NO: 8136 - DNA, 25 bp, Mus musculus
accgatgtcgctatccagctgacct

SEQ ID NO: 8137 - DNA, 25 bp, Mus musculus
gcctacatggaccagcagactggca

SEQ ID NO: 8138 - DNA, 25 bp, Mus musculus
tacatggaccagcagactggcaacc

SEQ ID NO: 8139 - DNA, 25 bp, Mus musculus
atggaccagcagactggcaacctca

SEQ ID NO: 8140 - DNA, 25 bp, Mus musculus
ctgctcctccagggatccaacgaga

SEQ ID NO: 8141 - DNA, 25 bp, Mus musculus
ctcctccagggatccaacgagatcg

SEQ ID NO: 8142 - DNA, 25 bp, Mus musculus
ctccagggatccaacgagatcgagc

SEQ ID NO: 8143 - DNA, 25 bp, Mus musculus
gacattggccctgcctgcttcgtgt

SEQ ID NO: 8144 - DNA, 25 bp, Mus musculus
attggccctgcctgcttcgtgtaaa

SEQ ID NO: 8145 - DNA, 25 bp, Mus musculus
ggccctgcctgcttcgtgtaaactc

SEQ ID NO: 8146 - DNA, 25 bp, Mus musculus
tcctttgcattcacctttcaaactt

SEQ ID NO: 8147 - DNA, 25 bp, Mus musculus
cagctgaccttcctgcgcctaatgt

SEQ ID NO: 8148 - DNA, 25 bp, Mus musculus
ctgaccttcctgcgcctaatgtcca

SEQ ID NO: 8149 - DNA, 25 bp, Mus musculus
ttcctgcgcctaatgtccaccgagg

SEQ ID NO: 8150 - DNA, 25 bp, Mus musculus
ctgcgcctaatgtccaccgaggcct

SEQ ID NO: 8151 - DNA, 25 bp, Mus musculus
tgcaagaacagcgtagcctacatgg

SEQ ID NO: 8152 - DNA, 25 bp, Mus musculus
aacagcgtagcctacatggaccagc

SEQ ID NO: 8153 - DNA, 25 bp, Mus musculus
agcgtagcctacatggaccagcaga

SEQ ID NO: 8154 - DNA, 25 bp, Mus musculus
gtagcctacatggaccagcagactg

SEQ ID NO: 8155 - DNA, 25 bp, Mus musculus
ctgctgtcaggacagctgctgaagc

SEQ ID NO: 8156 - DNA, 25 bp, Mus musculus
ctggctgcaatgtctccatgtgttg

SEQ ID NO: 8157 - DNA, 25 bp, Mus musculus
ttatctccaggttcctgattatcct

SEQ ID NO: 8158 - DNA, 25 bp, Mus musculus
ggttcctgattatcctgcttgttcc

SEQ ID NO: 8159 - DNA, 25 bp, Mus musculus
tcctgattatcctgcttgttccctt

SEQ ID NO: 8160 - DNA, 25 bp, Mus musculus
ttatcctgcttgttcccttagcact

SEQ ID NO: 8161 - DNA, 25 bp, Mus musculus
tgcttcccacagcttcaactcagat

SEQ ID NO: 8162 - DNA, 25 bp, Mus musculus
ttcccacagcttcaactcagatttg

SEQ ID NO: 8163 - DNA, 25 bp, Mus musculus
cttcaactcagatttggcttttcgt

SEQ ID NO: 8164 - DNA, 25 bp, Mus musculus
tttggcttttcgtcctcaagaagag

SEQ ID NO: 8165 - DNA, 25 bp, Mus musculus
tcgtcctcaagaagaggccatctgc

SEQ ID NO: 8166 - DNA, 25 bp, Mus musculus
agaggccatctgctcatctactatg

SEQ ID NO: 8167 - DNA, 25 bp, Mus musculus
gcaatgtctccatgtgttgccaagg

SEQ ID NO: 8168 - DNA, 25 bp, Mus musculus
ctcctctgcactcatgtacctctag

SEQ ID NO: 8169 - DNA, 25 bp, Mus musculus
atgtctccatgtgttgccaaggcaa

SEQ ID NO: 8170 - DNA, 25 bp, Mus musculus
tgaactgcttcctcagctgtggcct

SEQ ID NO: 8171 - DNA, 25 bp, Mus musculus
actgcttcctcagctgtggcctcca

SEQ ID NO: 8172 - DNA, 25 bp, Mus musculus
gctgtggcctccagtttatctccag

SEQ ID NO: 8173 - DNA, 25 bp, Mus musculus
gtggcctccagtttatctccaggtt

SEQ ID NO: 8174 - DNA, 25 bp, Mus musculus
tccagtttatctccaggttcctgat

SEQ ID NO: 8175 - DNA, 25 bp, Mus musculus
agtttatctccaggttcctgattat

SEQ ID NO: 8176 - DNA, 25 bp, Mus musculus
cggccagcctgctgggcttgcggaa

SEQ ID NO: 8177 - DNA, 25 bp, Mus musculus
gccagcctgctgggcttgcggaagt

SEQ ID NO: 8178 - DNA, 25 bp, Mus musculus
cccaggccagtgcatggtcagctag

SEQ ID NO: 8179 - DNA, 25 bp, Mus musculus
caggccagtgcatggtcagctagct

SEQ ID NO: 8180 - DNA, 25 bp, Mus musculus
catggtcagctagctcacatctcta

SEQ ID NO: 8181 - DNA, 25 bp, Mus musculus
tggtcagctagctcacatctctatc

SEQ ID NO: 8182 - DNA, 25 bp, Mus musculus
gtcagctagctcacatctctatccc

SEQ ID NO: 8183 - DNA, 25 bp, Mus musculus
ccggcctcttagcagcacggaacgg

SEQ ID NO: 8184 - DNA, 25 bp, Mus musculus
ggcctcttagcagcacggaacggac

SEQ ID NO: 8185 - DNA, 25 bp, Mus musculus
cctcttagcagcacggaacggacgg

SEQ ID NO: 8186 - DNA, 25 bp, Mus musculus
tcttagcagcacggaacggacggca

SEQ ID NO: 8187 - DNA, 25 bp, Mus musculus
ttagcagcacggaacggacggcagc

SEQ ID NO: 8188 - DNA, 25 bp, Mus musculus
cagcctgctgggcttgcggaagtac

SEQ ID NO: 8189 - DNA, 25 bp, Mus musculus
gcctgctgggcttgcggaagtacta

SEQ ID NO: 8190 - DNA, 25 bp, Mus musculus
ctgctgggcttgcggaagtactagc

SEQ ID NO: 8191 - DNA, 25 bp, Mus musculus
gaagtactagcctactgctcactcg

SEQ ID NO: 8192 - DNA, 25 bp, Mus musculus
tactagcctactgctcactcgatgc

SEQ ID NO: 8193 - DNA, 25 bp, Mus musculus
gctcactcgatgctgcgcgggcttc

SEQ ID NO: 8194 - DNA, 25 bp, Mus musculus
tcactcgatgctgcgcgggcttccc

SEQ ID NO: 8195 - DNA, 25 bp, Mus musculus
tcgatgctgcgcgggcttcccacag

SEQ ID NO: 8196 - DNA, 25 bp, Mus musculus
tccccgaaaaccggagctgctgcag

SEQ ID NO: 8197 - DNA, 25 bp, Mus musculus
accggagctgctgcaggaggaaact

SEQ ID NO: 8198 - DNA, 25 bp, Mus musculus
aggccctcaggaagaatccagagat

SEQ ID NO: 8199 - DNA, 25 bp, Mus musculus
gaatcgtttacatactgccacaagc

SEQ ID NO: 8200 - DNA, 25 bp, Mus musculus
tcgtttacatactgccacaagccga

SEQ ID NO: 8201 - DNA, 25 bp, Mus musculus
acatactgccacaagccgaaagagt

SEQ ID NO: 8202 - DNA, 25 bp, Mus musculus
tactgccacaagccgaaagagttac

SEQ ID NO: 8203 - DNA, 25 bp, Mus musculus
tgccacaagccgaaagagttaccag

SEQ ID NO: 8204 - DNA, 25 bp, Mus musculus
gagttaccagcctggctccatcgag

SEQ ID NO: 8205 - DNA, 25 bp, Mus musculus
gcctggctccatcgagccctggatg

SEQ ID NO: 8206 - DNA, 25 bp, Mus musculus
tggctccatcgagccctggatggag

SEQ ID NO: 8207 - DNA, 25 bp, Mus musculus
catcgagccctggatggagcccctg

SEQ ID NO: 8208 - DNA, 25 bp, Mus musculus
aactgtgccagcttctcatagctct

SEQ ID NO: 8209 - DNA, 25 bp, Mus musculus
gccagcttctcatagctctggattc

SEQ ID NO: 8210 - DNA, 25 bp, Mus musculus
agcttctcatagctctggattcttg

SEQ ID NO: 8211 - DNA, 25 bp, Mus musculus
tagctctggattcttgggctctaag

SEQ ID NO: 8212 - DNA, 25 bp, Mus musculus
ctctggattcttgggctctaagcct

SEQ ID NO: 8213 - DNA, 25 bp, Mus musculus
tggattcttgggctctaagcctgag

SEQ ID NO: 8214 - DNA, 25 bp, Mus musculus
cttgggctctaagcctgaggtccca

SEQ ID NO: 8215 - DNA, 25 bp, Mus musculus
tgaggtcccaggccctcaggaagaa

SEQ ID NO: 8216 - DNA, 25 bp, Mus musculus
ccagtccagctgctgtgcccctgtg

SEQ ID NO: 8217 - DNA, 25 bp, Mus musculus
ccctgtgtgctgccagtgtaaaatc

SEQ ID NO: 8218 - DNA, 25 bp, Mus musculus
attcctctgttctggggctctatgg

SEQ ID NO: 8219 - DNA, 25 bp, Mus musculus
ttctggggctctatggttttcacac

SEQ ID NO: 8220 - DNA, 25 bp, Mus musculus
atggttttcacaccacagttcacca

SEQ ID NO: 8221 - DNA, 25 bp, Mus musculus
ttcacaccacagttcaccaaagaca

SEQ ID NO: 8222 - DNA, 25 bp, Mus musculus
cagttcaccaaagacacctccaaca

SEQ ID NO: 8223 - DNA, 25 bp, Mus musculus
ttcaccaaagacacctccaacatgg

SEQ ID NO: 8224 - DNA, 25 bp, Mus musculus
acctccaacatggagagaagtctag

SEQ ID NO: 8225 - DNA, 25 bp, Mus musculus
ctcttaccaaatggactccactcct

SEQ ID NO: 8226 - DNA, 25 bp, Mus musculus
ttaccaaatggactccactcctggc

SEQ ID NO: 8227 - DNA, 25 bp, Mus musculus
catgttcacctcctttgtggtaggt

SEQ ID NO: 8228 - DNA, 25 bp, Mus musculus
tgtgtgctgccagtgtaaaatctga

SEQ ID NO: 8229 - DNA, 25 bp, Mus musculus
ctctggccacagatctcaggcagca

SEQ ID NO: 8230 - DNA, 25 bp, Mus musculus
ccacagatctcaggcagcagagctg

SEQ ID NO: 8231 - DNA, 25 bp, Mus musculus
cagatctcaggcagcagagctgatt

SEQ ID NO: 8232 - DNA, 25 bp, Mus musculus
ctttacagcctgtctattcctctgt

SEQ ID NO: 8233 - DNA, 25 bp, Mus musculus
tacagcctgtctattcctctgttct

SEQ ID NO: 8234 - DNA, 25 bp, Mus musculus
agcctgtctattcctctgttctggg

SEQ ID NO: 8235 - DNA, 25 bp, Mus musculus
tctattcctctgttctggggctcta

SEQ ID NO: 8236 - DNA, 25 bp, Mus musculus
cctcaagctctgcggcatggactgt

SEQ ID NO: 8237 - DNA, 25 bp, Mus musculus
caagctctgcggcatggactgtgac

SEQ ID NO: 8238 - DNA, 25 bp, Mus musculus
ctccaaccttcgagtctcgtggaga

SEQ ID NO: 8239 - DNA, 25 bp, Mus musculus
caaccttcgagtctcgtggagaagt

SEQ ID NO: 8240 - DNA, 25 bp, Mus musculus
ccttcgagtctcgtggagaagtggg

SEQ ID NO: 8241 - DNA, 25 bp, Mus musculus
agcatcactgtatctgacgccgtgc

SEQ ID NO: 8242 - DNA, 25 bp, Mus musculus
atcactgtatctgacgccgtgcgat

SEQ ID NO: 8243 - DNA, 25 bp, Mus musculus
gtatctgacgccgtgcgatagtagt

SEQ ID NO: 8244 - DNA, 25 bp, Mus musculus
tctgacgccgtgcgatagtagtgca

SEQ ID NO: 8245 - DNA, 25 bp, Mus musculus
cgatgatcgtacgtgcagcgggatc

SEQ ID NO: 8246 - DNA, 25 bp, Mus musculus
tacgtgcagcgggatcctgtagatg

SEQ ID NO: 8247 - DNA, 25 bp, Mus musculus
cagcgggatcctgtagatgatgcta

SEQ ID NO: 8248 - DNA, 25 bp, Mus musculus
gctctgcggcatggactgtgacagc

SEQ ID NO: 8249 - DNA, 25 bp, Mus musculus
cagctacatgagcatcctcgtgtga

SEQ ID NO: 8250 - DNA, 25 bp, Mus musculus
ctacatgagcatcctcgtgtgaagc

SEQ ID NO: 8251 - DNA, 25 bp, Mus musculus
catgagcatcctcgtgtgaagcaca

SEQ ID NO: 8252 - DNA, 25 bp, Mus musculus
gagcatcctcgtgtgaagcacagtg

SEQ ID NO: 8253 - DNA, 25 bp, Mus musculus
attacgcagcgaagtctccaacctt

SEQ ID NO: 8254 - DNA, 25 bp, Mus musculus
cagcgaagtctccaaccttcgagtc

SEQ ID NO: 8255 - DNA, 25 bp, Mus musculus
agtctccaaccttcgagtctcgtgg

SEQ ID NO: 8256 - DNA, 25 bp, Mus musculus
tcccaacataaccaggaatagagga

SEQ ID NO: 8257 - DNA, 25 bp, Mus musculus
ttgaacatagcaaggcccagatcta

SEQ ID NO: 8258 - DNA, 25 bp, Mus musculus
gtacaatccttggatttgccctccg

SEQ ID NO: 8259 - DNA, 25 bp, Mus musculus
cctttcctggggagcttctgatgcg

SEQ ID NO: 8260 - DNA, 25 bp, Mus musculus
agcttctgatgcggatctgcagatg

SEQ ID NO: 8261 - DNA, 25 bp, Mus musculus
tgatgcggatctgcagatgttggtc

SEQ ID NO: 8262 - DNA, 25 bp, Mus musculus
gatgttggtcttacccctgatcatc

SEQ ID NO: 8263 - DNA, 25 bp, Mus musculus
gttggtcttacccctgatcatctcc

SEQ ID NO: 8264 - DNA, 25 bp, Mus musculus
cttacccctgatcatctccagtctt

SEQ ID NO: 8265 - DNA, 25 bp, Mus musculus
acccctgatcatctccagtcttgtc

SEQ ID NO: 8266 - DNA, 25 bp, Mus musculus
cagtcttgtcacaggaatggcggcc

SEQ ID NO: 8267 - DNA, 25 bp, Mus musculus
cacaggaatggcggccctagatagt

SEQ ID NO: 8268 - DNA, 25 bp, Mus musculus
aacatagcaaggcccagatctacac

SEQ ID NO: 8269 - DNA, 25 bp, Mus musculus
aggcccagatctacacagcacctga

SEQ ID NO: 8270 - DNA, 25 bp, Mus musculus
cccagatctacacagcacctgatgt

SEQ ID NO: 8271 - DNA, 25 bp, Mus musculus
agatctacacagcacctgatgtttg

SEQ ID NO: 8272 - DNA, 25 bp, Mus musculus
acacagcacctgatgtttgacctcg

SEQ ID NO: 8273 - DNA, 25 bp, Mus musculus
cacctgatgtttgacctcgtggagt

SEQ ID NO: 8274 - DNA, 25 bp, Mus musculus
gagttcccacaggtacaatccttgg

SEQ ID NO: 8275 - DNA, 25 bp, Mus musculus
ttcccacaggtacaatccttggatt

SEQ ID NO: 8276 - DNA, 25 bp, Mus musculus
gtttgtatcattcctttgcatataa

SEQ ID NO: 8277 - DNA, 25 bp, Mus musculus
tgtatcattcctttgcatataattg

SEQ ID NO: 8278 - DNA, 25 bp, Mus musculus
tcatttgtttctttcttggccagca

SEQ ID NO: 8279 - DNA, 25 bp, Mus musculus
ttcttggccagcaaaagttaattgt

SEQ ID NO: 8280 - DNA, 25 bp, Mus musculus
ttactgttcacagtccaatcatttt

SEQ ID NO: 8281 - DNA, 25 bp, Mus musculus
ttcacagtccaatcattttgtgcat

SEQ ID NO: 8282 - DNA, 25 bp, Mus musculus
acagtccaatcattttgtgcatcta

SEQ ID NO: 8283 - DNA, 25 bp, Mus musculus
gtccaatcattttgtgcatctagaa

SEQ ID NO: 8284 - DNA, 25 bp, Mus musculus
tcattttgtgcatctagaattcatt

SEQ ID NO: 8285 - DNA, 25 bp, Mus musculus
tctagaattcattcctaatcaatta

SEQ ID NO: 8286 - DNA, 25 bp, Mus musculus
attcattcctaatcaattaaaagtg

SEQ ID NO: 8287 - DNA, 25 bp, Mus musculus
tacatatcaaaattaaccattgttg

SEQ ID NO: 8288 - DNA, 25 bp, Mus musculus
atcattcctttgcatataattgaac

SEQ ID NO: 8289 - DNA, 25 bp, Mus musculus
attgaacctgggacaacacacacta

SEQ ID NO: 8290 - DNA, 25 bp, Mus musculus
gaacctgggacaacacacactagat

SEQ ID NO: 8291 - DNA, 25 bp, Mus musculus
cctgggacaacacacactagatata

SEQ ID NO: 8292 - DNA, 25 bp, Mus musculus
tgtcttccctagaaatcctcagaat

SEQ ID NO: 8293 - DNA, 25 bp, Mus musculus
ccctagaaatcctcagaatgatttc

SEQ ID NO: 8294 - DNA, 25 bp, Mus musculus
tttatacacattttcatgcaatcat

SEQ ID NO: 8295 - DNA, 25 bp, Mus musculus
atacacattttcatgcaatcatttg

SEQ ID NO: 8296 - DNA, 25 bp, Mus musculus
taccggctctgggcttgtatcacga

SEQ ID NO: 8297 - DNA, 25 bp, Mus musculus
ctctgggcttgtatcacgatcctct

SEQ ID NO: 8298 - DNA, 25 bp, Mus musculus
accagtacatagacaccgacactga

SEQ ID NO: 8299 - DNA, 25 bp, Mus musculus
acatagacaccgacactgatgacga

SEQ ID NO: 8300 - DNA, 25 bp, Mus musculus
acaccgacactgatgacgagggtca

SEQ ID NO: 8301 - DNA, 25 bp, Mus musculus
acactgatgacgagggtcagctgct

SEQ ID NO: 8302 - DNA, 25 bp, Mus musculus
agctgctctacagcgtggactccag

SEQ ID NO: 8303 - DNA, 25 bp, Mus musculus
tctacagcgtggactccagtctccc

SEQ ID NO: 8304 - DNA, 25 bp, Mus musculus
ccaagagtctccacgggagtaccag

SEQ ID NO: 8305 - DNA, 25 bp, Mus musculus
agttcagccttggagctagaacaga

SEQ ID NO: 8306 - DNA, 25 bp, Mus musculus
ccgatgtgcacatgctgcctggggg

SEQ ID NO: 8307 - DNA, 25 bp, Mus musculus
cacacgggagcactcgggatcagag

SEQ ID NO: 8308 - DNA, 25 bp, Mus musculus
gcttgtatcacgatcctcttaggaa

SEQ ID NO: 8309 - DNA, 25 bp, Mus musculus
atcctcttaggaacagaggaggcgc

SEQ ID NO: 8310 - DNA, 25 bp, Mus musculus
tcgccggactggagtgtgcctccct

SEQ ID NO: 8311 - DNA, 25 bp, Mus musculus
tcttagacaagcccgtgctgagccc

SEQ ID NO: 8312 - DNA, 25 bp, Mus musculus
acaagcccgtgctgagcccggagtc

SEQ ID NO: 8313 - DNA, 25 bp, Mus musculus
tgagcccggagtcctccatctacac

SEQ ID NO: 8314 - DNA, 25 bp, Mus musculus
tctacaccacagcaagtgccaggac

SEQ ID NO: 8315 - DNA, 25 bp, Mus musculus
ccccagagaaacacacagcaatagc

SEQ ID NO: 8316 - DNA, 25 bp, Mus musculus
atcatctactatggattaccaggag

SEQ ID NO: 8317 - DNA, 25 bp, Mus musculus
tcatctactatggattaccaggagt

SEQ ID NO: 8318 - DNA, 25 bp, Mus musculus
agtgcttttctgttgtcctctgcta

SEQ ID NO: 8319 - DNA, 25 bp, Mus musculus
gtgcttttctgttgtcctctgctac

SEQ ID NO: 8320 - DNA, 25 bp, Mus musculus
ttctgttgtcctctgctacttctag

SEQ ID NO: 8321 - DNA, 25 bp, Mus musculus
tctgttgtcctctgctacttctagc

SEQ ID NO: 8322 - DNA, 25 bp, Mus musculus
ctgttgtcctctgctacttctagcc

SEQ ID NO: 8323 - DNA, 25 bp, Mus musculus
catctactatggattaccaggagtt

SEQ ID NO: 8324 - DNA, 25 bp, Mus musculus
atctactatggattaccaggagttg

SEQ ID NO: 8325 - DNA, 25 bp, Mus musculus
tctactatggattaccaggagttga

SEQ ID NO: 8326 - DNA, 25 bp, Mus musculus
acaagccaacagtattttgaggaat

SEQ ID NO: 8327 - DNA, 25 bp, Mus musculus
caagccaacagtattttgaggaatt

SEQ ID NO: 8328 - DNA, 25 bp, Mus musculus
aacacagtgcttttctgttgtcctc

SEQ ID NO: 8329 - DNA, 25 bp, Mus musculus
cacagtgcttttctgttgtcctctg

SEQ ID NO: 8330 - DNA, 25 bp, Mus musculus
acagtgcttttctgttgtcctctgc

SEQ ID NO: 8331 - DNA, 25 bp, Mus musculus
catctactatggattaccaggagtt

SEQ ID NO: 8332 - DNA, 25 bp, Mus musculus
atctactatggattaccaggagttg

SEQ ID NO: 8333 - DNA, 25 bp, Mus musculus
acagtgcttttctgttgtcctctgc

SEQ ID NO: 8334 - DNA, 25 bp, Mus musculus
agtgcttttctgttgtcctctgcta

SEQ ID NO: 8335 - DNA, 25 bp, Mus musculus
gtgcttttctgttgtcctctgctac

SEQ ID NO: 8336 - DNA, 25 bp, Mus musculus
tgcttttctgttgtcctctgctact

SEQ ID NO: 8337 - DNA, 25 bp, Mus musculus
gcttttctgttgtcctctgctactt

SEQ ID NO: 8338 - DNA, 25 bp, Mus musculus
cttttctgttgtcctctgctacttc

SEQ ID NO: 8339 - DNA, 25 bp, Mus musculus
ttttctgttgtcctctgctacttct

SEQ ID NO: 8340 - DNA, 25 bp, Mus musculus
tttctgttgtcctctgctacttcta

SEQ ID NO: 8341 - DNA, 25 bp, Mus musculus
ttctgttgtcctctgctacttctag

SEQ ID NO: 8342 - DNA, 25 bp, Mus musculus
tctgttgtcctctgctacttctagc

SEQ ID NO: 8343 - DNA, 25 bp, Mus musculus
tctactatggattaccaggagttga

SEQ ID NO: 8344 - DNA, 25 bp, Mus musculus
ctgttgtcctctgctacttctagcc

SEQ ID NO: 8345 - DNA, 25 bp, Mus musculus
taaaacaagccaacagtattttgag

SEQ ID NO: 8346 - DNA, 25 bp, Mus musculus
acaagccaacagtattttgaggaat

SEQ ID NO: 8347 - DNA, 25 bp, Mus musculus
caagccaacagtattttgaggaatt

SEQ ID NO: 8348 - DNA, 25 bp, Mus musculus
taaaacacagtgcttttctgttgtc

SEQ ID NO: 8349 - DNA, 25 bp, Mus musculus
aaacacagtgcttttctgttgtcct

SEQ ID NO: 8350 - DNA, 25 bp, Mus musculus
aacacagtgcttttctgttgtcctc

SEQ ID NO: 8351 - DNA, 25 bp, Mus musculus
cacagtgcttttctgttgtcctctg

SEQ ID NO: 8352 - DNA, 25 bp, Mus musculus
ttgaacgtctcaaagccaatgatgg

SEQ ID NO: 8353 - DNA, 25 bp, Mus musculus
gtctcaaagccaatgatgggctcaa

SEQ ID NO: 8354 - DNA, 25 bp, Mus musculus
ccattgatggtgttcctgggagtga

SEQ ID NO: 8355 - DNA, 25 bp, Mus musculus
gtgttcctgggagtgactacatcaa

SEQ ID NO: 8356 - DNA, 25 bp, Mus musculus
ccaactacattgatggctaccgaaa

SEQ ID NO: 8357 - DNA, 25 bp, Mus musculus
actacattgatggctaccgaaagcc

SEQ ID NO: 8358 - DNA, 25 bp, Mus musculus
ttgatggctaccgaaagccgaatgg

SEQ ID NO: 8359 - DNA, 25 bp, Mus musculus
gctaccgaaagccgaatggctacat

SEQ ID NO: 8360 - DNA, 25 bp, Mus musculus
agccgaatggctacatcggcacaca

SEQ ID NO: 8361 - DNA, 25 bp, Mus musculus
gctacatcggcacacagggtgcgct

SEQ ID NO: 8362 - DNA, 25 bp, Mus musculus
acatcggcacacagggtgcgctgcc

SEQ ID NO: 8363 - DNA, 25 bp, Mus musculus
cacagggtgcgctgcctgagaccat

SEQ ID NO: 8364 - DNA, 25 bp, Mus musculus
atgggctcaagttctcccaggagta

SEQ ID NO: 8365 - DNA, 25 bp, Mus musculus
tgcctgagaccatgggtgatttctg

SEQ ID NO: 8366 - DNA, 25 bp, Mus musculus
ggctcaagttctcccaggagtatga

SEQ ID NO: 8367 - DNA, 25 bp, Mus musculus
ctggacagcagttcacgtgggagaa

SEQ ID NO: 8368 - DNA, 25 bp, Mus musculus
agcagttcacgtgggagaattccaa

SEQ ID NO: 8369 - DNA, 25 bp, Mus musculus
agaattccaactcagaggtgaacaa

SEQ ID NO: 8370 - DNA, 25 bp, Mus musculus
attccaactcagaggtgaacaagcc

SEQ ID NO: 8371 - DNA, 25 bp, Mus musculus
tcctcaactccattgatggtgttcc

SEQ ID NO: 8372 - DNA, 25 bp, Mus musculus
actccattgatggtgttcctgggag

SEQ ID NO: 8373 - DNA, 25 bp, Mus musculus
ccacgcactgctcctagggcaagag

SEQ ID NO: 8374 - DNA, 25 bp, Mus musculus
actgctcctagggcaagagccttca

SEQ ID NO: 8375 - DNA, 25 bp, Mus musculus
aacgccaacaccatgcgcgagatcg

SEQ ID NO: 8376 - DNA, 25 bp, Mus musculus
acgccaacaccatgcgcgagatcgt

SEQ ID NO: 8377 - DNA, 25 bp, Mus musculus
tactacaatgaagctgctggcaaca

SEQ ID NO: 8378 - DNA, 25 bp, Mus musculus
tacaatgaagctgctggcaacaaat

SEQ ID NO: 8379 - DNA, 25 bp, Mus musculus
cgggccatcctagtggacctggagc

SEQ ID NO: 8380 - DNA, 25 bp, Mus musculus
atcctagtggacctggagccaggca

SEQ ID NO: 8381 - DNA, 25 bp, Mus musculus
gagccaggcaccatggactcagtga

SEQ ID NO: 8382 - DNA, 25 bp, Mus musculus
agccaggcaccatggactcagtgag

SEQ ID NO: 8383 - DNA, 25 bp, Mus musculus
ccaggcaccatggactcagtgaggt

SEQ ID NO: 8384 - DNA, 25 bp, Mus musculus
caggcaccatggactcagtgaggtc

SEQ ID NO: 8385 - DNA, 25 bp, Mus musculus
agggcaagagccttcacctcttcta

SEQ ID NO: 8386 - DNA, 25 bp, Mus musculus
gggcaagagccttcacctcttctaa

SEQ ID NO: 8387 - DNA, 25 bp, Mus musculus
gcaagagccttcacctcttctaacg

SEQ ID NO: 8388 - DNA, 25 bp, Mus musculus
caagagccttcacctcttctaacgc

SEQ ID NO: 8389 - DNA, 25 bp, Mus musculus
agagccttcacctcttctaacgcca

SEQ ID NO: 8390 - DNA, 25 bp, Mus musculus
tcttctaacgccaacaccatgcgcg

SEQ ID NO: 8391 - DNA, 25 bp, Mus musculus
cttctaacgccaacaccatgcgcga

SEQ ID NO: 8392 - DNA, 25 bp, Mus musculus
tctaacgccaacaccatgcgcgaga

SEQ ID NO: 8393 - DNA, 25 bp, Mus musculus
ttctgacttctccaatatgaagggt

SEQ ID NO: 8394 - DNA, 25 bp, Mus musculus
gaagggtctctcattcacattcagt

SEQ ID NO: 8395 - DNA, 25 bp, Mus musculus
atcaaagcttaccttgtaagtaatg

SEQ ID NO: 8396 - DNA, 25 bp, Mus musculus
ttcaactatgtacaaacccgctgcc

SEQ ID NO: 8397 - DNA, 25 bp, Mus musculus
ctctgtaatgatcatcctattagat

SEQ ID NO: 8398 - DNA, 25 bp, Mus musculus
aatgatcatcctattagatttttct

SEQ ID NO: 8399 - DNA, 25 bp, Mus musculus
atctgtcctaatgatatggcagtgg

SEQ ID NO: 8400 - DNA, 25 bp, Mus musculus
atcacagcaaaccggtactatactt

SEQ ID NO: 8401 - DNA, 25 bp, Mus musculus
tatacttataatactgtgcgaatga

SEQ ID NO: 8402 - DNA, 25 bp, Mus musculus
cttcttatgcgtctttcaaaaccat

SEQ ID NO: 8403 - DNA, 25 bp, Mus musculus
atgcgtctttcaaaaccattatcat

SEQ ID NO: 8404 - DNA, 25 bp, Mus musculus
ttttctccaagtacaattgactgga

SEQ ID NO: 8405 - DNA, 25 bp, Mus musculus
attcacattcagtgctgtgacactc

SEQ ID NO: 8406 - DNA, 25 bp, Mus musculus
attcagtgctgtgacactcttcttg

SEQ ID NO: 8407 - DNA, 25 bp, Mus musculus
tgctgtgacactcttcttggtccta

SEQ ID NO: 8408 - DNA, 25 bp, Mus musculus
gacactcttcttggtcctatgtctg

SEQ ID NO: 8409 - DNA, 25 bp, Mus musculus
ggtcctatgtctgcagctgggatca

SEQ ID NO: 8410 - DNA, 25 bp, Mus musculus
atagatgttccatcaacagcacagg

SEQ ID NO: 8411 - DNA, 25 bp, Mus musculus
gttccatcaacagcacaggaaaatc

SEQ ID NO: 8412 - DNA, 25 bp, Mus musculus
atcactgtgcaagttacagttgaaa

SEQ ID NO: 8413 - DNA, 25 bp, Mus musculus
cttttccactgtgagatcaacaggg

SEQ ID NO: 8414 - DNA, 25 bp, Mus musculus
gaatacaattcctctgtggcctgct

SEQ ID NO: 8415 - DNA, 25 bp, Mus musculus
agagcgtcttcagttggaagacttg

SEQ ID NO: 8416 - DNA, 25 bp, Mus musculus
ttgctcccttgctgtttaaaggcta

SEQ ID NO: 8417 - DNA, 25 bp, Mus musculus
acaatcagagcagcttttggctgct

SEQ ID NO: 8418 - DNA, 25 bp, Mus musculus
agagcagcttttggctgcttaactg

SEQ ID NO: 8419 - DNA, 25 bp, Mus musculus
gaatacacttgtggttggaaaagtg

SEQ ID NO: 8420 - DNA, 25 bp, Mus musculus
atttattacagccccaagagcagta

SEQ ID NO: 8421 - DNA, 25 bp, Mus musculus
tacagccccaagagcagtatttatt

SEQ ID NO: 8422 - DNA, 25 bp, Mus musculus
gttgaccatttcaaactcttggcaa

SEQ ID NO: 8423 - DNA, 25 bp, Mus musculus
catttcaaactcttggcaataaaga

SEQ ID NO: 8424 - DNA, 25 bp, Mus musculus
aaactcttggcaataaagagtatga

SEQ ID NO: 8425 - DNA, 25 bp, Mus musculus
aattcctctgtggcctgctggactg

SEQ ID NO: 8426 - DNA, 25 bp, Mus musculus
gctggaaccagaccagcctaaggtg

SEQ ID NO: 8427 - DNA, 25 bp, Mus musculus
accagaccagcctaaggtgtagagt

SEQ ID NO: 8428 - DNA, 25 bp, Mus musculus
aatcctgagtgtggagccgagtgca

SEQ ID NO: 8429 - DNA, 25 bp, Mus musculus
ccctgagatacctgtcgtgaaaagg

SEQ ID NO: 8430 - DNA, 25 bp, Mus musculus
ttgactctgaagttctctctgttga

SEQ ID NO: 8431 - DNA, 25 bp, Mus musculus
ctgaagttctctctgttgagagcgt

SEQ ID NO: 8432 - DNA, 25 bp, Mus musculus
ctgttgagagcgtcttcagttggaa

SEQ ID NO: 8433 - DNA, 25 bp, Mus musculus
ggacccaccagtcagaacccacatg

SEQ ID NO: 8434 - DNA, 25 bp, Mus musculus
accagtcagaacccacatggcaagt

SEQ ID NO: 8435 - DNA, 25 bp, Mus musculus
ctctaggcactgggaggctgtttca

SEQ ID NO: 8436 - DNA, 25 bp, Mus musculus
gcactgggaggctgtttcaggaaag

SEQ ID NO: 8437 - DNA, 25 bp, Mus musculus
ttcacatctagatggctgtcataaa

SEQ ID NO: 8438 - DNA, 25 bp, Mus musculus
ttccaagccaacggaatggtcagat

SEQ ID NO: 8439 - DNA, 25 bp, Mus musculus
gtcagatctcacaggctgagaaatt

SEQ ID NO: 8440 - DNA, 25 bp, Mus musculus
tctcacaggctgagaaattgttccc

SEQ ID NO: 8441 - DNA, 25 bp, Mus musculus
cctccaagcatttcatgaaaaagct

SEQ ID NO: 8442 - DNA, 25 bp, Mus musculus
tgcttctcattaaccatgcaaactc

SEQ ID NO: 8443 - DNA, 25 bp, Mus musculus
tcattaaccatgcaaactctcacag

SEQ ID NO: 8444 - DNA, 25 bp, Mus musculus
accatgcaaactctcacagcgatgt

SEQ ID NO: 8445 - DNA, 25 bp, Mus musculus
cagaacccacatggcaagtcttagt

SEQ ID NO: 8446 - DNA, 25 bp, Mus musculus
ccacatggcaagtcttagtagccta

SEQ ID NO: 8447 - DNA, 25 bp, Mus musculus
tcttagtagcctaggtcaaggaaag

SEQ ID NO: 8448 - DNA, 25 bp, Mus musculus
ataatccagagctgtggcacacatg

SEQ ID NO: 8449 - DNA, 25 bp, Mus musculus
ccagaacatcactcaactgcaattg

SEQ ID NO: 8450 - DNA, 25 bp, Mus musculus
catcactcaactgcaattgggcttt

SEQ ID NO: 8451 - DNA, 25 bp, Mus musculus
tcaactgcaattgggctttcaggtt

SEQ ID NO: 8452 - DNA, 25 bp, Mus musculus
tcttgccgggagctctaggcactgg

SEQ ID NO: 8453 - DNA, 25 bp, Mus musculus
cacgtcctcatgcagagaaagaagc

SEQ ID NO: 8454 - DNA, 25 bp, Mus musculus
tattgtcagactctctgtcatgatg

SEQ ID NO: 8455 - DNA, 25 bp, Mus musculus
tgccctgggtctatctgcagcatct

SEQ ID NO: 8456 - DNA, 25 bp, Mus musculus
agcatctgaaatgcttggtgcccag

SEQ ID NO: 8457 - DNA, 25 bp, Mus musculus
gatctgccttatgcttgccttcctc

SEQ ID NO: 8458 - DNA, 25 bp, Mus musculus
ccctgtagcactcctactcagaaca

SEQ ID NO: 8459 - DNA, 25 bp, Mus musculus
gtctttctcaatgtctcttgttgac

SEQ ID NO: 8460 - DNA, 25 bp, Mus musculus
ctcaatgtctcttgttgaccaacta

SEQ ID NO: 8461 - DNA, 25 bp, Mus musculus
gtctcttgttgaccaactacgtagg

SEQ ID NO: 8462 - DNA, 25 bp, Mus musculus
tgttgaccaactacgtaggactggt

SEQ ID NO: 8463 - DNA, 25 bp, Mus musculus
tggacacctctgcattactcacaca

SEQ ID NO: 8464 - DNA, 25 bp, Mus musculus
cctctgcattactcacacaaattga

SEQ ID NO: 8465 - DNA, 25 bp, Mus musculus
tcaggttcctgacctgaaatttgtg

SEQ ID NO: 8466 - DNA, 25 bp, Mus musculus
tcctgacctgaaatttgtgttattc

SEQ ID NO: 8467 - DNA, 25 bp, Mus musculus
ccaaaagcctgggcccagcagtgag

SEQ ID NO: 8468 - DNA, 25 bp, Mus musculus
cagtgaggctctctcctaacttagg

SEQ ID NO: 8469 - DNA, 25 bp, Mus musculus
ctcctaacttaggctctgcttatgt

SEQ ID NO: 8470 - DNA, 25 bp, Mus musculus
gctctgcttatgtctgccttcatcc

SEQ ID NO: 8471 - DNA, 25 bp, Mus musculus
cttatgtctgccttcatcctttcag

SEQ ID NO: 8472 - DNA, 25 bp, Mus musculus
ttcatcctttcagtcatgatgggac

SEQ ID NO: 8473 - DNA, 25 bp, Mus musculus
cagtgccgtgctcccagacttcttg

SEQ ID NO: 8474 - DNA, 25 bp, Mus musculus
actagcccatgttcctgagcctgaa

SEQ ID NO: 8475 - DNA, 25 bp, Mus musculus
tggtgcccagtctgcctcactcttt

SEQ ID NO: 8476 - DNA, 25 bp, Mus musculus
actctttcatttctccaggctttgc

SEQ ID NO: 8477 - DNA, 25 bp, Mus musculus
ctccaggctttgcctccaggcactg

SEQ ID NO: 8478 - DNA, 25 bp, Mus musculus
ctgcaggatctcctcactttgtcca

SEQ ID NO: 8479 - DNA, 25 bp, Mus musculus
gatctcctcactttgtccacatctg

SEQ ID NO: 8480 - DNA, 25 bp, Mus musculus
ttgtccacatctggcacagagttag

SEQ ID NO: 8481 - DNA, 25 bp, Mus musculus
gagttagagccctcacttctgcagc

SEQ ID NO: 8482 - DNA, 25 bp, Mus musculus
tcacttctgcagctgcatggggtct

SEQ ID NO: 8483 - DNA, 25 bp, Mus musculus
tcagagcagatcctttcccctggca

SEQ ID NO: 8484 - DNA, 25 bp, Mus musculus
cctggcactcctacttagaacaaag

SEQ ID NO: 8485 - DNA, 25 bp, Mus musculus
ccatgttcctgagcctgaaatttgt

SEQ ID NO: 8486 - DNA, 25 bp, Mus musculus
gccccatcaagtaagctcagtccca

SEQ ID NO: 8487 - DNA, 25 bp, Mus musculus
tcaagtaagctcagtcccagtttag

SEQ ID NO: 8488 - DNA, 25 bp, Mus musculus
aagctcagtcccagtttagactctg

SEQ ID NO: 8489 - DNA, 25 bp, Mus musculus
gtctcccttcagccttgctgtcttg

SEQ ID NO: 8490 - DNA, 25 bp, Mus musculus
ccgtgtctatccgcagcatctagga

SEQ ID NO: 8491 - DNA, 25 bp, Mus musculus
ctatccgcagcatctaggactactt

SEQ ID NO: 8492 - DNA, 25 bp, Mus musculus
actacttggtgcccagtctgcctca

SEQ ID NO: 8493 - DNA, 25 bp, Mus musculus
ctctgaaccttacagagacccaggt

SEQ ID NO: 8494 - DNA, 25 bp, Mus musculus
tggctgccaagcctatgctgccctc

SEQ ID NO: 8495 - DNA, 25 bp, Mus musculus
atggaccagactccaggatggatgc

SEQ ID NO: 8496 - DNA, 25 bp, Mus musculus
ggtgccaactctgctcctgaatgcg

SEQ ID NO: 8497 - DNA, 25 bp, Mus musculus
gctcctgaatgcgagccttgcattg

SEQ ID NO: 8498 - DNA, 25 bp, Mus musculus
gaatgcgagccttgcattgtcaccc

SEQ ID NO: 8499 - DNA, 25 bp, Mus musculus
gagccttgcattgtcaccctaagcg

SEQ ID NO: 8500 - DNA, 25 bp, Mus musculus
tgcattgtcaccctaagcgacaggg

SEQ ID NO: 8501 - DNA, 25 bp, Mus musculus
ctaagcgacagggccacttgataca

SEQ ID NO: 8502 - DNA, 25 bp, Mus musculus
gacagggccacttgatacagagtga

SEQ ID NO: 8503 - DNA, 25 bp, Mus musculus
tcctctcacaaatattggctctgct

SEQ ID NO: 8504 - DNA, 25 bp, Mus musculus
cacaaatattggctctgctagtttt

SEQ ID NO: 8505 - DNA, 25 bp, Mus musculus
tgccctcaggcttcagtctgccctt

SEQ ID NO: 8506 - DNA, 25 bp, Mus musculus
cacccctgcaagcagcatccatata

SEQ ID NO: 8507 - DNA, 25 bp, Mus musculus
tgcaagcagcatccatatacggcgc

SEQ ID NO: 8508 - DNA, 25 bp, Mus musculus
cagcatccatatacggcgcatccta

SEQ ID NO: 8509 - DNA, 25 bp, Mus musculus
ccatcccgcctgttggactctatgc

SEQ ID NO: 8510 - DNA, 25 bp, Mus musculus
cgcctgttggactctatgccacgcc

SEQ ID NO: 8511 - DNA, 25 bp, Mus musculus
ttggactctatgccacgccggttgg

SEQ ID NO: 8512 - DNA, 25 bp, Mus musculus
gcatgtaccatctatcctaaggaag

SEQ ID NO: 8513 - DNA, 25 bp, Mus musculus
gaagacagactgctctgatggcacc

SEQ ID NO: 8514 - DNA, 25 bp, Mus musculus
ctctgatggcaccgtctggtgaacg

SEQ ID NO: 8515 - DNA, 25 bp, Mus musculus
ccactaagtgtcaaccactgtgcta

SEQ ID NO: 8516 - DNA, 25 bp, Mus musculus
agtgtcaaccactgtgctagtagaa

SEQ ID NO: 8517 - DNA, 25 bp, Mus musculus
gtcaaccactgtgctagtagaaggg

SEQ ID NO: 8518 - DNA, 25 bp, Mus musculus
aagtcgtctttcatattgtatggtc

SEQ ID NO: 8519 - DNA, 25 bp, Mus musculus
cgtgttgacgcttcccttggacatt

SEQ ID NO: 8520 - DNA, 25 bp, Mus musculus
gttgacgcttcccttggacattttg

SEQ ID NO: 8521 - DNA, 25 bp, Mus musculus
gcttcccttggacattttgtgtcta

SEQ ID NO: 8522 - DNA, 25 bp, Mus musculus
tcccttggacattttgtgtctagtt

SEQ ID NO: 8523 - DNA, 25 bp, Mus musculus
cattttgtgtctagttggtagccca

SEQ ID NO: 8524 - DNA, 25 bp, Mus musculus
tagcccataatgggcttttacattc

SEQ ID NO: 8525 - DNA, 25 bp, Mus musculus
caccgtctggtgaacgctggcttct

SEQ ID NO: 8526 - DNA, 25 bp, Mus musculus
cgtctggtgaacgctggcttctgac

SEQ ID NO: 8527 - DNA, 25 bp, Mus musculus
gtgaacgctggcttctgacaacact

SEQ ID NO: 8528 - DNA, 25 bp, Mus musculus
gctggcttctgacaacactatacaa

SEQ ID NO: 8529 - DNA, 25 bp, Mus musculus
ttctgacaacactatacaatttctt

SEQ ID NO: 8530 - DNA, 25 bp, Mus musculus
acatttcatcgatggtagttcagtt

SEQ ID NO: 8531 - DNA, 25 bp, Mus musculus
tctgcttgttcagtttaaagatggt

SEQ ID NO: 8532 - DNA, 25 bp, Mus musculus
agaccactaagtgtcaaccactgtg

SEQ ID NO: 8533 - DNA, 25 bp, Mus musculus
gctgacgtccgggtgaagctccacg

SEQ ID NO: 8534 - DNA, 25 bp, Mus musculus
aagctccacgagagctcttctccgg

SEQ ID NO: 8535 - DNA, 25 bp, Mus musculus
ccttcagagaggtggctgtgtactt

SEQ ID NO: 8536 - DNA, 25 bp, Mus musculus
tggctgtgtacttctgcagggaaga

SEQ ID NO: 8537 - DNA, 25 bp, Mus musculus
ctgtgtacttctgcagggaagaatg

SEQ ID NO: 8538 - DNA, 25 bp, Mus musculus
tgtacttctgcagggaagaatggga

SEQ ID NO: 8539 - DNA, 25 bp, Mus musculus
agtgtctcagttttagccagaggac

SEQ ID NO: 8540 - DNA, 25 bp, Mus musculus
gtctcagttttagccagaggaccct

SEQ ID NO: 8541 - DNA, 25 bp, Mus musculus
caagccttatttctcgcctggaaca

SEQ ID NO: 8542 - DNA, 25 bp, Mus musculus
gccttatttctcgcctggaacaatg

SEQ ID NO: 8543 - DNA, 25 bp, Mus musculus
tttctcgcctggaacaatgggatga

SEQ ID NO: 8544 - DNA, 25 bp, Mus musculus
ctcgcctggaacaatgggatgagcc

SEQ ID NO: 8545 - DNA, 25 bp, Mus musculus
ctccacgagagctcttctccggact

SEQ ID NO: 8546 - DNA, 25 bp, Mus musculus
cacgagagctcttctccggactcag

SEQ ID NO: 8547 - DNA, 25 bp, Mus musculus
gagagctcttctccggactcagcag

SEQ ID NO: 8548 - DNA, 25 bp, Mus musculus
tgctctccgcagtgccggtgacctt

SEQ ID NO: 8549 - DNA, 25 bp, Mus musculus
tctccgcagtgccggtgaccttcag

SEQ ID NO: 8550 - DNA, 25 bp, Mus musculus
ccgcagtgccggtgaccttcagaga

SEQ ID NO: 8551 - DNA, 25 bp, Mus musculus
cagtgccggtgaccttcagagaggt

SEQ ID NO: 8552 - DNA, 25 bp, Mus musculus
tgaccttcagagaggtggctgtgta

SEQ ID NO: 8553 - DNA, 25 bp, Mus musculus
gggacttcttgcctgtggacaaagc

SEQ ID NO: 8554 - DNA, 25 bp, Mus musculus
gacttcttgcctgtggacaaagctg

SEQ ID NO: 8555 - DNA, 25 bp, Mus musculus
accctgaggggctcagctcagagtc

SEQ ID NO: 8556 - DNA, 25 bp, Mus musculus
gggacgacctgtgtcgtaggcgcct

SEQ ID NO: 8557 - DNA, 25 bp, Mus musculus
gacgacctgtgtcgtaggcgcctgg

SEQ ID NO: 8558 - DNA, 25 bp, Mus musculus
cgacctgtgtcgtaggcgcctggcg

SEQ ID NO: 8559 - DNA, 25 bp, Mus musculus
gccaagcctgcatctcctgctaggc

SEQ ID NO: 8560 - DNA, 25 bp, Mus musculus
caagcctgcatctcctgctaggcgg

SEQ ID NO: 8561 - DNA, 25 bp, Mus musculus
agcctgcatctcctgctaggcggtt

SEQ ID NO: 8562 - DNA, 25 bp, Mus musculus
cctgcatctcctgctaggcggttgg

SEQ ID NO: 8563 - DNA, 25 bp, Mus musculus
catctcctgctaggcggttggatat

SEQ ID NO: 8564 - DNA, 25 bp, Mus musculus
tctcctgctaggcggttggatattc

SEQ ID NO: 8565 - DNA, 25 bp, Mus musculus
cttcttgcctgtggacaaagctggg

SEQ ID NO: 8566 - DNA, 25 bp, Mus musculus
ctcctgctaggcggttggatattcg

SEQ ID NO: 8567 - DNA, 25 bp, Mus musculus
gttagcggaactcaccatcccagac

SEQ ID NO: 8568 - DNA, 25 bp, Mus musculus
tagcggaactcaccatcccagacct

SEQ ID NO: 8569 - DNA, 25 bp, Mus musculus
gcggaactcaccatcccagacctgg

SEQ ID NO: 8570 - DNA, 25 bp, Mus musculus
cctccacgaccggatgtttgcatgg

SEQ ID NO: 8571 - DNA, 25 bp, Mus musculus
tccacgaccggatgtttgcatggct

SEQ ID NO: 8572 - DNA, 25 bp, Mus musculus
cacgaccggatgtttgcatggctga

SEQ ID NO: 8573 - DNA, 25 bp, Mus musculus
tgaccctgaggggctcagctcagag

SEQ ID NO: 8574 - DNA, 25 bp, Mus musculus
accaacactgctaatgaggcctctg

SEQ ID NO: 8575 - DNA, 25 bp, Mus musculus
actgctaatgaggcctctgaggagg

SEQ ID NO: 8576 - DNA, 25 bp, Mus musculus
gtttgcatcttctactactgacctt

SEQ ID NO: 8577 - DNA, 25 bp, Mus musculus
atcttctactactgacctttctgac

SEQ ID NO: 8578 - DNA, 25 bp, Mus musculus
tactactgacctttctgacacagac

SEQ ID NO: 8579 - DNA, 25 bp, Mus musculus
tgacctttctgacacagactagaac

SEQ ID NO: 8580 - DNA, 25 bp, Mus musculus
cacagactagaacatccttgatttg

SEQ ID NO: 8581 - DNA, 25 bp, Mus musculus
ctagaacatccttgatttgatttcc

SEQ ID NO: 8582 - DNA, 25 bp, Mus musculus
catccttgatttgatttcctccagt

SEQ ID NO: 8583 - DNA, 25 bp, Mus musculus
ttatttaccctgactattcgctctc

SEQ ID NO: 8584 - DNA, 25 bp, Mus musculus
ctctctcattgctaacttttatcaa

SEQ ID NO: 8585 - DNA, 25 bp, Mus musculus
cattgctaacttttatcaaataaat

SEQ ID NO: 8586 - DNA, 25 bp, Mus musculus
gatacctctaatcagaccaaagtgg

SEQ ID NO: 8587 - DNA, 25 bp, Mus musculus
ggtgacacctccattcagaaggaag

SEQ ID NO: 8588 - DNA, 25 bp, Mus musculus
acctctaatcagaacaatgtgaatg

SEQ ID NO: 8589 - DNA, 25 bp, Mus musculus
gtgaatgatacctccaatgagaaac

SEQ ID NO: 8590 - DNA, 25 bp, Mus musculus
gatacctccaatgagaaacaagagg

SEQ ID NO: 8591 - DNA, 25 bp, Mus musculus
gataatacctctcataagaaagaag

SEQ ID NO: 8592 - DNA, 25 bp, Mus musculus
acctctcataagaaagaaggcaatg

SEQ ID NO: 8593 - DNA, 25 bp, Mus musculus
ttgaataccattcatggtagatgag

SEQ ID NO: 8594 - DNA, 25 bp, Mus musculus
gagttctgtgctgttgtaggtggcc

SEQ ID NO: 8595 - DNA, 25 bp, Mus musculus
tgtgctgttgtaggtggcctagata

SEQ ID NO: 8596 - DNA, 25 bp, Mus musculus
aagacgtccagcaatgctctctgtg

SEQ ID NO: 8597 - DNA, 25 bp, Mus musculus
aatgctctctgtgtgtgtaaatgga

SEQ ID NO: 8598 - DNA, 25 bp, Mus musculus
aagtatttttctctgtgaagccaca

SEQ ID NO: 8599 - DNA, 25 bp, Mus musculus
ctgtgaagccacattttccaacatg

SEQ ID NO: 8600 - DNA, 25 bp, Mus musculus
agccacattttccaacatgagcctc

SEQ ID NO: 8601 - DNA, 25 bp, Mus musculus
attttccaacatgagcctcatgaag

SEQ ID NO: 8602 - DNA, 25 bp, Mus musculus
caacatgagcctcatgaagccaacg

SEQ ID NO: 8603 - DNA, 25 bp, Mus musculus
gagcctcatgaagccaacgaagtgt

SEQ ID NO: 8604 - DNA, 25 bp, Mus musculus
ctaccctctcaataactcagtgtag

SEQ ID NO: 8605 - DNA, 25 bp, Mus musculus
tctcaataactcagtgtagcacttt

SEQ ID NO: 8606 - DNA, 25 bp, Mus musculus
ctagatatccacaaaaagatggtgg

SEQ ID NO: 8607 - DNA, 25 bp, Mus musculus
taactcagtgtagcactttcaagtt

SEQ ID NO: 8608 - DNA, 25 bp, Mus musculus
gtgtgactctttgatcactagtcac

SEQ ID NO: 8609 - DNA, 25 bp, Mus musculus
gatcactagtcacccagcacttttg

SEQ ID NO: 8610 - DNA, 25 bp, Mus musculus
tagtcacccagcacttttgctttct

SEQ ID NO: 8611 - DNA, 25 bp, Mus musculus
cccagcacttttgctttcttctcca

SEQ ID NO: 8612 - DNA, 25 bp, Mus musculus
gctttcttctccatctctgaagatc

SEQ ID NO: 8613 - DNA, 25 bp, Mus musculus
ttctccatctctgaagatctgctca

SEQ ID NO: 8614 - DNA, 25 bp, Mus musculus
ctgctcaagacgtccagcaatgctc

SEQ ID NO: 8615 - DNA, 25 bp, Mus musculus
gtctctaggctacaggccccgacta

SEQ ID NO: 8616 - DNA, 25 bp, Mus musculus
caggccccgactactgcctggaacg

SEQ ID NO: 8617 - DNA, 25 bp, Mus musculus
ccattagtgcgggtgtaatgtgagt

SEQ ID NO: 8618 - DNA, 25 bp, Mus musculus
tccaaacttttctggaaagagtcag

SEQ ID NO: 8619 - DNA, 25 bp, Mus musculus
gagtcagctataccctctcatcttc

SEQ ID NO: 8620 - DNA, 25 bp, Mus musculus
catcttctcacaactcttgtaccaa

SEQ ID NO: 8621 - DNA, 25 bp, Mus musculus
actcttgtaccaacaggagggacag

SEQ ID NO: 8622 - DNA, 25 bp, Mus musculus
cagctggccttctgtatacatgggc

SEQ ID NO: 8623 - DNA, 25 bp, Mus musculus
gccttctgtatacatgggccttact

SEQ ID NO: 8624 - DNA, 25 bp, Mus musculus
tgtatacatgggccttacttctgcc

SEQ ID NO: 8625 - DNA, 25 bp, Mus musculus
catgggccttacttctgccaattct

SEQ ID NO: 8626 - DNA, 25 bp, Mus musculus
caattctgctaactgtgcatagaaa

SEQ ID NO: 8627 - DNA, 25 bp, Mus musculus
aatgcccacagtagaaagacagagc

SEQ ID NO: 8628 - DNA, 25 bp, Mus musculus
tgtgcacacatgtgtagatgcgtgt

SEQ ID NO: 8629 - DNA, 25 bp, Mus musculus
catgctttgtgccacccttgggtac

SEQ ID NO: 8630 - DNA, 25 bp, Mus musculus
catattaagggccacagtggcatgg

SEQ ID NO: 8631 - DNA, 25 bp, Mus musculus
aagggccacagtggcatgggctttt

SEQ ID NO: 8632 - DNA, 25 bp, Mus musculus
tgcacaaatacatgcttaggtactg

SEQ ID NO: 8633 - DNA, 25 bp, Mus musculus
aatacatgcttaggtactgagcctg

SEQ ID NO: 8634 - DNA, 25 bp, Mus musculus
gtgtgaccattagtgcgggtgtaat

SEQ ID NO: 8635 - DNA, 25 bp, Mus musculus
tcaaccaactgtgttgaaggaactg

SEQ ID NO: 8636 - DNA, 25 bp, Mus musculus
ggaactgcacgtggcatcgttgtgt

SEQ ID NO: 8637 - DNA, 25 bp, Mus musculus
ggatcgcaccgtgatgggcaggatc

SEQ ID NO: 8638 - DNA, 25 bp, Mus musculus
atcgcaccgtgatgggcaggatcgc

SEQ ID NO: 8639 - DNA, 25 bp, Mus musculus
aaatcgagcacttcatccacctcat

SEQ ID NO: 8640 - DNA, 25 bp, Mus musculus
cttcattctctctctgatccttgag

SEQ ID NO: 8641 - DNA, 25 bp, Mus musculus
tcattctctctctgatccttgagta

SEQ ID NO: 8642 - DNA, 25 bp, Mus musculus
tctctgatccttgagtacacctggc

SEQ ID NO: 8643 - DNA, 25 bp, Mus musculus
tctgatccttgagtacacctggctc

SEQ ID NO: 8644 - DNA, 25 bp, Mus musculus
atccttgagtacacctggctcgagg

SEQ ID NO: 8645 - DNA, 25 bp, Mus musculus
ttgagtacacctggctcgaggctgt

SEQ ID NO: 8646 - DNA, 25 bp, Mus musculus
cgaggctgtcatcttcctcattggt

SEQ ID NO: 8647 - DNA, 25 bp, Mus musculus
aactgcacgtggcatcgttgtgtac

SEQ ID NO: 8648 - DNA, 25 bp, Mus musculus
ctgcacgtggcatcgttgtgtacac

SEQ ID NO: 8649 - DNA, 25 bp, Mus musculus
gcacgtggcatcgttgtgtacactg

SEQ ID NO: 8650 - DNA, 25 bp, Mus musculus
ggcatcgttgtgtacactggggatc

SEQ ID NO: 8651 - DNA, 25 bp, Mus musculus
catcgttgtgtacactggggatcgc

SEQ ID NO: 8652 - DNA, 25 bp, Mus musculus
tgtgtacactggggatcgcaccgtg

SEQ ID NO: 8653 - DNA, 25 bp, Mus musculus
tgtacactggggatcgcaccgtgat

SEQ ID NO: 8654 - DNA, 25 bp, Mus musculus
tacactggggatcgcaccgtgatgg

SEQ ID NO: 8655 - DNA, 25 bp, Mus musculus
atttccctatccatgctatgatgaa

SEQ ID NO: 8656 - DNA, 25 bp, Mus musculus
ctatccatgctatgatgaatataca

SEQ ID NO: 8657 - DNA, 25 bp, Mus musculus
tattttgcgaggcatcacctctttt

SEQ ID NO: 8658 - DNA, 25 bp, Mus musculus
gcgaggcatcacctcttttggtgga

SEQ ID NO: 8659 - DNA, 25 bp, Mus musculus
agatcgccgatggcctggtgtctat

SEQ ID NO: 8660 - DNA, 25 bp, Mus musculus
ccgatggcctggtgtctatactttc

SEQ ID NO: 8661 - DNA, 25 bp, Mus musculus
tgtctatactttcctctcagataaa

SEQ ID NO: 8662 - DNA, 25 bp, Mus musculus
tactttcctctcagataaacacctc

SEQ ID NO: 8663 - DNA, 25 bp, Mus musculus
cctctcagataaacacctcaattgg

SEQ ID NO: 8664 - DNA, 25 bp, Mus musculus
agataaacacctcaattggataaag

SEQ ID NO: 8665 - DNA, 25 bp, Mus musculus
aatgtatgtctttcactccatccct

SEQ ID NO: 8666 - DNA, 25 bp, Mus musculus
tgtcacttctgtgtctgatcacaaa

SEQ ID NO: 8667 - DNA, 25 bp, Mus musculus
aaatgtggctatccttcacctacct

SEQ ID NO: 8668 - DNA, 25 bp, Mus musculus
taagtcagctccctctgaaactctg

SEQ ID NO: 8669 - DNA, 25 bp, Mus musculus
agtcaacatcactgtcatagacaga

SEQ ID NO: 8670 - DNA, 25 bp, Mus musculus
catcactgtcatagacagaaaaatc

SEQ ID NO: 8671 - DNA, 25 bp, Mus musculus
aaaggactcctgcaatggggattct

SEQ ID NO: 8672 - DNA, 25 bp, Mus musculus
ctcctgcaatggggattctggcagc

SEQ ID NO: 8673 - DNA, 25 bp, Mus musculus
tggcagccctctgctatgtgatggt

SEQ ID NO: 8674 - DNA, 25 bp, Mus musculus
ccctctgctatgtgatggtattttg

SEQ ID NO: 8675 - DNA, 25 bp, Mus musculus
gctcctgcgaccgaaaaggacttgc

SEQ ID NO: 8676 - DNA, 25 bp, Mus musculus
ctcctgcgaccgaaaaggacttgcg

SEQ ID NO: 8677 - DNA, 25 bp, Mus musculus
tgctgcgtcctgctgaccttcgggt

SEQ ID NO: 8678 - DNA, 25 bp, Mus musculus
ctgaccttcgggtttgtgagagctg

SEQ ID NO: 8679 - DNA, 25 bp, Mus musculus
tgaccttcgggtttgtgagagctga

SEQ ID NO: 8680 - DNA, 25 bp, Mus musculus
accttcgggtttgtgagagctgacg

SEQ ID NO: 8681 - DNA, 25 bp, Mus musculus
ccttcgggtttgtgagagctgacga

SEQ ID NO: 8682 - DNA, 25 bp, Mus musculus
gaaggctcacggacagacgatgaag

SEQ ID NO: 8683 - DNA, 25 bp, Mus musculus
aaggctcacggacagacgatgaagt

SEQ ID NO: 8684 - DNA, 25 bp, Mus musculus
ggctcacggacagacgatgaagttg

SEQ ID NO: 8685 - DNA, 25 bp, Mus musculus
tgtttaaattgcttcacaattaggg

SEQ ID NO: 8686 - DNA, 25 bp, Mus musculus
ttgcttcacaattaggggaccttag

SEQ ID NO: 8687 - DNA, 25 bp, Mus musculus
aaggacttgcgactctccggccacg

SEQ ID NO: 8688 - DNA, 25 bp, Mus musculus
tccggccacgcaccaatgagggtcc

SEQ ID NO: 8689 - DNA, 25 bp, Mus musculus
ccggccacgcaccaatgagggtcct

SEQ ID NO: 8690 - DNA, 25 bp, Mus musculus
ggccacgcaccaatgagggtcctgt

SEQ ID NO: 8691 - DNA, 25 bp, Mus musculus
gccacgcaccaatgagggtcctgtg

SEQ ID NO: 8692 - DNA, 25 bp, Mus musculus
cacgcaccaatgagggtcctgtggg

SEQ ID NO: 8693 - DNA, 25 bp, Mus musculus
acgcaccaatgagggtcctgtgggt

SEQ ID NO: 8694 - DNA, 25 bp, Mus musculus
caccaatgagggtcctgtgggtgct

SEQ ID NO: 8695 - DNA, 25 bp, Mus musculus
tccatcagcagacctgctggcgtct

SEQ ID NO: 8696 - DNA, 25 bp, Mus musculus
ccatcagcagacctgctggcgtctg

SEQ ID NO: 8697 - DNA, 25 bp, Mus musculus
ttctgcagttgcaactcttcgaccc

SEQ ID NO: 8698 - DNA, 25 bp, Mus musculus
tctgcagttgcaactcttcgacccg

SEQ ID NO: 8699 - DNA, 25 bp, Mus musculus
tgcaactcttcgacccggctctcga

SEQ ID NO: 8700 - DNA, 25 bp, Mus musculus
caactcttcgacccggctctcgaga

SEQ ID NO: 8701 - DNA, 25 bp, Mus musculus
actcttcgacccggctctcgagaca

SEQ ID NO: 8702 - DNA, 25 bp, Mus musculus
ctcttcgacccggctctcgagacaa

SEQ ID NO: 8703 - DNA, 25 bp, Mus musculus
cttcgacccggctctcgagacaact

SEQ ID NO: 8704 - DNA, 25 bp, Mus musculus
ttcgacccggctctcgagacaactt

SEQ ID NO: 8705 - DNA, 25 bp, Mus musculus
tcgacccggctctcgagacaacttt

SEQ ID NO: 8706 - DNA, 25 bp, Mus musculus
cgacccggctctcgagacaactttg

SEQ ID NO: 8707 - DNA, 25 bp, Mus musculus
catcagcagacctgctggcgtctgc

SEQ ID NO: 8708 - DNA, 25 bp, Mus musculus
atcagcagacctgctggcgtctgcg

SEQ ID NO: 8709 - DNA, 25 bp, Mus musculus
tcagcagacctgctggcgtctgcgg

SEQ ID NO: 8710 - DNA, 25 bp, Mus musculus
cagcagacctgctggcgtctgcggg

SEQ ID NO: 8711 - DNA, 25 bp, Mus musculus
cagacctgctggcgtctgcggggcc

SEQ ID NO: 8712 - DNA, 25 bp, Mus musculus
cagcttctgcagttgcaactcttcg

SEQ ID NO: 8713 - DNA, 25 bp, Mus musculus
gcttctgcagttgcaactcttcgac

SEQ ID NO: 8714 - DNA, 25 bp, Mus musculus
cttctgcagttgcaactcttcgacc

SEQ ID NO: 8715 - DNA, 25 bp, Mus musculus
aatatttgcggctaccccagctggt

SEQ ID NO: 8716 - DNA, 25 bp, Mus musculus
tgcggctaccccagctggtggacat

SEQ ID NO: 8717 - DNA, 25 bp, Mus musculus
acgaatacacagcccggcaaggtgc

SEQ ID NO: 8718 - DNA, 25 bp, Mus musculus
acacagcccggcaaggtgccaaatt

SEQ ID NO: 8719 - DNA, 25 bp, Mus musculus
ctctgtacggcaggttcaccatcaa

SEQ ID NO: 8720 - DNA, 25 bp, Mus musculus
acggcaggttcaccatcaagtcgga

SEQ ID NO: 8721 - DNA, 25 bp, Mus musculus
ttctgctgaccgagctcaccactaa

SEQ ID NO: 8722 - DNA, 25 bp, Mus musculus
agctcaccactaagggaagagtgcc

SEQ ID NO: 8723 - DNA, 25 bp, Mus musculus
agtgccccgagtccctgcatgacct

SEQ ID NO: 8724 - DNA, 25 bp, Mus musculus
ccctgcatgaccttatgtgccagtg

SEQ ID NO: 8725 - DNA, 25 bp, Mus musculus
ttatgtgccagtgctggcggaagga

SEQ ID NO: 8726 - DNA, 25 bp, Mus musculus
ttacgtccactgagccacagtacca

SEQ ID NO: 8727 - DNA, 25 bp, Mus musculus
tggacatgtctgctcagatcgcttc

SEQ ID NO: 8728 - DNA, 25 bp, Mus musculus
tgtctgctcagatcgcttcaggcat

SEQ ID NO: 8729 - DNA, 25 bp, Mus musculus
ctcagatcgcttcaggcatggccta

SEQ ID NO: 8730 - DNA, 25 bp, Mus musculus
tcgcttcaggcatggcctatgtgga

SEQ ID NO: 8731 - DNA, 25 bp, Mus musculus
caggcatggcctatgtggagcggat

SEQ ID NO: 8732 - DNA, 25 bp, Mus musculus
tgaactatgtgcaccgggaccttcg

SEQ ID NO: 8733 - DNA, 25 bp, Mus musculus
atgtgcaccgggaccttcgagccgc

SEQ ID NO: 8734 - DNA, 25 bp, Mus musculus
accttcgagccgccaatatcctagt

SEQ ID NO: 8735 - DNA, 25 bp, Mus musculus
agcctggtggacgatacgtgcacga

SEQ ID NO: 8736 - DNA, 25 bp, Mus musculus
aacgctacgaagccatgaccagatc

SEQ ID NO: 8737 - DNA, 25 bp, Mus musculus
atctattaccggggtgctaagctgc

SEQ ID NO: 8738 - DNA, 25 bp, Mus musculus
ctattaccggggtgctaagctgcaa

SEQ ID NO: 8739 - DNA, 25 bp, Mus musculus
ctaagctgcaatgtcctgtatgact

SEQ ID NO: 8740 - DNA, 25 bp, Mus musculus
aagctgcaatgtcctgtatgactca

SEQ ID NO: 8741 - DNA, 25 bp, Mus musculus
gctgcaatgtcctgtatgactcacc

SEQ ID NO: 8742 - DNA, 25 bp, Mus musculus
tgcaatgtcctgtatgactcaccga

SEQ ID NO: 8743 - DNA, 25 bp, Mus musculus
atgtcctgtatgactcaccgacaca

SEQ ID NO: 8744 - DNA, 25 bp, Mus musculus
gtcctgtatgactcaccgacacagc

SEQ ID NO: 8745 - DNA, 25 bp, Mus musculus
cctgtatgactcaccgacacagcac

SEQ ID NO: 8746 - DNA, 25 bp, Mus musculus
tgtatgactcaccgacacagcactt

SEQ ID NO: 8747 - DNA, 25 bp, Mus musculus
cgctacgaagccatgaccagatcta

SEQ ID NO: 8748 - DNA, 25 bp, Mus musculus
ctacgaagccatgaccagatctatt

SEQ ID NO: 8749 - DNA, 25 bp, Mus musculus
gaagccatgaccagatctattaccg

SEQ ID NO: 8750 - DNA, 25 bp, Mus musculus
agccatgaccagatctattaccggg

SEQ ID NO: 8751 - DNA, 25 bp, Mus musculus
ccatgaccagatctattaccggggt

SEQ ID NO: 8752 - DNA, 25 bp, Mus musculus
atgaccagatctattaccggggtgc

SEQ ID NO: 8753 - DNA, 25 bp, Mus musculus
ccagatctattaccggggtgctaag

SEQ ID NO: 8754 - DNA, 25 bp, Mus musculus
agatctattaccggggtgctaagct

SEQ ID NO: 8755 - DNA, 25 bp, Mus musculus
gttcaatccacaactttatcgacac

SEQ ID NO: 8756 - DNA, 25 bp, Mus musculus
tcaatccacaactttatcgacacac

SEQ ID NO: 8757 - DNA, 25 bp, Mus musculus
gcgggatccaccttacaatagaaat

SEQ ID NO: 8758 - DNA, 25 bp, Mus musculus
gggatccaccttacaatagaaatga

SEQ ID NO: 8759 - DNA, 25 bp, Mus musculus
gatccaccttacaatagaaatgaac

SEQ ID NO: 8760 - DNA, 25 bp, Mus musculus
tccaccttacaatagaaatgaacaa

SEQ ID NO: 8761 - DNA, 25 bp, Mus musculus
aatgaacaagtctgctacctcttcg

SEQ ID NO: 8762 - DNA, 25 bp, Mus musculus
tgaacaagtctgctacctcttcgtc

SEQ ID NO: 8763 - DNA, 25 bp, Mus musculus
ctcttcgtccccagggagcccaatg

SEQ ID NO: 8764 - DNA, 25 bp, Mus musculus
tcgtccccagggagcccaatggcat

SEQ ID NO: 8765 - DNA, 25 bp, Mus musculus
ccagggagcccaatggcatagtttg

SEQ ID NO: 8766 - DNA, 25 bp, Mus musculus
agcccaatggcatagtttggaaaca

SEQ ID NO: 8767 - DNA, 25 bp, Mus musculus
tgaagatgacgctcctactaaacgc

SEQ ID NO: 8768 - DNA, 25 bp, Mus musculus
aagatgacgctcctactaaacgcaa

SEQ ID NO: 8769 - DNA, 25 bp, Mus musculus
gatgacgctcctactaaacgcaact

SEQ ID NO: 8770 - DNA, 25 bp, Mus musculus
tgacgctcctactaaacgcaactcc

SEQ ID NO: 8771 - DNA, 25 bp, Mus musculus
ataacaatgccgttgacagcgggat

SEQ ID NO: 8772 - DNA, 25 bp, Mus musculus
caatgccgttgacagcgggatccac

SEQ ID NO: 8773 - DNA, 25 bp, Mus musculus
atgccgttgacagcgggatccacct

SEQ ID NO: 8774 - DNA, 25 bp, Mus musculus
cagcgggatccaccttacaatagaa

SEQ ID NO: 8775 - DNA, 25 bp, Mus musculus
cacgctcagctttgtctgcacaact

SEQ ID NO: 8776 - DNA, 25 bp, Mus musculus
ctcagctttgtctgcacaactaaat

SEQ ID NO: 8777 - DNA, 25 bp, Mus musculus
catcacaccagggctccgacatgtc

SEQ ID NO: 8778 - DNA, 25 bp, Mus musculus
accagggctccgacatgtcacggac

SEQ ID NO: 8779 - DNA, 25 bp, Mus musculus
cagggctccgacatgtcacggacga

SEQ ID NO: 8780 - DNA, 25 bp, Mus musculus
gggctccgacatgtcacggacgacg

SEQ ID NO: 8781 - DNA, 25 bp, Mus musculus
tccgacatgtcacggacgacgagaa

SEQ ID NO: 8782 - DNA, 25 bp, Mus musculus
cgacatgtcacggacgacgagaaaa

SEQ ID NO: 8783 - DNA, 25 bp, Mus musculus
acatgtcacggacgacgagaaaata

SEQ ID NO: 8784 - DNA, 25 bp, Mus musculus
atgtcacggacgacgagaaaatata

SEQ ID NO: 8785 - DNA, 25 bp, Mus musculus
atatacgagaatcccagcttgaggg

SEQ ID NO: 8786 - DNA, 25 bp, Mus musculus
acgagaatcccagcttgagggccca

SEQ ID NO: 8787 - DNA, 25 bp, Mus musculus
cagctttgtctgcacaactaaatca

SEQ ID NO: 8788 - DNA, 25 bp, Mus musculus
gaatcccagcttgagggcccaagga

SEQ ID NO: 8789 - DNA, 25 bp, Mus musculus
gctttgtctgcacaactaaatcagg

SEQ ID NO: 8790 - DNA, 25 bp, Mus musculus
tttgtctgcacaactaaatcaggga

SEQ ID NO: 8791 - DNA, 25 bp, Mus musculus
tctgcacaactaaatcagggagaag

SEQ ID NO: 8792 - DNA, 25 bp, Mus musculus
tgcacaactaaatcagggagaagcc

SEQ ID NO: 8793 - DNA, 25 bp, Mus musculus
agaagccatcacaccagggctccga

SEQ ID NO: 8794 - DNA, 25 bp, Mus musculus
aagccatcacaccagggctccgaca

SEQ ID NO: 8795 - DNA, 25 bp, Mus musculus
gccatcacaccagggctccgacatg

SEQ ID NO: 8796 - DNA, 25 bp, Mus musculus
ctattgacgctgtgtgagatatcat

SEQ ID NO: 8797 - DNA, 25 bp, Mus musculus
gatatcatagctgtcttgtttccga

SEQ ID NO: 8798 - DNA, 25 bp, Mus musculus
gatacctgacataccagccgtatat

SEQ ID NO: 8799 - DNA, 25 bp, Mus musculus
tacctgacataccagccgtatatcg

SEQ ID NO: 8800 - DNA, 25 bp, Mus musculus
acctgacataccagccgtatatcgc

SEQ ID NO: 8801 - DNA, 25 bp, Mus musculus
ctgacataccagccgtatatcgcag

SEQ ID NO: 8802 - DNA, 25 bp, Mus musculus
tgacataccagccgtatatcgcaga

SEQ ID NO: 8803 - DNA, 25 bp, Mus musculus
ccgtatatcgcagactggatcaagg

SEQ ID NO: 8804 - DNA, 25 bp, Mus musculus
cgtatatcgcagactggatcaagga

SEQ ID NO: 8805 - DNA, 25 bp, Mus musculus
tatatcgcagactggatcaaggaga

SEQ ID NO: 8806 - DNA, 25 bp, Mus musculus
atatcgcagactggatcaaggagaa

SEQ ID NO: 8807 - DNA, 25 bp, Mus musculus
atcgcagactggatcaaggagaaga

SEQ ID NO: 8808 - DNA, 25 bp, Mus musculus
atatcatagctgtcttgtttccgag

SEQ ID NO: 8809 - DNA, 25 bp, Mus musculus
ttgtttccgagctgatacctgacat

SEQ ID NO: 8810 - DNA, 25 bp, Mus musculus
tgtttccgagctgatacctgacata

SEQ ID NO: 8811 - DNA, 25 bp, Mus musculus
tttccgagctgatacctgacatacc

SEQ ID NO: 8812 - DNA, 25 bp, Mus musculus
ttccgagctgatacctgacatacca

SEQ ID NO: 8813 - DNA, 25 bp, Mus musculus
ccgagctgatacctgacataccagc

SEQ ID NO: 8814 - DNA, 25 bp, Mus musculus
agctgatacctgacataccagccgt

SEQ ID NO: 8815 - DNA, 25 bp, Mus musculus
gctgatacctgacataccagccgta

SEQ ID NO: 8816 - DNA, 25 bp, Mus musculus
agaatccgcgttgaagcacagagca

SEQ ID NO: 8817 - DNA, 25 bp, Mus musculus
gaatccgcgttgaagcacagagcat

SEQ ID NO: 8818 - DNA, 25 bp, Mus musculus
ttagctcctctgtcagaacgaatgg

SEQ ID NO: 8819 - DNA, 25 bp, Mus musculus
aactgggacaccagagaagggagat

SEQ ID NO: 8820 - DNA, 25 bp, Mus musculus
actgggacaccagagaagggagatg

SEQ ID NO: 8821 - DNA, 25 bp, Mus musculus
agatgctattacccggatcaaagag

SEQ ID NO: 8822 - DNA, 25 bp, Mus musculus
agtacaacactgtaggaggcaagta

SEQ ID NO: 8823 - DNA, 25 bp, Mus musculus
ggtggtacagaccttccaggaactg

SEQ ID NO: 8824 - DNA, 25 bp, Mus musculus
tacagaccttccaggaactggtgtg

SEQ ID NO: 8825 - DNA, 25 bp, Mus musculus
acagaccttccaggaactggtgtga

SEQ ID NO: 8826 - DNA, 25 bp, Mus musculus
cagaccttccaggaactggtgtgaa

SEQ ID NO: 8827 - DNA, 25 bp, Mus musculus
gaccttccaggaactggtgtgaaca

SEQ ID NO: 8828 - DNA, 25 bp, Mus musculus
aatccgcgttgaagcacagagcatt

SEQ ID NO: 8829 - DNA, 25 bp, Mus musculus
cacagagcatttagctcctctgtca

SEQ ID NO: 8830 - DNA, 25 bp, Mus musculus
acagagcatttagctcctctgtcag

SEQ ID NO: 8831 - DNA, 25 bp, Mus musculus
agagcatttagctcctctgtcagaa

SEQ ID NO: 8832 - DNA, 25 bp, Mus musculus
gagcatttagctcctctgtcagaac

SEQ ID NO: 8833 - DNA, 25 bp, Mus musculus
agcatttagctcctctgtcagaacg

SEQ ID NO: 8834 - DNA, 25 bp, Mus musculus
gcatttagctcctctgtcagaacga

SEQ ID NO: 8835 - DNA, 25 bp, Mus musculus
atttagctcctctgtcagaacgaat

SEQ ID NO: 8836 - DNA, 25 bp, Mus musculus
cctccaagtgtactctttggttcat

SEQ ID NO: 8837 - DNA, 25 bp, Mus musculus
ctccaagtgtactctttggttcatg

SEQ ID NO: 8838 - DNA, 25 bp, Mus musculus
tgttcatactgttgttcctcctata

SEQ ID NO: 8839 - DNA, 25 bp, Mus musculus
gttcatactgttgttcctcctatag

SEQ ID NO: 8840 - DNA, 25 bp, Mus musculus
ttcatactgttgttcctcctatagg

SEQ ID NO: 8841 - DNA, 25 bp, Mus musculus
tcatactgttgttcctcctataggg

SEQ ID NO: 8842 - DNA, 25 bp, Mus musculus
catactgttgttcctcctatagggt

SEQ ID NO: 8843 - DNA, 25 bp, Mus musculus
tactgttgttcctcctatagggttg

SEQ ID NO: 8844 - DNA, 25 bp, Mus musculus
ctgttgttcctcctatagggttgca

SEQ ID NO: 8845 - DNA, 25 bp, Mus musculus
tgttgttcctcctatagggttgcaa

SEQ ID NO: 8846 - DNA, 25 bp, Mus musculus
tccaagtgtactctttggttcatgg

SEQ ID NO: 8847 - DNA, 25 bp, Mus musculus
ccaagtgtactctttggttcatggt

SEQ ID NO: 8848 - DNA, 25 bp, Mus musculus
caagtgtactctttggttcatggtt

SEQ ID NO: 8849 - DNA, 25 bp, Mus musculus
gtgtactctttggttcatggtttag

SEQ ID NO: 8850 - DNA, 25 bp, Mus musculus
tcatggtttagttcctgggaaatct

SEQ ID NO: 8851 - DNA, 25 bp, Mus musculus
catggtttagttcctgggaaatctg

SEQ ID NO: 8852 - DNA, 25 bp, Mus musculus
agtgttcatactgttgttcctccta

SEQ ID NO: 8853 - DNA, 25 bp, Mus musculus
gtgttcatactgttgttcctcctat

SEQ ID NO: 8854 - DNA, 25 bp, Mus musculus
gacacagtctacatgggcaaagtga

SEQ ID NO: 8855 - DNA, 25 bp, Mus musculus
ctcggacagcgacaccgcctggtgc

SEQ ID NO: 8856 - DNA, 25 bp, Mus musculus
ggtcgtctcatctcctaagcactcc

SEQ ID NO: 8857 - DNA, 25 bp, Mus musculus
tttggtcccactgcccagtgcacgg

SEQ ID NO: 8858 - DNA, 25 bp, Mus musculus
cacatgctaacttcttgagtggttc

SEQ ID NO: 8859 - DNA, 25 bp, Mus musculus
atgctaacttcttgagtggttcact

SEQ ID NO: 8860 - DNA, 25 bp, Mus musculus
ctaacttcttgagtggttcactatc

SEQ ID NO: 8861 - DNA, 25 bp, Mus musculus
acttcttgagtggttcactatcgcc

SEQ ID NO: 8862 - DNA, 25 bp, Mus musculus
gttcactatcgcctggtctggtcag

SEQ ID NO: 8863 - DNA, 25 bp, Mus musculus
tatcgcctggtctggtcagggttct

SEQ ID NO: 8864 - DNA, 25 bp, Mus musculus
cgcctggtctggtcagggttctgct

SEQ ID NO: 8865 - DNA, 25 bp, Mus musculus
ctggtctggtcagggttctgctact

SEQ ID NO: 8866 - DNA, 25 bp, Mus musculus
gtgctgacccaggagcagctgcacc

SEQ ID NO: 8867 - DNA, 25 bp, Mus musculus
tggtctggtcagggttctgctactt

SEQ ID NO: 8868 - DNA, 25 bp, Mus musculus
ctgacccaggagcagctgcaccagc

SEQ ID NO: 8869 - DNA, 25 bp, Mus musculus
acccaggagcagctgcaccagcttc

SEQ ID NO: 8870 - DNA, 25 bp, Mus musculus
cagctgcaccagcttcacggtcgtc

SEQ ID NO: 8871 - DNA, 25 bp, Mus musculus
ctgcaccagcttcacggtcgtctca

SEQ ID NO: 8872 - DNA, 25 bp, Mus musculus
caccagcttcacggtcgtctcatct

SEQ ID NO: 8873 - DNA, 25 bp, Mus musculus
cagcttcacggtcgtctcatctcct

SEQ ID NO: 8874 - DNA, 25 bp, Mus musculus
cacggtcgtctcatctcctaagcac

SEQ ID NO: 8875 - DNA, 25 bp, Mus musculus
ctttcgcaggatcctgctaagacca

SEQ ID NO: 8876 - DNA, 25 bp, Mus musculus
caggatcctgctaagaccatcacgt

SEQ ID NO: 8877 - DNA, 25 bp, Mus musculus
gggctcgaacacccacatgcagtga

SEQ ID NO: 8878 - DNA, 25 bp, Mus musculus
gaacacccacatgcagtgatctgag

SEQ ID NO: 8879 - DNA, 25 bp, Mus musculus
atctgagcagcagcgagaatgacct

SEQ ID NO: 8880 - DNA, 25 bp, Mus musculus
atgaccttatgtacatggctgtcct

SEQ ID NO: 8881 - DNA, 25 bp, Mus musculus
acatggctgtcctggtcctctctgg

SEQ ID NO: 8882 - DNA, 25 bp, Mus musculus
gaccgctgtggtaccagggtccagt

SEQ ID NO: 8883 - DNA, 25 bp, Mus musculus
tgtggtaccagggtccagtgatgga

SEQ ID NO: 8884 - DNA, 25 bp, Mus musculus
accagggtccagtgatggaatgttt

SEQ ID NO: 8885 - DNA, 25 bp, Mus musculus
cttgaactctgtgccactgtgccag

SEQ ID NO: 8886 - DNA, 25 bp, Mus musculus
ctctgtgccactgtgccaggacttg

SEQ ID NO: 8887 - DNA, 25 bp, Mus musculus
cctgctaagaccatcacgtcgcatt

SEQ ID NO: 8888 - DNA, 25 bp, Mus musculus
gtcgggacctccagagaagactgaa

SEQ ID NO: 8889 - DNA, 25 bp, Mus musculus
cagtcagatcgcacaggctggcact

SEQ ID NO: 8890 - DNA, 25 bp, Mus musculus
gccacggccctgcacagggactgct

SEQ ID NO: 8891 - DNA, 25 bp, Mus musculus
gcagcagcttctgccccaggaggcc

SEQ ID NO: 8892 - DNA, 25 bp, Mus musculus
gcttctgccccaggaggccacagct

SEQ ID NO: 8893 - DNA, 25 bp, Mus musculus
cagcacactgagccatctgtaagga

SEQ ID NO: 8894 - DNA, 25 bp, Mus musculus
actgagccatctgtaaggaccttca

SEQ ID NO: 8895 - DNA, 25 bp, Mus musculus
aaacgctcccagacagatcaatctc

SEQ ID NO: 8896 - DNA, 25 bp, Mus musculus
acgctcccagacagatcaatctcag

SEQ ID NO: 8897 - DNA, 25 bp, Mus musculus
tggtgtcttgcacattggctgctct

SEQ ID NO: 8898 - DNA, 25 bp, Mus musculus
gtgtcttgcacattggctgctctgt

SEQ ID NO: 8899 - DNA, 25 bp, Mus musculus
tgtcttgcacattggctgctctgtg

SEQ ID NO: 8900 - DNA, 25 bp, Mus musculus
gcacattggctgctctgtgccattc

SEQ ID NO: 8901 - DNA, 25 bp, Mus musculus
ttggctgctctgtgccattcagttc

SEQ ID NO: 8902 - DNA, 25 bp, Mus musculus
tggctgctctgtgccattcagttcc

SEQ ID NO: 8903 - DNA, 25 bp, Mus musculus
gctgctctgtgccattcagttcccc

SEQ ID NO: 8904 - DNA, 25 bp, Mus musculus
ctgctctgtgccattcagttcccct

SEQ ID NO: 8905 - DNA, 25 bp, Mus musculus
tctctctgcagacagaacagcagaa

SEQ ID NO: 8906 - DNA, 25 bp, Mus musculus
tctctgcagacagaacagcagaagg

SEQ ID NO: 8907 - DNA, 25 bp, Mus musculus
ctcccagacagatcaatctcagcgc

SEQ ID NO: 8908 - DNA, 25 bp, Mus musculus
tcccagacagatcaatctcagcgcg

SEQ ID NO: 8909 - DNA, 25 bp, Mus musculus
cagacagatcaatctcagcgcgggt

SEQ ID NO: 8910 - DNA, 25 bp, Mus musculus
gatcaatctcagcgcgggtaacctt

SEQ ID NO: 8911 - DNA, 25 bp, Mus musculus
tcaatctcagcgcgggtaaccttat

SEQ ID NO: 8912 - DNA, 25 bp, Mus musculus
tgagctaatcaaggacctgggaaaa

SEQ ID NO: 8913 - DNA, 25 bp, Mus musculus
ttctcgtggtgtcttgcacattggc

SEQ ID NO: 8914 - DNA, 25 bp, Mus musculus
tcgtggtgtcttgcacattggctgc

SEQ ID NO: 8915 - DNA, 25 bp, Mus musculus
gaaacggcctggtcgatattggtga

SEQ ID NO: 8916 - DNA, 25 bp, Mus musculus
aacggcctggtcgatattggtgatc

SEQ ID NO: 8917 - DNA, 25 bp, Mus musculus
cgctgattgagtcttcatggtcagt

SEQ ID NO: 8918 - DNA, 25 bp, Mus musculus
ttgagtcttcatggtcagtttggca

SEQ ID NO: 8919 - DNA, 25 bp, Mus musculus
gagtcttcatggtcagtttggcatt

SEQ ID NO: 8920 - DNA, 25 bp, Mus musculus
gtcttcatggtcagtttggcatttt

SEQ ID NO: 8921 - DNA, 25 bp, Mus musculus
cttcatggtcagtttggcattttgt

SEQ ID NO: 8922 - DNA, 25 bp, Mus musculus
tcagtttggcattttgtggcctctg

SEQ ID NO: 8923 - DNA, 25 bp, Mus musculus
agtttggcattttgtggcctctggg

SEQ ID NO: 8924 - DNA, 25 bp, Mus musculus
tggcattttgtggcctctggggctt

SEQ ID NO: 8925 - DNA, 25 bp, Mus musculus
gcattttgtggcctctggggcttgc

SEQ ID NO: 8926 - DNA, 25 bp, Mus musculus
ggcttgcctgcggcaatgggcgttt

SEQ ID NO: 8927 - DNA, 25 bp, Mus musculus
cggcctggtcgatattggtgatcct

SEQ ID NO: 8928 - DNA, 25 bp, Mus musculus
tattggtgatcctaagccattgcca

SEQ ID NO: 8929 - DNA, 25 bp, Mus musculus
ggtgatcctaagccattgccaaaat

SEQ ID NO: 8930 - DNA, 25 bp, Mus musculus
tgatcctaagccattgccaaaatga

SEQ ID NO: 8931 - DNA, 25 bp, Mus musculus
atcctaagccattgccaaaatgaag

SEQ ID NO: 8932 - DNA, 25 bp, Mus musculus
cctaagccattgccaaaatgaagac

SEQ ID NO: 8933 - DNA, 25 bp, Mus musculus
gtcaacctggccgtcgctgattgag

SEQ ID NO: 8934 - DNA, 25 bp, Mus musculus
caacctggccgtcgctgattgagtc

SEQ ID NO: 8935 - DNA, 25 bp, Mus musculus
ttgaatggttcctccaaggaaatgt

SEQ ID NO: 8936 - DNA, 25 bp, Mus musculus
ttctattcggatcatggtttgagca

SEQ ID NO: 8937 - DNA, 25 bp, Mus musculus
ctaatggcttgaagctcatgagaaa

SEQ ID NO: 8938 - DNA, 25 bp, Mus musculus
gtacaactggggactggaagaatca

SEQ ID NO: 8939 - DNA, 25 bp, Mus musculus
agaatcacttcacagtagcccaagc

SEQ ID NO: 8940 - DNA, 25 bp, Mus musculus
atcacttcacagtagcccaagctga

SEQ ID NO: 8941 - DNA, 25 bp, Mus musculus
tcacagtagcccaagctgaagcctt

SEQ ID NO: 8942 - DNA, 25 bp, Mus musculus
cagtagcccaagctgaagccttcga

SEQ ID NO: 8943 - DNA, 25 bp, Mus musculus
tagcccaagctgaagccttcgataa

SEQ ID NO: 8944 - DNA, 25 bp, Mus musculus
cccaagctgaagccttcgataaagt

SEQ ID NO: 8945 - DNA, 25 bp, Mus musculus
ttctatatcttgaatacctgaatat

SEQ ID NO: 8946 - DNA, 25 bp, Mus musculus
atcttgaatacctgaatatggtcat

SEQ ID NO: 8947 - DNA, 25 bp, Mus musculus
tattcggatcatggtttgagcatgt

SEQ ID NO: 8948 - DNA, 25 bp, Mus musculus
acttcttggtactatactatgaaga

SEQ ID NO: 8949 - DNA, 25 bp, Mus musculus
agaagatctgtgacttcctagggaa

SEQ ID NO: 8950 - DNA, 25 bp, Mus musculus
atttagggccagatgagctggatct

SEQ ID NO: 8951 - DNA, 25 bp, Mus musculus
tcgtcctcaagtacagctccttcca

SEQ ID NO: 8952 - DNA, 25 bp, Mus musculus
tcctcaagtacagctccttccaagc

SEQ ID NO: 8953 - DNA, 25 bp, Mus musculus
tcaagtacagctccttccaagccat

SEQ ID NO: 8954 - DNA, 25 bp, Mus musculus
acaacatgtccaattatagtctcat

SEQ ID NO: 8955 - DNA, 25 bp, Mus musculus
cctttgctacgtgtggcagctatca

SEQ ID NO: 8956 - DNA, 25 bp, Mus musculus
ttgctacgtgtggcagctatcaccg

SEQ ID NO: 8957 - DNA, 25 bp, Mus musculus
caccaagtgtactttcgatgcaccc

SEQ ID NO: 8958 - DNA, 25 bp, Mus musculus
agtgtactttcgatgcacccgtcct

SEQ ID NO: 8959 - DNA, 25 bp, Mus musculus
gtgtactttcgatgcacccgtcctg

SEQ ID NO: 8960 - DNA, 25 bp, Mus musculus
tgtactttcgatgcacccgtcctgc

SEQ ID NO: 8961 - DNA, 25 bp, Mus musculus
gtactttcgatgcacccgtcctgct

SEQ ID NO: 8962 - DNA, 25 bp, Mus musculus
tactttcgatgcacccgtcctgctg

SEQ ID NO: 8963 - DNA, 25 bp, Mus musculus
actttcgatgcacccgtcctgctgt

SEQ ID NO: 8964 - DNA, 25 bp, Mus musculus
tcctgctgtcaaacgggggcactac

SEQ ID NO: 8965 - DNA, 25 bp, Mus musculus
ctgctgtcaaacgggggcactacca

SEQ ID NO: 8966 - DNA, 25 bp, Mus musculus
tcaaacgggggcactaccaagatct

SEQ ID NO: 8967 - DNA, 25 bp, Mus musculus
ctatcaccggggagcttcggctgag

SEQ ID NO: 8968 - DNA, 25 bp, Mus musculus
tatcaccggggagcttcggctgagc

SEQ ID NO: 8969 - DNA, 25 bp, Mus musculus
agtgtgccaacaagactggagagtg

SEQ ID NO: 8970 - DNA, 25 bp, Mus musculus
gtgtgccaacaagactggagagtgc

SEQ ID NO: 8971 - DNA, 25 bp, Mus musculus
tgtgccaacaagactggagagtgcc

SEQ ID NO: 8972 - DNA, 25 bp, Mus musculus
aggctgcaccaagtgtactttcgat

SEQ ID NO: 8973 - DNA, 25 bp, Mus musculus
ggctgcaccaagtgtactttcgatg

SEQ ID NO: 8974 - DNA, 25 bp, Mus musculus
gcaccaagtgtactttcgatgcacc

SEQ ID NO: 8975 - DNA, 25 bp, Mus musculus
tgagattctcccatctggtgaacga

SEQ ID NO: 8976 - DNA, 25 bp, Mus musculus
gattctcccatctggtgaacgaccg

SEQ ID NO: 8977 - DNA, 25 bp, Mus musculus
aaccagaagcgtatcaccactccat

SEQ ID NO: 8978 - DNA, 25 bp, Mus musculus
cagaagcgtatcaccactccataca

SEQ ID NO: 8979 - DNA, 25 bp, Mus musculus
aagcgtatcaccactccatacatga

SEQ ID NO: 8980 - DNA, 25 bp, Mus musculus
accaagtacgagcgagcccgagtgc

SEQ ID NO: 8981 - DNA, 25 bp, Mus musculus
tacgagcgagcccgagtgctgggca

SEQ ID NO: 8982 - DNA, 25 bp, Mus musculus
ctgggcaccgggctctccagattgc

SEQ ID NO: 8983 - DNA, 25 bp, Mus musculus
ggcaccgggctctccagattgcgat

SEQ ID NO: 8984 - DNA, 25 bp, Mus musculus
agattgcgatgtgtgccccagtaat

SEQ ID NO: 8985 - DNA, 25 bp, Mus musculus
ttgcgatgtgtgccccagtaatggt

SEQ ID NO: 8986 - DNA, 25 bp, Mus musculus
cgatgtgtgccccagtaatggtgga

SEQ ID NO: 8987 - DNA, 25 bp, Mus musculus
tctcccatctggtgaacgaccgcag

SEQ ID NO: 8988 - DNA, 25 bp, Mus musculus
cccatctggtgaacgaccgcagcca

SEQ ID NO: 8989 - DNA, 25 bp, Mus musculus
tggtgaacgaccgcagccaaccaga

SEQ ID NO: 8990 - DNA, 25 bp, Mus musculus
tgaacgaccgcagccaaccagaagc

SEQ ID NO: 8991 - DNA, 25 bp, Mus musculus
acgaccgcagccaaccagaagcgta

SEQ ID NO: 8992 - DNA, 25 bp, Mus musculus
accgcagccaaccagaagcgtatca

SEQ ID NO: 8993 - DNA, 25 bp, Mus musculus
gcagccaaccagaagcgtatcacca

SEQ ID NO: 8994 - DNA, 25 bp, Mus musculus
gccaaccagaagcgtatcaccactc

SEQ ID NO: 8995 - DNA, 25 bp, Mus musculus
tcggcatctcacgacctccttaaga

SEQ ID NO: 8996 - DNA, 25 bp, Mus musculus
tctcacgacctccttaagatgagtg

SEQ ID NO: 8997 - DNA, 25 bp, Mus musculus
aagtacctggagcacctctctgggg

SEQ ID NO: 8998 - DNA, 25 bp, Mus musculus
gtacctggagcacctctctggggat

SEQ ID NO: 8999 - DNA, 25 bp, Mus musculus
gatggcaaagccatcggtgtcctga

SEQ ID NO: 9000 - DNA, 25 bp, Mus musculus
gcaaagccatcggtgtcctgaccag

SEQ ID NO: 9001 - DNA, 25 bp, Mus musculus
aaagccatcggtgtcctgaccagcg

SEQ ID NO: 9002 - DNA, 25 bp, Mus musculus
agccatcggtgtcctgaccagcggc

SEQ ID NO: 9003 - DNA, 25 bp, Mus musculus
gtgctgtggtgcgcatgggaatata

SEQ ID NO: 9004 - DNA, 25 bp, Mus musculus
gctgtggtgcgcatgggaatataca

SEQ ID NO: 9005 - DNA, 25 bp, Mus musculus
tggaggctccaatattgtggaagcc

SEQ ID NO: 9006 - DNA, 25 bp, Mus musculus
tgtctcagcattctacaagtgggtg

SEQ ID NO: 9007 - DNA, 25 bp, Mus musculus
tcacgacctccttaagatgagtgac

SEQ ID NO: 9008 - DNA, 25 bp, Mus musculus
acgacctccttaagatgagtgacca

SEQ ID NO: 9009 - DNA, 25 bp, Mus musculus
gagtgaccaggactcttcgacgtcc

SEQ ID NO: 9010 - DNA, 25 bp, Mus musculus
gtgaccaggactcttcgacgtccag

SEQ ID NO: 9011 - DNA, 25 bp, Mus musculus
gaccaggactcttcgacgtccagca

SEQ ID NO: 9012 - DNA, 25 bp, Mus musculus
aggactcttcgacgtccagcacctc

SEQ ID NO: 9013 - DNA, 25 bp, Mus musculus
tttccgaagtacctggagcacctct

SEQ ID NO: 9014 - DNA, 25 bp, Mus musculus
cgaagtacctggagcacctctctgg

SEQ ID NO: 9015 - DNA, 25 bp, Mus musculus
aacttatcaccatgaaacccactgc

SEQ ID NO: 9016 - DNA, 25 bp, Mus musculus
tcaccatgaaacccactgccatggc

SEQ ID NO: 9017 - DNA, 25 bp, Mus musculus
gggtccctggtctcacagaagcaga

SEQ ID NO: 9018 - DNA, 25 bp, Mus musculus
ctggtctcacagaagcagagaagac

SEQ ID NO: 9019 - DNA, 25 bp, Mus musculus
ctgttacagattccagtgagtgacc

SEQ ID NO: 9020 - DNA, 25 bp, Mus musculus
caaggtccttgtccgtgtcttctgt

SEQ ID NO: 9021 - DNA, 25 bp, Mus musculus
ccttgtccgtgtcttctgttcacag

SEQ ID NO: 9022 - DNA, 25 bp, Mus musculus
ttcacagattcaggctgaacaaagg

SEQ ID NO: 9023 - DNA, 25 bp, Mus musculus
catcccagcaccagagactgcagtt

SEQ ID NO: 9024 - DNA, 25 bp, Mus musculus
agcaccagagactgcagtttccctc

SEQ ID NO: 9025 - DNA, 25 bp, Mus musculus
ctactgctgcaggctcacagacctc

SEQ ID NO: 9026 - DNA, 25 bp, Mus musculus
agacctcagtcatgtgataagctat

SEQ ID NO: 9027 - DNA, 25 bp, Mus musculus
tgaaacccactgccatggcactgat

SEQ ID NO: 9028 - DNA, 25 bp, Mus musculus
cactgatgtgcctgctgctggctgc

SEQ ID NO: 9029 - DNA, 25 bp, Mus musculus
gcatgcttacggtctccaatagctg

SEQ ID NO: 9030 - DNA, 25 bp, Mus musculus
ttacggtctccaatagctgctgctt

SEQ ID NO: 9031 - DNA, 25 bp, Mus musculus
tctccaatagctgctgcttgaacac

SEQ ID NO: 9032 - DNA, 25 bp, Mus musculus
atagctgctgcttgaacaccttgaa

SEQ ID NO: 9033 - DNA, 25 bp, Mus musculus
agcttcccctgaagtttatccagtg

SEQ ID NO: 9034 - DNA, 25 bp, Mus musculus
agtttatccagtgttacagaaagat

SEQ ID NO: 9035 - DNA, 25 bp, Mus musculus
tgcttccagatagtctccactgtac

SEQ ID NO: 9036 - DNA, 25 bp, Mus musculus
cagatagtctccactgtacataaaa

SEQ ID NO: 9037 - DNA, 25 bp, Mus musculus
cctatgtctgcattccccagaattc

SEQ ID NO: 9038 - DNA, 25 bp, Mus musculus
tctgcattccccagaattctccact

SEQ ID NO: 9039 - DNA, 25 bp, Mus musculus
cctgctgctggaccctgctgtgtct

SEQ ID NO: 9040 - DNA, 25 bp, Mus musculus
aggattcttctctccaaaggtcact

SEQ ID NO: 9041 - DNA, 25 bp, Mus musculus
tccaaaggtcactccgatgttattt

SEQ ID NO: 9042 - DNA, 25 bp, Mus musculus
tttgattcctggggcagaaatatga

SEQ ID NO: 9043 - DNA, 25 bp, Mus musculus
agcccaagccagccaagagctctca

SEQ ID NO: 9044 - DNA, 25 bp, Mus musculus
agccagccaagagctctcattctta

SEQ ID NO: 9045 - DNA, 25 bp, Mus musculus
ccacaccaagcactttgtttctaat

SEQ ID NO: 9046 - DNA, 25 bp, Mus musculus
caagcactttgtttctaatatcttt

SEQ ID NO: 9047 - DNA, 25 bp, Mus musculus
gtctccactgtacataaaagtcaca

SEQ ID NO: 9048 - DNA, 25 bp, Mus musculus
cataaaagtcacactgtgtgcttgc

SEQ ID NO: 9049 - DNA, 25 bp, Mus musculus
agtcacactgtgtgcttgcattcct

SEQ ID NO: 9050 - DNA, 25 bp, Mus musculus
tgcttgcattcctgtatggtagtgg

SEQ ID NO: 9051 - DNA, 25 bp, Mus musculus
gtgactgtctctcacaccaccttct

SEQ ID NO: 9052 - DNA, 25 bp, Mus musculus
accttctctatcacgtcacagtttt

SEQ ID NO: 9053 - DNA, 25 bp, Mus musculus
tctatcacgtcacagttttctcctc

SEQ ID NO: 9054 - DNA, 25 bp, Mus musculus
acgtcacagttttctcctcctcagc

SEQ ID NO: 9055 - DNA, 25 bp, Mus musculus
tgctcagggtctcagcctggcaaca

SEQ ID NO: 9056 - DNA, 25 bp, Mus musculus
atccctacagaaaactgcagcaaga

SEQ ID NO: 9057 - DNA, 25 bp, Mus musculus
ctgtatacataactctgctacctca

SEQ ID NO: 9058 - DNA, 25 bp, Mus musculus
tatacataactctgctacctcactg

SEQ ID NO: 9059 - DNA, 25 bp, Mus musculus
taactctgctacctcactgtagcct

SEQ ID NO: 9060 - DNA, 25 bp, Mus musculus
tgctacctcactgtagcctccaggt

SEQ ID NO: 9061 - DNA, 25 bp, Mus musculus
agcaacactcctgtctgccacggca

SEQ ID NO: 9062 - DNA, 25 bp, Mus musculus
cagccctcagccatgaaataactta

SEQ ID NO: 9063 - DNA, 25 bp, Mus musculus
ccctcagccatgaaataacttattg

SEQ ID NO: 9064 - DNA, 25 bp, Mus musculus
aatggcctgttacactcaaggtgat

SEQ ID NO: 9065 - DNA, 25 bp, Mus musculus
cttttcattgactgtcaaactagaa

SEQ ID NO: 9066 - DNA, 25 bp, Mus musculus
ttcattgactgtcaaactagaaacc

SEQ ID NO: 9067 - DNA, 25 bp, Mus musculus
aactgcagcaagaccgtgagtccag

SEQ ID NO: 9068 - DNA, 25 bp, Mus musculus
aagaccgtgagtccagcctgtggcc

SEQ ID NO: 9069 - DNA, 25 bp, Mus musculus
ctggtccacacagggcaactgaggc

SEQ ID NO: 9070 - DNA, 25 bp, Mus musculus
caactgaggcaggcagcagcttgag

SEQ ID NO: 9071 - DNA, 25 bp, Mus musculus
acatggtttgctgcctatgccctgg

SEQ ID NO: 9072 - DNA, 25 bp, Mus musculus
tggtttgctgcctatgccctggggg

SEQ ID NO: 9073 - DNA, 25 bp, Mus musculus
ctggggtccctggcaatattactgt

SEQ ID NO: 9074 - DNA, 25 bp, Mus musculus
ttactgtatacataactctgctacc

SEQ ID NO: 9075 - DNA, 25 bp, Mus musculus
gaaaggatccacctggaggaagagg

SEQ ID NO: 9076 - DNA, 25 bp, Mus musculus
atccacctggaggaagagggcccag

SEQ ID NO: 9077 - DNA, 25 bp, Mus musculus
cacctggacggccgcacattttaca

SEQ ID NO: 9078 - DNA, 25 bp, Mus musculus
cctggacggccgcacattttacatt

SEQ ID NO: 9079 - DNA, 25 bp, Mus musculus
tggacggccgcacattttacattga

SEQ ID NO: 9080 - DNA, 25 bp, Mus musculus
gacggccgcacattttacattgacc

SEQ ID NO: 9081 - DNA, 25 bp, Mus musculus
cggccgcacattttacattgaccat

SEQ ID NO: 9082 - DNA, 25 bp, Mus musculus
gccgcacattttacattgaccataa

SEQ ID NO: 9083 - DNA, 25 bp, Mus musculus
cgcacattttacattgaccataata

SEQ ID NO: 9084 - DNA, 25 bp, Mus musculus
cacattttacattgaccataatagc

SEQ ID NO: 9085 - DNA, 25 bp, Mus musculus
cattttacattgaccataatagcaa

SEQ ID NO: 9086 - DNA, 25 bp, Mus musculus
ttacattgaccataatagcaaaatt

SEQ ID NO: 9087 - DNA, 25 bp, Mus musculus
agatgcttttgaccgcaatgacctg

SEQ ID NO: 9088 - DNA, 25 bp, Mus musculus
atgcttttgaccgcaatgacctggg

SEQ ID NO: 9089 - DNA, 25 bp, Mus musculus
gcttttgaccgcaatgacctgggcc

SEQ ID NO: 9090 - DNA, 25 bp, Mus musculus
ttgaccgcaatgacctgggccctct

SEQ ID NO: 9091 - DNA, 25 bp, Mus musculus
aatgacctgggccctcttcctctgg

SEQ ID NO: 9092 - DNA, 25 bp, Mus musculus
aggatccacctggacggccgcacat

SEQ ID NO: 9093 - DNA, 25 bp, Mus musculus
gatccacctggacggccgcacattt

SEQ ID NO: 9094 - DNA, 25 bp, Mus musculus
tccacctggacggccgcacatttta

SEQ ID NO: 9095 - DNA, 25 bp, Mus musculus
acagttttttcgactcatgatagca

SEQ ID NO: 9096 - DNA, 25 bp, Mus musculus
cttggaccactaccaaagcacatga

SEQ ID NO: 9097 - DNA, 25 bp, Mus musculus
ctatctcaggatgccgaacatgagc

SEQ ID NO: 9098 - DNA, 25 bp, Mus musculus
catgagcttctctttgacctcattg

SEQ ID NO: 9099 - DNA, 25 bp, Mus musculus
tttgacctcattgggaaaatgttgg

SEQ ID NO: 9100 - DNA, 25 bp, Mus musculus
gagtatgatcccgccaaaagaatta

SEQ ID NO: 9101 - DNA, 25 bp, Mus musculus
gatcccgccaaaagaattactctca

SEQ ID NO: 9102 - DNA, 25 bp, Mus musculus
actctcaaagaagccctaaagcatc

SEQ ID NO: 9103 - DNA, 25 bp, Mus musculus
tcttacagactgtatcagtctagct

SEQ ID NO: 9104 - DNA, 25 bp, Mus musculus
agactgtatcagtctagcttttaat

SEQ ID NO: 9105 - DNA, 25 bp, Mus musculus
tggccaaaccaaataacatctttca

SEQ ID NO: 9106 - DNA, 25 bp, Mus musculus
ataacatctttcagtaattatagaa

SEQ ID NO: 9107 - DNA, 25 bp, Mus musculus
ccactaccaaagcacatgatacaga

SEQ ID NO: 9108 - DNA, 25 bp, Mus musculus
cgcagatatttccatcatgatcgat

SEQ ID NO: 9109 - DNA, 25 bp, Mus musculus
tatttccatcatgatcgattagatt

SEQ ID NO: 9110 - DNA, 25 bp, Mus musculus
agttctgctggcagatatgtttctc

SEQ ID NO: 9111 - DNA, 25 bp, Mus musculus
gtttctcggcgctgtaaacctctga

SEQ ID NO: 9112 - DNA, 25 bp, Mus musculus
cggcgctgtaaacctctgaaggagt

SEQ ID NO: 9113 - DNA, 25 bp, Mus musculus
tgtaaacctctgaaggagtttatgc

SEQ ID NO: 9114 - DNA, 25 bp, Mus musculus
tttatgctatctcaggatgccgaac

SEQ ID NO: 9115 - DNA, 25 bp, Mus musculus
aaacttctctgaggtggccaggagc

SEQ ID NO: 9116 - DNA, 25 bp, Mus musculus
cgtgacacaacccaggaaccttgcg

SEQ ID NO: 9117 - DNA, 25 bp, Mus musculus
cgactctcatttatgaaggaaccca

SEQ ID NO: 9118 - DNA, 25 bp, Mus musculus
atgaaggaacccaaatccacaagag

SEQ ID NO: 9119 - DNA, 25 bp, Mus musculus
ggaacccaaatccacaagaggactg

SEQ ID NO: 9120 - DNA, 25 bp, Mus musculus
acccaaatccacaagaggactggtg

SEQ ID NO: 9121 - DNA, 25 bp, Mus musculus
cccaaatccacaagaggactggtgc

SEQ ID NO: 9122 - DNA, 25 bp, Mus musculus
caaatccacaagaggactggtgcat

SEQ ID NO: 9123 - DNA, 25 bp, Mus musculus
aaatccacaagaggactggtgcatc

SEQ ID NO: 9124 - DNA, 25 bp, Mus musculus
catcaagctatttgcaacttaaaca

SEQ ID NO: 9125 - DNA, 25 bp, Mus musculus
tcaagctatttgcaacttaaacatc

SEQ ID NO: 9126 - DNA, 25 bp, Mus musculus
catcaccctgccgatttatgccaag

SEQ ID NO: 9127 - DNA, 25 bp, Mus musculus
tgacacaacccaggaaccttgcggg

SEQ ID NO: 9128 - DNA, 25 bp, Mus musculus
atcaccctgccgatttatgccaagg

SEQ ID NO: 9129 - DNA, 25 bp, Mus musculus
ccaggaaccttgcgggcgactctca

SEQ ID NO: 9130 - DNA, 25 bp, Mus musculus
caggaaccttgcgggcgactctcat

SEQ ID NO: 9131 - DNA, 25 bp, Mus musculus
gaaccttgcgggcgactctcattta

SEQ ID NO: 9132 - DNA, 25 bp, Mus musculus
ccttgcgggcgactctcatttatga

SEQ ID NO: 9133 - DNA, 25 bp, Mus musculus
ttgcgggcgactctcatttatgaag

SEQ ID NO: 9134 - DNA, 25 bp, Mus musculus
cgggcgactctcatttatgaaggaa

SEQ ID NO: 9135 - DNA, 25 bp, Mus musculus
gcgactctcatttatgaaggaaccc

SEQ ID NO: 9136 - DNA, 25 bp, Mus musculus
gctgtgctgccgcgacggatgacgc

SEQ ID NO: 9137 - DNA, 25 bp, Mus musculus
ggcttctgaccccatgccagtgttg

SEQ ID NO: 9138 - DNA, 25 bp, Mus musculus
acagccgccgctaaagcagaggacg

SEQ ID NO: 9139 - DNA, 25 bp, Mus musculus
gccgccgctaaagcagaggacgatt

SEQ ID NO: 9140 - DNA, 25 bp, Mus musculus
cagtggttcctgcttttaatccctg

SEQ ID NO: 9141 - DNA, 25 bp, Mus musculus
tggttcctgcttttaatccctgcta

SEQ ID NO: 9142 - DNA, 25 bp, Mus musculus
ttcctgcttttaatccctgctactg

SEQ ID NO: 9143 - DNA, 25 bp, Mus musculus
ctgcttttaatccctgctactgctt

SEQ ID NO: 9144 - DNA, 25 bp, Mus musculus
cttttaatccctgctactgcttttg

SEQ ID NO: 9145 - DNA, 25 bp, Mus musculus
ttaatccctgctactgcttttggcc

SEQ ID NO: 9146 - DNA, 25 bp, Mus musculus
cctgctactgcttttggcctgggga

SEQ ID NO: 9147 - DNA, 25 bp, Mus musculus
gctactgcttttggcctggggactt

SEQ ID NO: 9148 - DNA, 25 bp, Mus musculus
ttctgaccccatgccagtgttgtaa

SEQ ID NO: 9149 - DNA, 25 bp, Mus musculus
cttcctccagggatggtctgtaggc

SEQ ID NO: 9150 - DNA, 25 bp, Mus musculus
atggtctgtaggccacgcaggtgtt

SEQ ID NO: 9151 - DNA, 25 bp, Mus musculus
aggccacgcaggtgttgcagttcta

SEQ ID NO: 9152 - DNA, 25 bp, Mus musculus
tgcagttctactgctgaaacagccg

SEQ ID NO: 9153 - DNA, 25 bp, Mus musculus
agttctactgctgaaacagccgccg

SEQ ID NO: 9154 - DNA, 25 bp, Mus musculus
tctactgctgaaacagccgccgcta

SEQ ID NO: 9155 - DNA, 25 bp, Mus musculus
gaaacagccgccgctaaagcagagg

SEQ ID NO: 9156 - DNA, 25 bp, Mus musculus
tagttaccaactggtagcagattcg

SEQ ID NO: 9157 - DNA, 25 bp, Mus musculus
ttaccaactggtagcagattcgaac

SEQ ID NO: 9158 - DNA, 25 bp, Mus musculus
ggcttcgacgctttcttgatgactt

SEQ ID NO: 9159 - DNA, 25 bp, Mus musculus
ttcgacgctttcttgatgacttcgg

SEQ ID NO: 9160 - DNA, 25 bp, Mus musculus
gacgctttcttgatgacttcgggga

SEQ ID NO: 9161 - DNA, 25 bp, Mus musculus
ttcttgatgacttcggggacctcac

SEQ ID NO: 9162 - DNA, 25 bp, Mus musculus
ttgatgacttcggggacctcacgaa

SEQ ID NO: 9163 - DNA, 25 bp, Mus musculus
gggacctcacgaacgtgggtgacat

SEQ ID NO: 9164 - DNA, 25 bp, Mus musculus
acctcacgaacgtgggtgacatgaa

SEQ ID NO: 9165 - DNA, 25 bp, Mus musculus
atgtacaggccaatagcgttgatgg

SEQ ID NO: 9166 - DNA, 25 bp, Mus musculus
atgaaacgctgctggacaagcatca

SEQ ID NO: 9167 - DNA, 25 bp, Mus musculus
atcaagagcacaagggtcggatcga

SEQ ID NO: 9168 - DNA, 25 bp, Mus musculus
agcagattcgaactctgggcgcaga

SEQ ID NO: 9169 - DNA, 25 bp, Mus musculus
ttcgaactctgggcgcagagagaca

SEQ ID NO: 9170 - DNA, 25 bp, Mus musculus
gaactctgggcgcagagagacatgc

SEQ ID NO: 9171 - DNA, 25 bp, Mus musculus
agagacatgcacggcttgatgactc

SEQ ID NO: 9172 - DNA, 25 bp, Mus musculus
atgcacggcttgatgactcatacag

SEQ ID NO: 9173 - DNA, 25 bp, Mus musculus
atgactcatacaggcttcgacgctt

SEQ ID NO: 9174 - DNA, 25 bp, Mus musculus
actcatacaggcttcgacgctttct

SEQ ID NO: 9175 - DNA, 25 bp, Mus musculus
catacaggcttcgacgctttcttga

SEQ ID NO: 9176 - DNA, 25 bp, Mus musculus
atgaactcccaggccagagaacagg

SEQ ID NO: 9177 - DNA, 25 bp, Mus musculus
aagacgccttgagtgacgacagcat

SEQ ID NO: 9178 - DNA, 25 bp, Mus musculus
acttcagttcctttaagcagctggg

SEQ ID NO: 9179 - DNA, 25 bp, Mus musculus
ttaagcagctggggagatgaagcct

SEQ ID NO: 9180 - DNA, 25 bp, Mus musculus
atggccactgatatcctgacattgg

SEQ ID NO: 9181 - DNA, 25 bp, Mus musculus
actgatatcctgacattggctgttg

SEQ ID NO: 9182 - DNA, 25 bp, Mus musculus
aagatggcagcgtcggggacttgca

SEQ ID NO: 9183 - DNA, 25 bp, Mus musculus
acttgcatggctttctctgcagtgt

SEQ ID NO: 9184 - DNA, 25 bp, Mus musculus
atggctttctctgcagtgttgagtg

SEQ ID NO: 9185 - DNA, 25 bp, Mus musculus
ttctctgcagtgttgagtgactctt

SEQ ID NO: 9186 - DNA, 25 bp, Mus musculus
gactcttgctgtagctcactgtagc

SEQ ID NO: 9187 - DNA, 25 bp, Mus musculus
tgctgtagctcactgtagcatcccg

SEQ ID NO: 9188 - DNA, 25 bp, Mus musculus
acagcatgacagacctatacccacc

SEQ ID NO: 9189 - DNA, 25 bp, Mus musculus
tgacagacctatacccacctgagct

SEQ ID NO: 9190 - DNA, 25 bp, Mus musculus
acctatacccacctgagctgttcac

SEQ ID NO: 9191 - DNA, 25 bp, Mus musculus
agaacgatgacactcctgaagactt

SEQ ID NO: 9192 - DNA, 25 bp, Mus musculus
atgacactcctgaagactttctgac

SEQ ID NO: 9193 - DNA, 25 bp, Mus musculus
aagactttctgacagaccaacagga

SEQ ID NO: 9194 - DNA, 25 bp, Mus musculus
agagctatcatcacaagcccaagaa

SEQ ID NO: 9195 - DNA, 25 bp, Mus musculus
atcatcacaagcccaagaacttcag

SEQ ID NO: 9196 - DNA, 25 bp, Mus musculus
gggcagctcacagacacacaaatca

SEQ ID NO: 9197 - DNA, 25 bp, Mus musculus
agctcacagacacacaaatcaagag

SEQ ID NO: 9198 - DNA, 25 bp, Mus musculus
cggcctatgacttcaaggctgacat

SEQ ID NO: 9199 - DNA, 25 bp, Mus musculus
gcctatgacttcaaggctgacatct

SEQ ID NO: 9200 - DNA, 25 bp, Mus musculus
ctatgacttcaaggctgacatctgg

SEQ ID NO: 9201 - DNA, 25 bp, Mus musculus
atgacttcaaggctgacatctggtc

SEQ ID NO: 9202 - DNA, 25 bp, Mus musculus
gacttcaaggctgacatctggtccc

SEQ ID NO: 9203 - DNA, 25 bp, Mus musculus
cttcaaggctgacatctggtccctg

SEQ ID NO: 9204 - DNA, 25 bp, Mus musculus
atcacagccatcgagctggccaaag

SEQ ID NO: 9205 - DNA, 25 bp, Mus musculus
cacagccatcgagctggccaaaggg

SEQ ID NO: 9206 - DNA, 25 bp, Mus musculus
cagccatcgagctggccaaagggga

SEQ ID NO: 9207 - DNA, 25 bp, Mus musculus
gccatcgagctggccaaaggggagc

SEQ ID NO: 9208 - DNA, 25 bp, Mus musculus
ctcacagacacacaaatcaagagga

SEQ ID NO: 9209 - DNA, 25 bp, Mus musculus
cccttctggatggcacctgaggtta

SEQ ID NO: 9210 - DNA, 25 bp, Mus musculus
cttctggatggcacctgaggttatc

SEQ ID NO: 9211 - DNA, 25 bp, Mus musculus
tctggatggcacctgaggttatcaa

SEQ ID NO: 9212 - DNA, 25 bp, Mus musculus
tggatggcacctgaggttatcaagc

SEQ ID NO: 9213 - DNA, 25 bp, Mus musculus
ggttatcaagcagtcggcctatgac

SEQ ID NO: 9214 - DNA, 25 bp, Mus musculus
ttatcaagcagtcggcctatgactt

SEQ ID NO: 9215 - DNA, 25 bp, Mus musculus
atcaagcagtcggcctatgacttca

SEQ ID NO: 9216 - DNA, 25 bp, Mus musculus
agcagagctgcgcagcgttggcctt

SEQ ID NO: 9217 - DNA, 25 bp, Mus musculus
cattcctcgataccagcaaatccct

SEQ ID NO: 9218 - DNA, 25 bp, Mus musculus
ataccagcaaatccctacaacatga

SEQ ID NO: 9219 - DNA, 25 bp, Mus musculus
taccagcaaatccctacaacatgac

SEQ ID NO: 9220 - DNA, 25 bp, Mus musculus
cgaagtgttggcggcgcgcttaatg

SEQ ID NO: 9221 - DNA, 25 bp, Mus musculus
gaagtgttggcggcgcgcttaatgt

SEQ ID NO: 9222 - DNA, 25 bp, Mus musculus
aagtgttggcggcgcgcttaatgtc

SEQ ID NO: 9223 - DNA, 25 bp, Mus musculus
agtgttggcggcgcgcttaatgtcc

SEQ ID NO: 9224 - DNA, 25 bp, Mus musculus
gcgcgcttaatgtccccttcgacca

SEQ ID NO: 9225 - DNA, 25 bp, Mus musculus
cgcgcttaatgtccccttcgaccag

SEQ ID NO: 9226 - DNA, 25 bp, Mus musculus
gcgcttaatgtccccttcgaccagt

SEQ ID NO: 9227 - DNA, 25 bp, Mus musculus
gcttaatgtccccttcgaccagtcg

SEQ ID NO: 9228 - DNA, 25 bp, Mus musculus
attcctcgataccagcaaatcccta

SEQ ID NO: 9229 - DNA, 25 bp, Mus musculus
ttcctcgataccagcaaatccctac

SEQ ID NO: 9230 - DNA, 25 bp, Mus musculus
tcctcgataccagcaaatccctaca

SEQ ID NO: 9231 - DNA, 25 bp, Mus musculus
cctcgataccagcaaatccctacaa

SEQ ID NO: 9232 - DNA, 25 bp, Mus musculus
ctcgataccagcaaatccctacaac

SEQ ID NO: 9233 - DNA, 25 bp, Mus musculus
tcgataccagcaaatccctacaaca

SEQ ID NO: 9234 - DNA, 25 bp, Mus musculus
cgataccagcaaatccctacaacat

SEQ ID NO: 9235 - DNA, 25 bp, Mus musculus
gataccagcaaatccctacaacatg

SEQ ID NO: 9236 - DNA, 25 bp, Mus musculus
caggactttgttctctgagtcactt

SEQ ID NO: 9237 - DNA, 25 bp, Mus musculus
tcgctggctctgcaggctgaattca

SEQ ID NO: 9238 - DNA, 25 bp, Mus musculus
catgctagttctttaccacagagct

SEQ ID NO: 9239 - DNA, 25 bp, Mus musculus
agttctttaccacagagctgcctca

SEQ ID NO: 9240 - DNA, 25 bp, Mus musculus
ttaccacagagctgcctcagtgcac

SEQ ID NO: 9241 - DNA, 25 bp, Mus musculus
tgcctcagtgcacagccacctgcag

SEQ ID NO: 9242 - DNA, 25 bp, Mus musculus
agtgcacagccacctgcagtggcag

SEQ ID NO: 9243 - DNA, 25 bp, Mus musculus
gcagaccctgggaggcaagtgcatg

SEQ ID NO: 9244 - DNA, 25 bp, Mus musculus
cagcagaagccctcgtcccagggtt

SEQ ID NO: 9245 - DNA, 25 bp, Mus musculus
gcctcctgtgggttctgcctgggat

SEQ ID NO: 9246 - DNA, 25 bp, Mus musculus
atacacatattggtttggcaaaagt

SEQ ID NO: 9247 - DNA, 25 bp, Mus musculus
tataaacctcatttttatgctgtat

SEQ ID NO: 9248 - DNA, 25 bp, Mus musculus
caggctgaattcaccttctcaacac

SEQ ID NO: 9249 - DNA, 25 bp, Mus musculus
accttctcaacacctagcccatgtt

SEQ ID NO: 9250 - DNA, 25 bp, Mus musculus
ccatgttttcctgcagccttatggc

SEQ ID NO: 9251 - DNA, 25 bp, Mus musculus
tttcctgcagccttatggcctgcct

SEQ ID NO: 9252 - DNA, 25 bp, Mus musculus
gcagccttatggcctgcctattcct

SEQ ID NO: 9253 - DNA, 25 bp, Mus musculus
tattcctcccaagtgagttccagca

SEQ ID NO: 9254 - DNA, 25 bp, Mus musculus
actggctcaggccatgctagttctt

SEQ ID NO: 9255 - DNA, 25 bp, Mus musculus
tcaggccatgctagttctttaccac

SEQ ID NO: 9256 - DNA, 25 bp, Mus musculus
tactctccgctaaacgctcggcagg

SEQ ID NO: 9257 - DNA, 25 bp, Mus musculus
ccgctaaacgctcggcaggaatcat

SEQ ID NO: 9258 - DNA, 25 bp, Mus musculus
tcagtttccgtctcgtctacgatag

SEQ ID NO: 9259 - DNA, 25 bp, Mus musculus
agggttatggcttctgcgagtacca

SEQ ID NO: 9260 - DNA, 25 bp, Mus musculus
gcttctgcgagtaccaagaccagga

SEQ ID NO: 9261 - DNA, 25 bp, Mus musculus
tctgcgagtaccaagaccaggagac

SEQ ID NO: 9262 - DNA, 25 bp, Mus musculus
agtaccaagaccaggagactgcgct

SEQ ID NO: 9263 - DNA, 25 bp, Mus musculus
agactgcgcttagtgccatgcggaa

SEQ ID NO: 9264 - DNA, 25 bp, Mus musculus
ttagtgccatgcggaacctcaatgg

SEQ ID NO: 9265 - DNA, 25 bp, Mus musculus
gtgccatgcggaacctcaatgggcg

SEQ ID NO: 9266 - DNA, 25 bp, Mus musculus
ccatgcggaacctcaatgggcgaga

SEQ ID NO: 9267 - DNA, 25 bp, Mus musculus
ggaacctcaatgggcgagaatttag

SEQ ID NO: 9268 - DNA, 25 bp, Mus musculus
aacgctcggcaggaatcatgtcgag

SEQ ID NO: 9269 - DNA, 25 bp, Mus musculus
tgtcgagtttggcggtcagagaccc

SEQ ID NO: 9270 - DNA, 25 bp, Mus musculus
gagacccagccatggatcgatcact

SEQ ID NO: 9271 - DNA, 25 bp, Mus musculus
acccagccatggatcgatcactgcg

SEQ ID NO: 9272 - DNA, 25 bp, Mus musculus
tggatcgatcactgcgttcggtgtt

SEQ ID NO: 9273 - DNA, 25 bp, Mus musculus
atcgatcactgcgttcggtgttcgt

SEQ ID NO: 9274 - DNA, 25 bp, Mus musculus
ttccgtatgaggcgacggaggacga

SEQ ID NO: 9275 - DNA, 25 bp, Mus musculus
gttcagttgtcagtttccgtctcgt

SEQ ID NO: 9276 - DNA, 25 bp, Mus musculus
cctcggccgtttcctcagattctag

SEQ ID NO: 9277 - DNA, 25 bp, Mus musculus
tcggccgtttcctcagattctagag

SEQ ID NO: 9278 - DNA, 25 bp, Mus musculus
tcttgccaacggggtcatcctctgc

SEQ ID NO: 9279 - DNA, 25 bp, Mus musculus
ctctgccagctgcgaaccagcttcg

SEQ ID NO: 9280 - DNA, 25 bp, Mus musculus
ctgccagctgcgaaccagcttcgac

SEQ ID NO: 9281 - DNA, 25 bp, Mus musculus
tgccagctgcgaaccagcttcgacc

SEQ ID NO: 9282 - DNA, 25 bp, Mus musculus
cccgctctgtgcccttcattcatgt

SEQ ID NO: 9283 - DNA, 25 bp, Mus musculus
cgctctgtgcccttcattcatgtgc

SEQ ID NO: 9284 - DNA, 25 bp, Mus musculus
gctctgtgcccttcattcatgtgcc

SEQ ID NO: 9285 - DNA, 25 bp, Mus musculus
tctgtgcccttcattcatgtgccct

SEQ ID NO: 9286 - DNA, 25 bp, Mus musculus
ctgtgcccttcattcatgtgccctc

SEQ ID NO: 9287 - DNA, 25 bp, Mus musculus
gtgcccttcattcatgtgccctcac

SEQ ID NO: 9288 - DNA, 25 bp, Mus musculus
cggccgtttcctcagattctagagg

SEQ ID NO: 9289 - DNA, 25 bp, Mus musculus
gccgtttcctcagattctagaggag

SEQ ID NO: 9290 - DNA, 25 bp, Mus musculus
ccgtttcctcagattctagaggagt

SEQ ID NO: 9291 - DNA, 25 bp, Mus musculus
gtttcctcagattctagaggagtag

SEQ ID NO: 9292 - DNA, 25 bp, Mus musculus
tttcctcagattctagaggagtagg

SEQ ID NO: 9293 - DNA, 25 bp, Mus musculus
tcctcagattctagaggagtaggag

SEQ ID NO: 9294 - DNA, 25 bp, Mus musculus
agaggctcttgccaacggggtcatc

SEQ ID NO: 9295 - DNA, 25 bp, Mus musculus
gctcttgccaacggggtcatcctct

SEQ ID NO: 9296 - DNA, 25 bp, Mus musculus
aaaggttctcgcaagcaattgaaga

SEQ ID NO: 9297 - DNA, 25 bp, Mus musculus
aggttctcgcaagcaattgaagagt

SEQ ID NO: 9298 - DNA, 25 bp, Mus musculus
ctcctcatgtcctgaggatggagac

SEQ ID NO: 9299 - DNA, 25 bp, Mus musculus
tcatgtcctgaggatggagacttcc

SEQ ID NO: 9300 - DNA, 25 bp, Mus musculus
gagacttccaggaggtcccagactg

SEQ ID NO: 9301 - DNA, 25 bp, Mus musculus
cttccaggaggtcccagactgcggt

SEQ ID NO: 9302 - DNA, 25 bp, Mus musculus
ggaggtcccagactgcggttcacgg

SEQ ID NO: 9303 - DNA, 25 bp, Mus musculus
gtcccagactgcggttcacggattt

SEQ ID NO: 9304 - DNA, 25 bp, Mus musculus
cccagactgcggttcacggatttat

SEQ ID NO: 9305 - DNA, 25 bp, Mus musculus
cagactgcggttcacggatttattt

SEQ ID NO: 9306 - DNA, 25 bp, Mus musculus
tgagatttctaaacccgtggttatg

SEQ ID NO: 9307 - DNA, 25 bp, Mus musculus
atgagaatatcctctttccaataaa

SEQ ID NO: 9308 - DNA, 25 bp, Mus musculus
gttctcgcaagcaattgaagagttt

SEQ ID NO: 9309 - DNA, 25 bp, Mus musculus
agcattgtccatgaggaggtttatg

SEQ ID NO: 9310 - DNA, 25 bp, Mus musculus
aagagagcatctgcaggggagatag

SEQ ID NO: 9311 - DNA, 25 bp, Mus musculus
gagtcacacagtgtcaatgaagctc

SEQ ID NO: 9312 - DNA, 25 bp, Mus musculus
gtcacacagtgtcaatgaagctcct

SEQ ID NO: 9313 - DNA, 25 bp, Mus musculus
gtcaatgaagctcctcatgtcctga

SEQ ID NO: 9314 - DNA, 25 bp, Mus musculus
atgaagctcctcatgtcctgaggat

SEQ ID NO: 9315 - DNA, 25 bp, Mus musculus
agctcctcatgtcctgaggatggag

SEQ ID NO: 9316 - DNA, 25 bp, Mus musculus
gcgcgtctcgcatgagaggattgag

SEQ ID NO: 9317 - DNA, 25 bp, Mus musculus
cgcgtctcgcatgagaggattgaga

SEQ ID NO: 9318 - DNA, 25 bp, Mus musculus
tcatggccaatatccaccaggaaaa

SEQ ID NO: 9319 - DNA, 25 bp, Mus musculus
atggccaatatccaccaggaaaacg

SEQ ID NO: 9320 - DNA, 25 bp, Mus musculus
tggccaatatccaccaggaaaacga

SEQ ID NO: 9321 - DNA, 25 bp, Mus musculus
gccaatatccaccaggaaaacgaag

SEQ ID NO: 9322 - DNA, 25 bp, Mus musculus
aaatggagcagcccctgcagaatgg

SEQ ID NO: 9323 - DNA, 25 bp, Mus musculus
gagcagcccctgcagaatggacagg

SEQ ID NO: 9324 - DNA, 25 bp, Mus musculus
agcagcccctgcagaatggacagga

SEQ ID NO: 9325 - DNA, 25 bp, Mus musculus
cagcccctgcagaatggacaggaag

SEQ ID NO: 9326 - DNA, 25 bp, Mus musculus
agcccctgcagaatggacaggaaga

SEQ ID NO: 9327 - DNA, 25 bp, Mus musculus
cccctgcagaatggacaggaagacc

SEQ ID NO: 9328 - DNA, 25 bp, Mus musculus
cgtctcgcatgagaggattgagagg

SEQ ID NO: 9329 - DNA, 25 bp, Mus musculus
gactacgcggcaagggataggccca

SEQ ID NO: 9330 - DNA, 25 bp, Mus musculus
actacgcggcaagggataggcccag

SEQ ID NO: 9331 - DNA, 25 bp, Mus musculus
aatctcatcatggccaatatccacc

SEQ ID NO: 9332 - DNA, 25 bp, Mus musculus
atctcatcatggccaatatccacca

SEQ ID NO: 9333 - DNA, 25 bp, Mus musculus
ctcatcatggccaatatccaccagg

SEQ ID NO: 9334 - DNA, 25 bp, Mus musculus
tcatcatggccaatatccaccagga

SEQ ID NO: 9335 - DNA, 25 bp, Mus musculus
atcatggccaatatccaccaggaaa

SEQ ID NO: 9336 - DNA, 25 bp, Mus musculus
tgttgcgctccttgtcgatgtaccg

SEQ ID NO: 9337 - DNA, 25 bp, Mus musculus
tgcgctccttgtcgatgtaccgccg

SEQ ID NO: 9338 - DNA, 25 bp, Mus musculus
gttccgcatcgatcgaacaaacgcc

SEQ ID NO: 9339 - DNA, 25 bp, Mus musculus
catcgatcgaacaaacgccgtgaat

SEQ ID NO: 9340 - DNA, 25 bp, Mus musculus
tcgaacaaacgccgtgaatcgagca

SEQ ID NO: 9341 - DNA, 25 bp, Mus musculus
aaacgccgtgaatcgagcagaccgg

SEQ ID NO: 9342 - DNA, 25 bp, Mus musculus
gaatcgagcagaccggacctacgac

SEQ ID NO: 9343 - DNA, 25 bp, Mus musculus
tcgagcagaccggacctacgactgc

SEQ ID NO: 9344 - DNA, 25 bp, Mus musculus
ccggacctacgactgcattgtcaga

SEQ ID NO: 9345 - DNA, 25 bp, Mus musculus
gacctacgactgcattgtcagacac

SEQ ID NO: 9346 - DNA, 25 bp, Mus musculus
cgactgcattgtcagacacgtgagc

SEQ ID NO: 9347 - DNA, 25 bp, Mus musculus
ctgcattgtcagacacgtgagctga

SEQ ID NO: 9348 - DNA, 25 bp, Mus musculus
tgtcgatgtaccgccgcacacagtg

SEQ ID NO: 9349 - DNA, 25 bp, Mus musculus
cgatgtaccgccgcacacagtgaat

SEQ ID NO: 9350 - DNA, 25 bp, Mus musculus
ttctacggagattcgtgtgttagac

SEQ ID NO: 9351 - DNA, 25 bp, Mus musculus
gttagacccatgtgattgatgtgtg

SEQ ID NO: 9352 - DNA, 25 bp, Mus musculus
tgattgatgtgtgcccagtgcagat

SEQ ID NO: 9353 - DNA, 25 bp, Mus musculus
atgtgtgcccagtgcagattgctag

SEQ ID NO: 9354 - DNA, 25 bp, Mus musculus
tgtgcccagtgcagattgctagttc

SEQ ID NO: 9355 - DNA, 25 bp, Mus musculus
ttgctagttccgcatcgatcgaaca

SEQ ID NO: 9356 - DNA, 25 bp, Mus musculus
ctgcttctccttctggtgacaggag

SEQ ID NO: 9357 - DNA, 25 bp, Mus musculus
ctccttctggtgacaggagccattg

SEQ ID NO: 9358 - DNA, 25 bp, Mus musculus
aacatctggaccaatatgctggagc

SEQ ID NO: 9359 - DNA, 25 bp, Mus musculus
aatatgctggagccatatcgccaga

SEQ ID NO: 9360 - DNA, 25 bp, Mus musculus
cgccagaacagagcccatgatgtct

SEQ ID NO: 9361 - DNA, 25 bp, Mus musculus
gcccatgatgtcttcagcatacagc

SEQ ID NO: 9362 - DNA, 25 bp, Mus musculus
ttcagcatacagctcccatgtggtc

SEQ ID NO: 9363 - DNA, 25 bp, Mus musculus
atacagctcccatgtggtctcagag

SEQ ID NO: 9364 - DNA, 25 bp, Mus musculus
ctcccatgtggtctcagaggcagtc

SEQ ID NO: 9365 - DNA, 25 bp, Mus musculus
ggcagtccctggatggcatttactt

SEQ ID NO: 9366 - DNA, 25 bp, Mus musculus
catttactctggagctttctttcca

SEQ ID NO: 9367 - DNA, 25 bp, Mus musculus
ctctggagctttctttccaataaag

SEQ ID NO: 9368 - DNA, 25 bp, Mus musculus
ttctcgacgggaagcagaggccata

SEQ ID NO: 9369 - DNA, 25 bp, Mus musculus
agaagttctgagccagaggtatttg

SEQ ID NO: 9370 - DNA, 25 bp, Mus musculus
gtatttgttaggccacaggactcca

SEQ ID NO: 9371 - DNA, 25 bp, Mus musculus
gactccatcggtgacgaagcttctg

SEQ ID NO: 9372 - DNA, 25 bp, Mus musculus
attatctctagcagttctgatggtt

SEQ ID NO: 9373 - DNA, 25 bp, Mus musculus
tctagcagttctgatggttctaata

SEQ ID NO: 9374 - DNA, 25 bp, Mus musculus
agccggttttctcaagatgcactcg

SEQ ID NO: 9375 - DNA, 25 bp, Mus musculus
cagctgaacatctggaccaatatgc

SEQ ID NO: 9376 - DNA, 25 bp, Mus musculus
ttattctaccaagcgacagagattc

SEQ ID NO: 9377 - DNA, 25 bp, Mus musculus
ggtaatcacaaagctagccggcatg

SEQ ID NO: 9378 - DNA, 25 bp, Mus musculus
cctggcagccactgacctggacgca

SEQ ID NO: 9379 - DNA, 25 bp, Mus musculus
agccactgacctggacgcagaggag

SEQ ID NO: 9380 - DNA, 25 bp, Mus musculus
ctctagatctggccaggcatcccgg

SEQ ID NO: 9381 - DNA, 25 bp, Mus musculus
tagatctggccaggcatcccggcgc

SEQ ID NO: 9382 - DNA, 25 bp, Mus musculus
atctggccaggcatcccggcgcttt

SEQ ID NO: 9383 - DNA, 25 bp, Mus musculus
gcgctttggcaccatgagctctctg

SEQ ID NO: 9384 - DNA, 25 bp, Mus musculus
ctttggcaccatgagctctctgtcc

SEQ ID NO: 9385 - DNA, 25 bp, Mus musculus
tggcaccatgagctctctgtccggg

SEQ ID NO: 9386 - DNA, 25 bp, Mus musculus
gagctctctgtccggggcagacgat

SEQ ID NO: 9387 - DNA, 25 bp, Mus musculus
ctctctgtccggggcagacgatact

SEQ ID NO: 9388 - DNA, 25 bp, Mus musculus
cacaaagctagccggcatggaggaa

SEQ ID NO: 9389 - DNA, 25 bp, Mus musculus
aaagctagccggcatggaggaagag

SEQ ID NO: 9390 - DNA, 25 bp, Mus musculus
gctggcattctccaccaaagaggag

SEQ ID NO: 9391 - DNA, 25 bp, Mus musculus
ctccaccaaagaggagcagcagcag

SEQ ID NO: 9392 - DNA, 25 bp, Mus musculus
gcagcagcagctcctgcagaaggtc

SEQ ID NO: 9393 - DNA, 25 bp, Mus musculus
gcagctcctgcagaaggtcctggca

SEQ ID NO: 9394 - DNA, 25 bp, Mus musculus
gctcctgcagaaggtcctggcagcc

SEQ ID NO: 9395 - DNA, 25 bp, Mus musculus
gaaggtcctggcagccactgacctg

SEQ ID NO: 9396 - DNA, 25 bp, Mus musculus
cacactcatcatgcagtagacatta

SEQ ID NO: 9397 - DNA, 25 bp, Mus musculus
cccatcataccttggcctgaatcaa

SEQ ID NO: 9398 - DNA, 25 bp, Mus musculus
taaagccggcatgccagggatgcag

SEQ ID NO: 9399 - DNA, 25 bp, Mus musculus
cggcatgccagggatgcagatctgg

SEQ ID NO: 9400 - DNA, 25 bp, Mus musculus
cctcacctgtgccagggatgcagat

SEQ ID NO: 9401 - DNA, 25 bp, Mus musculus
agtaacctaaaagctcatagattca

SEQ ID NO: 9402 - DNA, 25 bp, Mus musculus
gctcatagattcaccaagctggact

SEQ ID NO: 9403 - DNA, 25 bp, Mus musculus
agattcaccaagctggacttgggtg

SEQ ID NO: 9404 - DNA, 25 bp, Mus musculus
gaaaccgcggcttagcctctcattg

SEQ ID NO: 9405 - DNA, 25 bp, Mus musculus
ctcattgcctgaatggacacagttc

SEQ ID NO: 9406 - DNA, 25 bp, Mus musculus
cctgttctcctgggaaaggcatgca

SEQ ID NO: 9407 - DNA, 25 bp, Mus musculus
tgttctcatttttccacgaatgagt

SEQ ID NO: 9408 - DNA, 25 bp, Mus musculus
gaatcaagacaaccaagcgagcagc

SEQ ID NO: 9409 - DNA, 25 bp, Mus musculus
agacaaccaagcgagcagcatgcca

SEQ ID NO: 9410 - DNA, 25 bp, Mus musculus
ccaagcgagcagcatgccacagcac

SEQ ID NO: 9411 - DNA, 25 bp, Mus musculus
catgccacagcaccaactatgtcta

SEQ ID NO: 9412 - DNA, 25 bp, Mus musculus
acagcaccaactatgtctatgacca

SEQ ID NO: 9413 - DNA, 25 bp, Mus musculus
ccaactatgtctatgaccatggtgc

SEQ ID NO: 9414 - DNA, 25 bp, Mus musculus
tggttagcactctgtagtagaagaa

SEQ ID NO: 9415 - DNA, 25 bp, Mus musculus
ccagctgcacatgatcatgaggtgt

SEQ ID NO: 9416 - DNA, 25 bp, Mus musculus
ggaactgtcatcctcttgtgcagaa

SEQ ID NO: 9417 - DNA, 25 bp, Mus musculus
gtcatcctcttgtgcagaatgtaca

SEQ ID NO: 9418 - DNA, 25 bp, Mus musculus
gccaatggcctcatcaacgagatca

SEQ ID NO: 9419 - DNA, 25 bp, Mus musculus
ggcctcatcaacgagatcaagccac

SEQ ID NO: 9420 - DNA, 25 bp, Mus musculus
atcaacgagatcaagccacagtcgg

SEQ ID NO: 9421 - DNA, 25 bp, Mus musculus
gagatcaagccacagtcggtgtgtg

SEQ ID NO: 9422 - DNA, 25 bp, Mus musculus
ctgcacctcatcaagctagggatgg

SEQ ID NO: 9423 - DNA, 25 bp, Mus musculus
ctcatcaagctagggatggagaacg

SEQ ID NO: 9424 - DNA, 25 bp, Mus musculus
gatgacactgcagttcagtatgcca

SEQ ID NO: 9425 - DNA, 25 bp, Mus musculus
actgcagttcagtatgccattggtc

SEQ ID NO: 9426 - DNA, 25 bp, Mus musculus
gttcagtatgccattggtcgctctg

SEQ ID NO: 9427 - DNA, 25 bp, Mus musculus
tatgccattggtcgctctgacacgg

SEQ ID NO: 9428 - DNA, 25 bp, Mus musculus
aaggaccgccagcagctctacaagc

SEQ ID NO: 9429 - DNA, 25 bp, Mus musculus
cgctctgacacggttgcccctggca

SEQ ID NO: 9430 - DNA, 25 bp, Mus musculus
cagctctacaagctgatcatcagcc

SEQ ID NO: 9431 - DNA, 25 bp, Mus musculus
tacaagctgatcatcagccagctgc

SEQ ID NO: 9432 - DNA, 25 bp, Mus musculus
ctgatcatcagccagctgctctatg

SEQ ID NO: 9433 - DNA, 25 bp, Mus musculus
atcagccagctgctctatgacggat

SEQ ID NO: 9434 - DNA, 25 bp, Mus musculus
cagctgctctatgacggatacatta

SEQ ID NO: 9435 - DNA, 25 bp, Mus musculus
tacattagcatcgccaatggcctca

SEQ ID NO: 9436 - DNA, 25 bp, Mus musculus
agcatcgccaatggcctcatcaacg

SEQ ID NO: 9437 - DNA, 25 bp, Mus musculus
caacaatgcctttgccaagctgagg

SEQ ID NO: 9438 - DNA, 25 bp, Mus musculus
caatgcctttgccaagctgaggaaa

SEQ ID NO: 9439 - DNA, 25 bp, Mus musculus
gcaaagcctgcatcaaacaggagtc

SEQ ID NO: 9440 - DNA, 25 bp, Mus musculus
aagcctgcatcaaacaggagtcgct

SEQ ID NO: 9441 - DNA, 25 bp, Mus musculus
cctgcatcaaacaggagtcgctgct

SEQ ID NO: 9442 - DNA, 25 bp, Mus musculus
gcatcaaacaggagtcgctgctcag

SEQ ID NO: 9443 - DNA, 25 bp, Mus musculus
aacaggagtcgctgctcagggaaac

SEQ ID NO: 9444 - DNA, 25 bp, Mus musculus
aggagtcgctgctcagggaaacatt

SEQ ID NO: 9445 - DNA, 25 bp, Mus musculus
agtcgctgctcagggaaacattctg

SEQ ID NO: 9446 - DNA, 25 bp, Mus musculus
ccgcctgccagatgaggatgacaga

SEQ ID NO: 9447 - DNA, 25 bp, Mus musculus
tgacagaactctactgaatgactac

SEQ ID NO: 9448 - DNA, 25 bp, Mus musculus
cagaactctactgaatgactaccga

SEQ ID NO: 9449 - DNA, 25 bp, Mus musculus
tgcctttgccaagctgaggaaactt

SEQ ID NO: 9450 - DNA, 25 bp, Mus musculus
ctttgccaagctgaggaaacttatc

SEQ ID NO: 9451 - DNA, 25 bp, Mus musculus
gcttcgcttggcaatgaggtatatc

SEQ ID NO: 9452 - DNA, 25 bp, Mus musculus
gtatatcaacttcttggtcaaggtc

SEQ ID NO: 9453 - DNA, 25 bp, Mus musculus
tatcaacttcttggtcaaggtcttg

SEQ ID NO: 9454 - DNA, 25 bp, Mus musculus
cttcttggtcaaggtcttgggagag

SEQ ID NO: 9455 - DNA, 25 bp, Mus musculus
cttggtcaaggtcttgggagagcaa

SEQ ID NO: 9456 - DNA, 25 bp, Mus musculus
agagcaaagcctgcatcaaacagga

SEQ ID NO: 9457 - DNA, 25 bp, Mus musculus
ttccacgaatccaaccagtgtgcct

SEQ ID NO: 9458 - DNA, 25 bp, Mus musculus
ttcactccattacttcctatcctgg

SEQ ID NO: 9459 - DNA, 25 bp, Mus musculus
gaacagtcaagagtcccagggcagg

SEQ ID NO: 9460 - DNA, 25 bp, Mus musculus
ttgtgatcgctagcctcccagagct

SEQ ID NO: 9461 - DNA, 25 bp, Mus musculus
cagagctcagctgccattaagtccc

SEQ ID NO: 9462 - DNA, 25 bp, Mus musculus
tcagctgccattaagtccccatgca

SEQ ID NO: 9463 - DNA, 25 bp, Mus musculus
gccattaagtccccatgcacgtaat

SEQ ID NO: 9464 - DNA, 25 bp, Mus musculus
aagtccccatgcacgtaatcagtct

SEQ ID NO: 9465 - DNA, 25 bp, Mus musculus
cctccggtcccatggaaaccatgct

SEQ ID NO: 9466 - DNA, 25 bp, Mus musculus
tggaaaccatgctgcctgccctgct

SEQ ID NO: 9467 - DNA, 25 bp, Mus musculus
cgtcttcgccctgttagcttgtagt

SEQ ID NO: 9468 - DNA, 25 bp, Mus musculus
ctgggcttcaccagagtgactatga

SEQ ID NO: 9469 - DNA, 25 bp, Mus musculus
ccattacttcctatcctggatggga

SEQ ID NO: 9470 - DNA, 25 bp, Mus musculus
cttcctatcctggatgggaactggt

SEQ ID NO: 9471 - DNA, 25 bp, Mus musculus
ttcttttatctaagtggatgcctct

SEQ ID NO: 9472 - DNA, 25 bp, Mus musculus
tgcctctaggcctgactccttgtgt

SEQ ID NO: 9473 - DNA, 25 bp, Mus musculus
taggcctgactccttgtgttgagct

SEQ ID NO: 9474 - DNA, 25 bp, Mus musculus
cagccaagtcaggtgccaatgtctt

SEQ ID NO: 9475 - DNA, 25 bp, Mus musculus
agtcaggtgccaatgtcttggcatc

SEQ ID NO: 9476 - DNA, 25 bp, Mus musculus
gtgccaatgtcttggcatcagtaag

SEQ ID NO: 9477 - DNA, 25 bp, Mus musculus
gttgtccaggttgcctccatcccac

SEQ ID NO: 9478 - DNA, 25 bp, Mus musculus
aggactctaatgatcaccgcgtgcc

SEQ ID NO: 9479 - DNA, 25 bp, Mus musculus
gatgcaattcttctcaagccatagt

SEQ ID NO: 9480 - DNA, 25 bp, Mus musculus
attcttctcaagccatagtgactgt

SEQ ID NO: 9481 - DNA, 25 bp, Mus musculus
ctcaagccatagtgactgtactgag

SEQ ID NO: 9482 - DNA, 25 bp, Mus musculus
tgactgtactgaggctggtggtacc

SEQ ID NO: 9483 - DNA, 25 bp, Mus musculus
ggtctggatcttttgcttagaactc

SEQ ID NO: 9484 - DNA, 25 bp, Mus musculus
ttgcttagaactctgactaatggtt

SEQ ID NO: 9485 - DNA, 25 bp, Mus musculus
aatggttcacaacacactccatgcg

SEQ ID NO: 9486 - DNA, 25 bp, Mus musculus
tcacaacacactccatgcgtatctg

SEQ ID NO: 9487 - DNA, 25 bp, Mus musculus
cacactccatgcgtatctgtagtga

SEQ ID NO: 9488 - DNA, 25 bp, Mus musculus
ccatgcgtatctgtagtgatgggag

SEQ ID NO: 9489 - DNA, 25 bp, Mus musculus
ctaatgatcaccgcgtgccccaaga

SEQ ID NO: 9490 - DNA, 25 bp, Mus musculus
ccccttcagccagtgatatgtgatg

SEQ ID NO: 9491 - DNA, 25 bp, Mus musculus
ggcttcctctggcaaaggcatgaag

SEQ ID NO: 9492 - DNA, 25 bp, Mus musculus
tggtccttccagtgcagtgattctt

SEQ ID NO: 9493 - DNA, 25 bp, Mus musculus
ttccagtgcagtgattcttgctggt

SEQ ID NO: 9494 - DNA, 25 bp, Mus musculus
gattcttgctggtcctaaccaaggc

SEQ ID NO: 9495 - DNA, 25 bp, Mus musculus
tgctggtcctaaccaaggcttgagt

SEQ ID NO: 9496 - DNA, 25 bp, Mus musculus
tcctaaccaaggcttgagtgagata

SEQ ID NO: 9497 - DNA, 25 bp, Mus musculus
tcctctcagccagactttgagatgt

SEQ ID NO: 9498 - DNA, 25 bp, Mus musculus
atgttccagctggaggccatgctgg

SEQ ID NO: 9499 - DNA, 25 bp, Mus musculus
attcctgcactagtgcacctgaagg

SEQ ID NO: 9500 - DNA, 25 bp, Mus musculus
gtatccgggtatttcttcaggctag

SEQ ID NO: 9501 - DNA, 25 bp, Mus musculus
tatttcttcaggctagattgattgt

SEQ ID NO: 9502 - DNA, 25 bp, Mus musculus
ttcttcaggctagattgattgttgg

SEQ ID NO: 9503 - DNA, 25 bp, Mus musculus
ttggaattcagctcaactataatga

SEQ ID NO: 9504 - DNA, 25 bp, Mus musculus
gaattcagctcaactataatgacaa

SEQ ID NO: 9505 - DNA, 25 bp, Mus musculus
acaacgaggacggtcaagtgtatgg

SEQ ID NO: 9506 - DNA, 25 bp, Mus musculus
atggctctactgccgggaaggtgat

SEQ ID NO: 9507 - DNA, 25 bp, Mus musculus
gctctactgccgggaaggtgatggt

SEQ ID NO: 9508 - DNA, 25 bp, Mus musculus
ctactgccgggaaggtgatggtagc

SEQ ID NO: 9509 - DNA, 25 bp, Mus musculus
ttccagctggaggccatgctggctt

SEQ ID NO: 9510 - DNA, 25 bp, Mus musculus
cagctggaggccatgctggcttact

SEQ ID NO: 9511 - DNA, 25 bp, Mus musculus
gccatgctggcttactgattcttgc

SEQ ID NO: 9512 - DNA, 25 bp, Mus musculus
atgctggcttactgattcttgcctt

SEQ ID NO: 9513 - DNA, 25 bp, Mus musculus
gcttactgattcttgccttcttggg

SEQ ID NO: 9514 - DNA, 25 bp, Mus musculus
atcatggtccagaagttggaaaaca

SEQ ID NO: 9515 - DNA, 25 bp, Mus musculus
ttggaaaacattcctgcactagtgc

SEQ ID NO: 9516 - DNA, 25 bp, Mus musculus
aacattcctgcactagtgcacctga

SEQ ID NO: 9517 - DNA, 25 bp, Mus musculus
cacttgagtgtcatccttgcgccgg

SEQ ID NO: 9518 - DNA, 25 bp, Mus musculus
tacgagaatcgactcacagggcgcc

SEQ ID NO: 9519 - DNA, 25 bp, Mus musculus
ttgctttcagcctccaagcttctgc

SEQ ID NO: 9520 - DNA, 25 bp, Mus musculus
tccaagcttctgctagtctatggca

SEQ ID NO: 9521 - DNA, 25 bp, Mus musculus
aagcttctgctagtctatggcagca

SEQ ID NO: 9522 - DNA, 25 bp, Mus musculus
ctgctagtctatggcagcatcaagg

SEQ ID NO: 9523 - DNA, 25 bp, Mus musculus
gtctatggcagcatcaaggctggta

SEQ ID NO: 9524 - DNA, 25 bp, Mus musculus
agcatcaaggctggtatttgctacg

SEQ ID NO: 9525 - DNA, 25 bp, Mus musculus
ggtatttgctacggctgaccgctac

SEQ ID NO: 9526 - DNA, 25 bp, Mus musculus
atttgctacggctgaccgctacgcc

SEQ ID NO: 9527 - DNA, 25 bp, Mus musculus
tgaccgctacgccgccgcaataagg

SEQ ID NO: 9528 - DNA, 25 bp, Mus musculus
tcgactttgattcttgccggtacgt

SEQ ID NO: 9529 - DNA, 25 bp, Mus musculus
cggacctatggcgtcgatccttatt

SEQ ID NO: 9530 - DNA, 25 bp, Mus musculus
tatggcgtcgatccttattacctta

SEQ ID NO: 9531 - DNA, 25 bp, Mus musculus
gtcgatccttattaccttatcctgg

SEQ ID NO: 9532 - DNA, 25 bp, Mus musculus
tattaccttatcctggcgccaagat

SEQ ID NO: 9533 - DNA, 25 bp, Mus musculus
ataacgcggcgatctccactttaag

SEQ ID NO: 9534 - DNA, 25 bp, Mus musculus
tctccactttaagaacctggccgcg

SEQ ID NO: 9535 - DNA, 25 bp, Mus musculus
aattagttcttgctttcagcctcca

SEQ ID NO: 9536 - DNA, 25 bp, Mus musculus
ttcttgctttcagcctccaagcttc

SEQ ID NO: 9537 - DNA, 25 bp, Mus musculus
ggagccagtgccactcaccatcctg

SEQ ID NO: 9538 - DNA, 25 bp, Mus musculus
cagccatcgccagggaccctgttgc

SEQ ID NO: 9539 - DNA, 25 bp, Mus musculus
cttcctgggaacacccagcagacgc

SEQ ID NO: 9540 - DNA, 25 bp, Mus musculus
tcctgggaacacccagcagacgcca

SEQ ID NO: 9541 - DNA, 25 bp, Mus musculus
ctgggaacacccagcagacgccatc

SEQ ID NO: 9542 - DNA, 25 bp, Mus musculus
gggaacacccagcagacgccatcta

SEQ ID NO: 9543 - DNA, 25 bp, Mus musculus
agcagacgccatctagcctgccact

SEQ ID NO: 9544 - DNA, 25 bp, Mus musculus
cagacgccatctagcctgccactgg

SEQ ID NO: 9545 - DNA, 25 bp, Mus musculus
gacgccatctagcctgccactgggc

SEQ ID NO: 9546 - DNA, 25 bp, Mus musculus
atctagcctgccactgggctccacg

SEQ ID NO: 9547 - DNA, 25 bp, Mus musculus
tgccactgggctccacgccaggaat

SEQ ID NO: 9548 - DNA, 25 bp, Mus musculus
ttacacacccaggtccagagctcgg

SEQ ID NO: 9549 - DNA, 25 bp, Mus musculus
gccatcgccagggaccctgttgcct

SEQ ID NO: 9550 - DNA, 25 bp, Mus musculus
acctgtgcagctcagccctgctctg

SEQ ID NO: 9551 - DNA, 25 bp, Mus musculus
ctgtgcagctcagccctgctctgtg

SEQ ID NO: 9552 - DNA, 25 bp, Mus musculus
cctgctctgtgctggggtactcaag

SEQ ID NO: 9553 - DNA, 25 bp, Mus musculus
tgctctgtgctggggtactcaagcc

SEQ ID NO: 9554 - DNA, 25 bp, Mus musculus
ctctgtgctggggtactcaagcctg

SEQ ID NO: 9555 - DNA, 25 bp, Mus musculus
gtactcaagcctgccttccggcttc

SEQ ID NO: 9556 - DNA, 25 bp, Mus musculus
tccggcttctcaggaacccttcctg

SEQ ID NO: 9557 - DNA, 25 bp, Mus musculus
gcttttgctaccgcgagaagaaggt

SEQ ID NO: 9558 - DNA, 25 bp, Mus musculus
cttttgctaccgcgagaagaaggtg

SEQ ID NO: 9559 - DNA, 25 bp, Mus musculus
gatccgcgaacatggcctcaggagt

SEQ ID NO: 9560 - DNA, 25 bp, Mus musculus
agatgtcggcgttaccataactgat

SEQ ID NO: 9561 - DNA, 25 bp, Mus musculus
atgtcggcgttaccataactgatcc

SEQ ID NO: 9562 - DNA, 25 bp, Mus musculus
tgtcggcgttaccataactgatcct

SEQ ID NO: 9563 - DNA, 25 bp, Mus musculus
tcggcgttaccataactgatccttt

SEQ ID NO: 9564 - DNA, 25 bp, Mus musculus
ggcgttaccataactgatcctttca

SEQ ID NO: 9565 - DNA, 25 bp, Mus musculus
gcgttaccataactgatcctttcaa

SEQ ID NO: 9566 - DNA, 25 bp, Mus musculus
cgttaccataactgatcctttcaag

SEQ ID NO: 9567 - DNA, 25 bp, Mus musculus
gttaccataactgatcctttcaagc

SEQ ID NO: 9568 - DNA, 25 bp, Mus musculus
ttaccataactgatcctttcaagca

SEQ ID NO: 9569 - DNA, 25 bp, Mus musculus
ttttgctaccgcgagaagaaggtgc

SEQ ID NO: 9570 - DNA, 25 bp, Mus musculus
aaggtgcacagactttccgccaggt

SEQ ID NO: 9571 - DNA, 25 bp, Mus musculus
gtgcacagactttccgccaggttcc

SEQ ID NO: 9572 - DNA, 25 bp, Mus musculus
gcacagactttccgccaggttccta

SEQ ID NO: 9573 - DNA, 25 bp, Mus musculus
cacagactttccgccaggttcctag

SEQ ID NO: 9574 - DNA, 25 bp, Mus musculus
tcccgatccgcgaacatggcctcag

SEQ ID NO: 9575 - DNA, 25 bp, Mus musculus
cccgatccgcgaacatggcctcagg

SEQ ID NO: 9576 - DNA, 25 bp, Mus musculus
cgatccgcgaacatggcctcaggag

SEQ ID NO: 9577 - DNA, 25 bp, Mus musculus
aagcctactttgatgtagtcgaaga

SEQ ID NO: 9578 - DNA, 25 bp, Mus musculus
tcattgatgcttgcattaagctgtc

SEQ ID NO: 9579 - DNA, 25 bp, Mus musculus
atggaaatttccgactcatatcata

SEQ ID NO: 9580 - DNA, 25 bp, Mus musculus
gaaatttccgactcatatcataccg

SEQ ID NO: 9581 - DNA, 25 bp, Mus musculus
tccgactcatatcataccgcgtcac

SEQ ID NO: 9582 - DNA, 25 bp, Mus musculus
gactcatatcataccgcgtcactca

SEQ ID NO: 9583 - DNA, 25 bp, Mus musculus
tcatatcataccgcgtcactcacaa

SEQ ID NO: 9584 - DNA, 25 bp, Mus musculus
cataccgcgtcactcacaaaatcta

SEQ ID NO: 9585 - DNA, 25 bp, Mus musculus
accgcgtcactcacaaaatctagtg

SEQ ID NO: 9586 - DNA, 25 bp, Mus musculus
gcgtcactcacaaaatctagtggca

SEQ ID NO: 9587 - DNA, 25 bp, Mus musculus
ctcacaaaatctagtggcaatccca

SEQ ID NO: 9588 - DNA, 25 bp, Mus musculus
aaatctagtggcaatcccagtgtat

SEQ ID NO: 9589 - DNA, 25 bp, Mus musculus
ttgatgcttgcattaagctgtctgg

SEQ ID NO: 9590 - DNA, 25 bp, Mus musculus
agtggcaatcccagtgtatgtgaac

SEQ ID NO: 9591 - DNA, 25 bp, Mus musculus
ttaagctgtctggaatgcctgatct

SEQ ID NO: 9592 - DNA, 25 bp, Mus musculus
ctttcatgaacccaaggcttctaga

SEQ ID NO: 9593 - DNA, 25 bp, Mus musculus
tgaacccaaggcttctagatgatgt

SEQ ID NO: 9594 - DNA, 25 bp, Mus musculus
atgtcagcttccacccatgcatccg

SEQ ID NO: 9595 - DNA, 25 bp, Mus musculus
tccacccatgcatccggttcaaacg

SEQ ID NO: 9596 - DNA, 25 bp, Mus musculus
catgcatccggttcaaacgctggga

SEQ ID NO: 9597 - DNA, 25 bp, Mus musculus
tcattcctcccgatggaaatttccg

SEQ ID NO: 9598 - DNA, 25 bp, Mus musculus
gaagcatctgtcatcggagcgcctg

SEQ ID NO: 9599 - DNA, 25 bp, Mus musculus
tctgtcatcggagcgcctgtccttc

SEQ ID NO: 9600 - DNA, 25 bp, Mus musculus
cacactgggctgatttcactggtga

SEQ ID NO: 9601 - DNA, 25 bp, Mus musculus
tacgaacagttccagcagcacaagc

SEQ ID NO: 9602 - DNA, 25 bp, Mus musculus
cagttccagcagcacaagctgctcg

SEQ ID NO: 9603 - DNA, 25 bp, Mus musculus
cagcagcacaagctgctcgtaaggg

SEQ ID NO: 9604 - DNA, 25 bp, Mus musculus
cacaagctgctcgtaagggctgttg

SEQ ID NO: 9605 - DNA, 25 bp, Mus musculus
ctgctcgtaagggctgttgatggag

SEQ ID NO: 9606 - DNA, 25 bp, Mus musculus
ccgccactgagcagcgatgtggtcg

SEQ ID NO: 9607 - DNA, 25 bp, Mus musculus
ctgagcagcgatgtggtcgtcactg

SEQ ID NO: 9608 - DNA, 25 bp, Mus musculus
agcgatgtggtcgtcactgtggatg

SEQ ID NO: 9609 - DNA, 25 bp, Mus musculus
gtggatgtcacgacctcaacgataa

SEQ ID NO: 9610 - DNA, 25 bp, Mus musculus
atcggagcgcctgtccttcaagtta

SEQ ID NO: 9611 - DNA, 25 bp, Mus musculus
gcgcctgtccttcaagttagagcca

SEQ ID NO: 9612 - DNA, 25 bp, Mus musculus
gtccttcaagttagagccaccgact

SEQ ID NO: 9613 - DNA, 25 bp, Mus musculus
tctgactcggaaccaaatagaggga

SEQ ID NO: 9614 - DNA, 25 bp, Mus musculus
cacagcaaaagccacgatcactttc

SEQ ID NO: 9615 - DNA, 25 bp, Mus musculus
cacgatcactttcacatagatagtc

SEQ ID NO: 9616 - DNA, 25 bp, Mus musculus
cacatagatagtcacactgggctga

SEQ ID NO: 9617 - DNA, 25 bp, Mus musculus
gatagtcacactgggctgatttcac

SEQ ID NO: 9618 - DNA, 25 bp, Mus musculus
ccgctggctctcggcaggagaatgg

SEQ ID NO: 9619 - DNA, 25 bp, Mus musculus
ctggctctcggcaggagaatggcgc

SEQ ID NO: 9620 - DNA, 25 bp, Mus musculus
ggattgccagtctggaagtagagaa

SEQ ID NO: 9621 - DNA, 25 bp, Mus musculus
tagagaaccagaaccttcgaggcgt

SEQ ID NO: 9622 - DNA, 25 bp, Mus musculus
ccagaaccttcgaggcgtggtgcaa

SEQ ID NO: 9623 - DNA, 25 bp, Mus musculus
agaaccttcgaggcgtggtgcaaga

SEQ ID NO: 9624 - DNA, 25 bp, Mus musculus
gaaccttcgaggcgtggtgcaagat

SEQ ID NO: 9625 - DNA, 25 bp, Mus musculus
accttcgaggcgtggtgcaagattt

SEQ ID NO: 9626 - DNA, 25 bp, Mus musculus
ccttcgaggcgtggtgcaagatttg

SEQ ID NO: 9627 - DNA, 25 bp, Mus musculus
aagatttgcagcaggccatttccaa

SEQ ID NO: 9628 - DNA, 25 bp, Mus musculus
atttgcagcaggccatttccaagtt

SEQ ID NO: 9629 - DNA, 25 bp, Mus musculus
tttgcagcaggccatttccaagttg

SEQ ID NO: 9630 - DNA, 25 bp, Mus musculus
tggctctcggcaggagaatggcgcc

SEQ ID NO: 9631 - DNA, 25 bp, Mus musculus
catttccaagttggaggtccggctg

SEQ ID NO: 9632 - DNA, 25 bp, Mus musculus
ctctcggcaggagaatggcgccacg

SEQ ID NO: 9633 - DNA, 25 bp, Mus musculus
ccagaaatccttggctggaagttca

SEQ ID NO: 9634 - DNA, 25 bp, Mus musculus
tggaagttcaggccctggagcctcc

SEQ ID NO: 9635 - DNA, 25 bp, Mus musculus
tcattgtgcggattgccagtctgga

SEQ ID NO: 9636 - DNA, 25 bp, Mus musculus
tgtgcggattgccagtctggaagta

SEQ ID NO: 9637 - DNA, 25 bp, Mus musculus
tgcggattgccagtctggaagtaga

SEQ ID NO: 9638 - DNA, 25 bp, Mus musculus
gcggattgccagtctggaagtagag

SEQ ID NO: 9639 - DNA, 25 bp, Mus musculus
gacacgactcaccgtcctaggtaag

SEQ ID NO: 9640 - DNA, 25 bp, Mus musculus
tcaccgtcctaggtaagaaggcaga

SEQ ID NO: 9641 - DNA, 25 bp, Mus musculus
gccagcatttcgacgactgtgcaaa

SEQ ID NO: 9642 - DNA, 25 bp, Mus musculus
cagcatttcgacgactgtgcaaaca

SEQ ID NO: 9643 - DNA, 25 bp, Mus musculus
atttcgacgactgtgcaaacaccgg

SEQ ID NO: 9644 - DNA, 25 bp, Mus musculus
cgacgactgtgcaaacaccgggcag

SEQ ID NO: 9645 - DNA, 25 bp, Mus musculus
acgactgtgcaaacaccgggcagct

SEQ ID NO: 9646 - DNA, 25 bp, Mus musculus
gcaaacaccgggcagctctactttg

SEQ ID NO: 9647 - DNA, 25 bp, Mus musculus
cgggcagctctactttggtgaaggc

SEQ ID NO: 9648 - DNA, 25 bp, Mus musculus
ctcaaagctgacagtgctgggtaag

SEQ ID NO: 9649 - DNA, 25 bp, Mus musculus
aagctgacagtgctgggtaagcagg

SEQ ID NO: 9650 - DNA, 25 bp, Mus musculus
tgacagtgctgggtaagcaggcagc

SEQ ID NO: 9651 - DNA, 25 bp, Mus musculus
ggacagtcagccacaaagacccccg

SEQ ID NO: 9652 - DNA, 25 bp, Mus musculus
tcagccacaaagacccccggagcag

SEQ ID NO: 9653 - DNA, 25 bp, Mus musculus
tatttaactatccaaggccctgtat

SEQ ID NO: 9654 - DNA, 25 bp, Mus musculus
tttaactatccaaggccctgtatca

SEQ ID NO: 9655 - DNA, 25 bp, Mus musculus
taactatccaaggccctgtatcagg

SEQ ID NO: 9656 - DNA, 25 bp, Mus musculus
aggtttgtgccagcatttcgacgac

SEQ ID NO: 9657 - DNA, 25 bp, Mus musculus
ttgtgccagcatttcgacgactgtg

SEQ ID NO: 9658 - DNA, 25 bp, Mus musculus
gtgccagcatttcgacgactgtgca

SEQ ID NO: 9659 - DNA, 25 bp, Mus musculus
gggcacccgactatcggtgctaggt

SEQ ID NO: 9660 - DNA, 25 bp, Mus musculus
cacccgactatcggtgctaggtaag

SEQ ID NO: 9661 - DNA, 25 bp, Mus musculus
tgcgcgttctcagcgggattgggct

SEQ ID NO: 9662 - DNA, 25 bp, Mus musculus
gcgttctcagcgggattgggctgca

SEQ ID NO: 9663 - DNA, 25 bp, Mus musculus
ggccgggtttctctgggagtcacag

SEQ ID NO: 9664 - DNA, 25 bp, Mus musculus
gtttctctgggagtcacagggttgt

SEQ ID NO: 9665 - DNA, 25 bp, Mus musculus
tgccctgactgattggcagccgatt

SEQ ID NO: 9666 - DNA, 25 bp, Mus musculus
cctgactgattggcagccgattgaa

SEQ ID NO: 9667 - DNA, 25 bp, Mus musculus
tgattggcagccgattgaacagcct

SEQ ID NO: 9668 - DNA, 25 bp, Mus musculus
gcagccgattgaacagcctatgcga

SEQ ID NO: 9669 - DNA, 25 bp, Mus musculus
tgaacagcctatgcgagcttcttgg

SEQ ID NO: 9670 - DNA, 25 bp, Mus musculus
acagcctatgcgagcttcttggcaa

SEQ ID NO: 9671 - DNA, 25 bp, Mus musculus
atcggtgctaggtaagctggggtat

SEQ ID NO: 9672 - DNA, 25 bp, Mus musculus
ctatgcgagcttcttggcaactgca

SEQ ID NO: 9673 - DNA, 25 bp, Mus musculus
tgggttctggggctgtgaaccaaga

SEQ ID NO: 9674 - DNA, 25 bp, Mus musculus
gttctggggctgtgaaccaagacac

SEQ ID NO: 9675 - DNA, 25 bp, Mus musculus
ctgtgaaccaagacacccagtactt

SEQ ID NO: 9676 - DNA, 25 bp, Mus musculus
tgaaccaagacacccagtactttgg

SEQ ID NO: 9677 - DNA, 25 bp, Mus musculus
cccagtactttgggccaggcactcg

SEQ ID NO: 9678 - DNA, 25 bp, Mus musculus
actttgggccaggcactcggctcct

SEQ ID NO: 9679 - DNA, 25 bp, Mus musculus
gcactcggctcctcgtgttaggtga

SEQ ID NO: 9680 - DNA, 25 bp, Mus musculus
tcgtgttgcagctgtagcatgagcc

SEQ ID NO: 9681 - DNA, 25 bp, Mus musculus
tgttgcagctgtagcatgagccggc

SEQ ID NO: 9682 - DNA, 25 bp, Mus musculus
attttgagggactttgcgagcgccg

SEQ ID NO: 9683 - DNA, 25 bp, Mus musculus
aggtacttttggcgatggaagcgct

SEQ ID NO: 9684 - DNA, 25 bp, Mus musculus
tacttttggcgatggaagcgctttt

SEQ ID NO: 9685 - DNA, 25 bp, Mus musculus
aagcgcttttccagctcacagatct

SEQ ID NO: 9686 - DNA, 25 bp, Mus musculus
cgcttttccagctcacagatctgca

SEQ ID NO: 9687 - DNA, 25 bp, Mus musculus
ttttccagctcacagatctgcaccc

SEQ ID NO: 9688 - DNA, 25 bp, Mus musculus
agctcacagatctgcacccgggaaa

SEQ ID NO: 9689 - DNA, 25 bp, Mus musculus
tcacagatctgcacccgggaaaagg

SEQ ID NO: 9690 - DNA, 25 bp, Mus musculus
cagatctgcacccgggaaaaggacg

SEQ ID NO: 9691 - DNA, 25 bp, Mus musculus
aaggacgtgcgcggcttcttacgct

SEQ ID NO: 9692 - DNA, 25 bp, Mus musculus
tgcagctgtagcatgagccggctcg

SEQ ID NO: 9693 - DNA, 25 bp, Mus musculus
agctgtagcatgagccggctcgcct

SEQ ID NO: 9694 - DNA, 25 bp, Mus musculus
ttttggaaccaggtcttgacctgcg

SEQ ID NO: 9695 - DNA, 25 bp, Mus musculus
tggaaccaggtcttgacctgcgcgt

SEQ ID NO: 9696 - DNA, 25 bp, Mus musculus
aaccaggtcttgacctgcgcgtccg

SEQ ID NO: 9697 - DNA, 25 bp, Mus musculus
ttgacctgcgcgtccgtcattttga

SEQ ID NO: 9698 - DNA, 25 bp, Mus musculus
tgcgcgtccgtcattttgagggact

SEQ ID NO: 9699 - DNA, 25 bp, Mus musculus
gcgtccgtcattttgagggactttg

SEQ ID NO: 9700 - DNA, 25 bp, Mus musculus
gccttaccgctgtctcgactgtggc

SEQ ID NO: 9701 - DNA, 25 bp, Mus musculus
ccgctgtctcgactgtggcaagtca

SEQ ID NO: 9702 - DNA, 25 bp, Mus musculus
actagcccagcatcgtggcatccac

SEQ ID NO: 9703 - DNA, 25 bp, Mus musculus
ccagcatcgtggcatccacacaggt

SEQ ID NO: 9704 - DNA, 25 bp, Mus musculus
agcatcgtggcatccacacaggtgc

SEQ ID NO: 9705 - DNA, 25 bp, Mus musculus
catcgtggcatccacacaggtgcac

SEQ ID NO: 9706 - DNA, 25 bp, Mus musculus
ggcatccacacaggtgcacagccct

SEQ ID NO: 9707 - DNA, 25 bp, Mus musculus
tccacacaggtgcacagccctacta

SEQ ID NO: 9708 - DNA, 25 bp, Mus musculus
cacacaggtgcacagccctactagt

SEQ ID NO: 9709 - DNA, 25 bp, Mus musculus
ggtgcacagccctactagtgtactg

SEQ ID NO: 9710 - DNA, 25 bp, Mus musculus
tgcacagccctactagtgtactgcc

SEQ ID NO: 9711 - DNA, 25 bp, Mus musculus
cacagccctactagtgtactgcctg

SEQ ID NO: 9712 - DNA, 25 bp, Mus musculus
gctgtctcgactgtggcaagtcatt

SEQ ID NO: 9713 - DNA, 25 bp, Mus musculus
tgtctcgactgtggcaagtcattca

SEQ ID NO: 9714 - DNA, 25 bp, Mus musculus
caagtcattcagccatggcgccaca

SEQ ID NO: 9715 - DNA, 25 bp, Mus musculus
agtcattcagccatggcgccacact

SEQ ID NO: 9716 - DNA, 25 bp, Mus musculus
tcattcagccatggcgccacactag

SEQ ID NO: 9717 - DNA, 25 bp, Mus musculus
attcagccatggcgccacactagcc

SEQ ID NO: 9718 - DNA, 25 bp, Mus musculus
ggcgccacactagcccagcatcgtg

SEQ ID NO: 9719 - DNA, 25 bp, Mus musculus
ccacactagcccagcatcgtggcat

SEQ ID NO: 9720 - DNA, 25 bp, Mus musculus
ttcggtcccggcaccaggctcacgg

SEQ ID NO: 9721 - DNA, 25 bp, Mus musculus
taagattcacatctctcgcttccac

SEQ ID NO: 9722 - DNA, 25 bp, Mus musculus
ccaaacgttgttcgctctctcgcaa

SEQ ID NO: 9723 - DNA, 25 bp, Mus musculus
aaacgttgttcgctctctcgcaagc

SEQ ID NO: 9724 - DNA, 25 bp, Mus musculus
ttcgctctctcgcaagccaggacaa

SEQ ID NO: 9725 - DNA, 25 bp, Mus musculus
gctctctcgcaagccaggacaaggt

SEQ ID NO: 9726 - DNA, 25 bp, Mus musculus
ctctctcgcaagccaggacaaggta

SEQ ID NO: 9727 - DNA, 25 bp, Mus musculus
tctctcgcaagccaggacaaggtag

SEQ ID NO: 9728 - DNA, 25 bp, Mus musculus
ctctcgcaagccaggacaaggtagg

SEQ ID NO: 9729 - DNA, 25 bp, Mus musculus
tctcgcaagccaggacaaggtaggt

SEQ ID NO: 9730 - DNA, 25 bp, Mus musculus
tttctctgaggtatgcatgcactgg

SEQ ID NO: 9731 - DNA, 25 bp, Mus musculus
ttctctgaggtatgcatgcactggg

SEQ ID NO: 9732 - DNA, 25 bp, Mus musculus
aggagacagctctcaacttcaccct

SEQ ID NO: 9733 - DNA, 25 bp, Mus musculus
ggagacagctctcaacttcaccctt

SEQ ID NO: 9734 - DNA, 25 bp, Mus musculus
gagacagctctcaacttcacccttt

SEQ ID NO: 9735 - DNA, 25 bp, Mus musculus
gacagctctcaacttcaccctttct

SEQ ID NO: 9736 - DNA, 25 bp, Mus musculus
acagctctcaacttcaccctttctg

SEQ ID NO: 9737 - DNA, 25 bp, Mus musculus
cagctctcaacttcaccctttctgg

SEQ ID NO: 9738 - DNA, 25 bp, Mus musculus
tgccaaacgttgttcgctctctcgc

SEQ ID NO: 9739 - DNA, 25 bp, Mus musculus
gccaaacgttgttcgctctctcgca

SEQ ID NO: 9740 - DNA, 25 bp, Mus musculus
tgtatttctccggccgaacagtcat

SEQ ID NO: 9741 - DNA, 25 bp, Mus musculus
tttctccggccgaacagtcatctca

SEQ ID NO: 9742 - DNA, 25 bp, Mus musculus
aatggcccagatgttcacccaggag

SEQ ID NO: 9743 - DNA, 25 bp, Mus musculus
tggcccagatgttcacccaggagcc

SEQ ID NO: 9744 - DNA, 25 bp, Mus musculus
gcccagatgttcacccaggagccaa

SEQ ID NO: 9745 - DNA, 25 bp, Mus musculus
agatgttcacccaggagccaatttt

SEQ ID NO: 9746 - DNA, 25 bp, Mus musculus
atgttcacccaggagccaattttat

SEQ ID NO: 9747 - DNA, 25 bp, Mus musculus
tcacccaggagccaattttatccaa

SEQ ID NO: 9748 - DNA, 25 bp, Mus musculus
gccaattttatccaacaaagacaca

SEQ ID NO: 9749 - DNA, 25 bp, Mus musculus
caattttatccaacaaagacacatg

SEQ ID NO: 9750 - DNA, 25 bp, Mus musculus
tttatccaacaaagacacatgcaga

SEQ ID NO: 9751 - DNA, 25 bp, Mus musculus
tccaacaaagacacatgcagatgaa

SEQ ID NO: 9752 - DNA, 25 bp, Mus musculus
tccggccgaacagtcatctcacctg

SEQ ID NO: 9753 - DNA, 25 bp, Mus musculus
cggccgaacagtcatctcacctgac

SEQ ID NO: 9754 - DNA, 25 bp, Mus musculus
ccaacctccggattgatgaagtagc

SEQ ID NO: 9755 - DNA, 25 bp, Mus musculus
aacctccggattgatgaagtagccg

SEQ ID NO: 9756 - DNA, 25 bp, Mus musculus
agccgtgccagttcatgtggccaaa

SEQ ID NO: 9757 - DNA, 25 bp, Mus musculus
ccgtgccagttcatgtggccaaaat

SEQ ID NO: 9758 - DNA, 25 bp, Mus musculus
gccagttcatgtggccaaaattcta

SEQ ID NO: 9759 - DNA, 25 bp, Mus musculus
gttcgaaatggcccagatgttcacc

SEQ ID NO: 9760 - DNA, 25 bp, Mus musculus
taccttccttcacacaggactttgg

SEQ ID NO: 9761 - DNA, 25 bp, Mus musculus
cttccttcacacaggactttggcgg

SEQ ID NO: 9762 - DNA, 25 bp, Mus musculus
agctcataaagtccagcttgtcccc

SEQ ID NO: 9763 - DNA, 25 bp, Mus musculus
tcataaagtccagcttgtcccctca

SEQ ID NO: 9764 - DNA, 25 bp, Mus musculus
taaagtccagcttgtcccctcaatc

SEQ ID NO: 9765 - DNA, 25 bp, Mus musculus
agtccagcttgtcccctcaatccaa

SEQ ID NO: 9766 - DNA, 25 bp, Mus musculus
tgtcccctcaatccaaaggccattt

SEQ ID NO: 9767 - DNA, 25 bp, Mus musculus
ctcaatccaaaggccattttctcga

SEQ ID NO: 9768 - DNA, 25 bp, Mus musculus
gtgcacttccacaatgctgcaccaa

SEQ ID NO: 9769 - DNA, 25 bp, Mus musculus
cacttccacaatgctgcaccaaagc

SEQ ID NO: 9770 - DNA, 25 bp, Mus musculus
ttccacaatgctgcaccaaagccgg

SEQ ID NO: 9771 - DNA, 25 bp, Mus musculus
cacaatgctgcaccaaagccggggc

SEQ ID NO: 9772 - DNA, 25 bp, Mus musculus
tcacacaggactttggcggaaatct

SEQ ID NO: 9773 - DNA, 25 bp, Mus musculus
gcggaaatctctacacccgtgtctc

SEQ ID NO: 9774 - DNA, 25 bp, Mus musculus
gaaatctctacacccgtgtctcatc

SEQ ID NO: 9775 - DNA, 25 bp, Mus musculus
atctctacacccgtgtctcatcatc

SEQ ID NO: 9776 - DNA, 25 bp, Mus musculus
catccccttcgagagcattaactat

SEQ ID NO: 9777 - DNA, 25 bp, Mus musculus
tttaaacccaggagagaagcgctgt

SEQ ID NO: 9778 - DNA, 25 bp, Mus musculus
tgcgcccctgttagctcataaagtc

SEQ ID NO: 9779 - DNA, 25 bp, Mus musculus
gcccctgttagctcataaagtccag

SEQ ID NO: 9780 - DNA, 25 bp, Mus musculus
tcagattgtctgccagccaccttgt

SEQ ID NO: 9781 - DNA, 25 bp, Mus musculus
gattgtctgccagccaccttgtggg

SEQ ID NO: 9782 - DNA, 25 bp, Mus musculus
actcttctctgggatggattctgta

SEQ ID NO: 9783 - DNA, 25 bp, Mus musculus
ttctgtaatcattggcacaggtcct

SEQ ID NO: 9784 - DNA, 25 bp, Mus musculus
tgtaatcattggcacaggtcctgcc

SEQ ID NO: 9785 - DNA, 25 bp, Mus musculus
cccatttatagatcctggcccagcc

SEQ ID NO: 9786 - DNA, 25 bp, Mus musculus
tgcctctccagatttccccttagat

SEQ ID NO: 9787 - DNA, 25 bp, Mus musculus
ctctccagatttccccttagatcct

SEQ ID NO: 9788 - DNA, 25 bp, Mus musculus
agatttccccttagatcctcggatg

SEQ ID NO: 9789 - DNA, 25 bp, Mus musculus
ccccttagatcctcggatggtcatc

SEQ ID NO: 9790 - DNA, 25 bp, Mus musculus
tcctcggatggtcatcaccatctcc

SEQ ID NO: 9791 - DNA, 25 bp, Mus musculus
ggtcatcaccatctccatgaataca

SEQ ID NO: 9792 - DNA, 25 bp, Mus musculus
tacttttttcagccgccctgctgcc

SEQ ID NO: 9793 - DNA, 25 bp, Mus musculus
aattggccctcatagctaagccctt

SEQ ID NO: 9794 - DNA, 25 bp, Mus musculus
tagctaagccctttcctacagcttt

SEQ ID NO: 9795 - DNA, 25 bp, Mus musculus
ctaagccctttcctacagctttctg

SEQ ID NO: 9796 - DNA, 25 bp, Mus musculus
gcccccttgtctctacgagaatgtc

SEQ ID NO: 9797 - DNA, 25 bp, Mus musculus
aactctgtgttttacactcttctct

SEQ ID NO: 9798 - DNA, 25 bp, Mus musculus
tctgtgttttacactcttctctggg

SEQ ID NO: 9799 - DNA, 25 bp, Mus musculus
ttttacactcttctctgggatggat

SEQ ID NO: 9800 - DNA, 25 bp, Mus musculus
tcttcccgtacacatttctcctgac

SEQ ID NO: 9801 - DNA, 25 bp, Mus musculus
cgtacacatttctcctgacaacatc

SEQ ID NO: 9802 - DNA, 25 bp, Mus musculus
tctcccagatcatgatttgtgtcag

SEQ ID NO: 9803 - DNA, 25 bp, Mus musculus
cctactcagttactctagagtaaag

SEQ ID NO: 9804 - DNA, 25 bp, Mus musculus
gcagtcccttttgatccttaatcct

SEQ ID NO: 9805 - DNA, 25 bp, Mus musculus
gatccttaatcctgggtgcttatga

SEQ ID NO: 9806 - DNA, 25 bp, Mus musculus
ggtagctcacttcccactctccatg

SEQ ID NO: 9807 - DNA, 25 bp, Mus musculus
cccactctccatggagacagaaggt

SEQ ID NO: 9808 - DNA, 25 bp, Mus musculus
tatatatagatacacccaacaggca

SEQ ID NO: 9809 - DNA, 25 bp, Mus musculus
cacccaacaggcagctagaatgcaa

SEQ ID NO: 9810 - DNA, 25 bp, Mus musculus
ccgtgcgctcagttatttgggctcc

SEQ ID NO: 9811 - DNA, 25 bp, Mus musculus
ttatttgggctccctctctgagagc

SEQ ID NO: 9812 - DNA, 25 bp, Mus musculus
gagccacatttctcaccagggttgc

SEQ ID NO: 9813 - DNA, 25 bp, Mus musculus
ctctctgagagcgtgctgtctgtac

SEQ ID NO: 9814 - DNA, 25 bp, Mus musculus
atgatgtcatcctaacaagggagca

SEQ ID NO: 9815 - DNA, 25 bp, Mus musculus
taacaagggagcaccttccgtggct

SEQ ID NO: 9816 - DNA, 25 bp, Mus musculus
cgtggcttaaatctctccctaggtg

SEQ ID NO: 9817 - DNA, 25 bp, Mus musculus
ttaaatctctccctaggtggtgatt

SEQ ID NO: 9818 - DNA, 25 bp, Mus musculus
ctctccctaggtggtgatttcacat

SEQ ID NO: 9819 - DNA, 25 bp, Mus musculus
ggtgatttcacatctcccagatcat

SEQ ID NO: 9820 - DNA, 25 bp, Mus musculus
ttcacatctcccagatcatgatttg

SEQ ID NO: 9821 - DNA, 25 bp, Mus musculus
gcaagctgctagcgacatcattacg

SEQ ID NO: 9822 - DNA, 25 bp, Mus musculus
cgacatcattacgaggcagcccaga

SEQ ID NO: 9823 - DNA, 25 bp, Mus musculus
gctgatcagcatacgcctatggaca

SEQ ID NO: 9824 - DNA, 25 bp, Mus musculus
gatcagcatacgcctatggacagat

SEQ ID NO: 9825 - DNA, 25 bp, Mus musculus
cagcatacgcctatggacagatcgg

SEQ ID NO: 9826 - DNA, 25 bp, Mus musculus
acgcctatggacagatcggtattat

SEQ ID NO: 9827 - DNA, 25 bp, Mus musculus
tcggtattatgcatgccgtggaatc

SEQ ID NO: 9828 - DNA, 25 bp, Mus musculus
tgcatgccgtggaatcgttgttcac

SEQ ID NO: 9829 - DNA, 25 bp, Mus musculus
aatcgttgttcacatactccgtgat

SEQ ID NO: 9830 - DNA, 25 bp, Mus musculus
cgttgttcacatactccgtgattct

SEQ ID NO: 9831 - DNA, 25 bp, Mus musculus
catactccgtgattctggctgatta

SEQ ID NO: 9832 - DNA, 25 bp, Mus musculus
actccgtgattctggctgattacgt

SEQ ID NO: 9833 - DNA, 25 bp, Mus musculus
catcattacgaggcagcccagaaac

SEQ ID NO: 9834 - DNA, 25 bp, Mus musculus
ttctggctgattacgtgttcctgcc

SEQ ID NO: 9835 - DNA, 25 bp, Mus musculus
gaggcagcccagaaacatcaaaacg

SEQ ID NO: 9836 - DNA, 25 bp, Mus musculus
gcagcccagaaacatcaaaacgtac

SEQ ID NO: 9837 - DNA, 25 bp, Mus musculus
catcaaaacgtacaaacttgtcagc

SEQ ID NO: 9838 - DNA, 25 bp, Mus musculus
aacgtacaaacttgtcagcgatgcg

SEQ ID NO: 9839 - DNA, 25 bp, Mus musculus
caaacttgtcagcgatgcgctgatc

SEQ ID NO: 9840 - DNA, 25 bp, Mus musculus
tgtcagcgatgcgctgatcagcata

SEQ ID NO: 9841 - DNA, 25 bp, Mus musculus
cagcgatgcgctgatcagcatacgc

SEQ ID NO: 9842 - DNA, 25 bp, Mus musculus
tgcatccaacagactcaaggccagg

SEQ ID NO: 9843 - DNA, 25 bp, Mus musculus
caacagactcaaggccaggcagtag

SEQ ID NO: 9844 - DNA, 25 bp, Mus musculus
ggtcctggacatggcttccgtggcc

SEQ ID NO: 9845 - DNA, 25 bp, Mus musculus
ggacatggcttccgtggccttgtac

SEQ ID NO: 9846 - DNA, 25 bp, Mus musculus
ggcttccgtggccttgtacagacca

SEQ ID NO: 9847 - DNA, 25 bp, Mus musculus
cagaccatgccttctgtcggagtct

SEQ ID NO: 9848 - DNA, 25 bp, Mus musculus
atgccttctgtcggagtctggccct

SEQ ID NO: 9849 - DNA, 25 bp, Mus musculus
tctgtcggagtctggccctagagca

SEQ ID NO: 9850 - DNA, 25 bp, Mus musculus
tggccctagagcagagggtacaatg

SEQ ID NO: 9851 - DNA, 25 bp, Mus musculus
aacgtgaccactgccagctagttcc

SEQ ID NO: 9852 - DNA, 25 bp, Mus musculus
accactgccagctagttcctgggag

SEQ ID NO: 9853 - DNA, 25 bp, Mus musculus
gcagccgttaacaacgctggctccg

SEQ ID NO: 9854 - DNA, 25 bp, Mus musculus
actcaaggccaggcagtaggctcca

SEQ ID NO: 9855 - DNA, 25 bp, Mus musculus
gcagtaggctccaatctccaaatat

SEQ ID NO: 9856 - DNA, 25 bp, Mus musculus
ggctccaatctccaaatatagtttt

SEQ ID NO: 9857 - DNA, 25 bp, Mus musculus
tgaccaaaacagacaaagcgactca

SEQ ID NO: 9858 - DNA, 25 bp, Mus musculus
cgactcacgattcccttgacaatcc

SEQ ID NO: 9859 - DNA, 25 bp, Mus musculus
acaatcctggagatcccctgcacat

SEQ ID NO: 9860 - DNA, 25 bp, Mus musculus
ctggagatcccctgcacatgaggag

SEQ ID NO: 9861 - DNA, 25 bp, Mus musculus
aaatgaggtcctggacatggcttcc

SEQ ID NO: 9862 - DNA, 25 bp, Mus musculus
ttctctaatcctgtgtgacagttga

SEQ ID NO: 9863 - DNA, 25 bp, Mus musculus
aatcctgtgtgacagttgaagatgc

SEQ ID NO: 9864 - DNA, 25 bp, Mus musculus
tgtggtcagtacaccagcatttaac

SEQ ID NO: 9865 - DNA, 25 bp, Mus musculus
ggtcagtacaccagcatttaacctc

SEQ ID NO: 9866 - DNA, 25 bp, Mus musculus
cagtacaccagcatttaacctctgt

SEQ ID NO: 9867 - DNA, 25 bp, Mus musculus
accagcatttaacctctgtattcta

SEQ ID NO: 9868 - DNA, 25 bp, Mus musculus
agcatttaacctctgtattctaatc

SEQ ID NO: 9869 - DNA, 25 bp, Mus musculus
atttaacctctgtattctaatctgt

SEQ ID NO: 9870 - DNA, 25 bp, Mus musculus
cctctgtattctaatctgtgttcac

SEQ ID NO: 9871 - DNA, 25 bp, Mus musculus
aatctgtgttcacttggaaacttgc

SEQ ID NO: 9872 - DNA, 25 bp, Mus musculus
tgttcacttggaaacttgcagaact

SEQ ID NO: 9873 - DNA, 25 bp, Mus musculus
tgttgtgtacctacagagtatgttt

SEQ ID NO: 9874 - DNA, 25 bp, Mus musculus
tctcttgcgctttaacagaatgaag

SEQ ID NO: 9875 - DNA, 25 bp, Mus musculus
cctgaatatgcacaccaaagctttc

SEQ ID NO: 9876 - DNA, 25 bp, Mus musculus
gaatatgcacaccaaagctttcctg

SEQ ID NO: 9877 - DNA, 25 bp, Mus musculus
tatgcacaccaaagctttcctgagg

SEQ ID NO: 9878 - DNA, 25 bp, Mus musculus
tataatcatcttaccgtaaggtttg

SEQ ID NO: 9879 - DNA, 25 bp, Mus musculus
ttctaaaacagttactgaggcaatc

SEQ ID NO: 9880 - DNA, 25 bp, Mus musculus
tttatctaaagtttcagctgtggtc

SEQ ID NO: 9881 - DNA, 25 bp, Mus musculus
taaagtttcagctgtggtcagtaca

SEQ ID NO: 9882 - DNA, 25 bp, Mus musculus
gcgccatgtcgggttcttctagcgt

SEQ ID NO: 9883 - DNA, 25 bp, Mus musculus
gtttcccaggcagctgcagacttca

SEQ ID NO: 9884 - DNA, 25 bp, Mus musculus
agttctgtctgcagaatgctcaaca

SEQ ID NO: 9885 - DNA, 25 bp, Mus musculus
ttctgtctgcagaatgctcaacatg

SEQ ID NO: 9886 - DNA, 25 bp, Mus musculus
ctgtctgcagaatgctcaacatgac

SEQ ID NO: 9887 - DNA, 25 bp, Mus musculus
agaatgctcaacatgaccctctgct

SEQ ID NO: 9888 - DNA, 25 bp, Mus musculus
aatgctcaacatgaccctctgctga

SEQ ID NO: 9889 - DNA, 25 bp, Mus musculus
tgctcaacatgaccctctgctgact

SEQ ID NO: 9890 - DNA, 25 bp, Mus musculus
caacatgaccctctgctgactggag

SEQ ID NO: 9891 - DNA, 25 bp, Mus musculus
acatgaccctctgctgactggagtg

SEQ ID NO: 9892 - DNA, 25 bp, Mus musculus
atgaccctctgctgactggagtgtc

SEQ ID NO: 9893 - DNA, 25 bp, Mus musculus
gaccctctgctgactggagtgtctt

SEQ ID NO: 9894 - DNA, 25 bp, Mus musculus
ttcccaggcagctgcagacttcaaa

SEQ ID NO: 9895 - DNA, 25 bp, Mus musculus
ccctctgctgactggagtgtcttca

SEQ ID NO: 9896 - DNA, 25 bp, Mus musculus
cccaggcagctgcagacttcaaaca

SEQ ID NO: 9897 - DNA, 25 bp, Mus musculus
cagctgcagacttcaaacagttctg

SEQ ID NO: 9898 - DNA, 25 bp, Mus musculus
gctgcagacttcaaacagttctgtc

SEQ ID NO: 9899 - DNA, 25 bp, Mus musculus
tgcagacttcaaacagttctgtctg

SEQ ID NO: 9900 - DNA, 25 bp, Mus musculus
gacttcaaacagttctgtctgcaga

SEQ ID NO: 9901 - DNA, 25 bp, Mus musculus
cttcaaacagttctgtctgcagaat

SEQ ID NO: 9902 - DNA, 25 bp, Mus musculus
tcaaacagttctgtctgcagaatgc

SEQ ID NO: 9903 - DNA, 25 bp, Mus musculus
caactggccacactagcaaagagcc

SEQ ID NO: 9904 - DNA, 25 bp, Mus musculus
gccacactagcaaagagccaaccag

SEQ ID NO: 9905 - DNA, 25 bp, Mus musculus
cttgctgagcaactagtccttggcc

SEQ ID NO: 9906 - DNA, 25 bp, Mus musculus
gagcaactagtccttggccatgcat

SEQ ID NO: 9907 - DNA, 25 bp, Mus musculus
caactagtccttggccatgcatcca

SEQ ID NO: 9908 - DNA, 25 bp, Mus musculus
catgcatccaggaaaccccaagaac

SEQ ID NO: 9909 - DNA, 25 bp, Mus musculus
aggaaaccccaagaaccatgctgct

SEQ ID NO: 9910 - DNA, 25 bp, Mus musculus
gaaccatgctgcttttcctgattta

SEQ ID NO: 9911 - DNA, 25 bp, Mus musculus
ccatgctgcttttcctgatttagta

SEQ ID NO: 9912 - DNA, 25 bp, Mus musculus
tgcttttcctgatttagtaatctgg

SEQ ID NO: 9913 - DNA, 25 bp, Mus musculus
ggaaggttccactgcagctgtcccc

SEQ ID NO: 9914 - DNA, 25 bp, Mus musculus
aggttccactgcagctgtcccctac

SEQ ID NO: 9915 - DNA, 25 bp, Mus musculus
aagagccaaccagcaaatcatctta

SEQ ID NO: 9916 - DNA, 25 bp, Mus musculus
agccaaccagcaaatcatcttaggg

SEQ ID NO: 9917 - DNA, 25 bp, Mus musculus
aatcatcttagggaatcctgaacca

SEQ ID NO: 9918 - DNA, 25 bp, Mus musculus
gaatcctgaaccacggccaccgtgc

SEQ ID NO: 9919 - DNA, 25 bp, Mus musculus
ctgtgagaaacaccctattgaagcc

SEQ ID NO: 9920 - DNA, 25 bp, Mus musculus
ggaccctcatggctgccctcagggt

SEQ ID NO: 9921 - DNA, 25 bp, Mus musculus
ctgccctcagggtgccttgctgagc

SEQ ID NO: 9922 - DNA, 25 bp, Mus musculus
ccctcagggtgccttgctgagcaac

SEQ ID NO: 9923 - DNA, 25 bp, Mus musculus
caagtggccaccagtgcacacactc

SEQ ID NO: 9924 - DNA, 25 bp, Mus musculus
ctcagccttgtgtagggtcccaaag

SEQ ID NO: 9925 - DNA, 25 bp, Mus musculus
attaatgtttatccagctgccgtag

SEQ ID NO: 9926 - DNA, 25 bp, Mus musculus
ccagctgccgtagtttgaaacattc

SEQ ID NO: 9927 - DNA, 25 bp, Mus musculus
tctaatttcaaccccaaatgacatg

SEQ ID NO: 9928 - DNA, 25 bp, Mus musculus
ttcaaccccaaatgacatgtttatt

SEQ ID NO: 9929 - DNA, 25 bp, Mus musculus
gtttatttgcacctgatgctcagga

SEQ ID NO: 9930 - DNA, 25 bp, Mus musculus
ctgatgctcaggagccagatgtgga

SEQ ID NO: 9931 - DNA, 25 bp, Mus musculus
cagagccaggcttgtaccacagctc

SEQ ID NO: 9932 - DNA, 25 bp, Mus musculus
caggcttgtaccacagctcagaggc

SEQ ID NO: 9933 - DNA, 25 bp, Mus musculus
tgtaccacagctcagaggcgtcaag

SEQ ID NO: 9934 - DNA, 25 bp, Mus musculus
acagctcagaggcgtcaagtttcca

SEQ ID NO: 9935 - DNA, 25 bp, Mus musculus
agccttagaaccgagcaggtgaatc

SEQ ID NO: 9936 - DNA, 25 bp, Mus musculus
cagtcctaaacgtctgtgtggccaa

SEQ ID NO: 9937 - DNA, 25 bp, Mus musculus
tggccaactcagcatctgcttccag

SEQ ID NO: 9938 - DNA, 25 bp, Mus musculus
actcagcatctgcttccagaagttt

SEQ ID NO: 9939 - DNA, 25 bp, Mus musculus
catctgcttccagaagtttcccact

SEQ ID NO: 9940 - DNA, 25 bp, Mus musculus
tcccacttgcagatgttcagtgcag

SEQ ID NO: 9941 - DNA, 25 bp, Mus musculus
gttacagacatgcgtttgattccac

SEQ ID NO: 9942 - DNA, 25 bp, Mus musculus
catctataacttggtgtcattgaca

SEQ ID NO: 9943 - DNA, 25 bp, Mus musculus
gacatacagtcttccaggtaccctc

SEQ ID NO: 9944 - DNA, 25 bp, Mus musculus
gagtccctggcacgctgtgactgcc

SEQ ID NO: 9945 - DNA, 25 bp, Mus musculus
atccaagagggcctgcactccaggg

SEQ ID NO: 9946 - DNA, 25 bp, Mus musculus
ggcctgcactccagggactctttgc

SEQ ID NO: 9947 - DNA, 25 bp, Mus musculus
ctgcactccagggactctttgcaag

SEQ ID NO: 9948 - DNA, 25 bp, Mus musculus
cactccagggactctttgcaagaag

SEQ ID NO: 9949 - DNA, 25 bp, Mus musculus
gtgcctgacaccctctgacagttcc

SEQ ID NO: 9950 - DNA, 25 bp, Mus musculus
cctgacaccctctgacagttccaga

SEQ ID NO: 9951 - DNA, 25 bp, Mus musculus
tgacagttccagagtgcaaacatgt

SEQ ID NO: 9952 - DNA, 25 bp, Mus musculus
ctggttttcattttcctggcaatca

SEQ ID NO: 9953 - DNA, 25 bp, Mus musculus
ttcattttcctggcaatcaataaag

SEQ ID NO: 9954 - DNA, 25 bp, Mus musculus
attttcctggcaatcaataaagcta

SEQ ID NO: 9955 - DNA, 25 bp, Mus musculus
cgctgtgactgcccaccatggggcc

SEQ ID NO: 9956 - DNA, 25 bp, Mus musculus
cacacccataggaatcacagactat

SEQ ID NO: 9957 - DNA, 25 bp, Mus musculus
atcttggctgactaattcaaactct

SEQ ID NO: 9958 - DNA, 25 bp, Mus musculus
taattcaaactcttatctcccaact

SEQ ID NO: 9959 - DNA, 25 bp, Mus musculus
aactctcctcgggctgagtgaccca

SEQ ID NO: 9960 - DNA, 25 bp, Mus musculus
tgacccagtgcccgtctacctcaaa

SEQ ID NO: 9961 - DNA, 25 bp, Mus musculus
gcgactgcagctgcaatccaagagg

SEQ ID NO: 9962 - DNA, 25 bp, Mus musculus
gcaatccaagagggcctgcactcca

SEQ ID NO: 9963 - DNA, 25 bp, Mus musculus
actgcatttgttgttgatgaagtga

SEQ ID NO: 9964 - DNA, 25 bp, Mus musculus
atagaaagcgccatcggtggtaatg

SEQ ID NO: 9965 - DNA, 25 bp, Mus musculus
tggaccactaatgtcctagaacaga

SEQ ID NO: 9966 - DNA, 25 bp, Mus musculus
aatgtcctagaacagactttgagcc

SEQ ID NO: 9967 - DNA, 25 bp, Mus musculus
gtcctagaacagactttgagccaac

SEQ ID NO: 9968 - DNA, 25 bp, Mus musculus
cagactttgagccaactcaccaaac

SEQ ID NO: 9969 - DNA, 25 bp, Mus musculus
caactcaccaaactggggagaccat

SEQ ID NO: 9970 - DNA, 25 bp, Mus musculus
attgtgacctgtgtgatcatgcaga

SEQ ID NO: 9971 - DNA, 25 bp, Mus musculus
gggttacactccgcaagttcctgct

SEQ ID NO: 9972 - DNA, 25 bp, Mus musculus
gcaagttcctgcttctgggacagct

SEQ ID NO: 9973 - DNA, 25 bp, Mus musculus
ttctgggacagctccacagacggaa

SEQ ID NO: 9974 - DNA, 25 bp, Mus musculus
tgggacagctccacagacggaagct

SEQ ID NO: 9975 - DNA, 25 bp, Mus musculus
gaaagcgccatcggtggtaatgcct

SEQ ID NO: 9976 - DNA, 25 bp, Mus musculus
aatgcctaccagcacagcaaagtca

SEQ ID NO: 9977 - DNA, 25 bp, Mus musculus
gcctaccagcacagcaaagtcaacc

SEQ ID NO: 9978 - DNA, 25 bp, Mus musculus
taccagcacagcaaagtcaaccagt

SEQ ID NO: 9979 - DNA, 25 bp, Mus musculus
cacagcaaagtcaaccagtggacca

SEQ ID NO: 9980 - DNA, 25 bp, Mus musculus
aaagtcaaccagtggaccactaatg

SEQ ID NO: 9981 - DNA, 25 bp, Mus musculus
aaccagtggaccactaatgtcctag

SEQ ID NO: 9982 - DNA, 25 bp, Mus musculus
cagtggaccactaatgtcctagaac

SEQ ID NO: 9983 - DNA, 25 bp, Mus musculus
agccttcaaagatgtgttgggctct

SEQ ID NO: 9984 - DNA, 25 bp, Mus musculus
agatgtgttgggctctggcatacac

SEQ ID NO: 9985 - DNA, 25 bp, Mus musculus
caagatttcacgctttgaaaagcac

SEQ ID NO: 9986 - DNA, 25 bp, Mus musculus
gcacctgtacaatgctgcagccttc

SEQ ID NO: 9987 - DNA, 25 bp, Mus musculus
cctgtacaatgctgcagccttcaaa

SEQ ID NO: 9988 - DNA, 25 bp, Mus musculus
tgcagccttcaaagcccggaccaag

SEQ ID NO: 9989 - DNA, 25 bp, Mus musculus
gaccaaggcccgtagtcgtgcaagg

SEQ ID NO: 9990 - DNA, 25 bp, Mus musculus
ggcccgtagtcgtgcaagggacaag

SEQ ID NO: 9991 - DNA, 25 bp, Mus musculus
aatcagactggccaacgagaaggct

SEQ ID NO: 9992 - DNA, 25 bp, Mus musculus
cagactggccaacgagaaggctacc

SEQ ID NO: 9993 - DNA, 25 bp, Mus musculus
cgagaaggctacccataccatacca

SEQ ID NO: 9994 - DNA, 25 bp, Mus musculus
gaaggctacccataccataccatat

SEQ ID NO: 9995 - DNA, 25 bp, Mus musculus
ctctggcatacactatcacctccag

SEQ ID NO: 9996 - DNA, 25 bp, Mus musculus
tggcatacactatcacctccagaac

SEQ ID NO: 9997 - DNA, 25 bp, Mus musculus
tcacctccagaacaatgagcttctc

SEQ ID NO: 9998 - DNA, 25 bp, Mus musculus
gaacaatgagcttctccgtgacatc

SEQ ID NO: 9999 - DNA, 25 bp, Mus musculus
gcttctccgtgacatctttggcctg

SEQ ID NO: 10000 - DNA, 25 bp, Mus musculus
ccccgtgctagtgttggatgctgct

SEQ ID NO: 10001 - DNA, 25 bp, Mus musculus
tgctgccctgaaggcctgcaagatt

SEQ ID NO: 10002 - DNA, 25 bp, Mus musculus
ctgcaagatttcacgctttgaaaag

SEQ ID NO: 10003 - DNA, 25 bp, Mus musculus
agttcctttgtgattaccattatgg

SEQ ID NO: 10004 - DNA, 25 bp, Mus musculus
tttgtgattaccattatgggttctg

SEQ ID NO: 10005 - DNA, 25 bp, Mus musculus
acccattcactcctaatctgaaggt

SEQ ID NO: 10006 - DNA, 25 bp, Mus musculus
cattcactcctaatctgaaggtgga

SEQ ID NO: 10007 - DNA, 25 bp, Mus musculus
aaattaacatcgcatcggatcctca

SEQ ID NO: 10008 - DNA, 25 bp, Mus musculus
ttaacatcgcatcggatcctcacca

SEQ ID NO: 10009 - DNA, 25 bp, Mus musculus
tcgcatcggatcctcaccaatttca

SEQ ID NO: 10010 - DNA, 25 bp, Mus musculus
cggatcctcaccaatttcactggag

SEQ ID NO: 10011 - DNA, 25 bp, Mus musculus
accaatttcactggagtgatgccgc

SEQ ID NO: 10012 - DNA, 25 bp, Mus musculus
gtcacttcctgtctgattgcgtagt

SEQ ID NO: 10013 - DNA, 25 bp, Mus musculus
acttcctgtctgattgcgtagtaac

SEQ ID NO: 10014 - DNA, 25 bp, Mus musculus
tcctgtctgattgcgtagtaactac

SEQ ID NO: 10015 - DNA, 25 bp, Mus musculus
attatgggttctgtgatgtgatccc

SEQ ID NO: 10016 - DNA, 25 bp, Mus musculus
gtgatgtgatccctcctaattgtat

SEQ ID NO: 10017 - DNA, 25 bp, Mus musculus
tgatccctcctaattgtatccagtt

SEQ ID NO: 10018 - DNA, 25 bp, Mus musculus
atttgatcctgagtgccttcccaag

SEQ ID NO: 10019 - DNA, 25 bp, Mus musculus
tcctgagtgccttcccaagaaacat

SEQ ID NO: 10020 - DNA, 25 bp, Mus musculus
tgagtgccttcccaagaaacatgag

SEQ ID NO: 10021 - DNA, 25 bp, Mus musculus
gtgccttcccaagaaacatgaggct

SEQ ID NO: 10022 - DNA, 25 bp, Mus musculus
gaaacatgaggctcccagacccatt

SEQ ID NO: 10023 - DNA, 25 bp, Mus musculus
aactaacactgaccggccagcttgg

SEQ ID NO: 10024 - DNA, 25 bp, Mus musculus
taacactgaccggccagcttgggga

SEQ ID NO: 10025 - DNA, 25 bp, Mus musculus
ttgacaacacagacatccatctgca

SEQ ID NO: 10026 - DNA, 25 bp, Mus musculus
atctgcacttcccagctggagctgt

SEQ ID NO: 10027 - DNA, 25 bp, Mus musculus
acttcccagctggagctgtcacaaa

SEQ ID NO: 10028 - DNA, 25 bp, Mus musculus
aagatggaccatctgctggtgttac

SEQ ID NO: 10029 - DNA, 25 bp, Mus musculus
gaccatctgctggtgttaccatagt

SEQ ID NO: 10030 - DNA, 25 bp, Mus musculus
catctgctggtgttaccatagtaac

SEQ ID NO: 10031 - DNA, 25 bp, Mus musculus
ttaccatagtaacttgtctcgcctc

SEQ ID NO: 10032 - DNA, 25 bp, Mus musculus
ccatagtaacttgtctcgcctcact

SEQ ID NO: 10033 - DNA, 25 bp, Mus musculus
gtctcgcctcacttttcagtgggcg

SEQ ID NO: 10034 - DNA, 25 bp, Mus musculus
tgcgctcagatgtagccatgactgg

SEQ ID NO: 10035 - DNA, 25 bp, Mus musculus
tgaccggccagcttggggacgtcat

SEQ ID NO: 10036 - DNA, 25 bp, Mus musculus
atctcgccattagctggcttcgaag

SEQ ID NO: 10037 - DNA, 25 bp, Mus musculus
tcgccattagctggcttcgaagcaa

SEQ ID NO: 10038 - DNA, 25 bp, Mus musculus
atgcaaagaaataccacctgactaa

SEQ ID NO: 10039 - DNA, 25 bp, Mus musculus
accacctgactaatgcttttggaag

SEQ ID NO: 10040 - DNA, 25 bp, Mus musculus
gttttgatcttcttgacaacacaga

SEQ ID NO: 10041 - DNA, 25 bp, Mus musculus
atcttcttgacaacacagacatcca

SEQ ID NO: 10042 - DNA, 25 bp, Mus musculus
ttcttgacaacacagacatccatct

SEQ ID NO: 10043 - DNA, 25 bp, Mus musculus
cttgtcatcaaccgagcaagcagaa

SEQ ID NO: 10044 - DNA, 25 bp, Mus musculus
atcaggcttggtgtctctgctcccc

SEQ ID NO: 10045 - DNA, 25 bp, Mus musculus
gtggacattcagctctctgagctcc

SEQ ID NO: 10046 - DNA, 25 bp, Mus musculus
attcagctctctgagctcctgtttc

SEQ ID NO: 10047 - DNA, 25 bp, Mus musculus
gagctcctgtttcttgtcaatttgc

SEQ ID NO: 10048 - DNA, 25 bp, Mus musculus
ctagttgctcattgcctctctgcat

SEQ ID NO: 10049 - DNA, 25 bp, Mus musculus
gctcattgcctctctgcattataga

SEQ ID NO: 10050 - DNA, 25 bp, Mus musculus
taagggcatctttccataagcctca

SEQ ID NO: 10051 - DNA, 25 bp, Mus musculus
catctttccataagcctcagtggca

SEQ ID NO: 10052 - DNA, 25 bp, Mus musculus
tccataagcctcagtggcactttac

SEQ ID NO: 10053 - DNA, 25 bp, Mus musculus
agcctcagtggcactttacacatat

SEQ ID NO: 10054 - DNA, 25 bp, Mus musculus
agtggcactttacacatatattcat

SEQ ID NO: 10055 - DNA, 25 bp, Mus musculus
gtctctgctccccagaatgtcactg

SEQ ID NO: 10056 - DNA, 25 bp, Mus musculus
gtggcactttacacatatattcatt

SEQ ID NO: 10057 - DNA, 25 bp, Mus musculus
gtcactgtcacaagcttcctggcca

SEQ ID NO: 10058 - DNA, 25 bp, Mus musculus
ctggccagcctgtggatagattgtt

SEQ ID NO: 10059 - DNA, 25 bp, Mus musculus
tgctggtaacccagcgtgcatagga

SEQ ID NO: 10060 - DNA, 25 bp, Mus musculus
taacccagcgtgcataggaagcatc

SEQ ID NO: 10061 - DNA, 25 bp, Mus musculus
aagcatctgtggctctagctctgtg

SEQ ID NO: 10062 - DNA, 25 bp, Mus musculus
ctctgtgttcttgcgcatgtggaca

SEQ ID NO: 10063 - DNA, 25 bp, Mus musculus
gttcttgcgcatgtggacattcagc

SEQ ID NO: 10064 - DNA, 25 bp, Mus musculus
atgcaactgtcgtatacctcgacgc

SEQ ID NO: 10065 - DNA, 25 bp, Mus musculus
gcaactgtcgtatacctcgacgcta

SEQ ID NO: 10066 - DNA, 25 bp, Mus musculus
ggcccatgtatattcaccaatattt

SEQ ID NO: 10067 - DNA, 25 bp, Mus musculus
cccatgtatattcaccaatattttc

SEQ ID NO: 10068 - DNA, 25 bp, Mus musculus
tgtatattcaccaatattttcacta

SEQ ID NO: 10069 - DNA, 25 bp, Mus musculus
tatattcaccaatattttcactatg

SEQ ID NO: 10070 - DNA, 25 bp, Mus musculus
tattcaccaatattttcactatgta

SEQ ID NO: 10071 - DNA, 25 bp, Mus musculus
ccaatattttcactatgtatggcga

SEQ ID NO: 10072 - DNA, 25 bp, Mus musculus
aatattttcactatgtatggcgagt

SEQ ID NO: 10073 - DNA, 25 bp, Mus musculus
tattttcactatgtatggcgagtag

SEQ ID NO: 10074 - DNA, 25 bp, Mus musculus
ttttcactatgtatggcgagtagct

SEQ ID NO: 10075 - DNA, 25 bp, Mus musculus
atatcgagtacgtcattatacatgc

SEQ ID NO: 10076 - DNA, 25 bp, Mus musculus
aactgtcgtatacctcgacgctatg

SEQ ID NO: 10077 - DNA, 25 bp, Mus musculus
ctgtcgtatacctcgacgctatgaa

SEQ ID NO: 10078 - DNA, 25 bp, Mus musculus
cgtatacctcgacgctatgaagtct

SEQ ID NO: 10079 - DNA, 25 bp, Mus musculus
tatacctcgacgctatgaagtctga

SEQ ID NO: 10080 - DNA, 25 bp, Mus musculus
tacctcgacgctatgaagtctgatg

SEQ ID NO: 10081 - DNA, 25 bp, Mus musculus
cctcgacgctatgaagtctgatgca

SEQ ID NO: 10082 - DNA, 25 bp, Mus musculus
atgaagtctgatgcagtgggcccat

SEQ ID NO: 10083 - DNA, 25 bp, Mus musculus
tgatgcagtgggcccatgtatattc

SEQ ID NO: 10084 - DNA, 25 bp, Mus musculus
agttatcgtcgcaaggcactgtggg

SEQ ID NO: 10085 - DNA, 25 bp, Mus musculus
cgtcgcaaggcactgtgggctccgt

SEQ ID NO: 10086 - DNA, 25 bp, Mus musculus
tactgttctaatgcccagtcttctt

SEQ ID NO: 10087 - DNA, 25 bp, Mus musculus
tctaatgcccagtcttcttgcttag

SEQ ID NO: 10088 - DNA, 25 bp, Mus musculus
tgcttagttgccttctcaaattaac

SEQ ID NO: 10089 - DNA, 25 bp, Mus musculus
ctttcattcctctggaagagctgga

SEQ ID NO: 10090 - DNA, 25 bp, Mus musculus
ttcctctggaagagctggagcccat

SEQ ID NO: 10091 - DNA, 25 bp, Mus musculus
tatatgccttcaaacagtaccttct

SEQ ID NO: 10092 - DNA, 25 bp, Mus musculus
accttctacatcttggagatgacag

SEQ ID NO: 10093 - DNA, 25 bp, Mus musculus
gacatgttctgggctcagtctaaag

SEQ ID NO: 10094 - DNA, 25 bp, Mus musculus
ttctgggctcagtctaaagccataa

SEQ ID NO: 10095 - DNA, 25 bp, Mus musculus
tctaaagccataaggaccaaagatc

SEQ ID NO: 10096 - DNA, 25 bp, Mus musculus
tggtttctcactcattacgaacaag

SEQ ID NO: 10097 - DNA, 25 bp, Mus musculus
gaaagcagctgcacagacattggaa

SEQ ID NO: 10098 - DNA, 25 bp, Mus musculus
agctgcacagacattggaaaggttt

SEQ ID NO: 10099 - DNA, 25 bp, Mus musculus
gtagctctctactctgtttccttga

SEQ ID NO: 10100 - DNA, 25 bp, Mus musculus
ctctactctgtttccttgatgaagt

SEQ ID NO: 10101 - DNA, 25 bp, Mus musculus
tctgtttccttgatgaagtcactag

SEQ ID NO: 10102 - DNA, 25 bp, Mus musculus
tcactagtctctgttcttagatcct

SEQ ID NO: 10103 - DNA, 25 bp, Mus musculus
ttgttctactgttctaatgcccagt

SEQ ID NO: 10104 - DNA, 25 bp, Mus musculus
caaagcccctcatttgtcacttgaa

SEQ ID NO: 10105 - DNA, 25 bp, Mus musculus
aagcccctcatttgtcacttgaatt

SEQ ID NO: 10106 - DNA, 25 bp, Mus musculus
cagagtcttacgtggtattggcctt

SEQ ID NO: 10107 - DNA, 25 bp, Mus musculus
gtcttacgtggtattggccttggtg

SEQ ID NO: 10108 - DNA, 25 bp, Mus musculus
attggccttggtgtttgctctctat

SEQ ID NO: 10109 - DNA, 25 bp, Mus musculus
tggccttggtgtttgctctctattg

SEQ ID NO: 10110 - DNA, 25 bp, Mus musculus
cttggtgtttgctctctattgtgaa

SEQ ID NO: 10111 - DNA, 25 bp, Mus musculus
tggtgtttgctctctattgtgaata

SEQ ID NO: 10112 - DNA, 25 bp, Mus musculus
gtttgctctctattgtgaatagctc

SEQ ID NO: 10113 - DNA, 25 bp, Mus musculus
ttgctctctattgtgaatagctcag

SEQ ID NO: 10114 - DNA, 25 bp, Mus musculus
atagctcaggaccagcattttcacc

SEQ ID NO: 10115 - DNA, 25 bp, Mus musculus
agctcaggaccagcattttcacccc

SEQ ID NO: 10116 - DNA, 25 bp, Mus musculus
ccctcatttgtcacttgaattggca

SEQ ID NO: 10117 - DNA, 25 bp, Mus musculus
ctcatttgtcacttgaattggcaga

SEQ ID NO: 10118 - DNA, 25 bp, Mus musculus
tttgtcacttgaattggcagatgga

SEQ ID NO: 10119 - DNA, 25 bp, Mus musculus
aatattggcagcagtcaaagaattt

SEQ ID NO: 10120 - DNA, 25 bp, Mus musculus
agaatttgcataccatcgttataaa

SEQ ID NO: 10121 - DNA, 25 bp, Mus musculus
taaatattgccagcagatggatctg

SEQ ID NO: 10122 - DNA, 25 bp, Mus musculus
tattgccagcagatggatctgggat

SEQ ID NO: 10123 - DNA, 25 bp, Mus musculus
ttgccagcagatggatctgggatgt

SEQ ID NO: 10124 - DNA, 25 bp, Mus musculus
agcgccttttgcacaaatgctttag

SEQ ID NO: 10125 - DNA, 25 bp, Mus musculus
gccttttgcacaaatgctttagatt

SEQ ID NO: 10126 - DNA, 25 bp, Mus musculus
gatatttctgcttggggcatctttg

SEQ ID NO: 10127 - DNA, 25 bp, Mus musculus
atttctgcttggggcatctttgtga

SEQ ID NO: 10128 - DNA, 25 bp, Mus musculus
tctgcttggggcatctttgtgattt

SEQ ID NO: 10129 - DNA, 25 bp, Mus musculus
tgtactttcctacaatttagcactt

SEQ ID NO: 10130 - DNA, 25 bp, Mus musculus
ttcctacaatttagcactttaactg

SEQ ID NO: 10131 - DNA, 25 bp, Mus musculus
caatttagcactttaactgacaatg

SEQ ID NO: 10132 - DNA, 25 bp, Mus musculus
agcactttaactgacaatgatgggg

SEQ ID NO: 10133 - DNA, 25 bp, Mus musculus
taaacatttgacagccaactctatt

SEQ ID NO: 10134 - DNA, 25 bp, Mus musculus
acatttgacagccaactctattttt

SEQ ID NO: 10135 - DNA, 25 bp, Mus musculus
tatacgactactatacaaagaaact

SEQ ID NO: 10136 - DNA, 25 bp, Mus musculus
ttttgcacaaatgctttagattgta

SEQ ID NO: 10137 - DNA, 25 bp, Mus musculus
tgtatggtctacactcaggaagaca

SEQ ID NO: 10138 - DNA, 25 bp, Mus musculus
atggtctacactcaggaagacacta

SEQ ID NO: 10139 - DNA, 25 bp, Mus musculus
tacactcaggaagacactaggtcac

SEQ ID NO: 10140 - DNA, 25 bp, Mus musculus
actaggtcacccaggcaaagccagt

SEQ ID NO: 10141 - DNA, 25 bp, Mus musculus
aggtcacccaggcaaagccagtgga

SEQ ID NO: 10142 - DNA, 25 bp, Mus musculus
tggacagatgcctttcatataacct

SEQ ID NO: 10143 - DNA, 25 bp, Mus musculus
acagatgcctttcatataacctggg

SEQ ID NO: 10144 - DNA, 25 bp, Mus musculus
cctgcagggtcactcgatttcattc

SEQ ID NO: 10145 - DNA, 25 bp, Mus musculus
gggtcactcgatttcattcaaggcc

SEQ ID NO: 10146 - DNA, 25 bp, Mus musculus
tgagctttctctgctgctactggat

SEQ ID NO: 10147 - DNA, 25 bp, Mus musculus
ttctctgctgctactggatcacatt

SEQ ID NO: 10148 - DNA, 25 bp, Mus musculus
gctgctactggatcacatttgcttt

SEQ ID NO: 10149 - DNA, 25 bp, Mus musculus
actggatcacatttgctttgtgttg

SEQ ID NO: 10150 - DNA, 25 bp, Mus musculus
tcacatttgctttgtgttgttactg

SEQ ID NO: 10151 - DNA, 25 bp, Mus musculus
cctccgctgggttcctgctgtcatt

SEQ ID NO: 10152 - DNA, 25 bp, Mus musculus
ctgggttcctgctgtcattaaaagg

SEQ ID NO: 10153 - DNA, 25 bp, Mus musculus
tcctgctgtcattaaaaggtgtcgc

SEQ ID NO: 10154 - DNA, 25 bp, Mus musculus
agccatctactgtaagttgtgcatt

SEQ ID NO: 10155 - DNA, 25 bp, Mus musculus
atatttaaaacatgctacaatcagt

SEQ ID NO: 10156 - DNA, 25 bp, Mus musculus
ttcattcaaggccttccgaatttgg

SEQ ID NO: 10157 - DNA, 25 bp, Mus musculus
aatgtagttgccacgcacagacggt

SEQ ID NO: 10158 - DNA, 25 bp, Mus musculus
acgcacagacggtgtctagcaatca

SEQ ID NO: 10159 - DNA, 25 bp, Mus musculus
gcaatcatggcgctcgctcgctcag

SEQ ID NO: 10160 - DNA, 25 bp, Mus musculus
ctcgctcgctcagctgcactctatg

SEQ ID NO: 10161 - DNA, 25 bp, Mus musculus
cgctcagctgcactctatggctcag

SEQ ID NO: 10162 - DNA, 25 bp, Mus musculus
ctctatggctcaggtgcagtgtctt

SEQ ID NO: 10163 - DNA, 25 bp, Mus musculus
gtgtcttgagctttctctgctgcta

SEQ ID NO: 10164 - DNA, 25 bp, Mus musculus
tcgatttcattcaaggccttccgaa

SEQ ID NO: 10165 - DNA, 25 bp, Mus musculus
agttgccacgcacagacggtgtcta

SEQ ID NO: 10166 - DNA, 25 bp, Mus musculus
gttgccacgcacagacggtgtctag

SEQ ID NO: 10167 - DNA, 25 bp, Mus musculus
tcgatttcattcaaggccttccgaa

SEQ ID NO: 10168 - DNA, 25 bp, Mus musculus
agttgccacgcacagacggtgtcta

SEQ ID NO: 10169 - DNA, 25 bp, Mus musculus
gttgccacgcacagacggtgtctag

SEQ ID NO: 10170 - DNA, 25 bp, Mus musculus
ataaaaaacacatgaacttatcaat

SEQ ID NO: 10171 - DNA, 25 bp, Mus musculus
aaaaaacacatgaacttatcaatat

SEQ ID NO: 10172 - DNA, 25 bp, Mus musculus
aaaaacacatgaacttatcaatatt

SEQ ID NO: 10173 - DNA, 25 bp, Mus musculus
aaaacacatgaacttatcaatattt

SEQ ID NO: 10174 - DNA, 25 bp, Mus musculus
aacacatgaacttatcaatatttaa

SEQ ID NO: 10175 - DNA, 25 bp, Mus musculus
gttcgggctaagcctgctgtccgtg

SEQ ID NO: 10176 - DNA, 25 bp, Mus musculus
atagttaacttgccggtagatgact

SEQ ID NO: 10177 - DNA, 25 bp, Mus musculus
caacagctggcagagctgtaccatg

SEQ ID NO: 10178 - DNA, 25 bp, Mus musculus
gatattttccagcatcttcgggatg

SEQ ID NO: 10179 - DNA, 25 bp, Mus musculus
ttccagcatcttcgggatgaatctg

SEQ ID NO: 10180 - DNA, 25 bp, Mus musculus
catcttcgggatgaatctggcaaca

SEQ ID NO: 10181 - DNA, 25 bp, Mus musculus
ggcaacagttactcaccagaggaat

SEQ ID NO: 10182 - DNA, 25 bp, Mus musculus
caggctgctgatggtgccatctttc

SEQ ID NO: 10183 - DNA, 25 bp, Mus musculus
ggtgccatctttctggtaccccgtg

SEQ ID NO: 10184 - DNA, 25 bp, Mus musculus
tgagctggtctagagagtggacact

SEQ ID NO: 10185 - DNA, 25 bp, Mus musculus
tggtgctagagactccctcattccc

SEQ ID NO: 10186 - DNA, 25 bp, Mus musculus
cacaatggatctcgaggtcgaggga

SEQ ID NO: 10187 - DNA, 25 bp, Mus musculus
aacttgccggtagatgactttaatg

SEQ ID NO: 10188 - DNA, 25 bp, Mus musculus
gatctcgaggtcgagggatctctag

SEQ ID NO: 10189 - DNA, 25 bp, Mus musculus
ttggcacagtatccgctaacggaga

SEQ ID NO: 10190 - DNA, 25 bp, Mus musculus
agccagctggctctagttcgggaca

SEQ ID NO: 10191 - DNA, 25 bp, Mus musculus
ctggctctagttcgggacatccgtc

SEQ ID NO: 10192 - DNA, 25 bp, Mus musculus
gtggcagcccaaaactgtcgcaaga

SEQ ID NO: 10193 - DNA, 25 bp, Mus musculus
gaggctgaccgcactctggaggtca

SEQ ID NO: 10194 - DNA, 25 bp, Mus musculus
gaccgcactctggaggtcatgcgcc

SEQ ID NO: 10195 - DNA, 25 bp, Mus musculus
actctggaggtcatgcgccaacagc

SEQ ID NO: 10196 - DNA, 25 bp, Mus musculus
ccagggactatccacaagctactca

SEQ ID NO: 10197 - DNA, 25 bp, Mus musculus
cacaagctactcacacagtgcctag

SEQ ID NO: 10198 - DNA, 25 bp, Mus musculus
tgggtcatcatcccaagttagccca

SEQ ID NO: 10199 - DNA, 25 bp, Mus musculus
acctctctgtggctgggccctcaac

SEQ ID NO: 10200 - DNA, 25 bp, Mus musculus
gtcagagtctctggatcccctgaaa

SEQ ID NO: 10201 - DNA, 25 bp, Mus musculus
cctgaaatcccggagaagagcctgg

SEQ ID NO: 10202 - DNA, 25 bp, Mus musculus
catttaacgcgttctgctttacaca

SEQ ID NO: 10203 - DNA, 25 bp, Mus musculus
tctgctttacacagaggatcgcacc

SEQ ID NO: 10204 - DNA, 25 bp, Mus musculus
ttacacagaggatcgcaccgtgagc

SEQ ID NO: 10205 - DNA, 25 bp, Mus musculus
tcgcaccgtgagccgtgctatctgt

SEQ ID NO: 10206 - DNA, 25 bp, Mus musculus
gtctgtgcaagcttcaggttccaag

SEQ ID NO: 10207 - DNA, 25 bp, Mus musculus
gcaagcttcaggttccaagcaggca

SEQ ID NO: 10208 - DNA, 25 bp, Mus musculus
ctactcacacagtgcctagactaga

SEQ ID NO: 10209 - DNA, 25 bp, Mus musculus
acacagtgcctagactagatttcac

SEQ ID NO: 10210 - DNA, 25 bp, Mus musculus
gagccttaaatatccacgctggtcg

SEQ ID NO: 10211 - DNA, 25 bp, Mus musculus
taaatatccacgctggtcgctaatc

SEQ ID NO: 10212 - DNA, 25 bp, Mus musculus
ccagcagcctctagacacagcacgt

SEQ ID NO: 10213 - DNA, 25 bp, Mus musculus
agacacagcacgtgtctccagaaaa

SEQ ID NO: 10214 - DNA, 25 bp, Mus musculus
agcacgtgtctccagaaaagcgtgg

SEQ ID NO: 10215 - DNA, 25 bp, Mus musculus
gaagcctgtgtgtgggtcatcatcc

SEQ ID NO: 10216 - DNA, 25 bp, Mus musculus
gcagacaacatgatccggatctcag

SEQ ID NO: 10217 - DNA, 25 bp, Mus musculus
aacatgatccggatctcagccgttt

SEQ ID NO: 10218 - DNA, 25 bp, Mus musculus
ctcgctgacttttcctgcaataaat

SEQ ID NO: 10219 - DNA, 25 bp, Mus musculus
tcctgcaataaattccctacaatca

SEQ ID NO: 10220 - DNA, 25 bp, Mus musculus
acaatcaaggccatgctgcccattg

SEQ ID NO: 10221 - DNA, 25 bp, Mus musculus
cccattgatgtctctgagtgaccga

SEQ ID NO: 10222 - DNA, 25 bp, Mus musculus
tctgagtgaccgacccagcagcact

SEQ ID NO: 10223 - DNA, 25 bp, Mus musculus
cggtgacacagaccagacagcgctc

SEQ ID NO: 10224 - DNA, 25 bp, Mus musculus
cacagaccagacagcgctctcctgt

SEQ ID NO: 10225 - DNA, 25 bp, Mus musculus
gaaactgttgcctatgttgtccagc

SEQ ID NO: 10226 - DNA, 25 bp, Mus musculus
gttgcctatgttgtccagcctgaga

SEQ ID NO: 10227 - DNA, 25 bp, Mus musculus
aggctgccagacatggacttctagc

SEQ ID NO: 10228 - DNA, 25 bp, Mus musculus
gccgtttgcaaggtgcccgatgagg

SEQ ID NO: 10229 - DNA, 25 bp, Mus musculus
ctggataatcctgctttgaccctgg

SEQ ID NO: 10230 - DNA, 25 bp, Mus musculus
aatcctgctttgaccctggaggtgc

SEQ ID NO: 10231 - DNA, 25 bp, Mus musculus
accctggaggtgctggaacaggctc

SEQ ID NO: 10232 - DNA, 25 bp, Mus musculus
catgtgcggaagcccgtgaacgtgc

SEQ ID NO: 10233 - DNA, 25 bp, Mus musculus
aagtcccgcatccgatttgagattt

SEQ ID NO: 10234 - DNA, 25 bp, Mus musculus
agtggcaccaagcaactgctcgctg

SEQ ID NO: 10235 - DNA, 25 bp, Mus musculus
accaagcaactgctcgctgactttt

SEQ ID NO: 10236 - DNA, 25 bp, Mus musculus
acacacagtacagcaagggatcagc

SEQ ID NO: 10237 - DNA, 25 bp, Mus musculus
ggataccaactattgcttcagacgg

SEQ ID NO: 10238 - DNA, 25 bp, Mus musculus
tattgcttcagacggaatacagggc

SEQ ID NO: 10239 - DNA, 25 bp, Mus musculus
attgcttcagacggaatacagggct

SEQ ID NO: 10240 - DNA, 25 bp, Mus musculus
ttgcttcagacggaatacagggctt

SEQ ID NO: 10241 - DNA, 25 bp, Mus musculus
tgcttcagacggaatacagggcttt

SEQ ID NO: 10242 - DNA, 25 bp, Mus musculus
gcttcagacggaatacagggctttc

SEQ ID NO: 10243 - DNA, 25 bp, Mus musculus
ctgaaccaaggagccatctatgaga

SEQ ID NO: 10244 - DNA, 25 bp, Mus musculus
tgaaccaaggagccatctatgagaa

SEQ ID NO: 10245 - DNA, 25 bp, Mus musculus
gaaccaaggagccatctatgagaaa

SEQ ID NO: 10246 - DNA, 25 bp, Mus musculus
aaccaaggagccatctatgagaaaa

SEQ ID NO: 10247 - DNA, 25 bp, Mus musculus
accaaggagccatctatgagaaaac

SEQ ID NO: 10248 - DNA, 25 bp, Mus musculus
gataccaactattgcttcagacgga

SEQ ID NO: 10249 - DNA, 25 bp, Mus musculus
ataccaactattgcttcagacggaa

SEQ ID NO: 10250 - DNA, 25 bp, Mus musculus
taccaactattgcttcagacggaat

SEQ ID NO: 10251 - DNA, 25 bp, Mus musculus
accaactattgcttcagacggaata

SEQ ID NO: 10252 - DNA, 25 bp, Mus musculus
ccaactattgcttcagacggaatac

SEQ ID NO: 10253 - DNA, 25 bp, Mus musculus
caactattgcttcagacggaataca

SEQ ID NO: 10254 - DNA, 25 bp, Mus musculus
actattgcttcagacggaatacagg

SEQ ID NO: 10255 - DNA, 25 bp, Mus musculus
ctattgcttcagacggaatacaggg

SEQ ID NO: 10256 - DNA, 25 bp, Mus musculus
ttacgattcggctcctgtgatgtct

SEQ ID NO: 10257 - DNA, 25 bp, Mus musculus
gattcggctcctgtgatgtcttgtg

SEQ ID NO: 10258 - DNA, 25 bp, Mus musculus
ctctctaaaagctgatcggtgacat

SEQ ID NO: 10259 - DNA, 25 bp, Mus musculus
ctctaaaagctgatcggtgacatcg

SEQ ID NO: 10260 - DNA, 25 bp, Mus musculus
aagctgatcggtgacatcgagcaca

SEQ ID NO: 10261 - DNA, 25 bp, Mus musculus
tttaagtctcatctcatccgtgctg

SEQ ID NO: 10262 - DNA, 25 bp, Mus musculus
taagtctcatctcatccgtgctgat

SEQ ID NO: 10263 - DNA, 25 bp, Mus musculus
agtctcatctcatccgtgctgattg

SEQ ID NO: 10264 - DNA, 25 bp, Mus musculus
tctcatctcatccgtgctgattgga

SEQ ID NO: 10265 - DNA, 25 bp, Mus musculus
tcatctcatccgtgctgattggaga

SEQ ID NO: 10266 - DNA, 25 bp, Mus musculus
ctcatccgtgctgattggagatctg

SEQ ID NO: 10267 - DNA, 25 bp, Mus musculus
catccgtgctgattggagatctgtg

SEQ ID NO: 10268 - DNA, 25 bp, Mus musculus
ttcggctcctgtgatgtcttgtgtg

SEQ ID NO: 10269 - DNA, 25 bp, Mus musculus
cggctcctgtgatgtcttgtgtgaa

SEQ ID NO: 10270 - DNA, 25 bp, Mus musculus
gctcctgtgatgtcttgtgtgaaat

SEQ ID NO: 10271 - DNA, 25 bp, Mus musculus
tcctgtgatgtcttgtgtgaaatgt

SEQ ID NO: 10272 - DNA, 25 bp, Mus musculus
gaaatgtacgtccaacactgagctt

SEQ ID NO: 10273 - DNA, 25 bp, Mus musculus
cgctcagactctctaaaagctgatc

SEQ ID NO: 10274 - DNA, 25 bp, Mus musculus
cagactctctaaaagctgatcggtg

SEQ ID NO: 10275 - DNA, 25 bp, Mus musculus
gactctctaaaagctgatcggtgac

SEQ ID NO: 10276 - DNA, 25 bp, Mus musculus
acatgacgggcgagtttaagaatga

SEQ ID NO: 10277 - DNA, 25 bp, Mus musculus
cccgctcatcatccataacgacaga

SEQ ID NO: 10278 - DNA, 25 bp, Mus musculus
aagcccaatgtgccattatagtata

SEQ ID NO: 10279 - DNA, 25 bp, Mus musculus
agcccaatgtgccattatagtatat

SEQ ID NO: 10280 - DNA, 25 bp, Mus musculus
cccaatgtgccattatagtatataa

SEQ ID NO: 10281 - DNA, 25 bp, Mus musculus
tataatgtagcctcaagagttactt

SEQ ID NO: 10282 - DNA, 25 bp, Mus musculus
tgtagcctcaagagttacttacgaa

SEQ ID NO: 10283 - DNA, 25 bp, Mus musculus
aaagtgtacctaactgacatagaga

SEQ ID NO: 10284 - DNA, 25 bp, Mus musculus
aagtgtacctaactgacatagagat

SEQ ID NO: 10285 - DNA, 25 bp, Mus musculus
agtgtacctaactgacatagagatc

SEQ ID NO: 10286 - DNA, 25 bp, Mus musculus
tgtacctaactgacatagagatcta

SEQ ID NO: 10287 - DNA, 25 bp, Mus musculus
gtacctaactgacatagagatctag

SEQ ID NO: 10288 - DNA, 25 bp, Mus musculus
ccgctcatcatccataacgacagaa

SEQ ID NO: 10289 - DNA, 25 bp, Mus musculus
tacctaactgacatagagatctagt

SEQ ID NO: 10290 - DNA, 25 bp, Mus musculus
cgctcatcatccataacgacagaag

SEQ ID NO: 10291 - DNA, 25 bp, Mus musculus
ctcatcatccataacgacagaagac

SEQ ID NO: 10292 - DNA, 25 bp, Mus musculus
tcatcatccataacgacagaagacc

SEQ ID NO: 10293 - DNA, 25 bp, Mus musculus
catcatccataacgacagaagaccc

SEQ ID NO: 10294 - DNA, 25 bp, Mus musculus
tcatccataacgacagaagacccat

SEQ ID NO: 10295 - DNA, 25 bp, Mus musculus
catccataacgacagaagacccatc

SEQ ID NO: 10296 - DNA, 25 bp, Mus musculus
caagcccaatgtgccattatagtat

SEQ ID NO: 10297 - DNA, 25 bp, Mus musculus
agccaaagtcccctggaatcatatc

SEQ ID NO: 10298 - DNA, 25 bp, Mus musculus
tcatatcttgcactgcctggaatta

SEQ ID NO: 10299 - DNA, 25 bp, Mus musculus
tatctcaggtcccttagagatgctg

SEQ ID NO: 10300 - DNA, 25 bp, Mus musculus
aggtcccttagagatgctggactca

SEQ ID NO: 10301 - DNA, 25 bp, Mus musculus
tgccttccttcttggccgcatttcc

SEQ ID NO: 10302 - DNA, 25 bp, Mus musculus
gtgtattctccggattcagagtcca

SEQ ID NO: 10303 - DNA, 25 bp, Mus musculus
tctccggattcagagtccacatagc

SEQ ID NO: 10304 - DNA, 25 bp, Mus musculus
gattcagagtccacatagcctgggg

SEQ ID NO: 10305 - DNA, 25 bp, Mus musculus
ccaggtgttcctggaagcaggtgct

SEQ ID NO: 10306 - DNA, 25 bp, Mus musculus
aggtgctacatgccaagtatccggg

SEQ ID NO: 10307 - DNA, 25 bp, Mus musculus
catgatgactcggccccagatgcac

SEQ ID NO: 10308 - DNA, 25 bp, Mus musculus
gactcggccccagatgcacagactg

SEQ ID NO: 10309 - DNA, 25 bp, Mus musculus
cttgcactgcctggaattaaggaca

SEQ ID NO: 10310 - DNA, 25 bp, Mus musculus
ttctttctgcaactgtcttttcacc

SEQ ID NO: 10311 - DNA, 25 bp, Mus musculus
ctgcaactgtcttttcacctcgatc

SEQ ID NO: 10312 - DNA, 25 bp, Mus musculus
tttcacctcgatcagcatcatgagt

SEQ ID NO: 10313 - DNA, 25 bp, Mus musculus
ctcgatcagcatcatgagtcatcac

SEQ ID NO: 10314 - DNA, 25 bp, Mus musculus
cagcatcatgagtcatcacagatca

SEQ ID NO: 10315 - DNA, 25 bp, Mus musculus
ttagtttctgggccagcaactagct

SEQ ID NO: 10316 - DNA, 25 bp, Mus musculus
tctgggccagcaactagctatctca

SEQ ID NO: 10317 - DNA, 25 bp, Mus musculus
tggcccaggtgagcacctccggaat

SEQ ID NO: 10318 - DNA, 25 bp, Mus musculus
ccctgatcaggtacgactgctgtgg

SEQ ID NO: 10319 - DNA, 25 bp, Mus musculus
agtgcctgaggactttgagccattc

SEQ ID NO: 10320 - DNA, 25 bp, Mus musculus
ctttgagccattccggaggcagctg

SEQ ID NO: 10321 - DNA, 25 bp, Mus musculus
gcagctgctccagggaagagtgtga

SEQ ID NO: 10322 - DNA, 25 bp, Mus musculus
ccagatcctgatcggagacctttgg

SEQ ID NO: 10323 - DNA, 25 bp, Mus musculus
cctgatcggagacctttggccattg

SEQ ID NO: 10324 - DNA, 25 bp, Mus musculus
cctttggccattgaactctgttctg

SEQ ID NO: 10325 - DNA, 25 bp, Mus musculus
gccattgaactctgttctggagacc

SEQ ID NO: 10326 - DNA, 25 bp, Mus musculus
gaactctgttctggagaccctgggg

SEQ ID NO: 10327 - DNA, 25 bp, Mus musculus
gcccctcagcctaacggatggctct

SEQ ID NO: 10328 - DNA, 25 bp, Mus musculus
cagcctaacggatggctctctggca

SEQ ID NO: 10329 - DNA, 25 bp, Mus musculus
acgactgctgtggactgacccacgg

SEQ ID NO: 10330 - DNA, 25 bp, Mus musculus
gactgacccacggaatgtgggtttg

SEQ ID NO: 10331 - DNA, 25 bp, Mus musculus
ccaagttggctacattcgggtgaag

SEQ ID NO: 10332 - DNA, 25 bp, Mus musculus
cattcgggtgaagctctatgagggt

SEQ ID NO: 10333 - DNA, 25 bp, Mus musculus
gctctatgagggtccccagctagtg

SEQ ID NO: 10334 - DNA, 25 bp, Mus musculus
tctccagtaccgatgcaatgacaca

SEQ ID NO: 10335 - DNA, 25 bp, Mus musculus
atgcaatgacacagtgcctgaggac

SEQ ID NO: 10336 - DNA, 25 bp, Mus musculus
tgacacagtgcctgaggactttgag

SEQ ID NO: 10337 - DNA, 25 bp, Mus musculus
ccctcaaatgctttgctgagacacc

SEQ ID NO: 10338 - DNA, 25 bp, Mus musculus
tcaaatgctttgctgagacacccaa

SEQ ID NO: 10339 - DNA, 25 bp, Mus musculus
tccagatcacctggaacagaaagaa

SEQ ID NO: 10340 - DNA, 25 bp, Mus musculus
agtacgactgggatctgctggctgc

SEQ ID NO: 10341 - DNA, 25 bp, Mus musculus
atctgctggctgcccgttccatctg

SEQ ID NO: 10342 - DNA, 25 bp, Mus musculus
gttccatctgggccttcggacctga

SEQ ID NO: 10343 - DNA, 25 bp, Mus musculus
gggccttcggacctgatgctacagg

SEQ ID NO: 10344 - DNA, 25 bp, Mus musculus
ccttcggacctgatgctacaggccc

SEQ ID NO: 10345 - DNA, 25 bp, Mus musculus
tcggacctgatgctacaggccccaa

SEQ ID NO: 10346 - DNA, 25 bp, Mus musculus
ctgatgctacaggccccaacatcct

SEQ ID NO: 10347 - DNA, 25 bp, Mus musculus
caggccccaacatcctagtagatga

SEQ ID NO: 10348 - DNA, 25 bp, Mus musculus
gccccaacatcctagtagatgatac

SEQ ID NO: 10349 - DNA, 25 bp, Mus musculus
aatgctttgctgagacacccaataa

SEQ ID NO: 10350 - DNA, 25 bp, Mus musculus
ttgctgagacacccaataagaagaa

SEQ ID NO: 10351 - DNA, 25 bp, Mus musculus
acaagatcaccatgattgccgagcc

SEQ ID NO: 10352 - DNA, 25 bp, Mus musculus
agatcaccatgattgccgagcccct

SEQ ID NO: 10353 - DNA, 25 bp, Mus musculus
tgattgccgagccccttgagaaggg

SEQ ID NO: 10354 - DNA, 25 bp, Mus musculus
ttgccgagccccttgagaagggcct

SEQ ID NO: 10355 - DNA, 25 bp, Mus musculus
aagtggtccagatcacctggaacag

SEQ ID NO: 10356 - DNA, 25 bp, Mus musculus
tggtccagatcacctggaacagaaa

SEQ ID NO: 10357 - DNA, 25 bp, Mus musculus
tctctggagcttttcgggacccgtg

SEQ ID NO: 10358 - DNA, 25 bp, Mus musculus
cgtggccttcatcattttcgtaagt

SEQ ID NO: 10359 - DNA, 25 bp, Mus musculus
ttgcagccctataacccgagaccat

SEQ ID NO: 10360 - DNA, 25 bp, Mus musculus
ccactcagtgcaatgctgccatttt

SEQ ID NO: 10361 - DNA, 25 bp, Mus musculus
agtgcaatgctgccattttcgtgat

SEQ ID NO: 10362 - DNA, 25 bp, Mus musculus
gcaatgctgccattttcgtgatcac

SEQ ID NO: 10363 - DNA, 25 bp, Mus musculus
atgctgccattttcgtgatcactgt

SEQ ID NO: 10364 - DNA, 25 bp, Mus musculus
ttttcgtgatcactgtctggaagct

SEQ ID NO: 10365 - DNA, 25 bp, Mus musculus
tcgtgatcactgtctggaagctcac

SEQ ID NO: 10366 - DNA, 25 bp, Mus musculus
tcactgtctggaagctcacaaagaa

SEQ ID NO: 10367 - DNA, 25 bp, Mus musculus
tttctgaaatcaacccaaacatgaa

SEQ ID NO: 10368 - DNA, 25 bp, Mus musculus
tcaacccaaacatgaagaagttaag

SEQ ID NO: 10369 - DNA, 25 bp, Mus musculus
ggccttcatcattttcgtaagtact

SEQ ID NO: 10370 - DNA, 25 bp, Mus musculus
tttcgtaagtactctctgggcactg

SEQ ID NO: 10371 - DNA, 25 bp, Mus musculus
aagtactctctgggcactggaggcc

SEQ ID NO: 10372 - DNA, 25 bp, Mus musculus
tactctctgggcactggaggcctga

SEQ ID NO: 10373 - DNA, 25 bp, Mus musculus
ggcactggaggcctgagcagccaga

SEQ ID NO: 10374 - DNA, 25 bp, Mus musculus
ctgagcagccagactgctaactcct

SEQ ID NO: 10375 - DNA, 25 bp, Mus musculus
agcagccagactgctaactccttgc

SEQ ID NO: 10376 - DNA, 25 bp, Mus musculus
agccagactgctaactccttgcagc

SEQ ID NO: 10377 - DNA, 25 bp, Mus musculus
gcttcatgccaagcttttgatctgt

SEQ ID NO: 10378 - DNA, 25 bp, Mus musculus
cttcatgccaagcttttgatctgtt

SEQ ID NO: 10379 - DNA, 25 bp, Mus musculus
accacagtcgagggacttttcactg

SEQ ID NO: 10380 - DNA, 25 bp, Mus musculus
agggacttttcactgcaggacatcc

SEQ ID NO: 10381 - DNA, 25 bp, Mus musculus
gggacttttcactgcaggacatcca

SEQ ID NO: 10382 - DNA, 25 bp, Mus musculus
ggacttttcactgcaggacatccag

SEQ ID NO: 10383 - DNA, 25 bp, Mus musculus
gacttttcactgcaggacatccaga

SEQ ID NO: 10384 - DNA, 25 bp, Mus musculus
cttttcactgcaggacatccagaag

SEQ ID NO: 10385 - DNA, 25 bp, Mus musculus
ttcactgcaggacatccagaagagt

SEQ ID NO: 10386 - DNA, 25 bp, Mus musculus
cactgcaggacatccagaagagttt

SEQ ID NO: 10387 - DNA, 25 bp, Mus musculus
actgcaggacatccagaagagttta

SEQ ID NO: 10388 - DNA, 25 bp, Mus musculus
ctgcaggacatccagaagagtttag

SEQ ID NO: 10389 - DNA, 25 bp, Mus musculus
ttcatgccaagcttttgatctgtta

SEQ ID NO: 10390 - DNA, 25 bp, Mus musculus
agtttagaagctgccgaagacagac

SEQ ID NO: 10391 - DNA, 25 bp, Mus musculus
catgccaagcttttgatctgttact

SEQ ID NO: 10392 - DNA, 25 bp, Mus musculus
atgccaagcttttgatctgttactc

SEQ ID NO: 10393 - DNA, 25 bp, Mus musculus
agcttttgatctgttactcagccct

SEQ ID NO: 10394 - DNA, 25 bp, Mus musculus
tgtcgtcaccacagtcgagggactt

SEQ ID NO: 10395 - DNA, 25 bp, Mus musculus
tcgtcaccacagtcgagggactttt

SEQ ID NO: 10396 - DNA, 25 bp, Mus musculus
gtcaccacagtcgagggacttttca

SEQ ID NO: 10397 - DNA, 25 bp, Mus musculus
tcaccacagtcgagggacttttcac

SEQ ID NO: 10398 - DNA, 25 bp, Mus musculus
agtaccaacgtgttctcaatgtctc

SEQ ID NO: 10399 - DNA, 25 bp, Mus musculus
ttctcaatgtctcagtagtcacaga

SEQ ID NO: 10400 - DNA, 25 bp, Mus musculus
catagcgacggcttcatcgactaga

SEQ ID NO: 10401 - DNA, 25 bp, Mus musculus
gactcatttgatggcctaggtcgat

SEQ ID NO: 10402 - DNA, 25 bp, Mus musculus
tcatttgatggcctaggtcgatgtg

SEQ ID NO: 10403 - DNA, 25 bp, Mus musculus
tcattatcgtagatgctcgatgatc

SEQ ID NO: 10404 - DNA, 25 bp, Mus musculus
tcttcagcgtgttcctgacgatgtg

SEQ ID NO: 10405 - DNA, 25 bp, Mus musculus
aggctgatcctgaagcgtccatctt

SEQ ID NO: 10406 - DNA, 25 bp, Mus musculus
ctgatcctgaagcgtccatctttac

SEQ ID NO: 10407 - DNA, 25 bp, Mus musculus
atcctgaagcgtccatctttacagc

SEQ ID NO: 10408 - DNA, 25 bp, Mus musculus
ccatctttacagcattgaaggtgta

SEQ ID NO: 10409 - DNA, 25 bp, Mus musculus
tctttacagcattgaaggtgtatga

SEQ ID NO: 10410 - DNA, 25 bp, Mus musculus
tcaatgtctcagtagtcacagattc

SEQ ID NO: 10411 - DNA, 25 bp, Mus musculus
attcaggagttgtcgaggtgtttca

SEQ ID NO: 10412 - DNA, 25 bp, Mus musculus
aggtgtttcacattcatgtatcagc

SEQ ID NO: 10413 - DNA, 25 bp, Mus musculus
tgtttcacattcatgtatcagcata

SEQ ID NO: 10414 - DNA, 25 bp, Mus musculus
ttcacattcatgtatcagcatagcg

SEQ ID NO: 10415 - DNA, 25 bp, Mus musculus
atgtatcagcatagcgacggcttca

SEQ ID NO: 10416 - DNA, 25 bp, Mus musculus
tatcagcatagcgacggcttcatcg

SEQ ID NO: 10417 - DNA, 25 bp, Mus musculus
cagcatagcgacggcttcatcgact

SEQ ID NO: 10418 - DNA, 25 bp, Mus musculus
atgcctctcgtatccagcgcccatt

SEQ ID NO: 10419 - DNA, 25 bp, Mus musculus
ctcgtatccagcgcccattctctgt

SEQ ID NO: 10420 - DNA, 25 bp, Mus musculus
aagcactgagtgccattagctaaat

SEQ ID NO: 10421 - DNA, 25 bp, Mus musculus
ttctccaacctttcctggcccagag

SEQ ID NO: 10422 - DNA, 25 bp, Mus musculus
cccagaggctttcccatgtgtgtgg

SEQ ID NO: 10423 - DNA, 25 bp, Mus musculus
gctggaccctttgatgggctgctct

SEQ ID NO: 10424 - DNA, 25 bp, Mus musculus
ccctttgatgggctgctcttggtcc

SEQ ID NO: 10425 - DNA, 25 bp, Mus musculus
tcaaccacatcttactactgcatgc

SEQ ID NO: 10426 - DNA, 25 bp, Mus musculus
tactactgcatgcgctccaggatgg

SEQ ID NO: 10427 - DNA, 25 bp, Mus musculus
tgcatgcgctccaggatggtcctgc

SEQ ID NO: 10428 - DNA, 25 bp, Mus musculus
tgctgtattctaccctgattattat

SEQ ID NO: 10429 - DNA, 25 bp, Mus musculus
attctaccctgattattatctcaat

SEQ ID NO: 10430 - DNA, 25 bp, Mus musculus
ttgacccgtacaccctggccattga

SEQ ID NO: 10431 - DNA, 25 bp, Mus musculus
cgtacaccctggccattgatgtact

SEQ ID NO: 10432 - DNA, 25 bp, Mus musculus
ccctggccattgatgtactggacag

SEQ ID NO: 10433 - DNA, 25 bp, Mus musculus
atgtactggacagtcctcacaccat

SEQ ID NO: 10434 - DNA, 25 bp, Mus musculus
tggacagtcctcacaccatccggcg

SEQ ID NO: 10435 - DNA, 25 bp, Mus musculus
aggatgagctgcacaccctgaccca

SEQ ID NO: 10436 - DNA, 25 bp, Mus musculus
acaccctgacccaagcactgagtgc

SEQ ID NO: 10437 - DNA, 25 bp, Mus musculus
tgacccaagcactgagtgccattag

SEQ ID NO: 10438 - DNA, 25 bp, Mus musculus
ccacctcatgtttgccgtgcgagac

SEQ ID NO: 10439 - DNA, 25 bp, Mus musculus
acctcatgtttgccgtgcgagacgc

SEQ ID NO: 10440 - DNA, 25 bp, Mus musculus
ccaatgggccctccatctgagcctt

SEQ ID NO: 10441 - DNA, 25 bp, Mus musculus
tgggccctccatctgagccttcttt

SEQ ID NO: 10442 - DNA, 25 bp, Mus musculus
atctgagccttctttccctcacaat

SEQ ID NO: 10443 - DNA, 25 bp, Mus musculus
ctgagccttctttccctcacaatgt

SEQ ID NO: 10444 - DNA, 25 bp, Mus musculus
tggctgttgcgccttgtgccggcag

SEQ ID NO: 10445 - DNA, 25 bp, Mus musculus
tgttgcgccttgtgccggcagcctg

SEQ ID NO: 10446 - DNA, 25 bp, Mus musculus
cccctcttcctatgtagctttaatg

SEQ ID NO: 10447 - DNA, 25 bp, Mus musculus
cctcttcctatgtagctttaatgcc

SEQ ID NO: 10448 - DNA, 25 bp, Mus musculus
tcttcctatgtagctttaatgccca

SEQ ID NO: 10449 - DNA, 25 bp, Mus musculus
ttcctatgtagctttaatgcccatg

SEQ ID NO: 10450 - DNA, 25 bp, Mus musculus
cagatccgagacctggcagagcgga

SEQ ID NO: 10451 - DNA, 25 bp, Mus musculus
tccgagacctggcagagcggaaccg

SEQ ID NO: 10452 - DNA, 25 bp, Mus musculus
acctggcagagcggaaccgtgcatt

SEQ ID NO: 10453 - DNA, 25 bp, Mus musculus
aaccgtgcattggagcaggagaatg

SEQ ID NO: 10454 - DNA, 25 bp, Mus musculus
ccgtgcattggagcaggagaatgga

SEQ ID NO: 10455 - DNA, 25 bp, Mus musculus
atggattgctgcgcgcactggccag

SEQ ID NO: 10456 - DNA, 25 bp, Mus musculus
attgctgcgcgcactggccagcccg

SEQ ID NO: 10457 - DNA, 25 bp, Mus musculus
gcacccaatgggccctccatctgag

SEQ ID NO: 10458 - DNA, 25 bp, Mus musculus
tatagactttcaccacttcacagac

SEQ ID NO: 10459 - DNA, 25 bp, Mus musculus
catcactgtcacacagtagcctgtc

SEQ ID NO: 10460 - DNA, 25 bp, Mus musculus
accacatcacatattactgtagctc

SEQ ID NO: 10461 - DNA, 25 bp, Mus musculus
acatcacatattactgtagctctct

SEQ ID NO: 10462 - DNA, 25 bp, Mus musculus
tcacatattactgtagctctctata

SEQ ID NO: 10463 - DNA, 25 bp, Mus musculus
attactgtagctctctatagtgtta

SEQ ID NO: 10464 - DNA, 25 bp, Mus musculus
actgtagctctctatagtgttacgt

SEQ ID NO: 10465 - DNA, 25 bp, Mus musculus
acgttcagacaccgtagctctgtcc

SEQ ID NO: 10466 - DNA, 25 bp, Mus musculus
agacaccgtagctctgtcctctctt

SEQ ID NO: 10467 - DNA, 25 bp, Mus musculus
aaatcaccccgatgtggaagagctc

SEQ ID NO: 10468 - DNA, 25 bp, Mus musculus
tcaccccgatgtggaagagctcggc

SEQ ID NO: 10469 - DNA, 25 bp, Mus musculus
agagctcggctcctctttagcattt

SEQ ID NO: 10470 - DNA, 25 bp, Mus musculus
tgtcacacagtagcctgtcacacgg

SEQ ID NO: 10471 - DNA, 25 bp, Mus musculus
acagtagcctgtcacacggatagta

SEQ ID NO: 10472 - DNA, 25 bp, Mus musculus
gttcagacaagactccttcagattc

SEQ ID NO: 10473 - DNA, 25 bp, Mus musculus
cagacaagactccttcagattccga

SEQ ID NO: 10474 - DNA, 25 bp, Mus musculus
ctccttcagattccgagacgcctac

SEQ ID NO: 10475 - DNA, 25 bp, Mus musculus
cttcagattccgagacgcctaccgg

SEQ ID NO: 10476 - DNA, 25 bp, Mus musculus
ttttttacaacagcaataaccacat

SEQ ID NO: 10477 - DNA, 25 bp, Mus musculus
acagcaataaccacatcacatatta

SEQ ID NO: 10478 - DNA, 25 bp, Mus musculus
cgctctgctcaagctaaagaaacct

SEQ ID NO: 10479 - DNA, 25 bp, Mus musculus
gaaacctgtacccttcagtgactat

SEQ ID NO: 10480 - DNA, 25 bp, Mus musculus
catgttctgtgctggcttcaaggtg

SEQ ID NO: 10481 - DNA, 25 bp, Mus musculus
gaatgacaccaagcgaggagatgct

SEQ ID NO: 10482 - DNA, 25 bp, Mus musculus
ctttaacaaccgctggtatcaaatg

SEQ ID NO: 10483 - DNA, 25 bp, Mus musculus
caaccgctggtatcaaatgggtatt

SEQ ID NO: 10484 - DNA, 25 bp, Mus musculus
tgtctcatggggtgaaggatgtgac

SEQ ID NO: 10485 - DNA, 25 bp, Mus musculus
atacggcttctacacgcatgtgttc

SEQ ID NO: 10486 - DNA, 25 bp, Mus musculus
cacgcatgtgttccgtctgaaaagg

SEQ ID NO: 10487 - DNA, 25 bp, Mus musculus
cctacactatggaatcctcattgca

SEQ ID NO: 10488 - DNA, 25 bp, Mus musculus
aatcctcattgcaaaatcacagaaa

SEQ ID NO: 10489 - DNA, 25 bp, Mus musculus
tgtttctgttctcaataaaagtgat

SEQ ID NO: 10490 - DNA, 25 bp, Mus musculus
tgactatattcaccccgtgtgtttg

SEQ ID NO: 10491 - DNA, 25 bp, Mus musculus
ccccgtgtgtttgccagacaagcag

SEQ ID NO: 10492 - DNA, 25 bp, Mus musculus
aaccagcttgctccgggctggttat

SEQ ID NO: 10493 - DNA, 25 bp, Mus musculus
gacatggacaaccaacatcaatgag

SEQ ID NO: 10494 - DNA, 25 bp, Mus musculus
caatgagatacagcccagcgtcctg

SEQ ID NO: 10495 - DNA, 25 bp, Mus musculus
ggtgaacctgcccattgtagagcgg

SEQ ID NO: 10496 - DNA, 25 bp, Mus musculus
cattgtagagcggccagtgtgcaag

SEQ ID NO: 10497 - DNA, 25 bp, Mus musculus
aattactgacaacatgttctgtgct

SEQ ID NO: 10498 - DNA, 25 bp, Mus musculus
tacaattgtcaggcatagcgttcgg

SEQ ID NO: 10499 - DNA, 25 bp, Mus musculus
aggataacctgggctagccgacagg

SEQ ID NO: 10500 - DNA, 25 bp, Mus musculus
atggttagtcagagcgtcggaagca

SEQ ID NO: 10501 - DNA, 25 bp, Mus musculus
gttagtcagagcgtcggaagcatga

SEQ ID NO: 10502 - DNA, 25 bp, Mus musculus
tagtcagagcgtcggaagcatgaag

SEQ ID NO: 10503 - DNA, 25 bp, Mus musculus
agtcagagcgtcggaagcatgaagg

SEQ ID NO: 10504 - DNA, 25 bp, Mus musculus
gaaggttcagtccttcaaggtgccg

SEQ ID NO: 10505 - DNA, 25 bp, Mus musculus
gttcagtccttcaaggtgccgtcct

SEQ ID NO: 10506 - DNA, 25 bp, Mus musculus
cagtccttcaaggtgccgtcctcgg

SEQ ID NO: 10507 - DNA, 25 bp, Mus musculus
ttcaaggtgccgtcctcggggatct

SEQ ID NO: 10508 - DNA, 25 bp, Mus musculus
gtgccgtcctcggggatctaccagg

SEQ ID NO: 10509 - DNA, 25 bp, Mus musculus
tcctcggggatctaccaggtttgtg

SEQ ID NO: 10510 - DNA, 25 bp, Mus musculus
ataacctgggctagccgacaggaca

SEQ ID NO: 10511 - DNA, 25 bp, Mus musculus
acctgggctagccgacaggacaagg

SEQ ID NO: 10512 - DNA, 25 bp, Mus musculus
taacatggggttcccttccgtcatg

SEQ ID NO: 10513 - DNA, 25 bp, Mus musculus
gttcccttccgtcatggttagtcag

SEQ ID NO: 10514 - DNA, 25 bp, Mus musculus
ttcccttccgtcatggttagtcaga

SEQ ID NO: 10515 - DNA, 25 bp, Mus musculus
ccttccgtcatggttagtcagagcg

SEQ ID NO: 10516 - DNA, 25 bp, Mus musculus
ttccgtcatggttagtcagagcgtc

SEQ ID NO: 10517 - DNA, 25 bp, Mus musculus
tccgtcatggttagtcagagcgtcg

SEQ ID NO: 10518 - DNA, 25 bp, Mus musculus
gtccaaatctctggatacctgaaca

SEQ ID NO: 10519 - DNA, 25 bp, Mus musculus
atctctggatacctgaacaggacac

SEQ ID NO: 10520 - DNA, 25 bp, Mus musculus
agccttgctcctgatggacacacac

SEQ ID NO: 10521 - DNA, 25 bp, Mus musculus
acatagcgcgggcactggcccagtg

SEQ ID NO: 10522 - DNA, 25 bp, Mus musculus
acaagcttccccaggaaggctgaga

SEQ ID NO: 10523 - DNA, 25 bp, Mus musculus
ctgcatctgctccagatgttctgct

SEQ ID NO: 10524 - DNA, 25 bp, Mus musculus
cagatgttctgctttcacctaaaag

SEQ ID NO: 10525 - DNA, 25 bp, Mus musculus
ttctgctttcacctaaaaggccctg

SEQ ID NO: 10526 - DNA, 25 bp, Mus musculus
gggatacacagcactggagattgta

SEQ ID NO: 10527 - DNA, 25 bp, Mus musculus
taacctatcagcaatattcatcaga

SEQ ID NO: 10528 - DNA, 25 bp, Mus musculus
atcagcaatattcatcagagcagct

SEQ ID NO: 10529 - DNA, 25 bp, Mus musculus
aatattcatcagagcagctagcgat

SEQ ID NO: 10530 - DNA, 25 bp, Mus musculus
actcatgggctctttgctggaacct

SEQ ID NO: 10531 - DNA, 25 bp, Mus musculus
tttgctggaacctcacttcagaccc

SEQ ID NO: 10532 - DNA, 25 bp, Mus musculus
tcacttcagaccctggaagcctcag

SEQ ID NO: 10533 - DNA, 25 bp, Mus musculus
cagaccctggaagcctcagacatct

SEQ ID NO: 10534 - DNA, 25 bp, Mus musculus
gcctcagacatctcgcccggagctt

SEQ ID NO: 10535 - DNA, 25 bp, Mus musculus
tccctggcattcaacctccagggtg

SEQ ID NO: 10536 - DNA, 25 bp, Mus musculus
gcattcaacctccagggtggacttc

SEQ ID NO: 10537 - DNA, 25 bp, Mus musculus
tctccaagccttgctcctgatggac

SEQ ID NO: 10538 - DNA, 25 bp, Mus musculus
ggagtcatcgtcttcgacaatgtga

SEQ ID NO: 10539 - DNA, 25 bp, Mus musculus
gtcatcgtcttcgacaatgtgaact

SEQ ID NO: 10540 - DNA, 25 bp, Mus musculus
gatgggcctctggttctgaagcacc

SEQ ID NO: 10541 - DNA, 25 bp, Mus musculus
gggcctctggttctgaagcacctga

SEQ ID NO: 10542 - DNA, 25 bp, Mus musculus
cctctggttctgaagcacctgactg

SEQ ID NO: 10543 - DNA, 25 bp, Mus musculus
gttctgaagcacctgactgcgctca

SEQ ID NO: 10544 - DNA, 25 bp, Mus musculus
ctgaagcacctgactgcgctcatca

SEQ ID NO: 10545 - DNA, 25 bp, Mus musculus
ctgactgcgctcatcaagtccaggg

SEQ ID NO: 10546 - DNA, 25 bp, Mus musculus
ctcatcaagtccagggaaaaggttg

SEQ ID NO: 10547 - DNA, 25 bp, Mus musculus
gccctcttcaggctgtcagaacccg

SEQ ID NO: 10548 - DNA, 25 bp, Mus musculus
ctcttcaggctgtcagaacccgagg

SEQ ID NO: 10549 - DNA, 25 bp, Mus musculus
ttcaggctgtcagaacccgagggga

SEQ ID NO: 10550 - DNA, 25 bp, Mus musculus
atcgtcttcgacaatgtgaacttca

SEQ ID NO: 10551 - DNA, 25 bp, Mus musculus
aatgtgaacttcacctacagcttag

SEQ ID NO: 10552 - DNA, 25 bp, Mus musculus
gtgaacttcacctacagcttagatg

SEQ ID NO: 10553 - DNA, 25 bp, Mus musculus
aacttcacctacagcttagatgggc

SEQ ID NO: 10554 - DNA, 25 bp, Mus musculus
ttcacctacagcttagatgggcctc

SEQ ID NO: 10555 - DNA, 25 bp, Mus musculus
tacagcttagatgggcctctggttc

SEQ ID NO: 10556 - DNA, 25 bp, Mus musculus
agcttagatgggcctctggttctga

SEQ ID NO: 10557 - DNA, 25 bp, Mus musculus
ttagatgggcctctggttctgaagc

SEQ ID NO: 10558 - DNA, 25 bp, Mus musculus
agaatgctatttgtctcctaagtgt

SEQ ID NO: 10559 - DNA, 25 bp, Mus musculus
acttgtcgttgtatatggggcatat

SEQ ID NO: 10560 - DNA, 25 bp, Mus musculus
accccttctacctgttgacttgcat

SEQ ID NO: 10561 - DNA, 25 bp, Mus musculus
tctacctgttgacttgcatgttgct

SEQ ID NO: 10562 - DNA, 25 bp, Mus musculus
cttgcatgttgcttctattgtgctc

SEQ ID NO: 10563 - DNA, 25 bp, Mus musculus
ttctattgtgctcctgaatgattga

SEQ ID NO: 10564 - DNA, 25 bp, Mus musculus
tgtgctcctgaatgattgatttctt

SEQ ID NO: 10565 - DNA, 25 bp, Mus musculus
tacaacatgcctctgaatggtttgg

SEQ ID NO: 10566 - DNA, 25 bp, Mus musculus
atgcctctgaatggtttggtttcct

SEQ ID NO: 10567 - DNA, 25 bp, Mus musculus
gctgtatgctgactcatctcattgc

SEQ ID NO: 10568 - DNA, 25 bp, Mus musculus
gattaaccattgtgtccacatgaac

SEQ ID NO: 10569 - DNA, 25 bp, Mus musculus
ttctctctgcagtgtgaaactgttt

SEQ ID NO: 10570 - DNA, 25 bp, Mus musculus
attcagaggcccataatagccacga

SEQ ID NO: 10571 - DNA, 25 bp, Mus musculus
aggcccataatagccacgaagttat

SEQ ID NO: 10572 - DNA, 25 bp, Mus musculus
aagttatccagttatgctaaccata

SEQ ID NO: 10573 - DNA, 25 bp, Mus musculus
tccagttatgctaaccatagagatc

SEQ ID NO: 10574 - DNA, 25 bp, Mus musculus
tagctcataggtccttcataagcct

SEQ ID NO: 10575 - DNA, 25 bp, Mus musculus
ataggtccttcataagcctaagcat

SEQ ID NO: 10576 - DNA, 25 bp, Mus musculus
taagcctaagcatccgtattaaatg

SEQ ID NO: 10577 - DNA, 25 bp, Mus musculus
taagcatccgtattaaatgtgaaac

SEQ ID NO: 10578 - DNA, 25 bp, Mus musculus
ccgtgttgcttcgccatcttcggaa

SEQ ID NO: 10579 - DNA, 25 bp, Mus musculus
tgttgcttcgccatcttcggaaggt

SEQ ID NO: 10580 - DNA, 25 bp, Mus musculus
gttgactgccatttgtagaaggtcc

SEQ ID NO: 10581 - DNA, 25 bp, Mus musculus
actgcaagtgtgggacacggctggc

SEQ ID NO: 10582 - DNA, 25 bp, Mus musculus
cacggctggccaagaacgattcaag

SEQ ID NO: 10583 - DNA, 25 bp, Mus musculus
agccatgggcattatcctcgtatat

SEQ ID NO: 10584 - DNA, 25 bp, Mus musculus
catgggcattatcctcgtatatgac

SEQ ID NO: 10585 - DNA, 25 bp, Mus musculus
gggcattatcctcgtatatgacatc

SEQ ID NO: 10586 - DNA, 25 bp, Mus musculus
cattatcctcgtatatgacatcaca

SEQ ID NO: 10587 - DNA, 25 bp, Mus musculus
tatcctcgtatatgacatcacagat

SEQ ID NO: 10588 - DNA, 25 bp, Mus musculus
cctcgtatatgacatcacagatgag

SEQ ID NO: 10589 - DNA, 25 bp, Mus musculus
atatgacatcacagatgagaaatcc

SEQ ID NO: 10590 - DNA, 25 bp, Mus musculus
tgcttcgccatcttcggaaggtctt

SEQ ID NO: 10591 - DNA, 25 bp, Mus musculus
ttcgccatcttcggaaggtcttcta

SEQ ID NO: 10592 - DNA, 25 bp, Mus musculus
atcttcggaaggtcttctactctgt

SEQ ID NO: 10593 - DNA, 25 bp, Mus musculus
ggaaggtcttctactctgttcgaat

SEQ ID NO: 10594 - DNA, 25 bp, Mus musculus
aggtcttctactctgttcgaatgca

SEQ ID NO: 10595 - DNA, 25 bp, Mus musculus
actctgttcgaatgcaacggaatgc

SEQ ID NO: 10596 - DNA, 25 bp, Mus musculus
tgcaacggaatgcccgttgactgcc

SEQ ID NO: 10597 - DNA, 25 bp, Mus musculus
atgcccgttgactgccatttgtaga

SEQ ID NO: 10598 - DNA, 25 bp, Mus musculus
gccatcttctttcttgtgccgttga

SEQ ID NO: 10599 - DNA, 25 bp, Mus musculus
tccacggtctgctacacgtccatca

SEQ ID NO: 10600 - DNA, 25 bp, Mus musculus
gacagtcctggtacagaggcagcct

SEQ ID NO: 10601 - DNA, 25 bp, Mus musculus
ctcctctgcgtctgtgtgagcagcg

SEQ ID NO: 10602 - DNA, 25 bp, Mus musculus
tgcgtctgtgtgagcagcgtgagct

SEQ ID NO: 10603 - DNA, 25 bp, Mus musculus
tgtgtgagcagcgtgagctgctgca

SEQ ID NO: 10604 - DNA, 25 bp, Mus musculus
tgctgcatcgatccgttgatttact

SEQ ID NO: 10605 - DNA, 25 bp, Mus musculus
agcatcttgtgctgcaaagaaagct

SEQ ID NO: 10606 - DNA, 25 bp, Mus musculus
tctgatcccaacagttgcaacagca

SEQ ID NO: 10607 - DNA, 25 bp, Mus musculus
agttgcaacagcaccggccagctga

SEQ ID NO: 10608 - DNA, 25 bp, Mus musculus
atggatacctgctctagtcacctga

SEQ ID NO: 10609 - DNA, 25 bp, Mus musculus
tctagtcacctgaataacagcatat

SEQ ID NO: 10610 - DNA, 25 bp, Mus musculus
gtctgctacacgtccatcatccggt

SEQ ID NO: 10611 - DNA, 25 bp, Mus musculus
tccatcatccggtgcctgagctcct

SEQ ID NO: 10612 - DNA, 25 bp, Mus musculus
atccggtgcctgagctcctccgcgg

SEQ ID NO: 10613 - DNA, 25 bp, Mus musculus
gttgccaaccggagcaagaagtcgc

SEQ ID NO: 10614 - DNA, 25 bp, Mus musculus
ctgtctgccgcggtgttctgcatct

SEQ ID NO: 10615 - DNA, 25 bp, Mus musculus
gtgttctgcatcttcatcgtctgct

SEQ ID NO: 10616 - DNA, 25 bp, Mus musculus
ttcatcgtctgctttgggcccacca

SEQ ID NO: 10617 - DNA, 25 bp, Mus musculus
ctcctgattgtgcactaccttttcc

SEQ ID NO: 10618 - DNA, 25 bp, Mus musculus
gtcgccctttgagcagcgcctttcc

SEQ ID NO: 10619 - DNA, 25 bp, Mus musculus
cgcctttcccacgactatatcagca

SEQ ID NO: 10620 - DNA, 25 bp, Mus musculus
aaggcatccccaacgtgctagcgcg

SEQ ID NO: 10621 - DNA, 25 bp, Mus musculus
aggcatccccaacgtgctagcgcgc

SEQ ID NO: 10622 - DNA, 25 bp, Mus musculus
ggcatccccaacgtgctagcgcgca

SEQ ID NO: 10623 - DNA, 25 bp, Mus musculus
ccaacgtgctagcgcgcactcgcga

SEQ ID NO: 10624 - DNA, 25 bp, Mus musculus
caacgtgctagcgcgcactcgcgag

SEQ ID NO: 10625 - DNA, 25 bp, Mus musculus
aacgtgctagcgcgcactcgcgagc

SEQ ID NO: 10626 - DNA, 25 bp, Mus musculus
tgctagcgcgcactcgcgagccatc

SEQ ID NO: 10627 - DNA, 25 bp, Mus musculus
cgcactcgcgagccatctctgcggt

SEQ ID NO: 10628 - DNA, 25 bp, Mus musculus
gcactcgcgagccatctctgcggtt

SEQ ID NO: 10629 - DNA, 25 bp, Mus musculus
actcgcgagccatctctgcggttgg

SEQ ID NO: 10630 - DNA, 25 bp, Mus musculus
gcctttcccacgactatatcagcaa

SEQ ID NO: 10631 - DNA, 25 bp, Mus musculus
cctttcccacgactatatcagcaaa

SEQ ID NO: 10632 - DNA, 25 bp, Mus musculus
tttcccacgactatatcagcaaagg

SEQ ID NO: 10633 - DNA, 25 bp, Mus musculus
ttcccacgactatatcagcaaaggc

SEQ ID NO: 10634 - DNA, 25 bp, Mus musculus
tcccacgactatatcagcaaaggca

SEQ ID NO: 10635 - DNA, 25 bp, Mus musculus
cccacgactatatcagcaaaggcat

SEQ ID NO: 10636 - DNA, 25 bp, Mus musculus
cacgactatatcagcaaaggcatcc

SEQ ID NO: 10637 - DNA, 25 bp, Mus musculus
aaaggcatccccaacgtgctagcgc

SEQ ID NO: 10638 - DNA, 25 bp, Mus musculus
tttatggtttccaatggaggcattt

SEQ ID NO: 10639 - DNA, 25 bp, Mus musculus
attcagattactcgggacaaggagt

SEQ ID NO: 10640 - DNA, 25 bp, Mus musculus
atatgggtctgggcgtgcccttcaa

SEQ ID NO: 10641 - DNA, 25 bp, Mus musculus
gcgtgcccttcaacattgccagcta

SEQ ID NO: 10642 - DNA, 25 bp, Mus musculus
ccttcaacattgccagctatgctct

SEQ ID NO: 10643 - DNA, 25 bp, Mus musculus
ccagctatgctctgctcacctacat

SEQ ID NO: 10644 - DNA, 25 bp, Mus musculus
atgctctgctcacctacatgattgc

SEQ ID NO: 10645 - DNA, 25 bp, Mus musculus
tgctcacctacatgattgcacatat

SEQ ID NO: 10646 - DNA, 25 bp, Mus musculus
cacatatcacaggcctgcagccagg

SEQ ID NO: 10647 - DNA, 25 bp, Mus musculus
tcacaggcctgcagccaggtgattt

SEQ ID NO: 10648 - DNA, 25 bp, Mus musculus
ggtataatccacatccaacgattaa

SEQ ID NO: 10649 - DNA, 25 bp, Mus musculus
atccacatccaacgattaaaatgga

SEQ ID NO: 10650 - DNA, 25 bp, Mus musculus
tagaccagctgcaaaaagtgattga

SEQ ID NO: 10651 - DNA, 25 bp, Mus musculus
tcaaaaccaaccctgatgacagaag

SEQ ID NO: 10652 - DNA, 25 bp, Mus musculus
ccaaccctgatgacagaagaatcat

SEQ ID NO: 10653 - DNA, 25 bp, Mus musculus
tcatgtgtgcctggaacccaaaaga

SEQ ID NO: 10654 - DNA, 25 bp, Mus musculus
cttgccatgccctctgtcagttcta

SEQ ID NO: 10655 - DNA, 25 bp, Mus musculus
agttctatgtggtgaatggggaact

SEQ ID NO: 10656 - DNA, 25 bp, Mus musculus
gccagctttaccagaggtcaggaga

SEQ ID NO: 10657 - DNA, 25 bp, Mus musculus
tttaccagaggtcaggagatatggg

SEQ ID NO: 10658 - DNA, 25 bp, Mus musculus
tctaccaggtcattctcagccacca

SEQ ID NO: 10659 - DNA, 25 bp, Mus musculus
aagcgctctgccatcactgaagaag

SEQ ID NO: 10660 - DNA, 25 bp, Mus musculus
gacccagcttaccaagggagagcct

SEQ ID NO: 10661 - DNA, 25 bp, Mus musculus
cccccagacagcgagagtcttgcaa

SEQ ID NO: 10662 - DNA, 25 bp, Mus musculus
ctcttccaagacctcctaatctcag

SEQ ID NO: 10663 - DNA, 25 bp, Mus musculus
caagacctcctaatctcaggggcag

SEQ ID NO: 10664 - DNA, 25 bp, Mus musculus
ggcgtgcacactttttggaagatag

SEQ ID NO: 10665 - DNA, 25 bp, Mus musculus
aagatagctttcccaaggatcctct

SEQ ID NO: 10666 - DNA, 25 bp, Mus musculus
cccatcaccatgtataataccacca

SEQ ID NO: 10667 - DNA, 25 bp, Mus musculus
accatgtataataccaccactgcta

SEQ ID NO: 10668 - DNA, 25 bp, Mus musculus
acagcatctcaccgaggaagaaaat

SEQ ID NO: 10669 - DNA, 25 bp, Mus musculus
tgcacaataaaaccaagcctctgga

SEQ ID NO: 10670 - DNA, 25 bp, Mus musculus
tctgccatcactgaagaagccccct

SEQ ID NO: 10671 - DNA, 25 bp, Mus musculus
gcacaataaaaccaagcctctggag

SEQ ID NO: 10672 - DNA, 25 bp, Mus musculus
atcactgaagaagccccctagggct

SEQ ID NO: 10673 - DNA, 25 bp, Mus musculus
tcttgggccagggcacactcagtaa

SEQ ID NO: 10674 - DNA, 25 bp, Mus musculus
aacacgagcctgctgtctccaaagg

SEQ ID NO: 10675 - DNA, 25 bp, Mus musculus
agaactctgactccaggatctaagt

SEQ ID NO: 10676 - DNA, 25 bp, Mus musculus
ccaggatctaagtccgtgcaggaag

SEQ ID NO: 10677 - DNA, 25 bp, Mus musculus
ggggatcctagaaccatctggttgg

SEQ ID NO: 10678 - DNA, 25 bp, Mus musculus
cctagaaccatctggttggacccag

SEQ ID NO: 10679 - DNA, 25 bp, Mus musculus
tccttccagcaaccatgtctgacaa

SEQ ID NO: 10680 - DNA, 25 bp, Mus musculus
ttccagcaaccatgtctgacaaacc

SEQ ID NO: 10681 - DNA, 25 bp, Mus musculus
gcgagcccgccaatatgcactgtac

SEQ ID NO: 10682 - DNA, 25 bp, Mus musculus
agcccgccaatatgcactgtacatt

SEQ ID NO: 10683 - DNA, 25 bp, Mus musculus
ccgccaatatgcactgtacattcca

SEQ ID NO: 10684 - DNA, 25 bp, Mus musculus
atatgcactgtacattccacaagca

SEQ ID NO: 10685 - DNA, 25 bp, Mus musculus
tgcactgtacattccacaagcattg

SEQ ID NO: 10686 - DNA, 25 bp, Mus musculus
actgtacattccacaagcattgcct

SEQ ID NO: 10687 - DNA, 25 bp, Mus musculus
gtacattccacaagcattgcctcct

SEQ ID NO: 10688 - DNA, 25 bp, Mus musculus
tccacaagcattgcctcctaattta

SEQ ID NO: 10689 - DNA, 25 bp, Mus musculus
acaagcattgcctcctaatttaact

SEQ ID NO: 10690 - DNA, 25 bp, Mus musculus
agcattgcctcctaatttaactcct

SEQ ID NO: 10691 - DNA, 25 bp, Mus musculus
cagcaaccatgtctgacaaacccga

SEQ ID NO: 10692 - DNA, 25 bp, Mus musculus
caaccatgtctgacaaacccgatat

SEQ ID NO: 10693 - DNA, 25 bp, Mus musculus
ctgacaaacccgatatggctgagat

SEQ ID NO: 10694 - DNA, 25 bp, Mus musculus
acaaacccgatatggctgagatcga

SEQ ID NO: 10695 - DNA, 25 bp, Mus musculus
aacccgatatggctgagatcgagaa

SEQ ID NO: 10696 - DNA, 25 bp, Mus musculus
atcctctgccttcaaaagaaacaat

SEQ ID NO: 10697 - DNA, 25 bp, Mus musculus
ctctgccttcaaaagaaacaattga

SEQ ID NO: 10698 - DNA, 25 bp, Mus musculus
gaggcgagcccgccaatatgcactg

SEQ ID NO: 10699 - DNA, 25 bp, Mus musculus
gcagatcagactctcctcgttcgcg

SEQ ID NO: 10700 - DNA, 25 bp, Mus musculus
cagatcagactctcctcgttcgcgc

SEQ ID NO: 10701 - DNA, 25 bp, Mus musculus
agatcagactctcctcgttcgcgca

SEQ ID NO: 10702 - DNA, 25 bp, Mus musculus
tccacaagcattgcctcctaattta

SEQ ID NO: 10703 - DNA, 25 bp, Mus musculus
ccacaagcattgcctcctaatttaa

SEQ ID NO: 10704 - DNA, 25 bp, Mus musculus
cacaagcattgcctcctaatttaac

SEQ ID NO: 10705 - DNA, 25 bp, Mus musculus
acaagcattgcctcctaatttaact

SEQ ID NO: 10706 - DNA, 25 bp, Mus musculus
caagcattgcctcctaatttaactc

SEQ ID NO: 10707 - DNA, 25 bp, Mus musculus
agcattgcctcctaatttaactcct

SEQ ID NO: 10708 - DNA, 25 bp, Mus musculus
gcattgcctcctaatttaactcctt

SEQ ID NO: 10709 - DNA, 25 bp, Mus musculus
gcagatcagactctcctcgttcgcg

SEQ ID NO: 10710 - DNA, 25 bp, Mus musculus
cagatcagactctcctcgttcgcgc

SEQ ID NO: 10711 - DNA, 25 bp, Mus musculus
acaagcattgcctcctaatttaact

SEQ ID NO: 10712 - DNA, 25 bp, Mus musculus
caagcattgcctcctaatttaactc

SEQ ID NO: 10713 - DNA, 25 bp, Mus musculus
agcattgcctcctaatttaactcct

SEQ ID NO: 10714 - DNA, 25 bp, Mus musculus
gcattgcctcctaatttaactcctt

SEQ ID NO: 10715 - DNA, 25 bp, Mus musculus
agatcagactctcctcgttcgcgca

SEQ ID NO: 10716 - DNA, 25 bp, Mus musculus
gcactctgctcggctccttccagca

SEQ ID NO: 10717 - DNA, 25 bp, Mus musculus
cactctgctcggctccttccagcaa

SEQ ID NO: 10718 - DNA, 25 bp, Mus musculus
actctgctcggctccttccagcaac

SEQ ID NO: 10719 - DNA, 25 bp, Mus musculus
ctctgctcggctccttccagcaacc

SEQ ID NO: 10720 - DNA, 25 bp, Mus musculus
tccacaagcattgcctcctaattta

SEQ ID NO: 10721 - DNA, 25 bp, Mus musculus
ccacaagcattgcctcctaatttaa

SEQ ID NO: 10722 - DNA, 25 bp, Mus musculus
cacaagcattgcctcctaatttaac

SEQ ID NO: 10723 - DNA, 25 bp, Mus musculus
taagttccaggtagcccagcagtgg

SEQ ID NO: 10724 - DNA, 25 bp, Mus musculus
aagttccaggtagcccagcagtggg

SEQ ID NO: 10725 - DNA, 25 bp, Mus musculus
cagacccaaggcagcaagaagctaa

SEQ ID NO: 10726 - DNA, 25 bp, Mus musculus
agacccaaggcagcaagaagctaac

SEQ ID NO: 10727 - DNA, 25 bp, Mus musculus
gaagctaacgaggcaccatgcgaga

SEQ ID NO: 10728 - DNA, 25 bp, Mus musculus
cgaggcaccatgcgagagatcgtgc

SEQ ID NO: 10729 - DNA, 25 bp, Mus musculus
aggcaccatgcgagagatcgtgcac

SEQ ID NO: 10730 - DNA, 25 bp, Mus musculus
atgtatactacaacgaagcaactgg

SEQ ID NO: 10731 - DNA, 25 bp, Mus musculus
gtatactacaacgaagcaactggta

SEQ ID NO: 10732 - DNA, 25 bp, Mus musculus
tatactacaacgaagcaactggtaa

SEQ ID NO: 10733 - DNA, 25 bp, Mus musculus
atactacaacgaagcaactggtaat

SEQ ID NO: 10734 - DNA, 25 bp, Mus musculus
tactacaacgaagcaactggtaata

SEQ ID NO: 10735 - DNA, 25 bp, Mus musculus
agttccaggtagcccagcagtgggt

SEQ ID NO: 10736 - DNA, 25 bp, Mus musculus
gttccaggtagcccagcagtgggtg

SEQ ID NO: 10737 - DNA, 25 bp, Mus musculus
ttccaggtagcccagcagtgggtgt

SEQ ID NO: 10738 - DNA, 25 bp, Mus musculus
tccaggtagcccagcagtgggtgtg

SEQ ID NO: 10739 - DNA, 25 bp, Mus musculus
aggatcatcagacccactgacccag

SEQ ID NO: 10740 - DNA, 25 bp, Mus musculus
ggatcatcagacccactgacccaga

SEQ ID NO: 10741 - DNA, 25 bp, Mus musculus
gatcatcagacccactgacccagac

SEQ ID NO: 10742 - DNA, 25 bp, Mus musculus
actgacccagacccaaggcagcaag

SEQ ID NO: 10743 - DNA, 25 bp, Mus musculus
acgcgtccgcacaggagaccatcca

SEQ ID NO: 10744 - DNA, 25 bp, Mus musculus
cacaggagaccatccaatcacagcc

SEQ ID NO: 10745 - DNA, 25 bp, Mus musculus
ccccagagatgccaaggcctgtgta

SEQ ID NO: 10746 - DNA, 25 bp, Mus musculus
caaggcctgtgtagtacatggcagt

SEQ ID NO: 10747 - DNA, 25 bp, Mus musculus
acatggcagtgacttgaaggacatg

SEQ ID NO: 10748 - DNA, 25 bp, Mus musculus
gacctctgaggagctggatgacatt

SEQ ID NO: 10749 - DNA, 25 bp, Mus musculus
cattttgcggtaccacacggagatt

SEQ ID NO: 10750 - DNA, 25 bp, Mus musculus
tttgcggtaccacacggagattgtc

SEQ ID NO: 10751 - DNA, 25 bp, Mus musculus
tgtctttgctaggacctctcctcaa

SEQ ID NO: 10752 - DNA, 25 bp, Mus musculus
tgctaggacctctcctcaacagaag

SEQ ID NO: 10753 - DNA, 25 bp, Mus musculus
gacctctcctcaacagaagctcatc

SEQ ID NO: 10754 - DNA, 25 bp, Mus musculus
ctctcctcaacagaagctcatcatt

SEQ ID NO: 10755 - DNA, 25 bp, Mus musculus
aggagaccatccaatcacagccaaa

SEQ ID NO: 10756 - DNA, 25 bp, Mus musculus
agaccatccaatcacagccaaagcc

SEQ ID NO: 10757 - DNA, 25 bp, Mus musculus
tccaatcacagccaaagccattgct

SEQ ID NO: 10758 - DNA, 25 bp, Mus musculus
aatcacagccaaagccattgctaag

SEQ ID NO: 10759 - DNA, 25 bp, Mus musculus
cacagccaaagccattgctaagggg

SEQ ID NO: 10760 - DNA, 25 bp, Mus musculus
ccgcctcaacattccagtgaaccag

SEQ ID NO: 10761 - DNA, 25 bp, Mus musculus
caacattccagtgaaccaggtgaac

SEQ ID NO: 10762 - DNA, 25 bp, Mus musculus
ccaggtgaaccccagagatgccaag

SEQ ID NO: 10763 - DNA, 25 bp, Mus musculus
ttgctacaggcaggagtggagcaca

SEQ ID NO: 10764 - DNA, 25 bp, Mus musculus
gagcacagacttgttaccaggtctc

SEQ ID NO: 10765 - DNA, 25 bp, Mus musculus
atccctcctgcatctggtatggact

SEQ ID NO: 10766 - DNA, 25 bp, Mus musculus
gtcagccccatgaatccacagactt

SEQ ID NO: 10767 - DNA, 25 bp, Mus musculus
cccatgaatccacagacttcagcga

SEQ ID NO: 10768 - DNA, 25 bp, Mus musculus
aatccacagacttcagcgaatggaa

SEQ ID NO: 10769 - DNA, 25 bp, Mus musculus
ccctgagccgtgtttctggcttcaa

SEQ ID NO: 10770 - DNA, 25 bp, Mus musculus
tttctggcttcaaccaagtcattgc

SEQ ID NO: 10771 - DNA, 25 bp, Mus musculus
gcttcaaccaagtcattgctgcctt

SEQ ID NO: 10772 - DNA, 25 bp, Mus musculus
accaagtcattgctgccttcctctc

SEQ ID NO: 10773 - DNA, 25 bp, Mus musculus
cacacaccctcagtggggtctgtga

SEQ ID NO: 10774 - DNA, 25 bp, Mus musculus
tctcaagcttcccaagccattcttc

SEQ ID NO: 10775 - DNA, 25 bp, Mus musculus
agacttgttaccaggtctctctggc

SEQ ID NO: 10776 - DNA, 25 bp, Mus musculus
gttaccaggtctctctggcactgtc

SEQ ID NO: 10777 - DNA, 25 bp, Mus musculus
cacatgcagcagacaggcagcatta

SEQ ID NO: 10778 - DNA, 25 bp, Mus musculus
accctagctctgttagggcagagct

SEQ ID NO: 10779 - DNA, 25 bp, Mus musculus
ttttgcagaaactcttgaaggttgt

SEQ ID NO: 10780 - DNA, 25 bp, Mus musculus
ccaggtccttttcatcctgagagtg

SEQ ID NO: 10781 - DNA, 25 bp, Mus musculus
gacatgtccctcgttttctgcagtg

SEQ ID NO: 10782 - DNA, 25 bp, Mus musculus
gttttctgcagtggccacctctctc

SEQ ID NO: 10783 - DNA, 25 bp, Mus musculus
atcagactctgacccagttcttgaa

SEQ ID NO: 10784 - DNA, 25 bp, Mus musculus
agactctgacccagttcttgaatga

SEQ ID NO: 10785 - DNA, 25 bp, Mus musculus
ctgtttgcttttgcagacaggcaga

SEQ ID NO: 10786 - DNA, 25 bp, Mus musculus
tttgcagacaggcagacgggagatc

SEQ ID NO: 10787 - DNA, 25 bp, Mus musculus
gtgaaacgtgatcccccatggatcc

SEQ ID NO: 10788 - DNA, 25 bp, Mus musculus
aaacgtgatcccccatggatccagg

SEQ ID NO: 10789 - DNA, 25 bp, Mus musculus
cgtgatcccccatggatccaggtgc

SEQ ID NO: 10790 - DNA, 25 bp, Mus musculus
aaggacgacactgtgacgctgacgt

SEQ ID NO: 10791 - DNA, 25 bp, Mus musculus
gacgacactgtgacgctgacgtgcg

SEQ ID NO: 10792 - DNA, 25 bp, Mus musculus
acccagtggttccacaaccagagct

SEQ ID NO: 10793 - DNA, 25 bp, Mus musculus
cagtggttccacaaccagagctcca

SEQ ID NO: 10794 - DNA, 25 bp, Mus musculus
tggttccacaaccagagctccacct

SEQ ID NO: 10795 - DNA, 25 bp, Mus musculus
ctctgacccagttcttgaatgactt

SEQ ID NO: 10796 - DNA, 25 bp, Mus musculus
actttggagacccagatgtttcaga

SEQ ID NO: 10797 - DNA, 25 bp, Mus musculus
gagacccagatgtttcagaatgcac

SEQ ID NO: 10798 - DNA, 25 bp, Mus musculus
cagaatgcacattctggaagccaat

SEQ ID NO: 10799 - DNA, 25 bp, Mus musculus
aatgcacattctggaagccaatggc

SEQ ID NO: 10800 - DNA, 25 bp, Mus musculus
cattctggaagccaatggctactcc

SEQ ID NO: 10801 - DNA, 25 bp, Mus musculus
ccaccactgacaatgttgctgctgt

SEQ ID NO: 10802 - DNA, 25 bp, Mus musculus
acaatgttgctgctgtttgcttttg

SEQ ID NO: 10803 - DNA, 25 bp, Mus musculus
cagcaaccgactacacgcatttcga

SEQ ID NO: 10804 - DNA, 25 bp, Mus musculus
gcaaccgactacacgcatttcgaca

SEQ ID NO: 10805 - DNA, 25 bp, Mus musculus
actaatcatacttatcatcaaacaa

SEQ ID NO: 10806 - DNA, 25 bp, Mus musculus
taatcatacttatcatcaaacaagt

SEQ ID NO: 10807 - DNA, 25 bp, Mus musculus
atcatacttatcatcaaacaagtga

SEQ ID NO: 10808 - DNA, 25 bp, Mus musculus
tacttatcatcaaacaagtgatgtt

SEQ ID NO: 10809 - DNA, 25 bp, Mus musculus
tgatgttaatccacacaccattagg

SEQ ID NO: 10810 - DNA, 25 bp, Mus musculus
atgttaatccacacaccattaggac

SEQ ID NO: 10811 - DNA, 25 bp, Mus musculus
gttaatccacacaccattaggacga

SEQ ID NO: 10812 - DNA, 25 bp, Mus musculus
taatccacacaccattaggacgaac

SEQ ID NO: 10813 - DNA, 25 bp, Mus musculus
atccacacaccattaggacgaacct

SEQ ID NO: 10814 - DNA, 25 bp, Mus musculus
ccacacaccattaggacgaacctgg

SEQ ID NO: 10815 - DNA, 25 bp, Mus musculus
aaccgactacacgcatttcgacagt

SEQ ID NO: 10816 - DNA, 25 bp, Mus musculus
ccgactacacgcatttcgacagtga

SEQ ID NO: 10817 - DNA, 25 bp, Mus musculus
gactacacgcatttcgacagtgact

SEQ ID NO: 10818 - DNA, 25 bp, Mus musculus
ctacacgcatttcgacagtgactaa

SEQ ID NO: 10819 - DNA, 25 bp, Mus musculus
acacgcatttcgacagtgactaatc

SEQ ID NO: 10820 - DNA, 25 bp, Mus musculus
acgcatttcgacagtgactaatcat

SEQ ID NO: 10821 - DNA, 25 bp, Mus musculus
atttcgacagtgactaatcatactt

SEQ ID NO: 10822 - DNA, 25 bp, Mus musculus
tgactaatcatacttatcatcaaac

SEQ ID NO: 10823 - DNA, 25 bp, Mus musculus
tgttgtgcttcttaaacgacaaaga

SEQ ID NO: 10824 - DNA, 25 bp, Mus musculus
gcttcttaaacgacaaagaacatag

SEQ ID NO: 10825 - DNA, 25 bp, Mus musculus
gaaatgaccatgctctggggacagg

SEQ ID NO: 10826 - DNA, 25 bp, Mus musculus
atgaccatgctctggggacaggggt

SEQ ID NO: 10827 - DNA, 25 bp, Mus musculus
gtctatttttcctctagcaagccag

SEQ ID NO: 10828 - DNA, 25 bp, Mus musculus
ttttcctctagcaagccagctgtgc

SEQ ID NO: 10829 - DNA, 25 bp, Mus musculus
ccagctgtgctgaagcccagtagag

SEQ ID NO: 10830 - DNA, 25 bp, Mus musculus
gctgtgctgaagcccagtagagatg

SEQ ID NO: 10831 - DNA, 25 bp, Mus musculus
gaagagacaccagccagagaaaacc

SEQ ID NO: 10832 - DNA, 25 bp, Mus musculus
ttgtagcactgtttacagttttcct

SEQ ID NO: 10833 - DNA, 25 bp, Mus musculus
cagttttcctccatgttatttatga

SEQ ID NO: 10834 - DNA, 25 bp, Mus musculus
atagctgtcctttattctaaacagt

SEQ ID NO: 10835 - DNA, 25 bp, Mus musculus
aacatagtgacttttggggatagat

SEQ ID NO: 10836 - DNA, 25 bp, Mus musculus
cctgcctcacatcaaggtgccattc

SEQ ID NO: 10837 - DNA, 25 bp, Mus musculus
tcacatcaaggtgccattcaggtag

SEQ ID NO: 10838 - DNA, 25 bp, Mus musculus
ggtgccattcaggtagttggctccc

SEQ ID NO: 10839 - DNA, 25 bp, Mus musculus
gtagttggctcccagctacttaacg

SEQ ID NO: 10840 - DNA, 25 bp, Mus musculus
gttggctcccagctacttaacgata

SEQ ID NO: 10841 - DNA, 25 bp, Mus musculus
atcactttcgtatttgtatcagaga

SEQ ID NO: 10842 - DNA, 25 bp, Mus musculus
gatctaagtcagctgtttgggttga

SEQ ID NO: 10843 - DNA, 25 bp, Mus musculus
tgctggtgcccgaagctgtaggttc

SEQ ID NO: 10844 - DNA, 25 bp, Mus musculus
gctggtgcccgaagctgtaggttct

SEQ ID NO: 10845 - DNA, 25 bp, Mus musculus
aatcccttcctagactatgaggtcg

SEQ ID NO: 10846 - DNA, 25 bp, Mus musculus
atcccttcctagactatgaggtcgc

SEQ ID NO: 10847 - DNA, 25 bp, Mus musculus
tcccttcctagactatgaggtcgct

SEQ ID NO: 10848 - DNA, 25 bp, Mus musculus
ccttcctagactatgaggtcgctgc

SEQ ID NO: 10849 - DNA, 25 bp, Mus musculus
cttcctagactatgaggtcgctgcc

SEQ ID NO: 10850 - DNA, 25 bp, Mus musculus
ttcctagactatgaggtcgctgcct

SEQ ID NO: 10851 - DNA, 25 bp, Mus musculus
cctagactatgaggtcgctgcctcc

SEQ ID NO: 10852 - DNA, 25 bp, Mus musculus
gttcgcctctggaactgcggaggaa

SEQ ID NO: 10853 - DNA, 25 bp, Mus musculus
gcctctggaactgcggaggaaacag

SEQ ID NO: 10854 - DNA, 25 bp, Mus musculus
cctctggaactgcggaggaaacagg

SEQ ID NO: 10855 - DNA, 25 bp, Mus musculus
tggtgcccgaagctgtaggttcttg

SEQ ID NO: 10856 - DNA, 25 bp, Mus musculus
agattgttcctaacttgataaagcg

SEQ ID NO: 10857 - DNA, 25 bp, Mus musculus
ggtgcccgaagctgtaggttcttgc

SEQ ID NO: 10858 - DNA, 25 bp, Mus musculus
gtgcccgaagctgtaggttcttgca

SEQ ID NO: 10859 - DNA, 25 bp, Mus musculus
cccgaagctgtaggttcttgcacca

SEQ ID NO: 10860 - DNA, 25 bp, Mus musculus
agttccacctaggagaggcggagat

SEQ ID NO: 10861 - DNA, 25 bp, Mus musculus
tttcctaatcccttcctagactatg

SEQ ID NO: 10862 - DNA, 25 bp, Mus musculus
tcctaatcccttcctagactatgag

SEQ ID NO: 10863 - DNA, 25 bp, Mus musculus
ctaatcccttcctagactatgaggt

SEQ ID NO: 10864 - DNA, 25 bp, Mus musculus
ccatggcatcctgtgtcctagattt

SEQ ID NO: 10865 - DNA, 25 bp, Mus musculus
catcctgtgtcctagatttctcagc

SEQ ID NO: 10866 - DNA, 25 bp, Mus musculus
ttgtgttttgtccgcacacaggtgc

SEQ ID NO: 10867 - DNA, 25 bp, Mus musculus
tttgtccgcacacaggtgcctgccg

SEQ ID NO: 10868 - DNA, 25 bp, Mus musculus
gtttagaagctgcctcctggtctca

SEQ ID NO: 10869 - DNA, 25 bp, Mus musculus
aagctgcctcctggtctcatgctta

SEQ ID NO: 10870 - DNA, 25 bp, Mus musculus
atgcttaaatcttcaattctttact

SEQ ID NO: 10871 - DNA, 25 bp, Mus musculus
tcaattctttactgtccttgttcac

SEQ ID NO: 10872 - DNA, 25 bp, Mus musculus
tgtccttgttcactttagaaatgac

SEQ ID NO: 10873 - DNA, 25 bp, Mus musculus
aaatgacaaaccctagagctggact

SEQ ID NO: 10874 - DNA, 25 bp, Mus musculus
tgttgagcaggcctgtctctcttat

SEQ ID NO: 10875 - DNA, 25 bp, Mus musculus
gcaggcctgtctctcttattaagta

SEQ ID NO: 10876 - DNA, 25 bp, Mus musculus
tagatttctcagctcctcagtttct

SEQ ID NO: 10877 - DNA, 25 bp, Mus musculus
tctcagctcctcagtttctgctcaa

SEQ ID NO: 10878 - DNA, 25 bp, Mus musculus
ctcctcagtttctgctcaaaggtgc

SEQ ID NO: 10879 - DNA, 25 bp, Mus musculus
agtttctgctcaaaggtgctattta

SEQ ID NO: 10880 - DNA, 25 bp, Mus musculus
ctatttaccaaactctctgcctgcc

SEQ ID NO: 10881 - DNA, 25 bp, Mus musculus
ctctcttgctttaaccttaactctg

SEQ ID NO: 10882 - DNA, 25 bp, Mus musculus
gcctacaacaaagctgtgaattgtt

SEQ ID NO: 10883 - DNA, 25 bp, Mus musculus
tggttcttgtgttttgtccgcacac

SEQ ID NO: 10884 - DNA, 25 bp, Mus musculus
cccctcagtattcatgaggtgtagc

SEQ ID NO: 10885 - DNA, 25 bp, Mus musculus
cctctggacacagctgcttcgagcc

SEQ ID NO: 10886 - DNA, 25 bp, Mus musculus
tgtctggtgacacctgtttcacagc

SEQ ID NO: 10887 - DNA, 25 bp, Mus musculus
gtgacacctgtttcacagcagttta

SEQ ID NO: 10888 - DNA, 25 bp, Mus musculus
cctgtttcacagcagtttaactgtc

SEQ ID NO: 10889 - DNA, 25 bp, Mus musculus
aactgtctcagaagggaccatgaat

SEQ ID NO: 10890 - DNA, 25 bp, Mus musculus
taatggccatcacttgttaggggcc

SEQ ID NO: 10891 - DNA, 25 bp, Mus musculus
ccatcacttgttaggggccaagtgg

SEQ ID NO: 10892 - DNA, 25 bp, Mus musculus
ttcagcctggccaatgtgtctccca

SEQ ID NO: 10893 - DNA, 25 bp, Mus musculus
ctggccaatgtgtctcccagaacta

SEQ ID NO: 10894 - DNA, 25 bp, Mus musculus
gccaatgtgtctcccagaactattt

SEQ ID NO: 10895 - DNA, 25 bp, Mus musculus
aatgtgtctcccagaactattttgg

SEQ ID NO: 10896 - DNA, 25 bp, Mus musculus
gacacagctgcttcgagccatagaa

SEQ ID NO: 10897 - DNA, 25 bp, Mus musculus
gctgcttcgagccatagaactaaag

SEQ ID NO: 10898 - DNA, 25 bp, Mus musculus
catagaactaaagccaacccactgg

SEQ ID NO: 10899 - DNA, 25 bp, Mus musculus
gccaacccactggctgggaagcttg

SEQ ID NO: 10900 - DNA, 25 bp, Mus musculus
tacaacagactatgcaatagttccc

SEQ ID NO: 10901 - DNA, 25 bp, Mus musculus
cagctgtaaccatgcctcagcaggg

SEQ ID NO: 10902 - DNA, 25 bp, Mus musculus
tgcctcagcagggtggttactggac

SEQ ID NO: 10903 - DNA, 25 bp, Mus musculus
actggacacatgtccaggtgcccct

SEQ ID NO: 10904 - DNA, 25 bp, Mus musculus
tttaagaagtcttcagcccagactg

SEQ ID NO: 10905 - DNA, 25 bp, Mus musculus
aagtcttcagcccagactgctggct

SEQ ID NO: 10906 - DNA, 25 bp, Mus musculus
accttgaacaggctgccactcgctg

SEQ ID NO: 10907 - DNA, 25 bp, Mus musculus
aacaggctgccactcgctgaagccg

SEQ ID NO: 10908 - DNA, 25 bp, Mus musculus
agttcccttcttgattgccaagatg

SEQ ID NO: 10909 - DNA, 25 bp, Mus musculus
gattgccaagatgcctcaatgcaga

SEQ ID NO: 10910 - DNA, 25 bp, Mus musculus
caagatgcctcaatgcagactggag

SEQ ID NO: 10911 - DNA, 25 bp, Mus musculus
gcctcaatgcagactggagcccaga

SEQ ID NO: 10912 - DNA, 25 bp, Mus musculus
atgcagactggagcccagaccctgc

SEQ ID NO: 10913 - DNA, 25 bp, Mus musculus
cgtgttcagccaaaggtgaggacag

SEQ ID NO: 10914 - DNA, 25 bp, Mus musculus
tcctcagaacctcagctcttagtga

SEQ ID NO: 10915 - DNA, 25 bp, Mus musculus
gaacctcagctcttagtgagccact

SEQ ID NO: 10916 - DNA, 25 bp, Mus musculus
tcagcccagactgctggctcagaca

SEQ ID NO: 10917 - DNA, 25 bp, Mus musculus
cagactgctggctcagacaacaaga

SEQ ID NO: 10918 - DNA, 25 bp, Mus musculus
gcctctcagcaagtcctacaataca

SEQ ID NO: 10919 - DNA, 25 bp, Mus musculus
cagcaagtcctacaatacaactctg

SEQ ID NO: 10920 - DNA, 25 bp, Mus musculus
gtcctacaatacaactctgccaact

SEQ ID NO: 10921 - DNA, 25 bp, Mus musculus
cgcgggcctgccattcctaatggac

SEQ ID NO: 10922 - DNA, 25 bp, Mus musculus
cctgccattcctaatggacaatgta

SEQ ID NO: 10923 - DNA, 25 bp, Mus musculus
caatgtaccttgaacaggctgccac

SEQ ID NO: 10924 - DNA, 25 bp, Mus musculus
ccaccagtgcatgaggatgggcagg

SEQ ID NO: 10925 - DNA, 25 bp, Mus musculus
caccagcgcggagatggcccacact

SEQ ID NO: 10926 - DNA, 25 bp, Mus musculus
agggtctcgatgctggccgtcacac

SEQ ID NO: 10927 - DNA, 25 bp, Mus musculus
gtctcgatgctggccgtcacacata

SEQ ID NO: 10928 - DNA, 25 bp, Mus musculus
ctggccgtcacacatagcacgtcta

SEQ ID NO: 10929 - DNA, 25 bp, Mus musculus
gccgtcacacatagcacgtctaccg

SEQ ID NO: 10930 - DNA, 25 bp, Mus musculus
gtcacacatagcacgtctaccgaag

SEQ ID NO: 10931 - DNA, 25 bp, Mus musculus
acacatagcacgtctaccgaagtcc

SEQ ID NO: 10932 - DNA, 25 bp, Mus musculus
accgaagtccagagctcacagaaga

SEQ ID NO: 10933 - DNA, 25 bp, Mus musculus
gtccagagctcacagaagaaagagc

SEQ ID NO: 10934 - DNA, 25 bp, Mus musculus
cggacgggccacaacacaatggtgg

SEQ ID NO: 10935 - DNA, 25 bp, Mus musculus
ggccacaacacaatggtggacccga

SEQ ID NO: 10936 - DNA, 25 bp, Mus musculus
ggcccacactatgcacacgaggaga

SEQ ID NO: 10937 - DNA, 25 bp, Mus musculus
ccacactatgcacacgaggagaccg

SEQ ID NO: 10938 - DNA, 25 bp, Mus musculus
cactatgcacacgaggagaccgcga

SEQ ID NO: 10939 - DNA, 25 bp, Mus musculus
tatgcacacgaggagaccgcgatcg

SEQ ID NO: 10940 - DNA, 25 bp, Mus musculus
accgcgatcgcgcgcagtcgagcag

SEQ ID NO: 10941 - DNA, 25 bp, Mus musculus
taacggtccagggcgatgacacaca

SEQ ID NO: 10942 - DNA, 25 bp, Mus musculus
atgacacacagggtctcgatgctgg

SEQ ID NO: 10943 - DNA, 25 bp, Mus musculus
cacagggtctcgatgctggccgtca

SEQ ID NO: 10944 - DNA, 25 bp, Mus musculus
taccgaatgccatgcccggagacat

SEQ ID NO: 10945 - DNA, 25 bp, Mus musculus
atgccatgcccggagacatgtccac

SEQ ID NO: 10946 - DNA, 25 bp, Mus musculus
gcctccttctggactctgactttgg

SEQ ID NO: 10947 - DNA, 25 bp, Mus musculus
tatgttcacacttagctcttcttcc

SEQ ID NO: 10948 - DNA, 25 bp, Mus musculus
tagctcttcttccaggtaggttgca

SEQ ID NO: 10949 - DNA, 25 bp, Mus musculus
ttcttccaggtaggttgcagaatca

SEQ ID NO: 10950 - DNA, 25 bp, Mus musculus
tgcttctcaagtgagggagccagga

SEQ ID NO: 10951 - DNA, 25 bp, Mus musculus
agatggcttcatggtgaggcatgag

SEQ ID NO: 10952 - DNA, 25 bp, Mus musculus
gcatgagctctcaaggcacaacctc

SEQ ID NO: 10953 - DNA, 25 bp, Mus musculus
gctctcaaggcacaacctcggtcca

SEQ ID NO: 10954 - DNA, 25 bp, Mus musculus
cggtccacctttcactggctgtgtg

SEQ ID NO: 10955 - DNA, 25 bp, Mus musculus
ctgtgtgcctttggccaagttactt

SEQ ID NO: 10956 - DNA, 25 bp, Mus musculus
tgcccggagacatgtccaccggagt

SEQ ID NO: 10957 - DNA, 25 bp, Mus musculus
gagacatgtccaccggagttgtaca

SEQ ID NO: 10958 - DNA, 25 bp, Mus musculus
aatgatatcatcactgagtgctggc

SEQ ID NO: 10959 - DNA, 25 bp, Mus musculus
acctttgagttcctgcagtcggtgt

SEQ ID NO: 10960 - DNA, 25 bp, Mus musculus
ctgcagtcggtgttggaggacttct

SEQ ID NO: 10961 - DNA, 25 bp, Mus musculus
tacacagccacggagggccaatatg

SEQ ID NO: 10962 - DNA, 25 bp, Mus musculus
cagccctagcaaccaatggtctctt

SEQ ID NO: 10963 - DNA, 25 bp, Mus musculus
tagcaaccaatggtctcttcagggc

SEQ ID NO: 10964 - DNA, 25 bp, Mus musculus
cagctgcgctgcaaagcgtggagcg

SEQ ID NO: 10965 - DNA, 25 bp, Mus musculus
tatacatcgcaagattgagaggaag

SEQ ID NO: 10966 - DNA, 25 bp, Mus musculus
attgttgctgctgataactgcttta

SEQ ID NO: 10967 - DNA, 25 bp, Mus musculus
ttgctgctgataactgctttaccaa

SEQ ID NO: 10968 - DNA, 25 bp, Mus musculus
tgctgataactgctttaccaagtca

SEQ ID NO: 10969 - DNA, 25 bp, Mus musculus
ctgataactgctttaccaagtcata

SEQ ID NO: 10970 - DNA, 25 bp, Mus musculus
taactgctttaccaagtcatacaat

SEQ ID NO: 10971 - DNA, 25 bp, Mus musculus
actgctttaccaagtcatacaatga

SEQ ID NO: 10972 - DNA, 25 bp, Mus musculus
tgctttaccaagtcatacaatgagt

SEQ ID NO: 10973 - DNA, 25 bp, Mus musculus
ctttaccaagtcatacaatgagtgt

SEQ ID NO: 10974 - DNA, 25 bp, Mus musculus
accaagtcatacaatgagtgtttgg

SEQ ID NO: 10975 - DNA, 25 bp, Mus musculus
attttcatcttggaaaattgatcaa

SEQ ID NO: 10976 - DNA, 25 bp, Mus musculus
tacatcgcaagattgagaggaagaa

SEQ ID NO: 10977 - DNA, 25 bp, Mus musculus
agtcatgggccatgtggtcaagata

SEQ ID NO: 10978 - DNA, 25 bp, Mus musculus
tcatgggccatgtggtcaagatact

SEQ ID NO: 10979 - DNA, 25 bp, Mus musculus
tggtcaagatacttctctgggaatt

SEQ ID NO: 10980 - DNA, 25 bp, Mus musculus
gtcaagatacttctctgggaattgt

SEQ ID NO: 10981 - DNA, 25 bp, Mus musculus
atacttctctgggaattgttgctgc

SEQ ID NO: 10982 - DNA, 25 bp, Mus musculus
acttctctgggaattgttgctgctg

SEQ ID NO: 10983 - DNA, 25 bp, Mus musculus
ttctctgggaattgttgctgctgat

SEQ ID NO: 10984 - DNA, 25 bp, Mus musculus
tgtgcaataactctgttctccttct

SEQ ID NO: 10985 - DNA, 25 bp, Mus musculus
gcaataactctgttctccttctctc

SEQ ID NO: 10986 - DNA, 25 bp, Mus musculus
ccccgagataacatcctgattgaat

SEQ ID NO: 10987 - DNA, 25 bp, Mus musculus
cccagtttccactggactcgcaaca

SEQ ID NO: 10988 - DNA, 25 bp, Mus musculus
agtttccactggactcgcaacagca

SEQ ID NO: 10989 - DNA, 25 bp, Mus musculus
tggactcgcaacagcaggttcttca

SEQ ID NO: 10990 - DNA, 25 bp, Mus musculus
actcgcaacagcaggttcttcaaca

SEQ ID NO: 10991 - DNA, 25 bp, Mus musculus
cgcaacagcaggttcttcaacattg

SEQ ID NO: 10992 - DNA, 25 bp, Mus musculus
agcaggttcttcaacattgccaagg

SEQ ID NO: 10993 - DNA, 25 bp, Mus musculus
ttcttcaacattgccaaggacccac

SEQ ID NO: 10994 - DNA, 25 bp, Mus musculus
gccaaggacccacgggtgtccatga

SEQ ID NO: 10995 - DNA, 25 bp, Mus musculus
gacccacgggtgtccatgaggagga

SEQ ID NO: 10996 - DNA, 25 bp, Mus musculus
aatgctaacccactggaactaacag

SEQ ID NO: 10997 - DNA, 25 bp, Mus musculus
aggtctgggaccttggtgatcgact

SEQ ID NO: 10998 - DNA, 25 bp, Mus musculus
gctaacccactggaactaacagcaa

SEQ ID NO: 10999 - DNA, 25 bp, Mus musculus
aacccactggaactaacagcaagca

SEQ ID NO: 11000 - DNA, 25 bp, Mus musculus
ctaacagcaagcattcagaatgagc

SEQ ID NO: 11001 - DNA, 25 bp, Mus musculus
ccaacgatcaccaagcagtcggtga

SEQ ID NO: 11002 - DNA, 25 bp, Mus musculus
atcaccaagcagtcggtgaaggacc

SEQ ID NO: 11003 - DNA, 25 bp, Mus musculus
cacatcgtggacccccgagataaca

SEQ ID NO: 11004 - DNA, 25 bp, Mus musculus
gtggacccccgagataacatcctga

SEQ ID NO: 11005 - DNA, 25 bp, Mus musculus
ttctctctagcttaattatgttgac

SEQ ID NO: 11006 - DNA, 25 bp, Mus musculus
tctctagcttaattatgttgacacc

SEQ ID NO: 11007 - DNA, 25 bp, Mus musculus
tacgcgtccactgaagtgaggctga

SEQ ID NO: 11008 - DNA, 25 bp, Mus musculus
accattgagttttcttgtagcatga

SEQ ID NO: 11009 - DNA, 25 bp, Mus musculus
ttttcttgtagcatgacccccttat

SEQ ID NO: 11010 - DNA, 25 bp, Mus musculus
tcttgtagcatgacccccttataaa

SEQ ID NO: 11011 - DNA, 25 bp, Mus musculus
tgtagcatgacccccttataaacac

SEQ ID NO: 11012 - DNA, 25 bp, Mus musculus
ttaaaaccatattcctgagccagta

SEQ ID NO: 11013 - DNA, 25 bp, Mus musculus
aaaccatattcctgagccagtaatc

SEQ ID NO: 11014 - DNA, 25 bp, Mus musculus
ccatattcctgagccagtaatcagc

SEQ ID NO: 11015 - DNA, 25 bp, Mus musculus
tcctgagccagtaatcagcaatttt

SEQ ID NO: 11016 - DNA, 25 bp, Mus musculus
tatcttgtctttgggaattaggatt

SEQ ID NO: 11017 - DNA, 25 bp, Mus musculus
taattatgttgacacctcagcctcc

SEQ ID NO: 11018 - DNA, 25 bp, Mus musculus
ttatgttgacacctcagcctccact

SEQ ID NO: 11019 - DNA, 25 bp, Mus musculus
ctcagcctccacttctgcttgatat

SEQ ID NO: 11020 - DNA, 25 bp, Mus musculus
agcctccacttctgcttgatatacg

SEQ ID NO: 11021 - DNA, 25 bp, Mus musculus
cacttctgcttgatatacgcgtcca

SEQ ID NO: 11022 - DNA, 25 bp, Mus musculus
ttctgcttgatatacgcgtccactg

SEQ ID NO: 11023 - DNA, 25 bp, Mus musculus
tgcttgatatacgcgtccactgaag

SEQ ID NO: 11024 - DNA, 25 bp, Mus musculus
atatacgcgtccactgaagtgaggc

SEQ ID NO: 11025 - DNA, 25 bp, Mus musculus
cacacaagtgtatatcctttcacac

SEQ ID NO: 11026 - DNA, 25 bp, Mus musculus
ttcacacgtacatcagaatgttaat

SEQ ID NO: 11027 - DNA, 25 bp, Mus musculus
ctgataacgccctctggtatcacag

SEQ ID NO: 11028 - DNA, 25 bp, Mus musculus
atcacagtgatcacctctagacagc

SEQ ID NO: 11029 - DNA, 25 bp, Mus musculus
gtgatcacctctagacagcccctac

SEQ ID NO: 11030 - DNA, 25 bp, Mus musculus
ctcctctcagtttcctcatccaggt

SEQ ID NO: 11031 - DNA, 25 bp, Mus musculus
ctcagcctctttaatgcacgctgaa

SEQ ID NO: 11032 - DNA, 25 bp, Mus musculus
ctctttaatgcacgctgaaggtcca

SEQ ID NO: 11033 - DNA, 25 bp, Mus musculus
aatgcacgctgaaggtccaggcaca

SEQ ID NO: 11034 - DNA, 25 bp, Mus musculus
aggtccaggcacacctcaagtcctg

SEQ ID NO: 11035 - DNA, 25 bp, Mus musculus
aggcacacctcaagtcctgtgcttg

SEQ ID NO: 11036 - DNA, 25 bp, Mus musculus
acctcaagtcctgtgcttgagcaat

SEQ ID NO: 11037 - DNA, 25 bp, Mus musculus
ttgctccctctgttagctccatttt

SEQ ID NO: 11038 - DNA, 25 bp, Mus musculus
ttagctccattttcacgtggtagaa

SEQ ID NO: 11039 - DNA, 25 bp, Mus musculus
tgtggttttccaagcctgtgtctcc

SEQ ID NO: 11040 - DNA, 25 bp, Mus musculus
agcctgtgtctccgtgcaggtgcta

SEQ ID NO: 11041 - DNA, 25 bp, Mus musculus
atgggtacaccgctgttgcatccat

SEQ ID NO: 11042 - DNA, 25 bp, Mus musculus
ctgttgcatccattgcctctcttac

SEQ ID NO: 11043 - DNA, 25 bp, Mus musculus
tctcctgagttggtattcctgataa

SEQ ID NO: 11044 - DNA, 25 bp, Mus musculus
gtattcctgataacgccctctggta

SEQ ID NO: 11045 - DNA, 25 bp, Mus musculus
atttacctgtgacaggtacttcaca

SEQ ID NO: 11046 - DNA, 25 bp, Mus musculus
atgaaggtctggctttggaataaat

SEQ ID NO: 11047 - DNA, 25 bp, Mus musculus
tatagttacacagggccacagggcc

SEQ ID NO: 11048 - DNA, 25 bp, Mus musculus
gtatctggccgaatcacagcaccat

SEQ ID NO: 11049 - DNA, 25 bp, Mus musculus
ggccgaatcacagcaccataaaatc

SEQ ID NO: 11050 - DNA, 25 bp, Mus musculus
atcacagcaccataaaatccttgag

SEQ ID NO: 11051 - DNA, 25 bp, Mus musculus
gcaccataaaatccttgagatcatg

SEQ ID NO: 11052 - DNA, 25 bp, Mus musculus
cactcctcaactcttgggacatatc

SEQ ID NO: 11053 - DNA, 25 bp, Mus musculus
tcaactcttgggacatatcccttgt

SEQ ID NO: 11054 - DNA, 25 bp, Mus musculus
cttgggacatatcccttgtatacag

SEQ ID NO: 11055 - DNA, 25 bp, Mus musculus
acatatcccttgtatacagtgtaaa

SEQ ID NO: 11056 - DNA, 25 bp, Mus musculus
actctatagatggttgggagaactg

SEQ ID NO: 11057 - DNA, 25 bp, Mus musculus
gccctcctggtccactatgttgtac

SEQ ID NO: 11058 - DNA, 25 bp, Mus musculus
ctggtccactatgttgtacactgaa

SEQ ID NO: 11059 - DNA, 25 bp, Mus musculus
gttgtacactgaaccacaagatcat

SEQ ID NO: 11060 - DNA, 25 bp, Mus musculus
cactgaaccacaagatcatgtctca

SEQ ID NO: 11061 - DNA, 25 bp, Mus musculus
accacaagatcatgtctcaacagca

SEQ ID NO: 11062 - DNA, 25 bp, Mus musculus
agatcatgtctcaacagcaaaaaat

SEQ ID NO: 11063 - DNA, 25 bp, Mus musculus
tacaacttgatctttcaggagtgaa

SEQ ID NO: 11064 - DNA, 25 bp, Mus musculus
aagtttgcactggggacaagaatgt

SEQ ID NO: 11065 - DNA, 25 bp, Mus musculus
aagacttcagcaggctgtaaacatg

SEQ ID NO: 11066 - DNA, 25 bp, Mus musculus
attcattaacatgcccagtgtgcag

SEQ ID NO: 11067 - DNA, 25 bp, Mus musculus
ttacatcaacatcaaccgactttat

SEQ ID NO: 11068 - DNA, 25 bp, Mus musculus
caaccgactttatagcgcctgccag

SEQ ID NO: 11069 - DNA, 25 bp, Mus musculus
tagcgcctgccaggatgaagcttga

SEQ ID NO: 11070 - DNA, 25 bp, Mus musculus
agcttgacatctacatgtgtcttct

SEQ ID NO: 11071 - DNA, 25 bp, Mus musculus
acatctacatgtgtcttctgtcttc

SEQ ID NO: 11072 - DNA, 25 bp, Mus musculus
tgtcttcttacttaaacacagataa

SEQ ID NO: 11073 - DNA, 25 bp, Mus musculus
cttacttaaacacagataatcactt

SEQ ID NO: 11074 - DNA, 25 bp, Mus musculus
taaacacagataatcacttctttca

SEQ ID NO: 11075 - DNA, 25 bp, Mus musculus
cagataatcacttctttcaataaag

SEQ ID NO: 11076 - DNA, 25 bp, Mus musculus
atcacttctttcaataaagaactca

SEQ ID NO: 11077 - DNA, 25 bp, Mus musculus
tcacatcccaaatgacaaggcttct

SEQ ID NO: 11078 - DNA, 25 bp, Mus musculus
tgacaaggcttctttccttcctaga

SEQ ID NO: 11079 - DNA, 25 bp, Mus musculus
ggcttctttccttcctagattcata

SEQ ID NO: 11080 - DNA, 25 bp, Mus musculus
attcatacattaatatctttcagaa

SEQ ID NO: 11081 - DNA, 25 bp, Mus musculus
atatctttcagaacagccatttaaa

SEQ ID NO: 11082 - DNA, 25 bp, Mus musculus
gttgcaccatatcaggtcattcacc

SEQ ID NO: 11083 - DNA, 25 bp, Mus musculus
ccatatcaggtcattcacctctgga

SEQ ID NO: 11084 - DNA, 25 bp, Mus musculus
tcctaaattaacctgcaatggaaga

SEQ ID NO: 11085 - DNA, 25 bp, Mus musculus
tgactccaggatatgtgcccactga

SEQ ID NO: 11086 - DNA, 25 bp, Mus musculus
caggatatgtgcccactgagcagga

SEQ ID NO: 11087 - DNA, 25 bp, Mus musculus
tcgccacaacgtctatcgtgctctt

SEQ ID NO: 11088 - DNA, 25 bp, Mus musculus
caacgtctatcgtgctcttcctcaa

SEQ ID NO: 11089 - DNA, 25 bp, Mus musculus
tcagcatctgcttccccgactacga

SEQ ID NO: 11090 - DNA, 25 bp, Mus musculus
actacatcaaagtgcagttcctgga

SEQ ID NO: 11091 - DNA, 25 bp, Mus musculus
tcaaagtgcagttcctggagcttaa

SEQ ID NO: 11092 - DNA, 25 bp, Mus musculus
tgcagttcctggagcttaacatgcg

SEQ ID NO: 11093 - DNA, 25 bp, Mus musculus
agcttaacatgcgacgtgatgtgaa

SEQ ID NO: 11094 - DNA, 25 bp, Mus musculus
acatgcgacgtgatgtgaaggagat

SEQ ID NO: 11095 - DNA, 25 bp, Mus musculus
tctattcccacatgacgtgcgctac

SEQ ID NO: 11096 - DNA, 25 bp, Mus musculus
tcaccgacattatcatcaaggagaa

SEQ ID NO: 11097 - DNA, 25 bp, Mus musculus
ccactgagcaggacgtgttgcgttc

SEQ ID NO: 11098 - DNA, 25 bp, Mus musculus
cctcaaagactgcgggctcttctga

SEQ ID NO: 11099 - DNA, 25 bp, Mus musculus
tcgagactcaattctccttcaagga

SEQ ID NO: 11100 - DNA, 25 bp, Mus musculus
actgctttgagggtgtgacgtgcat

SEQ ID NO: 11101 - DNA, 25 bp, Mus musculus
cgtgcatcattttcatcgctgcgct

SEQ ID NO: 11102 - DNA, 25 bp, Mus musculus
tcattttcatcgctgcgctgagcgc

SEQ ID NO: 11103 - DNA, 25 bp, Mus musculus
tgcacgagagccttcacctgttcaa

SEQ ID NO: 11104 - DNA, 25 bp, Mus musculus
agagccttcacctgttcaacagcat

SEQ ID NO: 11105 - DNA, 25 bp, Mus musculus
tctgcaatcatcgctacttcgccac

SEQ ID NO: 11106 - DNA, 25 bp, Mus musculus
acgagcgcctggccggtgatcttct

SEQ ID NO: 11107 - DNA, 25 bp, Mus musculus
ccggtgatcttctagagtggatccg

SEQ ID NO: 11108 - DNA, 25 bp, Mus musculus
ttccgagactataggcgtgtgcaca

SEQ ID NO: 11109 - DNA, 25 bp, Mus musculus
accctgcagaccaagctgcggctga

SEQ ID NO: 11110 - DNA, 25 bp, Mus musculus
cagaccaagctgcggctgagcaacc

SEQ ID NO: 11111 - DNA, 25 bp, Mus musculus
accaagctgcggctgagcaacctgg

SEQ ID NO: 11112 - DNA, 25 bp, Mus musculus
aagctgcggctgagcaacctggctg

SEQ ID NO: 11113 - DNA, 25 bp, Mus musculus
cggctgagcaacctggctgccttca

SEQ ID NO: 11114 - DNA, 25 bp, Mus musculus
ctgagcaacctggctgccttcatgc

SEQ ID NO: 11115 - DNA, 25 bp, Mus musculus
agcaacctggctgccttcatgccct

SEQ ID NO: 11116 - DNA, 25 bp, Mus musculus
gctgccttcatgccctccgagggca

SEQ ID NO: 11117 - DNA, 25 bp, Mus musculus
actggtctcggacatcaacaatggg

SEQ ID NO: 11118 - DNA, 25 bp, Mus musculus
ttctagagtggatccggcgcaccat

SEQ ID NO: 11119 - DNA, 25 bp, Mus musculus
ctcggacatcaacaatgggtggcaa

SEQ ID NO: 11120 - DNA, 25 bp, Mus musculus
aagaccgtgtgcctcagaagaccat

SEQ ID NO: 11121 - DNA, 25 bp, Mus musculus
accgtgtgcctcagaagaccatcca

SEQ ID NO: 11122 - DNA, 25 bp, Mus musculus
gtgtgcctcagaagaccatccagga

SEQ ID NO: 11123 - DNA, 25 bp, Mus musculus
ctcagaagaccatccaggagatgca

SEQ ID NO: 11124 - DNA, 25 bp, Mus musculus
agctggcaggacttccgagactata

SEQ ID NO: 11125 - DNA, 25 bp, Mus musculus
caggacttccgagactataggcgtg

SEQ ID NO: 11126 - DNA, 25 bp, Mus musculus
gacttccgagactataggcgtgtgc

SEQ ID NO: 11127 - DNA, 25 bp, Mus musculus
agaacctgcaaggatgctgtcccgt

SEQ ID NO: 11128 - DNA, 25 bp, Mus musculus
aacctgcaaggatgctgtcccgtgc

SEQ ID NO: 11129 - DNA, 25 bp, Mus musculus
cgacgatgtccctccattctcgacg

SEQ ID NO: 11130 - DNA, 25 bp, Mus musculus
cattctcgacgagccgatccctcga

SEQ ID NO: 11131 - DNA, 25 bp, Mus musculus
attctcgacgagccgatccctcgag

SEQ ID NO: 11132 - DNA, 25 bp, Mus musculus
tctcgacgagccgatccctcgagct

SEQ ID NO: 11133 - DNA, 25 bp, Mus musculus
ctcgacgagccgatccctcgagctg

SEQ ID NO: 11134 - DNA, 25 bp, Mus musculus
acgagccgatccctcgagctgatac

SEQ ID NO: 11135 - DNA, 25 bp, Mus musculus
cgagccgatccctcgagctgatact

SEQ ID NO: 11136 - DNA, 25 bp, Mus musculus
gccgatccctcgagctgatacttcc

SEQ ID NO: 11137 - DNA, 25 bp, Mus musculus
ccgatccctcgagctgatacttccg

SEQ ID NO: 11138 - DNA, 25 bp, Mus musculus
cgatccctcgagctgatacttccgt

SEQ ID NO: 11139 - DNA, 25 bp, Mus musculus
tgcaaggatgctgtcccgtgcgatc

SEQ ID NO: 11140 - DNA, 25 bp, Mus musculus
aggatgctgtcccgtgcgatcgccg

SEQ ID NO: 11141 - DNA, 25 bp, Mus musculus
gtacaagaaatctcatccctctaac

SEQ ID NO: 11142 - DNA, 25 bp, Mus musculus
gacctcagaagactggcactgcgac

SEQ ID NO: 11143 - DNA, 25 bp, Mus musculus
ctcagaagactggcactgcgacgat

SEQ ID NO: 11144 - DNA, 25 bp, Mus musculus
tggcactgcgacgatgtccctccat

SEQ ID NO: 11145 - DNA, 25 bp, Mus musculus
ggcactgcgacgatgtccctccatt

SEQ ID NO: 11146 - DNA, 25 bp, Mus musculus
gcactgcgacgatgtccctccattc

SEQ ID NO: 11147 - DNA, 25 bp, Mus musculus
tctggtctctgagaagcagtcagag

SEQ ID NO: 11148 - DNA, 25 bp, Mus musculus
ccaggcccttgccagtaggttagtg

SEQ ID NO: 11149 - DNA, 25 bp, Mus musculus
ttctccttgagaaacaatgacaaga

SEQ ID NO: 11150 - DNA, 25 bp, Mus musculus
ctcttattttcttctacagttgcaa

SEQ ID NO: 11151 - DNA, 25 bp, Mus musculus
tcttctacagttgcaaagcccagaa

SEQ ID NO: 11152 - DNA, 25 bp, Mus musculus
tctacagttgcaaagcccagaagaa

SEQ ID NO: 11153 - DNA, 25 bp, Mus musculus
acagttgcaaagcccagaagaaaga

SEQ ID NO: 11154 - DNA, 25 bp, Mus musculus
aagatgtcaccaacagacttctgac

SEQ ID NO: 11155 - DNA, 25 bp, Mus musculus
atgtcaccaacagacttctgactgc

SEQ ID NO: 11156 - DNA, 25 bp, Mus musculus
tcaccaacagacttctgactgcatg

SEQ ID NO: 11157 - DNA, 25 bp, Mus musculus
gacttctgactgcatggtgaacttt

SEQ ID NO: 11158 - DNA, 25 bp, Mus musculus
ttctgactgcatggtgaactttcat

SEQ ID NO: 11159 - DNA, 25 bp, Mus musculus
ccttgccagtaggttagtgaggttg

SEQ ID NO: 11160 - DNA, 25 bp, Mus musculus
ttatggacactctccaaatcataaa

SEQ ID NO: 11161 - DNA, 25 bp, Mus musculus
ctctccaaatcataaatactctaac

SEQ ID NO: 11162 - DNA, 25 bp, Mus musculus
tccaaatcataaatactctaacagc

SEQ ID NO: 11163 - DNA, 25 bp, Mus musculus
tcataaatactctaacagctaagga

SEQ ID NO: 11164 - DNA, 25 bp, Mus musculus
atactctaacagctaaggatctctg

SEQ ID NO: 11165 - DNA, 25 bp, Mus musculus
taacagctaaggatctctgagggaa

SEQ ID NO: 11166 - DNA, 25 bp, Mus musculus
cagctaaggatctctgagggaaaca

SEQ ID NO: 11167 - DNA, 25 bp, Mus musculus
agccctatgcatgtgactcatcgcg

SEQ ID NO: 11168 - DNA, 25 bp, Mus musculus
ccctatgcatgtgactcatcgcggt

SEQ ID NO: 11169 - DNA, 25 bp, Mus musculus
aatacatacctggagagaagcccta

SEQ ID NO: 11170 - DNA, 25 bp, Mus musculus
gagagaagccctatgacgtgtggtt

SEQ ID NO: 11171 - DNA, 25 bp, Mus musculus
gagaagccctatgacgtgtggttgg

SEQ ID NO: 11172 - DNA, 25 bp, Mus musculus
agccctatgacgtgtggttggtgtg

SEQ ID NO: 11173 - DNA, 25 bp, Mus musculus
taaagcctttatacgttgtagtcat

SEQ ID NO: 11174 - DNA, 25 bp, Mus musculus
gcctttatacgttgtagtcatctcc

SEQ ID NO: 11175 - DNA, 25 bp, Mus musculus
atacgttgtagtcatctccaagtac

SEQ ID NO: 11176 - DNA, 25 bp, Mus musculus
gttgtagtcatctccaagtacataa

SEQ ID NO: 11177 - DNA, 25 bp, Mus musculus
tgtagtcatctccaagtacataaga

SEQ ID NO: 11178 - DNA, 25 bp, Mus musculus
atgtatgtgatcggtgtggtaaaga

SEQ ID NO: 11179 - DNA, 25 bp, Mus musculus
gtgactcatcgcggtaaagcctttg

SEQ ID NO: 11180 - DNA, 25 bp, Mus musculus
ctcatcgcggtaaagcctttgcatc

SEQ ID NO: 11181 - DNA, 25 bp, Mus musculus
taaagcctttgcatctcatagttat

SEQ ID NO: 11182 - DNA, 25 bp, Mus musculus
aagcctttgcatctcatagttatct

SEQ ID NO: 11183 - DNA, 25 bp, Mus musculus
gcctttgcatctcatagttatctcc

SEQ ID NO: 11184 - DNA, 25 bp, Mus musculus
ctttgcatctcatagttatctccaa

SEQ ID NO: 11185 - DNA, 25 bp, Mus musculus
gcatctcatagttatctccaagtac

SEQ ID NO: 11186 - DNA, 25 bp, Mus musculus
atctcatagttatctccaagtacat

SEQ ID NO: 11187 - DNA, 25 bp, Mus musculus
agtgggtcttctcgcatcttccgct

SEQ ID NO: 11188 - DNA, 25 bp, Mus musculus
gggtcttctcgcatcttccgctttg

SEQ ID NO: 11189 - DNA, 25 bp, Mus musculus
cgagtacgcttcaggctcgcacaag

SEQ ID NO: 11190 - DNA, 25 bp, Mus musculus
agtacgcttcaggctcgcacaagtg

SEQ ID NO: 11191 - DNA, 25 bp, Mus musculus
gtacgcttcaggctcgcacaagtgt

SEQ ID NO: 11192 - DNA, 25 bp, Mus musculus
acgcttcaggctcgcacaagtgtac

SEQ ID NO: 11193 - DNA, 25 bp, Mus musculus
gcttcaggctcgcacaagtgtactt

SEQ ID NO: 11194 - DNA, 25 bp, Mus musculus
cttcaggctcgcacaagtgtacttt

SEQ ID NO: 11195 - DNA, 25 bp, Mus musculus
ttcaggctcgcacaagtgtactttc

SEQ ID NO: 11196 - DNA, 25 bp, Mus musculus
tcaggctcgcacaagtgtactttcg

SEQ ID NO: 11197 - DNA, 25 bp, Mus musculus
caggctcgcacaagtgtactttcga

SEQ ID NO: 11198 - DNA, 25 bp, Mus musculus
tcgcacaagtgtactttcgatgaac

SEQ ID NO: 11199 - DNA, 25 bp, Mus musculus
gtcttctcgcatcttccgctttgct

SEQ ID NO: 11200 - DNA, 25 bp, Mus musculus
cgcacaagtgtactttcgatgaacc

SEQ ID NO: 11201 - DNA, 25 bp, Mus musculus
tcttctcgcatcttccgctttgcta

SEQ ID NO: 11202 - DNA, 25 bp, Mus musculus
ttctcgcatcttccgctttgctacg

SEQ ID NO: 11203 - DNA, 25 bp, Mus musculus
tctcgcatcttccgctttgctacgt

SEQ ID NO: 11204 - DNA, 25 bp, Mus musculus
tgaattcgagtacgcttcaggctcg

SEQ ID NO: 11205 - DNA, 25 bp, Mus musculus
gaattcgagtacgcttcaggctcgc

SEQ ID NO: 11206 - DNA, 25 bp, Mus musculus
attcgagtacgcttcaggctcgcac

SEQ ID NO: 11207 - DNA, 25 bp, Mus musculus
tcgagtacgcttcaggctcgcacaa

SEQ ID NO: 11208 - DNA, 25 bp, Mus musculus
caatctgccttctccaggtggttcc

SEQ ID NO: 11209 - DNA, 25 bp, Mus musculus
tctctggccaaggagatccagtatc

SEQ ID NO: 11210 - DNA, 25 bp, Mus musculus
tgctttgtgcttgtacatagtcttg

SEQ ID NO: 11211 - DNA, 25 bp, Mus musculus
ttgtacatagtcttgtgttgctgtg

SEQ ID NO: 11212 - DNA, 25 bp, Mus musculus
acatagtcttgtgttgctgtgtttg

SEQ ID NO: 11213 - DNA, 25 bp, Mus musculus
catagtcttgtgttgctgtgtttgc

SEQ ID NO: 11214 - DNA, 25 bp, Mus musculus
tgtgttgctgtgtttgctgtaataa

SEQ ID NO: 11215 - DNA, 25 bp, Mus musculus
gtgttgctgtgtttgctgtaataaa

SEQ ID NO: 11216 - DNA, 25 bp, Mus musculus
tgttgctgtgtttgctgtaataaat

SEQ ID NO: 11217 - DNA, 25 bp, Mus musculus
ctctggccaaggagatccagtatct

SEQ ID NO: 11218 - DNA, 25 bp, Mus musculus
tctggccaaggagatccagtatctg

SEQ ID NO: 11219 - DNA, 25 bp, Mus musculus
tagtcaggtgctttgtgcttgtaca

SEQ ID NO: 11220 - DNA, 25 bp, Mus musculus
agtcaggtgctttgtgcttgtacat

SEQ ID NO: 11221 - DNA, 25 bp, Mus musculus
gtcaggtgctttgtgcttgtacata

SEQ ID NO: 11222 - DNA, 25 bp, Mus musculus
tcaggtgctttgtgcttgtacatag

SEQ ID NO: 11223 - DNA, 25 bp, Mus musculus
aggtgctttgtgcttgtacatagtc

SEQ ID NO: 11224 - DNA, 25 bp, Mus musculus
gtgctttgtgcttgtacatagtctt

SEQ ID NO: 11225 - DNA, 25 bp, Mus musculus
tgtcccatcgagtctcgggagactg

SEQ ID NO: 11226 - DNA, 25 bp, Mus musculus
tcccatcgagtctcgggagactgag

SEQ ID NO: 11227 - DNA, 25 bp, Mus musculus
cctggccaagtacaatcagatcctt

SEQ ID NO: 11228 - DNA, 25 bp, Mus musculus
cagcaaagccaagtttgccggcagt

SEQ ID NO: 11229 - DNA, 25 bp, Mus musculus
agcaaagccaagtttgccggcagtc

SEQ ID NO: 11230 - DNA, 25 bp, Mus musculus
gcaaagccaagtttgccggcagtcc

SEQ ID NO: 11231 - DNA, 25 bp, Mus musculus
caaagccaagtttgccggcagtcct

SEQ ID NO: 11232 - DNA, 25 bp, Mus musculus
agccaagtttgccggcagtccttca

SEQ ID NO: 11233 - DNA, 25 bp, Mus musculus
ccaagtttgccggcagtccttcagg

SEQ ID NO: 11234 - DNA, 25 bp, Mus musculus
caagtttgccggcagtccttcagga

SEQ ID NO: 11235 - DNA, 25 bp, Mus musculus
gaaccccctggccaagtaaggcatg

SEQ ID NO: 11236 - DNA, 25 bp, Mus musculus
ccctggccaagtaaggcatggaccg

SEQ ID NO: 11237 - DNA, 25 bp, Mus musculus
tcgagtctcgggagactgaggacac

SEQ ID NO: 11238 - DNA, 25 bp, Mus musculus
cctgccgatctgagcgcctggccaa

SEQ ID NO: 11239 - DNA, 25 bp, Mus musculus
ctgccgatctgagcgcctggccaag

SEQ ID NO: 11240 - DNA, 25 bp, Mus musculus
cgatctgagcgcctggccaagtaca

SEQ ID NO: 11241 - DNA, 25 bp, Mus musculus
tgagcgcctggccaagtacaatcag

SEQ ID NO: 11242 - DNA, 25 bp, Mus musculus
agcgcctggccaagtacaatcagat

SEQ ID NO: 11243 - DNA, 25 bp, Mus musculus
gcgcctggccaagtacaatcagatc

SEQ ID NO: 11244 - DNA, 25 bp, Mus musculus
cgcctggccaagtacaatcagatcc

SEQ ID NO: 11245 - DNA, 25 bp, Mus musculus
gatgaccttcagcgagtatccctat

SEQ ID NO: 11246 - DNA, 25 bp, Mus musculus
cttcagcgagtatccctataacaac

SEQ ID NO: 11247 - DNA, 25 bp, Mus musculus
ccccacgtggcctgccaagagtgag

SEQ ID NO: 11248 - DNA, 25 bp, Mus musculus
aggcacgagtccacggcctcctgag

SEQ ID NO: 11249 - DNA, 25 bp, Mus musculus
ctacagccagctgggtgatgatgac

SEQ ID NO: 11250 - DNA, 25 bp, Mus musculus
agcctcagctgcaggccctggcttc

SEQ ID NO: 11251 - DNA, 25 bp, Mus musculus
cagcctcaagttctgaggtcggctt

SEQ ID NO: 11252 - DNA, 25 bp, Mus musculus
caagttctgaggtcggcttgatgga

SEQ ID NO: 11253 - DNA, 25 bp, Mus musculus
acgtggcccgactaggtggtgacag

SEQ ID NO: 11254 - DNA, 25 bp, Mus musculus
gtgacagccagacctgctgatgctg

SEQ ID NO: 11255 - DNA, 25 bp, Mus musculus
gccagacctgctgatgctgaatcag

SEQ ID NO: 11256 - DNA, 25 bp, Mus musculus
cctgctgatgctgaatcagggcaac

SEQ ID NO: 11257 - DNA, 25 bp, Mus musculus
tccctataacaacctccgcaagaga

SEQ ID NO: 11258 - DNA, 25 bp, Mus musculus
taacaacctccgcaagagatttggg

SEQ ID NO: 11259 - DNA, 25 bp, Mus musculus
cctccgcaagagatttggggctttg

SEQ ID NO: 11260 - DNA, 25 bp, Mus musculus
atttggggctttgttatcagatcaa

SEQ ID NO: 11261 - DNA, 25 bp, Mus musculus
caagttcctgacatactaccctggc

SEQ ID NO: 11262 - DNA, 25 bp, Mus musculus
cctgacatactaccctggcaggagg

SEQ ID NO: 11263 - DNA, 25 bp, Mus musculus
agatggcctcaagcacgaatatttc

SEQ ID NO: 11264 - DNA, 25 bp, Mus musculus
catgttccccacgtggcctgccaag

SEQ ID NO: 11265 - DNA, 25 bp, Mus musculus
tcaatcccctgggatcccatctggt

SEQ ID NO: 11266 - DNA, 25 bp, Mus musculus
ccctgggatcccatctggtggaagg

SEQ ID NO: 11267 - DNA, 25 bp, Mus musculus
ctctacacctctagctataacttta

SEQ ID NO: 11268 - DNA, 25 bp, Mus musculus
tggagacccagtctgaaatgaaaga

SEQ ID NO: 11269 - DNA, 25 bp, Mus musculus
atagattccaggtggacatacacag

SEQ ID NO: 11270 - DNA, 25 bp, Mus musculus
tacacagaaccaaaccatgagttag

SEQ ID NO: 11271 - DNA, 25 bp, Mus musculus
gtttgtcatgtgccccagaaaaagg

SEQ ID NO: 11272 - DNA, 25 bp, Mus musculus
agtgactatgtccctgagtcctaga

SEQ ID NO: 11273 - DNA, 25 bp, Mus musculus
tatgtccctgagtcctagatggtga

SEQ ID NO: 11274 - DNA, 25 bp, Mus musculus
agtgcctatgaggcactggatagac

SEQ ID NO: 11275 - DNA, 25 bp, Mus musculus
gatagaccagcaacactctgacact

SEQ ID NO: 11276 - DNA, 25 bp, Mus musculus
caggccccagtcctgtaatgagtaa

SEQ ID NO: 11277 - DNA, 25 bp, Mus musculus
gatcccatctggtggaaggagagaa

SEQ ID NO: 11278 - DNA, 25 bp, Mus musculus
taaacttgtctctctcccaaggcca

SEQ ID NO: 11279 - DNA, 25 bp, Mus musculus
gagagaaccggcttgcccaggatgt

SEQ ID NO: 11280 - DNA, 25 bp, Mus musculus
accggcttgcccaggatgtcttctg

SEQ ID NO: 11281 - DNA, 25 bp, Mus musculus
tcttctgatttctacgtacacgcac

SEQ ID NO: 11282 - DNA, 25 bp, Mus musculus
gatttctacgtacacgcacacgcac

SEQ ID NO: 11283 - DNA, 25 bp, Mus musculus
cacacgcacatatgagtacacacaa

SEQ ID NO: 11284 - DNA, 25 bp, Mus musculus
tgagtacacacaaagtctaagtttt

SEQ ID NO: 11285 - DNA, 25 bp, Mus musculus
ttctagaaagacctctacacctcta

SEQ ID NO: 11286 - DNA, 25 bp, Mus musculus
attctgctaggtctgagcggctctg

SEQ ID NO: 11287 - DNA, 25 bp, Mus musculus
ctaggtctgagcggctctgtcaaat

SEQ ID NO: 11288 - DNA, 25 bp, Mus musculus
gacccaaggttgacatctggtccct

SEQ ID NO: 11289 - DNA, 25 bp, Mus musculus
ttgacatctggtccctgggtattat

SEQ ID NO: 11290 - DNA, 25 bp, Mus musculus
tctggtccctgggtattatggcaat

SEQ ID NO: 11291 - DNA, 25 bp, Mus musculus
catacctcaatgaaaaccctttgag

SEQ ID NO: 11292 - DNA, 25 bp, Mus musculus
tcaatgaaaaccctttgagagcctt

SEQ ID NO: 11293 - DNA, 25 bp, Mus musculus
ctttgagagccttgtaccttattgc

SEQ ID NO: 11294 - DNA, 25 bp, Mus musculus
tgagagccttgtaccttattgctac

SEQ ID NO: 11295 - DNA, 25 bp, Mus musculus
tgtaccttattgctaccaatgggac

SEQ ID NO: 11296 - DNA, 25 bp, Mus musculus
ttattgctaccaatgggacgccaga

SEQ ID NO: 11297 - DNA, 25 bp, Mus musculus
ctaccaatgggacgccagagcttca

SEQ ID NO: 11298 - DNA, 25 bp, Mus musculus
ggtctgagcggctctgtcaaattaa

SEQ ID NO: 11299 - DNA, 25 bp, Mus musculus
ctgagcggctctgtcaaattaactg

SEQ ID NO: 11300 - DNA, 25 bp, Mus musculus
ttaactgactttggattctgtgcac

SEQ ID NO: 11301 - DNA, 25 bp, Mus musculus
ttctgtgcacagataactccagagc

SEQ ID NO: 11302 - DNA, 25 bp, Mus musculus
cagataactccagagcagacaaaag

SEQ ID NO: 11303 - DNA, 25 bp, Mus musculus
ataactccagagcagacaaaaggag

SEQ ID NO: 11304 - DNA, 25 bp, Mus musculus
ttgtgacacgcaaggcctatggacc

SEQ ID NO: 11305 - DNA, 25 bp, Mus musculus
cacgcaaggcctatggacccaaggt

SEQ ID NO: 11306 - DNA, 25 bp, Mus musculus
agtgcacactaaaagtctaatccac

SEQ ID NO: 11307 - DNA, 25 bp, Mus musculus
cactaaaagtctaatccacacataa

SEQ ID NO: 11308 - DNA, 25 bp, Mus musculus
ttgctaacttctgtgatttccacct

SEQ ID NO: 11309 - DNA, 25 bp, Mus musculus
acctacaaccctgcgactgatagac

SEQ ID NO: 11310 - DNA, 25 bp, Mus musculus
tacaaccctgcgactgatagactta

SEQ ID NO: 11311 - DNA, 25 bp, Mus musculus
gctaacgattgctttcaaagtccac

SEQ ID NO: 11312 - DNA, 25 bp, Mus musculus
gattgctttcaaagtccacccggca

SEQ ID NO: 11313 - DNA, 25 bp, Mus musculus
gcagcaccagggactgtgtggccag

SEQ ID NO: 11314 - DNA, 25 bp, Mus musculus
ccagggactgtgtggccaggagtat

SEQ ID NO: 11315 - DNA, 25 bp, Mus musculus
tggacctgaattaaccacagcctga

SEQ ID NO: 11316 - DNA, 25 bp, Mus musculus
acctgaattaaccacagcctgagaa

SEQ ID NO: 11317 - DNA, 25 bp, Mus musculus
tgaattaaccacagcctgagaataa

SEQ ID NO: 11318 - DNA, 25 bp, Mus musculus
aagtctaatccacacataacaccta

SEQ ID NO: 11319 - DNA, 25 bp, Mus musculus
aatccacacataacacctatttcag

SEQ ID NO: 11320 - DNA, 25 bp, Mus musculus
ataacacctatttcagcaacatctt

SEQ ID NO: 11321 - DNA, 25 bp, Mus musculus
acacctatttcagcaacatcttctg

SEQ ID NO: 11322 - DNA, 25 bp, Mus musculus
gcaacatcttctgttctctaacctt

SEQ ID NO: 11323 - DNA, 25 bp, Mus musculus
tcttctgttctctaacctttgctaa

SEQ ID NO: 11324 - DNA, 25 bp, Mus musculus
tctgttctctaacctttgctaactt

SEQ ID NO: 11325 - DNA, 25 bp, Mus musculus
taacctttgctaacttctgtgattt

SEQ ID NO: 11326 - DNA, 25 bp, Mus musculus
aggcaagcccgagtcagggcacttg

SEQ ID NO: 11327 - DNA, 25 bp, Mus musculus
caagcccgagtcagggcacttgtta

SEQ ID NO: 11328 - DNA, 25 bp, Mus musculus
cattaacagccagagtgccaatggt

SEQ ID NO: 11329 - DNA, 25 bp, Mus musculus
taacagccagagtgccaatggtggg

SEQ ID NO: 11330 - DNA, 25 bp, Mus musculus
caatttagacttctgtccaacacta

SEQ ID NO: 11331 - DNA, 25 bp, Mus musculus
tttagacttctgtccaacactaatt

SEQ ID NO: 11332 - DNA, 25 bp, Mus musculus
aagccacgctggtcttctgagattc

SEQ ID NO: 11333 - DNA, 25 bp, Mus musculus
ccacgctggtcttctgagattccaa

SEQ ID NO: 11334 - DNA, 25 bp, Mus musculus
cttcccagttctccatatcagggta

SEQ ID NO: 11335 - DNA, 25 bp, Mus musculus
agttctccatatcagggtagaagat

SEQ ID NO: 11336 - DNA, 25 bp, Mus musculus
tctccatatcagggtagaagatcta

SEQ ID NO: 11337 - DNA, 25 bp, Mus musculus
tctaggcactacatatgtaattggt

SEQ ID NO: 11338 - DNA, 25 bp, Mus musculus
atgtgccatttcccaggttgccacc

SEQ ID NO: 11339 - DNA, 25 bp, Mus musculus
tgccatttcccaggttgccaccctt

SEQ ID NO: 11340 - DNA, 25 bp, Mus musculus
ggttgccacccttcatagagtttag

SEQ ID NO: 11341 - DNA, 25 bp, Mus musculus
tgccacccttcatagagtttaggca

SEQ ID NO: 11342 - DNA, 25 bp, Mus musculus
ttaggcatgcagtttgcttagccag

SEQ ID NO: 11343 - DNA, 25 bp, Mus musculus
atgcagtttgcttagccagtgtagg

SEQ ID NO: 11344 - DNA, 25 bp, Mus musculus
tttgcttagccagtgtaggaagcct

SEQ ID NO: 11345 - DNA, 25 bp, Mus musculus
aaccattaacagccagagtgccaat

SEQ ID NO: 11346 - DNA, 25 bp, Mus musculus
gaggaccagctcaacgaggagaagt

SEQ ID NO: 11347 - DNA, 25 bp, Mus musculus
aggaccagctcaacgaggagaagtg

SEQ ID NO: 11348 - DNA, 25 bp, Mus musculus
acagcgattggggattcaggccacc

SEQ ID NO: 11349 - DNA, 25 bp, Mus musculus
gggattcaggccaccaatatggcta

SEQ ID NO: 11350 - DNA, 25 bp, Mus musculus
ggattcaggccaccaatatggctag

SEQ ID NO: 11351 - DNA, 25 bp, Mus musculus
gattcaggccaccaatatggctagg

SEQ ID NO: 11352 - DNA, 25 bp, Mus musculus
ttcaggccaccaatatggctaggac

SEQ ID NO: 11353 - DNA, 25 bp, Mus musculus
tcaggccaccaatatggctaggaca

SEQ ID NO: 11354 - DNA, 25 bp, Mus musculus
caggccaccaatatggctaggacat

SEQ ID NO: 11355 - DNA, 25 bp, Mus musculus
ggccaccaatatggctaggacattc

SEQ ID NO: 11356 - DNA, 25 bp, Mus musculus
gccaccaatatggctaggacattca

SEQ ID NO: 11357 - DNA, 25 bp, Mus musculus
ccaccaatatggctaggacattcat

SEQ ID NO: 11358 - DNA, 25 bp, Mus musculus
gaccagctcaacgaggagaagtgcg

SEQ ID NO: 11359 - DNA, 25 bp, Mus musculus
accagctcaacgaggagaagtgcgc

SEQ ID NO: 11360 - DNA, 25 bp, Mus musculus
aagtgcgcacgcgaggccaacaaaa

SEQ ID NO: 11361 - DNA, 25 bp, Mus musculus
cacgcaccgccatgctgctgctggg

SEQ ID NO: 11362 - DNA, 25 bp, Mus musculus
cgcaccgccatgctgctgctgggtg

SEQ ID NO: 11363 - DNA, 25 bp, Mus musculus
ggatcctacatgtgaattgggttaa

SEQ ID NO: 11364 - DNA, 25 bp, Mus musculus
gatcctacatgtgaattgggttaac

SEQ ID NO: 11365 - DNA, 25 bp, Mus musculus
atcctacatgtgaattgggttaacg

SEQ ID NO: 11366 - DNA, 25 bp, Mus musculus
aggattcactccgagatcgtgaagc

SEQ ID NO: 11367 - DNA, 25 bp, Mus musculus
attcactccgagatcgtgaagcagt

SEQ ID NO: 11368 - DNA, 25 bp, Mus musculus
ggtttcctgactgatctgagccaac

SEQ ID NO: 11369 - DNA, 25 bp, Mus musculus
ttcctgactgatctgagccaactga

SEQ ID NO: 11370 - DNA, 25 bp, Mus musculus
ctgactgatctgagccaactgaaga

SEQ ID NO: 11371 - DNA, 25 bp, Mus musculus
actgatctgagccaactgaagaagc

SEQ ID NO: 11372 - DNA, 25 bp, Mus musculus
gatctgagccaactgaagaagctgc

SEQ ID NO: 11373 - DNA, 25 bp, Mus musculus
ctgctgtcactggttgatgatgagg

SEQ ID NO: 11374 - DNA, 25 bp, Mus musculus
ctgtcactggttgatgatgaggcct

SEQ ID NO: 11375 - DNA, 25 bp, Mus musculus
gatgaggccttcatcagggatgtag

SEQ ID NO: 11376 - DNA, 25 bp, Mus musculus
gaggccttcatcagggatgtagcca

SEQ ID NO: 11377 - DNA, 25 bp, Mus musculus
gccttcatcagggatgtagccaagg

SEQ ID NO: 11378 - DNA, 25 bp, Mus musculus
aagcagtctgtcttcaaggactttt

SEQ ID NO: 11379 - DNA, 25 bp, Mus musculus
cagtctgtcttcaaggacttttatg

SEQ ID NO: 11380 - DNA, 25 bp, Mus musculus
tctgtcttcaaggacttttatgagc

SEQ ID NO: 11381 - DNA, 25 bp, Mus musculus
gtcttcaaggacttttatgagctgg

SEQ ID NO: 11382 - DNA, 25 bp, Mus musculus
ccagagaacttccagaacaagacca

SEQ ID NO: 11383 - DNA, 25 bp, Mus musculus
gagaacttccagaacaagaccaatg

SEQ ID NO: 11384 - DNA, 25 bp, Mus musculus
ttccagaacaagaccaatggtatca

SEQ ID NO: 11385 - DNA, 25 bp, Mus musculus
gaaggtttcctgactgatctgagcc

SEQ ID NO: 11386 - DNA, 25 bp, Mus musculus
aagaccatatccatgctctaggtcc

SEQ ID NO: 11387 - DNA, 25 bp, Mus musculus
atatccatgctctaggtccccaaat

SEQ ID NO: 11388 - DNA, 25 bp, Mus musculus
tctttagaagctctttggctttata

SEQ ID NO: 11389 - DNA, 25 bp, Mus musculus
gaagctctttggctttataaggaca

SEQ ID NO: 11390 - DNA, 25 bp, Mus musculus
agtattcctgatctcaccagtatcc

SEQ ID NO: 11391 - DNA, 25 bp, Mus musculus
agtatcctttcaaactaatggcagt

SEQ ID NO: 11392 - DNA, 25 bp, Mus musculus
ctttcaaactaatggcagttattct

SEQ ID NO: 11393 - DNA, 25 bp, Mus musculus
gactaatccagtagttcttaagatc

SEQ ID NO: 11394 - DNA, 25 bp, Mus musculus
cagtgaaacatcaatcctagaggaa

SEQ ID NO: 11395 - DNA, 25 bp, Mus musculus
aacatcaatcctagaggaagacact

SEQ ID NO: 11396 - DNA, 25 bp, Mus musculus
agaggaagacactcctccaacatca

SEQ ID NO: 11397 - DNA, 25 bp, Mus musculus
tcctccaacatcaggttgatgatca

SEQ ID NO: 11398 - DNA, 25 bp, Mus musculus
atgctctaggtccccaaatgaacca

SEQ ID NO: 11399 - DNA, 25 bp, Mus musculus
taggtccccaaatgaaccagatagg

SEQ ID NO: 11400 - DNA, 25 bp, Mus musculus
tcagcaatctcaaggactagctctg

SEQ ID NO: 11401 - DNA, 25 bp, Mus musculus
atctcaaggactagctctggttcaa

SEQ ID NO: 11402 - DNA, 25 bp, Mus musculus
gcacccaggtacaatgctttcctta

SEQ ID NO: 11403 - DNA, 25 bp, Mus musculus
aggtacaatgctttccttataatgg

SEQ ID NO: 11404 - DNA, 25 bp, Mus musculus
aatgtttctgggaccagaggagtgc

SEQ ID NO: 11405 - DNA, 25 bp, Mus musculus
tctatttctttagaagctctttggc

SEQ ID NO: 11406 - DNA, 25 bp, Mus musculus
tactcatacacagccctatctgatg

SEQ ID NO: 11407 - DNA, 25 bp, Mus musculus
catacacagccctatctgatgagca

SEQ ID NO: 11408 - DNA, 25 bp, Mus musculus
acacgcgatagttgtcggatattgc

SEQ ID NO: 11409 - DNA, 25 bp, Mus musculus
gtggcaccaggcaatggcatactag

SEQ ID NO: 11410 - DNA, 25 bp, Mus musculus
aatggcatactagctgcagatcagt

SEQ ID NO: 11411 - DNA, 25 bp, Mus musculus
atggcatactagctgcagatcagtc

SEQ ID NO: 11412 - DNA, 25 bp, Mus musculus
atactagctgcagatcagtccgtcg

SEQ ID NO: 11413 - DNA, 25 bp, Mus musculus
tactagctgcagatcagtccgtcgg

SEQ ID NO: 11414 - DNA, 25 bp, Mus musculus
ctagctgcagatcagtccgtcggga

SEQ ID NO: 11415 - DNA, 25 bp, Mus musculus
atcagtccgtcgggagcatggacaa

SEQ ID NO: 11416 - DNA, 25 bp, Mus musculus
gtccgtcgggagcatggacaacagg

SEQ ID NO: 11417 - DNA, 25 bp, Mus musculus
gcatggacaacaggctcgagcaaat

SEQ ID NO: 11418 - DNA, 25 bp, Mus musculus
tacacagccctatctgatgagcaca

SEQ ID NO: 11419 - DNA, 25 bp, Mus musculus
acacagccctatctgatgagcacac

SEQ ID NO: 11420 - DNA, 25 bp, Mus musculus
acagccctatctgatgagcacacgc

SEQ ID NO: 11421 - DNA, 25 bp, Mus musculus
cagccctatctgatgagcacacgcg

SEQ ID NO: 11422 - DNA, 25 bp, Mus musculus
gatgagcacacgcgatagttgtcgg

SEQ ID NO: 11423 - DNA, 25 bp, Mus musculus
atgagcacacgcgatagttgtcgga

SEQ ID NO: 11424 - DNA, 25 bp, Mus musculus
agcacacgcgatagttgtcggatat

SEQ ID NO: 11425 - DNA, 25 bp, Mus musculus
cacacgcgatagttgtcggatattg

SEQ ID NO: 11426 - DNA, 25 bp, Mus musculus
ttcgagacattcccacacacggtag

SEQ ID NO: 11427 - DNA, 25 bp, Mus musculus
acattcccacacacggtagccatcg

SEQ ID NO: 11428 - DNA, 25 bp, Mus musculus
tgttcctacgaccaaccacactgtg

SEQ ID NO: 11429 - DNA, 25 bp, Mus musculus
cactgtgctgcccgatgccttagga

SEQ ID NO: 11430 - DNA, 25 bp, Mus musculus
gctgcccgatgccttaggagctctg

SEQ ID NO: 11431 - DNA, 25 bp, Mus musculus
cgatgccttaggagctctgtgccgc

SEQ ID NO: 11432 - DNA, 25 bp, Mus musculus
agctctgtgccgctgtctatctatg

SEQ ID NO: 11433 - DNA, 25 bp, Mus musculus
ccgcgacacctggacatcatctatg

SEQ ID NO: 11434 - DNA, 25 bp, Mus musculus
cacctggacatcatctatgccctca

SEQ ID NO: 11435 - DNA, 25 bp, Mus musculus
gacatcatctatgccctcatccaga

SEQ ID NO: 11436 - DNA, 25 bp, Mus musculus
atccagactgagctggatcacgtgg

SEQ ID NO: 11437 - DNA, 25 bp, Mus musculus
ctggatcacgtggctgcgctgtttc

SEQ ID NO: 11438 - DNA, 25 bp, Mus musculus
ccacacacggtagccatcgaactgt

SEQ ID NO: 11439 - DNA, 25 bp, Mus musculus
acggtagccatcgaactgtatgaca

SEQ ID NO: 11440 - DNA, 25 bp, Mus musculus
atcgccgagctcatgcggatcctga

SEQ ID NO: 11441 - DNA, 25 bp, Mus musculus
gagctcatgcggatcctgatgtacg

SEQ ID NO: 11442 - DNA, 25 bp, Mus musculus
atgcggatcctgatgtacgtggaga

SEQ ID NO: 11443 - DNA, 25 bp, Mus musculus
atcctgatgtacgtggagacggtcg

SEQ ID NO: 11444 - DNA, 25 bp, Mus musculus
tatacggcctgagagatctacaaga

SEQ ID NO: 11445 - DNA, 25 bp, Mus musculus
tacaagatgacctgttcctacgacc

SEQ ID NO: 11446 - DNA, 25 bp, Mus musculus
aagcagcatccttttgtattcccac

SEQ ID NO: 11447 - DNA, 25 bp, Mus musculus
catccttttgtattcccactgagta

SEQ ID NO: 11448 - DNA, 25 bp, Mus musculus
tcgccgtaagctgcaagtgtggcaa

SEQ ID NO: 11449 - DNA, 25 bp, Mus musculus
taagctgcaagtgtggcaagtgtaa

SEQ ID NO: 11450 - DNA, 25 bp, Mus musculus
atactgacaacagtgactgcataca

SEQ ID NO: 11451 - DNA, 25 bp, Mus musculus
gtgactgcatacacgaggctgtcag

SEQ ID NO: 11452 - DNA, 25 bp, Mus musculus
gcatacacgaggctgtcagaaccaa

SEQ ID NO: 11453 - DNA, 25 bp, Mus musculus
ctgtcagaaccaactactgcaccaa

SEQ ID NO: 11454 - DNA, 25 bp, Mus musculus
gaaccaactactgcaccaagccgca

SEQ ID NO: 11455 - DNA, 25 bp, Mus musculus
actactgcaccaagccgcagtcttt

SEQ ID NO: 11456 - DNA, 25 bp, Mus musculus
ctgtttaacttcaatagcagtgcaa

SEQ ID NO: 11457 - DNA, 25 bp, Mus musculus
aacttcaatagcagtgcaatctggt

SEQ ID NO: 11458 - DNA, 25 bp, Mus musculus
tttgtattcccactgagtatacaat

SEQ ID NO: 11459 - DNA, 25 bp, Mus musculus
ttcccactgagtatacaatgtacgt

SEQ ID NO: 11460 - DNA, 25 bp, Mus musculus
acaccaccatctgtgctgggtattg

SEQ ID NO: 11461 - DNA, 25 bp, Mus musculus
aactgtttcttcccaaatatgcact

SEQ ID NO: 11462 - DNA, 25 bp, Mus musculus
ttcttcccaaatatgcactctctca

SEQ ID NO: 11463 - DNA, 25 bp, Mus musculus
ccaaatatgcactctctcaggatgt

SEQ ID NO: 11464 - DNA, 25 bp, Mus musculus
catacagagacttcatctacagaac

SEQ ID NO: 11465 - DNA, 25 bp, Mus musculus
tcatctacagaacggtggaaatacc

SEQ ID NO: 11466 - DNA, 25 bp, Mus musculus
ggccaaacatacctaacagatggtt

SEQ ID NO: 11467 - DNA, 25 bp, Mus musculus
acatacctaacagatggttctcaga

SEQ ID NO: 11468 - DNA, 25 bp, Mus musculus
tgctggcctgactggttgtcagaac

SEQ ID NO: 11469 - DNA, 25 bp, Mus musculus
tcttcccagccatgttccaggggga

SEQ ID NO: 11470 - DNA, 25 bp, Mus musculus
aacctcgctcaaaaactgtgactcg

SEQ ID NO: 11471 - DNA, 25 bp, Mus musculus
aaactgtgactcgagccctcgatga

SEQ ID NO: 11472 - DNA, 25 bp, Mus musculus
tgactcgagccctcgatgaactgtt

SEQ ID NO: 11473 - DNA, 25 bp, Mus musculus
tcgatgaactgttcacaccacaaag

SEQ ID NO: 11474 - DNA, 25 bp, Mus musculus
tcacaccacaaagacttaacggtgg

SEQ ID NO: 11475 - DNA, 25 bp, Mus musculus
acccggagagatcctgcaggcgatc

SEQ ID NO: 11476 - DNA, 25 bp, Mus musculus
cctgcaggcgatctgggcattaaga

SEQ ID NO: 11477 - DNA, 25 bp, Mus musculus
attaagacagtggctctctgcgtat

SEQ ID NO: 11478 - DNA, 25 bp, Mus musculus
gatggttctcagacccgacattaac

SEQ ID NO: 11479 - DNA, 25 bp, Mus musculus
ggtatcagaacccatccgcaagact

SEQ ID NO: 11480 - DNA, 25 bp, Mus musculus
caagactcacagctctacgtatcaa

SEQ ID NO: 11481 - DNA, 25 bp, Mus musculus
tcacagctctacgtatcaaaaagac

SEQ ID NO: 11482 - DNA, 25 bp, Mus musculus
aaactgactgttgaccttgtcaccg

SEQ ID NO: 11483 - DNA, 25 bp, Mus musculus
gaccttgtcaccggtgtcaagaagg

SEQ ID NO: 11484 - DNA, 25 bp, Mus musculus
gagagtcaatgctgtccttgtccag

SEQ ID NO: 11485 - DNA, 25 bp, Mus musculus
acctaatgctggcctgactggttgt

SEQ ID NO: 11486 - DNA, 25 bp, Mus musculus
ctcttccagagatggctaacagggg

SEQ ID NO: 11487 - DNA, 25 bp, Mus musculus
cttccagagatggctaacaggggtc

SEQ ID NO: 11488 - DNA, 25 bp, Mus musculus
gactggatcatcctgcagtgtgctg

SEQ ID NO: 11489 - DNA, 25 bp, Mus musculus
ggatcatcctgcagtgtgctgagga

SEQ ID NO: 11490 - DNA, 25 bp, Mus musculus
catcctgcagtgtgctgaggatata

SEQ ID NO: 11491 - DNA, 25 bp, Mus musculus
tcctgcagtgtgctgaggatataga

SEQ ID NO: 11492 - DNA, 25 bp, Mus musculus
gacggtcctgtgcaagctgataaac

SEQ ID NO: 11493 - DNA, 25 bp, Mus musculus
cggtcctgtgcaagctgataaacag

SEQ ID NO: 11494 - DNA, 25 bp, Mus musculus
taaacagtttatatccaccagggca

SEQ ID NO: 11495 - DNA, 25 bp, Mus musculus
aacagtttatatccaccagggcaag

SEQ ID NO: 11496 - DNA, 25 bp, Mus musculus
cagtttatatccaccagggcaagaa

SEQ ID NO: 11497 - DNA, 25 bp, Mus musculus
atatccaccagggcaagaacccatc

SEQ ID NO: 11498 - DNA, 25 bp, Mus musculus
tggctaacaggggtccgagctatgg

SEQ ID NO: 11499 - DNA, 25 bp, Mus musculus
gctatggcttaagccgagaggtgca

SEQ ID NO: 11500 - DNA, 25 bp, Mus musculus
tatggcttaagccgagaggtgcagg

SEQ ID NO: 11501 - DNA, 25 bp, Mus musculus
gaagtatgacgcggatctggagaac

SEQ ID NO: 11502 - DNA, 25 bp, Mus musculus
agtatgacgcggatctggagaacaa

SEQ ID NO: 11503 - DNA, 25 bp, Mus musculus
tatgacgcggatctggagaacaagc

SEQ ID NO: 11504 - DNA, 25 bp, Mus musculus
agaacaagctggtggactggatcat

SEQ ID NO: 11505 - DNA, 25 bp, Mus musculus
tggactggatcatcctgcagtgtgc

SEQ ID NO: 11506 - DNA, 25 bp, Mus musculus
cgtcctgcgtagggagcaggactct

SEQ ID NO: 11507 - DNA, 25 bp, Mus musculus
tcctgcgtagggagcaggactctga

SEQ ID NO: 11508 - DNA, 25 bp, Mus musculus
ttccgcatgatcaacgagcagcaag

SEQ ID NO: 11509 - DNA, 25 bp, Mus musculus
tccgcatgatcaacgagcagcaagt

SEQ ID NO: 11510 - DNA, 25 bp, Mus musculus
gaggacatcaccatagacttcttct

SEQ ID NO: 11511 - DNA, 25 bp, Mus musculus
aggacatcaccatagacttcttcta

SEQ ID NO: 11512 - DNA, 25 bp, Mus musculus
gacatcaccatagacttcttctacc

SEQ ID NO: 11513 - DNA, 25 bp, Mus musculus
acatcaccatagacttcttctaccg

SEQ ID NO: 11514 - DNA, 25 bp, Mus musculus
atcaccatagacttcttctaccggc

SEQ ID NO: 11515 - DNA, 25 bp, Mus musculus
tcaccatagacttcttctaccggcc

SEQ ID NO: 11516 - DNA, 25 bp, Mus musculus
ccatagacttcttctaccggccgca

SEQ ID NO: 11517 - DNA, 25 bp, Mus musculus
atagacttcttctaccggccgcaca

SEQ ID NO: 11518 - DNA, 25 bp, Mus musculus
aactacaggatgcatttccgcatga

SEQ ID NO: 11519 - DNA, 25 bp, Mus musculus
actacaggatgcatttccgcatgat

SEQ ID NO: 11520 - DNA, 25 bp, Mus musculus
acaggatgcatttccgcatgatcaa

SEQ ID NO: 11521 - DNA, 25 bp, Mus musculus
aggatgcatttccgcatgatcaacg

SEQ ID NO: 11522 - DNA, 25 bp, Mus musculus
ggatgcatttccgcatgatcaacga

SEQ ID NO: 11523 - DNA, 25 bp, Mus musculus
atgcatttccgcatgatcaacgagc

SEQ ID NO: 11524 - DNA, 25 bp, Mus musculus
catttccgcatgatcaacgagcagc

SEQ ID NO: 11525 - DNA, 25 bp, Mus musculus
atttccgcatgatcaacgagcagca

SEQ ID NO: 11526 - DNA, 25 bp, Mus musculus
ttgacagagaccccaagctgcccat

SEQ ID NO: 11527 - DNA, 25 bp, Mus musculus
tgacagagaccccaagctgcccatt

SEQ ID NO: 11528 - DNA, 25 bp, Mus musculus
ccccaagctgcccatttcacttatg

SEQ ID NO: 11529 - DNA, 25 bp, Mus musculus
cccaagctgcccatttcacttatgg

SEQ ID NO: 11530 - DNA, 25 bp, Mus musculus
ccaagctgcccatttcacttatggg

SEQ ID NO: 11531 - DNA, 25 bp, Mus musculus
caagctgcccatttcacttatgggt

SEQ ID NO: 11532 - DNA, 25 bp, Mus musculus
aagctgcccatttcacttatgggtt

SEQ ID NO: 11533 - DNA, 25 bp, Mus musculus
agctgcccatttcacttatgggttt

SEQ ID NO: 11534 - DNA, 25 bp, Mus musculus
gctgcccatttcacttatgggtttt

SEQ ID NO: 11535 - DNA, 25 bp, Mus musculus
gacagagaccccaagctgcccattt

SEQ ID NO: 11536 - DNA, 25 bp, Mus musculus
acagagaccccaagctgcccatttc

SEQ ID NO: 11537 - DNA, 25 bp, Mus musculus
cagagaccccaagctgcccatttca

SEQ ID NO: 11538 - DNA, 25 bp, Mus musculus
agagaccccaagctgcccatttcac

SEQ ID NO: 11539 - DNA, 25 bp, Mus musculus
gagaccccaagctgcccatttcact

SEQ ID NO: 11540 - DNA, 25 bp, Mus musculus
agaccccaagctgcccatttcactt

SEQ ID NO: 11541 - DNA, 25 bp, Mus musculus
gaccccaagctgcccatttcactta

SEQ ID NO: 11542 - DNA, 25 bp, Mus musculus
accccaagctgcccatttcacttat

SEQ ID NO: 11543 - DNA, 25 bp, Mus musculus
catctcagctgagaaggcataccat

SEQ ID NO: 11544 - DNA, 25 bp, Mus musculus
gatgtcaacgcggctattgcaacca

SEQ ID NO: 11545 - DNA, 25 bp, Mus musculus
gcctggaccacaaatttgacctcat

SEQ ID NO: 11546 - DNA, 25 bp, Mus musculus
ggaccacaaatttgacctcatgtac

SEQ ID NO: 11547 - DNA, 25 bp, Mus musculus
accacaaatttgacctcatgtacgc

SEQ ID NO: 11548 - DNA, 25 bp, Mus musculus
caaatttgacctcatgtacgccaag

SEQ ID NO: 11549 - DNA, 25 bp, Mus musculus
aatttgacctcatgtacgccaagcg

SEQ ID NO: 11550 - DNA, 25 bp, Mus musculus
tttgacctcatgtacgccaagcgag

SEQ ID NO: 11551 - DNA, 25 bp, Mus musculus
tgacctcatgtacgccaagcgagcc

SEQ ID NO: 11552 - DNA, 25 bp, Mus musculus
acctcatgtacgccaagcgagcctt

SEQ ID NO: 11553 - DNA, 25 bp, Mus musculus
ctcatgtacgccaagcgagcctttg

SEQ ID NO: 11554 - DNA, 25 bp, Mus musculus
ctggcagcgctggagaaggactatg

SEQ ID NO: 11555 - DNA, 25 bp, Mus musculus
tgtcaacgcggctattgcaaccata

SEQ ID NO: 11556 - DNA, 25 bp, Mus musculus
tcaacgcggctattgcaaccataaa

SEQ ID NO: 11557 - DNA, 25 bp, Mus musculus
aacgcggctattgcaaccataaaga

SEQ ID NO: 11558 - DNA, 25 bp, Mus musculus
gctattgcaaccataaagacaaagc

SEQ ID NO: 11559 - DNA, 25 bp, Mus musculus
tattgcaaccataaagacaaagcgt

SEQ ID NO: 11560 - DNA, 25 bp, Mus musculus
tagattggtgtccgactggatttaa

SEQ ID NO: 11561 - DNA, 25 bp, Mus musculus
gctgagcaataccacggccatcgca

SEQ ID NO: 11562 - DNA, 25 bp, Mus musculus
tgagcaataccacggccatcgcaga

SEQ ID NO: 11563 - DNA, 25 bp, Mus musculus
gaccctgagctggaacgcatcagtg

SEQ ID NO: 11564 - DNA, 25 bp, Mus musculus
ctggaacgcatcagtgtctactaca

SEQ ID NO: 11565 - DNA, 25 bp, Mus musculus
agtatgtgcccagagccattctggt

SEQ ID NO: 11566 - DNA, 25 bp, Mus musculus
atgtgcccagagccattctggtgga

SEQ ID NO: 11567 - DNA, 25 bp, Mus musculus
tgcccagagccattctggtggacct

SEQ ID NO: 11568 - DNA, 25 bp, Mus musculus
agcctggaaccatggacagcgttcg

SEQ ID NO: 11569 - DNA, 25 bp, Mus musculus
ctggaaccatggacagcgttcggtc

SEQ ID NO: 11570 - DNA, 25 bp, Mus musculus
gaaccatggacagcgttcggtctgg

SEQ ID NO: 11571 - DNA, 25 bp, Mus musculus
ccatggacagcgttcggtctggggc

SEQ ID NO: 11572 - DNA, 25 bp, Mus musculus
cctttggacacctattcaggcctga

SEQ ID NO: 11573 - DNA, 25 bp, Mus musculus
ttggacacctattcaggcctgacaa

SEQ ID NO: 11574 - DNA, 25 bp, Mus musculus
gacacctattcaggcctgacaactt

SEQ ID NO: 11575 - DNA, 25 bp, Mus musculus
agtgtctactacaatgaggctcctc

SEQ ID NO: 11576 - DNA, 25 bp, Mus musculus
gtctactacaatgaggctcctctca

SEQ ID NO: 11577 - DNA, 25 bp, Mus musculus
tactacaatgaggctcctctcacaa

SEQ ID NO: 11578 - DNA, 25 bp, Mus musculus
tacaatgaggctcctctcacaagta

SEQ ID NO: 11579 - DNA, 25 bp, Mus musculus
aatgaggctcctctcacaagtatgt

SEQ ID NO: 11580 - DNA, 25 bp, Mus musculus
gaggctcctctcacaagtatgtgcc

SEQ ID NO: 11581 - DNA, 25 bp, Mus musculus
gctcctctcacaagtatgtgcccag

SEQ ID NO: 11582 - DNA, 25 bp, Mus musculus
ctcacaagtatgtgcccagagccat

SEQ ID NO: 11583 - DNA, 25 bp, Mus musculus
tgcactccggccagggaaggcatga

SEQ ID NO: 11584 - DNA, 25 bp, Mus musculus
ctcaagccttctggaaggcggtcac

SEQ ID NO: 11585 - DNA, 25 bp, Mus musculus
cctggccatgctcatctttgttctg

SEQ ID NO: 11586 - DNA, 25 bp, Mus musculus
tggccatgctcatctttgttctgct

SEQ ID NO: 11587 - DNA, 25 bp, Mus musculus
gccatgctcatctttgttctgctca

SEQ ID NO: 11588 - DNA, 25 bp, Mus musculus
tgctcatctttgttctgctcagcgt

SEQ ID NO: 11589 - DNA, 25 bp, Mus musculus
ctcatctttgttctgctcagcgtgg

SEQ ID NO: 11590 - DNA, 25 bp, Mus musculus
tttgttctgctcagcgtgggatcca

SEQ ID NO: 11591 - DNA, 25 bp, Mus musculus
tgttctgctcagcgtgggatccacc

SEQ ID NO: 11592 - DNA, 25 bp, Mus musculus
ttctgctcagcgtgggatccaccat

SEQ ID NO: 11593 - DNA, 25 bp, Mus musculus
ctgctcagcgtgggatccaccatta

SEQ ID NO: 11594 - DNA, 25 bp, Mus musculus
tcagcgtgggatccaccattaactg

SEQ ID NO: 11595 - DNA, 25 bp, Mus musculus
aaggcggtcacagcagagttcctgg

SEQ ID NO: 11596 - DNA, 25 bp, Mus musculus
cggtcacagcagagttcctggccat

SEQ ID NO: 11597 - DNA, 25 bp, Mus musculus
gtcacagcagagttcctggccatgc

SEQ ID NO: 11598 - DNA, 25 bp, Mus musculus
cacagcagagttcctggccatgctc

SEQ ID NO: 11599 - DNA, 25 bp, Mus musculus
cagcagagttcctggccatgctcat

SEQ ID NO: 11600 - DNA, 25 bp, Mus musculus
agagttcctggccatgctcatcttt

SEQ ID NO: 11601 - DNA, 25 bp, Mus musculus
agttcctggccatgctcatctttgt

SEQ ID NO: 11602 - DNA, 25 bp, Mus musculus
ttcctggccatgctcatctttgttc

SEQ ID NO: 11603 - DNA, 25 bp, Mus musculus
atgcaccagtcatttctgcagagaa

SEQ ID NO: 11604 - DNA, 25 bp, Mus musculus
caccagtcatttctgcagagaaggc

SEQ ID NO: 11605 - DNA, 25 bp, Mus musculus
tcgactcctatgaggacgaggatga

SEQ ID NO: 11606 - DNA, 25 bp, Mus musculus
actcctatgaggacgaggatgaggg

SEQ ID NO: 11607 - DNA, 25 bp, Mus musculus
aagagtagaccgctacttggagcct

SEQ ID NO: 11608 - DNA, 25 bp, Mus musculus
agtagaccgctacttggagcctgtt

SEQ ID NO: 11609 - DNA, 25 bp, Mus musculus
ctacttggagcctgttcactgtgtt

SEQ ID NO: 11610 - DNA, 25 bp, Mus musculus
cttggagcctgttcactgtgtttat

SEQ ID NO: 11611 - DNA, 25 bp, Mus musculus
ggagcctgttcactgtgtttattgc

SEQ ID NO: 11612 - DNA, 25 bp, Mus musculus
gcctgttcactgtgtttattgcaaa

SEQ ID NO: 11613 - DNA, 25 bp, Mus musculus
tgttcactgtgtttattgcaaaatc

SEQ ID NO: 11614 - DNA, 25 bp, Mus musculus
tgcaaaatcctttcgaaataaacag

SEQ ID NO: 11615 - DNA, 25 bp, Mus musculus
cagtcatttctgcagagaaggccta

SEQ ID NO: 11616 - DNA, 25 bp, Mus musculus
ctgccatagctgccatcaagacgaa

SEQ ID NO: 11617 - DNA, 25 bp, Mus musculus
tagctgccatcaagacgaagcgcag

SEQ ID NO: 11618 - DNA, 25 bp, Mus musculus
ctgccatcaagacgaagcgcagcat

SEQ ID NO: 11619 - DNA, 25 bp, Mus musculus
gtctggaccacaagtttgacttgat

SEQ ID NO: 11620 - DNA, 25 bp, Mus musculus
aagtaggcatcgactcctatgagga

SEQ ID NO: 11621 - DNA, 25 bp, Mus musculus
taggcatcgactcctatgaggacga

SEQ ID NO: 11622 - DNA, 25 bp, Mus musculus
gcatcgactcctatgaggacgagga

SEQ ID NO: 11623 - DNA, 25 bp, Mus musculus
gctctgctacactccggcctgagag

SEQ ID NO: 11624 - DNA, 25 bp, Mus musculus
ctccggcctgagagacgggtcttca

SEQ ID NO: 11625 - DNA, 25 bp, Mus musculus
gtcactcgagttgtgagctcggaac

SEQ ID NO: 11626 - DNA, 25 bp, Mus musculus
tcactcgagttgtgagctcggaacc

SEQ ID NO: 11627 - DNA, 25 bp, Mus musculus
cactcgagttgtgagctcggaaccc

SEQ ID NO: 11628 - DNA, 25 bp, Mus musculus
actcgagttgtgagctcggaacccg

SEQ ID NO: 11629 - DNA, 25 bp, Mus musculus
agttgtgagctcggaacccgtgaag

SEQ ID NO: 11630 - DNA, 25 bp, Mus musculus
gttgtgagctcggaacccgtgaagg

SEQ ID NO: 11631 - DNA, 25 bp, Mus musculus
ttgtgagctcggaacccgtgaaggc

SEQ ID NO: 11632 - DNA, 25 bp, Mus musculus
tgtgagctcggaacccgtgaaggcc

SEQ ID NO: 11633 - DNA, 25 bp, Mus musculus
gaccagaccctctctttttgaccat

SEQ ID NO: 11634 - DNA, 25 bp, Mus musculus
accctctctttttgaccatcaagtg

SEQ ID NO: 11635 - DNA, 25 bp, Mus musculus
tttctcttccgcgtcactcgagttg

SEQ ID NO: 11636 - DNA, 25 bp, Mus musculus
ttctcttccgcgtcactcgagttgt

SEQ ID NO: 11637 - DNA, 25 bp, Mus musculus
tctcttccgcgtcactcgagttgtg

SEQ ID NO: 11638 - DNA, 25 bp, Mus musculus
ctcttccgcgtcactcgagttgtga

SEQ ID NO: 11639 - DNA, 25 bp, Mus musculus
tcttccgcgtcactcgagttgtgag

SEQ ID NO: 11640 - DNA, 25 bp, Mus musculus
cttccgcgtcactcgagttgtgagc

SEQ ID NO: 11641 - DNA, 25 bp, Mus musculus
ccgcgtcactcgagttgtgagctcg

SEQ ID NO: 11642 - DNA, 25 bp, Mus musculus
cgtcactcgagttgtgagctcggaa

SEQ ID NO: 11643 - DNA, 25 bp, Mus musculus
cagctctgaacagatcatgaagaca

SEQ ID NO: 11644 - DNA, 25 bp, Mus musculus
ctttttgctacagggtttcatccag

SEQ ID NO: 11645 - DNA, 25 bp, Mus musculus
caaactggtgctcaaggccctgtgc

SEQ ID NO: 11646 - DNA, 25 bp, Mus musculus
ggtgctcaaggccctgtgcactaaa

SEQ ID NO: 11647 - DNA, 25 bp, Mus musculus
cactaaagtgcccgagctgatcaga

SEQ ID NO: 11648 - DNA, 25 bp, Mus musculus
agtgcccgagctgatcagaaccatc

SEQ ID NO: 11649 - DNA, 25 bp, Mus musculus
aaccatcatgggctggacactggac

SEQ ID NO: 11650 - DNA, 25 bp, Mus musculus
ctggacactggacttcctccgtgag

SEQ ID NO: 11651 - DNA, 25 bp, Mus musculus
actggacttcctccgtgagcggctg

SEQ ID NO: 11652 - DNA, 25 bp, Mus musculus
ctggatccaagaccagggtggctgg

SEQ ID NO: 11653 - DNA, 25 bp, Mus musculus
catctttgtggctggagtcctcacc

SEQ ID NO: 11654 - DNA, 25 bp, Mus musculus
gctcaccatctggaagaagatgggc

SEQ ID NO: 11655 - DNA, 25 bp, Mus musculus
gggtttcatccaggatcgagcaggg

SEQ ID NO: 11656 - DNA, 25 bp, Mus musculus
catccaggatcgagcagggaggatg

SEQ ID NO: 11657 - DNA, 25 bp, Mus musculus
gccccaggatgcgtccaccaagaag

SEQ ID NO: 11658 - DNA, 25 bp, Mus musculus
cgagtgtctccggcgaattggagat

SEQ ID NO: 11659 - DNA, 25 bp, Mus musculus
ggtcttcttccgggtggcagctgac

SEQ ID NO: 11660 - DNA, 25 bp, Mus musculus
ggttgccctcttctactttgctagc

SEQ ID NO: 11661 - DNA, 25 bp, Mus musculus
ctactttgctagcaaactggtgctc

SEQ ID NO: 11662 - DNA, 25 bp, Mus musculus
tgctagcaaactggtgctcaaggcc

SEQ ID NO: 11663 - DNA, 25 bp, Mus musculus
atgtgattcttgtcatggtaaatac

SEQ ID NO: 11664 - DNA, 25 bp, Mus musculus
catggcttgctgcctattgtaccac

SEQ ID NO: 11665 - DNA, 25 bp, Mus musculus
tggtccctggagcaacctggccaag

SEQ ID NO: 11666 - DNA, 25 bp, Mus musculus
ggctcctgtagaccacaagtttgat

SEQ ID NO: 11667 - DNA, 25 bp, Mus musculus
tcctgtagaccacaagtttgatctg

SEQ ID NO: 11668 - DNA, 25 bp, Mus musculus
tactagttgctgcatcatgttcagt

SEQ ID NO: 11669 - DNA, 25 bp, Mus musculus
ttgctgcatcatgttcagttccagc

SEQ ID NO: 11670 - DNA, 25 bp, Mus musculus
ctgcatcatgttcagttccagcatt

SEQ ID NO: 11671 - DNA, 25 bp, Mus musculus
catcatgttcagttccagcattggt

SEQ ID NO: 11672 - DNA, 25 bp, Mus musculus
gttcagttccagcattggtaacagg

SEQ ID NO: 11673 - DNA, 25 bp, Mus musculus
cagttccagcattggtaacaggcat

SEQ ID NO: 11674 - DNA, 25 bp, Mus musculus
ttccagcattggtaacaggcatcca

SEQ ID NO: 11675 - DNA, 25 bp, Mus musculus
ggcttgctgcctattgtaccacagt

SEQ ID NO: 11676 - DNA, 25 bp, Mus musculus
ctgcctattgtaccacagtggtatg

SEQ ID NO: 11677 - DNA, 25 bp, Mus musculus
gattcccaaagatatccatgctgct

SEQ ID NO: 11678 - DNA, 25 bp, Mus musculus
caccaccaagaccaggtgcagcatc

SEQ ID NO: 11679 - DNA, 25 bp, Mus musculus
taattaccagcctcactgtggtccc

SEQ ID NO: 11680 - DNA, 25 bp, Mus musculus
ttaccagcctcactgtggtccctgg

SEQ ID NO: 11681 - DNA, 25 bp, Mus musculus
ccagcctcactgtggtccctggagc

SEQ ID NO: 11682 - DNA, 25 bp, Mus musculus
tcactgtggtccctggagcaacctg

SEQ ID NO: 11683 - DNA, 25 bp, Mus musculus
acgggacccctagtcagctctcgag

SEQ ID NO: 11684 - DNA, 25 bp, Mus musculus
agctctcgagttctcgagtgtcggg

SEQ ID NO: 11685 - DNA, 25 bp, Mus musculus
aaactccaatgccacttcactctga

SEQ ID NO: 11686 - DNA, 25 bp, Mus musculus
tgccacttcactctgatcctcctga

SEQ ID NO: 11687 - DNA, 25 bp, Mus musculus
atcctcctgacagctctaaggggag

SEQ ID NO: 11688 - DNA, 25 bp, Mus musculus
gagagccgctacctagaggtgcaag

SEQ ID NO: 11689 - DNA, 25 bp, Mus musculus
caagaagccgcagtctacgaccctt

SEQ ID NO: 11690 - DNA, 25 bp, Mus musculus
gcagtctacgaccctttcctgcttt

SEQ ID NO: 11691 - DNA, 25 bp, Mus musculus
tacgaccctttcctgcttttcagcg

SEQ ID NO: 11692 - DNA, 25 bp, Mus musculus
cctttcctgcttttcagcggcaatt

SEQ ID NO: 11693 - DNA, 25 bp, Mus musculus
ttcctgcttttcagcggcaatttga

SEQ ID NO: 11694 - DNA, 25 bp, Mus musculus
ctgcttttcagcggcaatttgaaac

SEQ ID NO: 11695 - DNA, 25 bp, Mus musculus
cgcagccgagcttaacaagctgcag

SEQ ID NO: 11696 - DNA, 25 bp, Mus musculus
taacaagctgcagacacaaggccag

SEQ ID NO: 11697 - DNA, 25 bp, Mus musculus
caagctgcagacacaaggccagcca

SEQ ID NO: 11698 - DNA, 25 bp, Mus musculus
gctgcagacacaaggccagccatgt

SEQ ID NO: 11699 - DNA, 25 bp, Mus musculus
gacacaaggccagccatgtcaccga

SEQ ID NO: 11700 - DNA, 25 bp, Mus musculus
acaaggccagccatgtcaccgaact

SEQ ID NO: 11701 - DNA, 25 bp, Mus musculus
aggccagccatgtcaccgaacttca

SEQ ID NO: 11702 - DNA, 25 bp, Mus musculus
aacttcaaactccaatgccacttca

SEQ ID NO: 11703 - DNA, 25 bp, Mus musculus
caggatgccactgctgaagagggcg

SEQ ID NO: 11704 - DNA, 25 bp, Mus musculus
gtggcttaagtctcctgccatcact

SEQ ID NO: 11705 - DNA, 25 bp, Mus musculus
atgagcatcttcaccatgaggccaa

SEQ ID NO: 11706 - DNA, 25 bp, Mus musculus
agcatcttcaccatgaggccaagcc

SEQ ID NO: 11707 - DNA, 25 bp, Mus musculus
atcttcaccatgaggccaagcccag

SEQ ID NO: 11708 - DNA, 25 bp, Mus musculus
ttcaccatgaggccaagcccaggtt

SEQ ID NO: 11709 - DNA, 25 bp, Mus musculus
accatgaggccaagcccaggttgct

SEQ ID NO: 11710 - DNA, 25 bp, Mus musculus
aggccaagcccaggttgcttctatt

SEQ ID NO: 11711 - DNA, 25 bp, Mus musculus
ccaagcccaggttgcttctatttgc

SEQ ID NO: 11712 - DNA, 25 bp, Mus musculus
agcccaggttgcttctatttgcttc

SEQ ID NO: 11713 - DNA, 25 bp, Mus musculus
tgcttctatttgcttcacctttaac

SEQ ID NO: 11714 - DNA, 25 bp, Mus musculus
caacacatgtacacacgcacacaca

SEQ ID NO: 11715 - DNA, 25 bp, Mus musculus
gcttaagtctcctgccatcactctg

SEQ ID NO: 11716 - DNA, 25 bp, Mus musculus
taagtctcctgccatcactctgtcc

SEQ ID NO: 11717 - DNA, 25 bp, Mus musculus
tctgtccctggggcccaccagcaaa

SEQ ID NO: 11718 - DNA, 25 bp, Mus musculus
gcccaccagcaaagctttgacccta

SEQ ID NO: 11719 - DNA, 25 bp, Mus musculus
caccagcaaagctttgaccctaagc

SEQ ID NO: 11720 - DNA, 25 bp, Mus musculus
cagcaaagctttgaccctaagcatc

SEQ ID NO: 11721 - DNA, 25 bp, Mus musculus
caaagctttgaccctaagcatcaca

SEQ ID NO: 11722 - DNA, 25 bp, Mus musculus
agctttgaccctaagcatcacaccc

SEQ ID NO: 11723 - DNA, 25 bp, Mus musculus
gactcaaccctttggcggcctgcac

SEQ ID NO: 11724 - DNA, 25 bp, Mus musculus
actcaaccctttggcggcctgcaca

SEQ ID NO: 11725 - DNA, 25 bp, Mus musculus
cagtcgtctgcggccccgaaagcag

SEQ ID NO: 11726 - DNA, 25 bp, Mus musculus
agtcgtctgcggccccgaaagcagg

SEQ ID NO: 11727 - DNA, 25 bp, Mus musculus
tctgcggccccgaaagcaggcaccg

SEQ ID NO: 11728 - DNA, 25 bp, Mus musculus
ccgaaagcaggcaccgcaccgggca

SEQ ID NO: 11729 - DNA, 25 bp, Mus musculus
cgaaagcaggcaccgcaccgggcaa

SEQ ID NO: 11730 - DNA, 25 bp, Mus musculus
gaaagcaggcaccgcaccgggcaaa

SEQ ID NO: 11731 - DNA, 25 bp, Mus musculus
gcaggcaccgcaccgggcaaattgt

SEQ ID NO: 11732 - DNA, 25 bp, Mus musculus
caggcaccgcaccgggcaaattgtg

SEQ ID NO: 11733 - DNA, 25 bp, Mus musculus
aggcaccgcaccgggcaaattgtgg

SEQ ID NO: 11734 - DNA, 25 bp, Mus musculus
cgcaccgggcaaattgtggcagtca

SEQ ID NO: 11735 - DNA, 25 bp, Mus musculus
cctgcacagcgcatcttctactacg

SEQ ID NO: 11736 - DNA, 25 bp, Mus musculus
ctgcacagcgcatcttctactacga

SEQ ID NO: 11737 - DNA, 25 bp, Mus musculus
tgcacagcgcatcttctactacgaa

SEQ ID NO: 11738 - DNA, 25 bp, Mus musculus
gcacagcgcatcttctactacgaac

SEQ ID NO: 11739 - DNA, 25 bp, Mus musculus
acagcgcatcttctactacgaaccg

SEQ ID NO: 11740 - DNA, 25 bp, Mus musculus
cagcgcatcttctactacgaaccgc

SEQ ID NO: 11741 - DNA, 25 bp, Mus musculus
agcgcatcttctactacgaaccgct

SEQ ID NO: 11742 - DNA, 25 bp, Mus musculus
gcgcatcttctactacgaaccgctc

SEQ ID NO: 11743 - DNA, 25 bp, Mus musculus
acagtgatcctagctggcccaggcg

SEQ ID NO: 11744 - DNA, 25 bp, Mus musculus
agtgatcctagctggcccaggcggc

SEQ ID NO: 11745 - DNA, 25 bp, Mus musculus
gacttcggctccttgaggagttggc

SEQ ID NO: 11746 - DNA, 25 bp, Mus musculus
ctccttgaggagttggcggcgcacg

SEQ ID NO: 11747 - DNA, 25 bp, Mus musculus
gcattgatgtccagatctcgccgct

SEQ ID NO: 11748 - DNA, 25 bp, Mus musculus
attgatgtccagatctcgccgctgt

SEQ ID NO: 11749 - DNA, 25 bp, Mus musculus
gtccagatctcgccgctgtccaaga

SEQ ID NO: 11750 - DNA, 25 bp, Mus musculus
ccagatctcgccgctgtccaagaaa

SEQ ID NO: 11751 - DNA, 25 bp, Mus musculus
gtcttcagtgccaaccaacgggaat

SEQ ID NO: 11752 - DNA, 25 bp, Mus musculus
cttcagtgccaaccaacgggaatgg

SEQ ID NO: 11753 - DNA, 25 bp, Mus musculus
tcagtgccaaccaacgggaatggcg

SEQ ID NO: 11754 - DNA, 25 bp, Mus musculus
tgccaaccaacgggaatggcgaaga

SEQ ID NO: 11755 - DNA, 25 bp, Mus musculus
tgatcctagctggcccaggcggcag

SEQ ID NO: 11756 - DNA, 25 bp, Mus musculus
atcctagctggcccaggcggcaggg

SEQ ID NO: 11757 - DNA, 25 bp, Mus musculus
cggcacgagcttgacttcggctcct

SEQ ID NO: 11758 - DNA, 25 bp, Mus musculus
gcacgagcttgacttcggctccttg

SEQ ID NO: 11759 - DNA, 25 bp, Mus musculus
acgagcttgacttcggctccttgag

SEQ ID NO: 11760 - DNA, 25 bp, Mus musculus
gagcttgacttcggctccttgagga

SEQ ID NO: 11761 - DNA, 25 bp, Mus musculus
gcttgacttcggctccttgaggagt

SEQ ID NO: 11762 - DNA, 25 bp, Mus musculus
ttgacttcggctccttgaggagttg

SEQ ID NO: 11763 - DNA, 25 bp, Mus musculus
gccggtacctcacagttgccgccgt

SEQ ID NO: 11764 - DNA, 25 bp, Mus musculus
ccaccgcgtggcctcaagatggcag

SEQ ID NO: 11765 - DNA, 25 bp, Mus musculus
cctaacggcagagagccctgcatca

SEQ ID NO: 11766 - DNA, 25 bp, Mus musculus
gctgcttagatccctcagcctttct

SEQ ID NO: 11767 - DNA, 25 bp, Mus musculus
ctgcttagatccctcagcctttctc

SEQ ID NO: 11768 - DNA, 25 bp, Mus musculus
tgcttagatccctcagcctttctcc

SEQ ID NO: 11769 - DNA, 25 bp, Mus musculus
gcttagatccctcagcctttctcca

SEQ ID NO: 11770 - DNA, 25 bp, Mus musculus
ttagatccctcagcctttctccaac

SEQ ID NO: 11771 - DNA, 25 bp, Mus musculus
tagatccctcagcctttctccaact

SEQ ID NO: 11772 - DNA, 25 bp, Mus musculus
tccaactgccctttgtcctccagtt

SEQ ID NO: 11773 - DNA, 25 bp, Mus musculus
tgcttctgttttctcattgggggta

SEQ ID NO: 11774 - DNA, 25 bp, Mus musculus
caccgcgtggcctcaagatggcagt

SEQ ID NO: 11775 - DNA, 25 bp, Mus musculus
accgcgtggcctcaagatggcagtc

SEQ ID NO: 11776 - DNA, 25 bp, Mus musculus
ccgcgtggcctcaagatggcagtca

SEQ ID NO: 11777 - DNA, 25 bp, Mus musculus
catctctgagcagtttacggctatg

SEQ ID NO: 11778 - DNA, 25 bp, Mus musculus
atctctgagcagtttacggctatgt

SEQ ID NO: 11779 - DNA, 25 bp, Mus musculus
tctctgagcagtttacggctatgtt

SEQ ID NO: 11780 - DNA, 25 bp, Mus musculus
ctctgagcagtttacggctatgttc

SEQ ID NO: 11781 - DNA, 25 bp, Mus musculus
aggcctaacggcagagagccctgca

SEQ ID NO: 11782 - DNA, 25 bp, Mus musculus
ggcaaacactgaacgcagtctcgca

SEQ ID NO: 11783 - DNA, 25 bp, Mus musculus
gcaaacactgaacgcagtctcgcag

SEQ ID NO: 11784 - DNA, 25 bp, Mus musculus
tcgcagacgtgctacattgcagtgg

SEQ ID NO: 11785 - DNA, 25 bp, Mus musculus
cgcagacgtgctacattgcagtggc

SEQ ID NO: 11786 - DNA, 25 bp, Mus musculus
cagacgtgctacattgcagtggcac

SEQ ID NO: 11787 - DNA, 25 bp, Mus musculus
agacgtgctacattgcagtggcacg

SEQ ID NO: 11788 - DNA, 25 bp, Mus musculus
gacgtgctacattgcagtggcacgg

SEQ ID NO: 11789 - DNA, 25 bp, Mus musculus
acgtgctacattgcagtggcacggg

SEQ ID NO: 11790 - DNA, 25 bp, Mus musculus
cgtgctacattgcagtggcacgggc

SEQ ID NO: 11791 - DNA, 25 bp, Mus musculus
ccgtcagtccatatcatttgggacc

SEQ ID NO: 11792 - DNA, 25 bp, Mus musculus
gtcagtccatatcatttgggaccaa

SEQ ID NO: 11793 - DNA, 25 bp, Mus musculus
tcagtccatatcatttgggaccaaa

SEQ ID NO: 11794 - DNA, 25 bp, Mus musculus
caaacactgaacgcagtctcgcagg

SEQ ID NO: 11795 - DNA, 25 bp, Mus musculus
aacactgaacgcagtctcgcagggt

SEQ ID NO: 11796 - DNA, 25 bp, Mus musculus
cagtctcgcagggtaagcccgaggc

SEQ ID NO: 11797 - DNA, 25 bp, Mus musculus
agtctcgcagggtaagcccgaggca

SEQ ID NO: 11798 - DNA, 25 bp, Mus musculus
gctagacgtgggctcgcagacgtgc

SEQ ID NO: 11799 - DNA, 25 bp, Mus musculus
ggctcgcagacgtgctacattgcag

SEQ ID NO: 11800 - DNA, 25 bp, Mus musculus
gctcgcagacgtgctacattgcagt

SEQ ID NO: 11801 - DNA, 25 bp, Mus musculus
ctcgcagacgtgctacattgcagtg

SEQ ID NO: 11802 - DNA, 25 bp, Mus musculus
ctgcaccacggatcgcctctcggat

SEQ ID NO: 11803 - DNA, 25 bp, Mus musculus
tcgcctctcggatgccgctagcctg

SEQ ID NO: 11804 - DNA, 25 bp, Mus musculus
tgctatgaccggcaaactcgccgag

SEQ ID NO: 11805 - DNA, 25 bp, Mus musculus
ctatgaccggcaaactcgccgagaa

SEQ ID NO: 11806 - DNA, 25 bp, Mus musculus
gaccggcaaactcgccgagaagctg

SEQ ID NO: 11807 - DNA, 25 bp, Mus musculus
ccggcaaactcgccgagaagctgcc

SEQ ID NO: 11808 - DNA, 25 bp, Mus musculus
ggcaaactcgccgagaagctgccgg

SEQ ID NO: 11809 - DNA, 25 bp, Mus musculus
caaactcgccgagaagctgccggtg

SEQ ID NO: 11810 - DNA, 25 bp, Mus musculus
cgccgagaagctgccggtgaccatg

SEQ ID NO: 11811 - DNA, 25 bp, Mus musculus
gagaagctgccggtgaccatgagca

SEQ ID NO: 11812 - DNA, 25 bp, Mus musculus
gaagctgccggtgaccatgagcagt

SEQ ID NO: 11813 - DNA, 25 bp, Mus musculus
agctgccggtgaccatgagcagttt

SEQ ID NO: 11814 - DNA, 25 bp, Mus musculus
gcctctcggatgccgctagcctgga

SEQ ID NO: 11815 - DNA, 25 bp, Mus musculus
cggatgccgctagcctggaagctgc

SEQ ID NO: 11816 - DNA, 25 bp, Mus musculus
tgccgctagcctggaagctgcgtta

SEQ ID NO: 11817 - DNA, 25 bp, Mus musculus
gctagcctggaagctgcgttaggaa

SEQ ID NO: 11818 - DNA, 25 bp, Mus musculus
tagcctggaagctgcgttaggaaca

SEQ ID NO: 11819 - DNA, 25 bp, Mus musculus
gcctggaagctgcgttaggaacagg

SEQ ID NO: 11820 - DNA, 25 bp, Mus musculus
ctgtagctcgggagtgctatgaccg

SEQ ID NO: 11821 - DNA, 25 bp, Mus musculus
agtgctatgaccggcaaactcgccg

SEQ ID NO: 11822 - DNA, 25 bp, Mus musculus
agataaaactcccataagtgaagat

SEQ ID NO: 11823 - DNA, 25 bp, Mus musculus
tattcaagagaccaatattgcttaa

SEQ ID NO: 11824 - DNA, 25 bp, Mus musculus
gactcattcccagatggacaggaca

SEQ ID NO: 11825 - DNA, 25 bp, Mus musculus
cattcccagatggacaggacatgtc

SEQ ID NO: 11826 - DNA, 25 bp, Mus musculus
tgttacagcctagtagttgagaaaa

SEQ ID NO: 11827 - DNA, 25 bp, Mus musculus
atataaactttgttgccaggattat

SEQ ID NO: 11828 - DNA, 25 bp, Mus musculus
caaacaagcaagcaaaaccctgtca

SEQ ID NO: 11829 - DNA, 25 bp, Mus musculus
caagcaagcaaaaccctgtcaataa

SEQ ID NO: 11830 - DNA, 25 bp, Mus musculus
agcaagcaaaaccctgtcaataata

SEQ ID NO: 11831 - DNA, 25 bp, Mus musculus
caagcaaaaccctgtcaataatagg

SEQ ID NO: 11832 - DNA, 25 bp, Mus musculus
agcaaaaccctgtcaataataggcg

SEQ ID NO: 11833 - DNA, 25 bp, Mus musculus
accctgtcaataataggcggccgcg

SEQ ID NO: 11834 - DNA, 25 bp, Mus musculus
agttatcacaagctggtggcaagct

SEQ ID NO: 11835 - DNA, 25 bp, Mus musculus
gtcaataataggcggccgcgaattc

SEQ ID NO: 11836 - DNA, 25 bp, Mus musculus
ttatcacaagctggtggcaagctac

SEQ ID NO: 11837 - DNA, 25 bp, Mus musculus
atcacaagctggtggcaagctacaa

SEQ ID NO: 11838 - DNA, 25 bp, Mus musculus
gctacaaaagacctgactcattccc

SEQ ID NO: 11839 - DNA, 25 bp, Mus musculus
tacaaaagacctgactcattcccag

SEQ ID NO: 11840 - DNA, 25 bp, Mus musculus
agacctgactcattcccagatggac

SEQ ID NO: 11841 - DNA, 25 bp, Mus musculus
acctgactcattcccagatggacag

SEQ ID NO: 11842 - DNA, 25 bp, Mus musculus
ctgactcattcccagatggacagga

SEQ ID NO: 11843 - DNA, 25 bp, Mus musculus
aggcgtctcaggtgcaaactgtatc

SEQ ID NO: 11844 - DNA, 25 bp, Mus musculus
cgtctcaggtgcaaactgtatcagc

SEQ ID NO: 11845 - DNA, 25 bp, Mus musculus
cacatagatgctgtctcaattagat

SEQ ID NO: 11846 - DNA, 25 bp, Mus musculus
atagatgctgtctcaattagatgct

SEQ ID NO: 11847 - DNA, 25 bp, Mus musculus
gatgctgtctcaattagatgctgtc

SEQ ID NO: 11848 - DNA, 25 bp, Mus musculus
gtctcaattagatgctgtcgagaga

SEQ ID NO: 11849 - DNA, 25 bp, Mus musculus
gtgtcagcttttacaagccattcta

SEQ ID NO: 11850 - DNA, 25 bp, Mus musculus
tcagcttttacaagccattctagaa

SEQ ID NO: 11851 - DNA, 25 bp, Mus musculus
gcttttacaagccattctagaagcc

SEQ ID NO: 11852 - DNA, 25 bp, Mus musculus
tttacaagccattctagaagccctt

SEQ ID NO: 11853 - DNA, 25 bp, Mus musculus
ccttctctgcagatcaccaagattc

SEQ ID NO: 11854 - DNA, 25 bp, Mus musculus
tctctgcagatcaccaagattccac

SEQ ID NO: 11855 - DNA, 25 bp, Mus musculus
ctgtatcagccaaacggtattacct

SEQ ID NO: 11856 - DNA, 25 bp, Mus musculus
ggtattacctttagaccatatgtgt

SEQ ID NO: 11857 - DNA, 25 bp, Mus musculus
attacctttagaccatatgtgtgcc

SEQ ID NO: 11858 - DNA, 25 bp, Mus musculus
agaccatatgtgtgccaacagtaag

SEQ ID NO: 11859 - DNA, 25 bp, Mus musculus
ccatatgtgtgccaacagtaagaag

SEQ ID NO: 11860 - DNA, 25 bp, Mus musculus
gatcacttaaagccattgtgatggg

SEQ ID NO: 11861 - DNA, 25 bp, Mus musculus
cacttaaagccattgtgatgggatt

SEQ ID NO: 11862 - DNA, 25 bp, Mus musculus
ttaaagccattgtgatgggattttc

SEQ ID NO: 11863 - DNA, 25 bp, Mus musculus
gaccaaattcacaagaatcagggcg

SEQ ID NO: 11864 - DNA, 25 bp, Mus musculus
acaggcccgtggacagagattccca

SEQ ID NO: 11865 - DNA, 25 bp, Mus musculus
acaggaaaggcatccctgtggactg

SEQ ID NO: 11866 - DNA, 25 bp, Mus musculus
aaggcatccctgtggactggctcca

SEQ ID NO: 11867 - DNA, 25 bp, Mus musculus
gcatccctgtggactggctccattt

SEQ ID NO: 11868 - DNA, 25 bp, Mus musculus
tccctgtggactggctccattttaa

SEQ ID NO: 11869 - DNA, 25 bp, Mus musculus
aaacgctgggatcaaactggcctgc

SEQ ID NO: 11870 - DNA, 25 bp, Mus musculus
caaactggcctgcaaatcatagtca

SEQ ID NO: 11871 - DNA, 25 bp, Mus musculus
actggcctgcaaatcatagtcagtg

SEQ ID NO: 11872 - DNA, 25 bp, Mus musculus
catcacttcctctgaaggaaaagaa

SEQ ID NO: 11873 - DNA, 25 bp, Mus musculus
atttattgatgacccatggtaaaat

SEQ ID NO: 11874 - DNA, 25 bp, Mus musculus
tattgatgacccatggtaaaatgca

SEQ ID NO: 11875 - DNA, 25 bp, Mus musculus
attcccagaggggcagcagcagacc

SEQ ID NO: 11876 - DNA, 25 bp, Mus musculus
cacctctgcattctgatagaagtct

SEQ ID NO: 11877 - DNA, 25 bp, Mus musculus
ctctgcattctgatagaagtctgaa

SEQ ID NO: 11878 - DNA, 25 bp, Mus musculus
ttcatgcatgcattctcaagaggtc

SEQ ID NO: 11879 - DNA, 25 bp, Mus musculus
atgcatgcattctcaagaggtcttg

SEQ ID NO: 11880 - DNA, 25 bp, Mus musculus
catgcattctcaagaggtcttgcca

SEQ ID NO: 11881 - DNA, 25 bp, Mus musculus
ttctcaagaggtcttgccaatcagc

SEQ ID NO: 11882 - DNA, 25 bp, Mus musculus
agaggtcttgccaatcagccactga

SEQ ID NO: 11883 - DNA, 25 bp, Mus musculus
ctttgcaccagacaggtgctagcat

SEQ ID NO: 11884 - DNA, 25 bp, Mus musculus
tgcaccagacaggtgctagcatgac

SEQ ID NO: 11885 - DNA, 25 bp, Mus musculus
tgaccaagccgaccacaatcattga

SEQ ID NO: 11886 - DNA, 25 bp, Mus musculus
gaccaagccgaccacaatcattgag

SEQ ID NO: 11887 - DNA, 25 bp, Mus musculus
accaagccgaccacaatcattgaga

SEQ ID NO: 11888 - DNA, 25 bp, Mus musculus
caagccgaccacaatcattgagaag

SEQ ID NO: 11889 - DNA, 25 bp, Mus musculus
aagccgaccacaatcattgagaaga

SEQ ID NO: 11890 - DNA, 25 bp, Mus musculus
agccgaccacaatcattgagaagaa

SEQ ID NO: 11891 - DNA, 25 bp, Mus musculus
gccgaccacaatcattgagaagaat

SEQ ID NO: 11892 - DNA, 25 bp, Mus musculus
ccgaccacaatcattgagaagaatg

SEQ ID NO: 11893 - DNA, 25 bp, Mus musculus
cgaccacaatcattgagaagaatgg

SEQ ID NO: 11894 - DNA, 25 bp, Mus musculus
ggtcgtgacactggacggaggcaaa

SEQ ID NO: 11895 - DNA, 25 bp, Mus musculus
gcaccagacaggtgctagcatgacc

SEQ ID NO: 11896 - DNA, 25 bp, Mus musculus
caccagacaggtgctagcatgacca

SEQ ID NO: 11897 - DNA, 25 bp, Mus musculus
gtgctagcatgaccaagccgaccac

SEQ ID NO: 11898 - DNA, 25 bp, Mus musculus
tgctagcatgaccaagccgaccaca

SEQ ID NO: 11899 - DNA, 25 bp, Mus musculus
gctagcatgaccaagccgaccacaa

SEQ ID NO: 11900 - DNA, 25 bp, Mus musculus
ctagcatgaccaagccgaccacaat

SEQ ID NO: 11901 - DNA, 25 bp, Mus musculus
catgaccaagccgaccacaatcatt

SEQ ID NO: 11902 - DNA, 25 bp, Mus musculus
atgaccaagccgaccacaatcattg

SEQ ID NO: 11903 - DNA, 25 bp, Mus musculus
ttcatcctagtgggagtcaggttac

SEQ ID NO: 11904 - DNA, 25 bp, Mus musculus
ttcacagtgcctcttgttggcctct

SEQ ID NO: 11905 - DNA, 25 bp, Mus musculus
ggccagttcatctatagcatcttgt

SEQ ID NO: 11906 - DNA, 25 bp, Mus musculus
ttcatctatagcatcttgtttcctg

SEQ ID NO: 11907 - DNA, 25 bp, Mus musculus
gttccctgagccctctggatcaagt

SEQ ID NO: 11908 - DNA, 25 bp, Mus musculus
tgagccctctggatcaagttttata

SEQ ID NO: 11909 - DNA, 25 bp, Mus musculus
accaaaggcctttagttctcatgca

SEQ ID NO: 11910 - DNA, 25 bp, Mus musculus
tagttctcatgcactatgcactcaa

SEQ ID NO: 11911 - DNA, 25 bp, Mus musculus
tcatgcactatgcactcaagacaaa

SEQ ID NO: 11912 - DNA, 25 bp, Mus musculus
actatgcactcaagacaaatccagg

SEQ ID NO: 11913 - DNA, 25 bp, Mus musculus
cactcaagacaaatccaggcttatt

SEQ ID NO: 11914 - DNA, 25 bp, Mus musculus
tgccaaagaggccatgctgagttag

SEQ ID NO: 11915 - DNA, 25 bp, Mus musculus
ggcctcttggtgggctacagcctgg

SEQ ID NO: 11916 - DNA, 25 bp, Mus musculus
ccagtggctcagcgacgaacagtca

SEQ ID NO: 11917 - DNA, 25 bp, Mus musculus
gctcagcgacgaacagtcagcattg

SEQ ID NO: 11918 - DNA, 25 bp, Mus musculus
cgccgccttcaagcagactatgcct

SEQ ID NO: 11919 - DNA, 25 bp, Mus musculus
gcagactatgcctctcaggcccctt

SEQ ID NO: 11920 - DNA, 25 bp, Mus musculus
tctcaggcccctttcattgtggcac

SEQ ID NO: 11921 - DNA, 25 bp, Mus musculus
ttcattgtggcactgagtggtacct

SEQ ID NO: 11922 - DNA, 25 bp, Mus musculus
ggtacctccgagatgttggctttgg

SEQ ID NO: 11923 - DNA, 25 bp, Mus musculus
ccacgcgtccgggagagacctagat

SEQ ID NO: 11924 - DNA, 25 bp, Mus musculus
cgcgtccgggagagacctagatcca

SEQ ID NO: 11925 - DNA, 25 bp, Mus musculus
cattcagaccttggcgtcaggagat

SEQ ID NO: 11926 - DNA, 25 bp, Mus musculus
attcagaccttggcgtcaggagata

SEQ ID NO: 11927 - DNA, 25 bp, Mus musculus
ttcagaccttggcgtcaggagatac

SEQ ID NO: 11928 - DNA, 25 bp, Mus musculus
tcagaccttggcgtcaggagatacg

SEQ ID NO: 11929 - DNA, 25 bp, Mus musculus
cagaccttggcgtcaggagatacga

SEQ ID NO: 11930 - DNA, 25 bp, Mus musculus
agaccttggcgtcaggagatacgag

SEQ ID NO: 11931 - DNA, 25 bp, Mus musculus
gaccttggcgtcaggagatacgagg

SEQ ID NO: 11932 - DNA, 25 bp, Mus musculus
accttggcgtcaggagatacgaggt

SEQ ID NO: 11933 - DNA, 25 bp, Mus musculus
ccttggcgtcaggagatacgaggtc

SEQ ID NO: 11934 - DNA, 25 bp, Mus musculus
gagacctagatccaaagacggagaa

SEQ ID NO: 11935 - DNA, 25 bp, Mus musculus
gacctagatccaaagacggagaacg

SEQ ID NO: 11936 - DNA, 25 bp, Mus musculus
aaattggcgactgaagcggcctggg

SEQ ID NO: 11937 - DNA, 25 bp, Mus musculus
tttagcattcagaccttggcgtcag

SEQ ID NO: 11938 - DNA, 25 bp, Mus musculus
ttagcattcagaccttggcgtcagg

SEQ ID NO: 11939 - DNA, 25 bp, Mus musculus
tagcattcagaccttggcgtcagga

SEQ ID NO: 11940 - DNA, 25 bp, Mus musculus
agcattcagaccttggcgtcaggag

SEQ ID NO: 11941 - DNA, 25 bp, Mus musculus
gcattcagaccttggcgtcaggaga

SEQ ID NO: 11942 - DNA, 25 bp, Mus musculus
gacaggtccttgagccgcctaacac

SEQ ID NO: 11943 - DNA, 25 bp, Mus musculus
tccttgagccgcctaacactggatg

SEQ ID NO: 11944 - DNA, 25 bp, Mus musculus
atgtatccagctcttgctaggtgct

SEQ ID NO: 11945 - DNA, 25 bp, Mus musculus
ccagctcttgctaggtgctaggtac

SEQ ID NO: 11946 - DNA, 25 bp, Mus musculus
ctcaaagtacatggcctgagttctc

SEQ ID NO: 11947 - DNA, 25 bp, Mus musculus
aagttgaggctgcactgtagagaca

SEQ ID NO: 11948 - DNA, 25 bp, Mus musculus
acctagcaatggcttgggacagaca

SEQ ID NO: 11949 - DNA, 25 bp, Mus musculus
caagtctagccagcctatagaagtg

SEQ ID NO: 11950 - DNA, 25 bp, Mus musculus
agaagtgcctctgtaggagaaagag

SEQ ID NO: 11951 - DNA, 25 bp, Mus musculus
ttagtattcccatttagcccactca

SEQ ID NO: 11952 - DNA, 25 bp, Mus musculus
ccactcagcatacaccctcaaaaga

SEQ ID NO: 11953 - DNA, 25 bp, Mus musculus
tcaggaaaccactagttcctgtcac

SEQ ID NO: 11954 - DNA, 25 bp, Mus musculus
agccgcctaacactggatgacatcg

SEQ ID NO: 11955 - DNA, 25 bp, Mus musculus
gacatcgaacgtttggccagccgct

SEQ ID NO: 11956 - DNA, 25 bp, Mus musculus
ttggccagccgctttctacaccctg

SEQ ID NO: 11957 - DNA, 25 bp, Mus musculus
tttctacaccctgaagtgactgagg

SEQ ID NO: 11958 - DNA, 25 bp, Mus musculus
aatcccaggtcaggccacagctgca

SEQ ID NO: 11959 - DNA, 25 bp, Mus musculus
aggtcaggccacagctgcatgttgc

SEQ ID NO: 11960 - DNA, 25 bp, Mus musculus
atgtgttctcatgtcgcagtttggc

SEQ ID NO: 11961 - DNA, 25 bp, Mus musculus
gtcgcagtttggctcatagtgataa

SEQ ID NO: 11962 - DNA, 25 bp, Mus musculus
ggaaagtcacccgcaaagatggcag

SEQ ID NO: 11963 - DNA, 25 bp, Mus musculus
aaagtcacccgcaaagatggcagtg

SEQ ID NO: 11964 - DNA, 25 bp, Mus musculus
acacgctgctggaactttggactgc

SEQ ID NO: 11965 - DNA, 25 bp, Mus musculus
acgctgctggaactttggactgcat

SEQ ID NO: 11966 - DNA, 25 bp, Mus musculus
gaactttggactgcattctgccgcc

SEQ ID NO: 11967 - DNA, 25 bp, Mus musculus
aactttggactgcattctgccgcca

SEQ ID NO: 11968 - DNA, 25 bp, Mus musculus
ctttggactgcattctgccgccaac

SEQ ID NO: 11969 - DNA, 25 bp, Mus musculus
tttggactgcattctgccgccaact

SEQ ID NO: 11970 - DNA, 25 bp, Mus musculus
ttggactgcattctgccgccaactc

SEQ ID NO: 11971 - DNA, 25 bp, Mus musculus
tggactgcattctgccgccaactcg

SEQ ID NO: 11972 - DNA, 25 bp, Mus musculus
ggactgcattctgccgccaactcgt

SEQ ID NO: 11973 - DNA, 25 bp, Mus musculus
gactgcattctgccgccaactcgtc

SEQ ID NO: 11974 - DNA, 25 bp, Mus musculus
cagtgccagtggacacgctgctgga

SEQ ID NO: 11975 - DNA, 25 bp, Mus musculus
tgccagtggacacgctgctggaact

SEQ ID NO: 11976 - DNA, 25 bp, Mus musculus
gccagtggacacgctgctggaactt

SEQ ID NO: 11977 - DNA, 25 bp, Mus musculus
cagtggacacgctgctggaactttg

SEQ ID NO: 11978 - DNA, 25 bp, Mus musculus
agtggacacgctgctggaactttgg

SEQ ID NO: 11979 - DNA, 25 bp, Mus musculus
gtggacacgctgctggaactttgga

SEQ ID NO: 11980 - DNA, 25 bp, Mus musculus
ggacacgctgctggaactttggact

SEQ ID NO: 11981 - DNA, 25 bp, Mus musculus
gacacgctgctggaactttggactg

SEQ ID NO: 11982 - DNA, 25 bp, Mus musculus
tctctttgttgtccgagagttataa

SEQ ID NO: 11983 - DNA, 25 bp, Mus musculus
gttataaccctcatgtgcgctacgg

SEQ ID NO: 11984 - DNA, 25 bp, Mus musculus
agcctcagctctcatcatgatccaa

SEQ ID NO: 11985 - DNA, 25 bp, Mus musculus
catcatgatccaacagaccgaaatc

SEQ ID NO: 11986 - DNA, 25 bp, Mus musculus
gatccaacagaccgaaatcacgtgt

SEQ ID NO: 11987 - DNA, 25 bp, Mus musculus
acagaccgaaatcacgtgtccaaag

SEQ ID NO: 11988 - DNA, 25 bp, Mus musculus
ggtaaaccagttccggcagctgtat

SEQ ID NO: 11989 - DNA, 25 bp, Mus musculus
ccagttccggcagctgtattccaaa

SEQ ID NO: 11990 - DNA, 25 bp, Mus musculus
ccggcagctgtattccaaagtcatc

SEQ ID NO: 11991 - DNA, 25 bp, Mus musculus
gctgtattccaaagtcatcaatgac

SEQ ID NO: 11992 - DNA, 25 bp, Mus musculus
ttccaaagtcatcaatgacaagcat

SEQ ID NO: 11993 - DNA, 25 bp, Mus musculus
tgtcatggccaaatttggcgctatt

SEQ ID NO: 11994 - DNA, 25 bp, Mus musculus
atgtgcgctacggcgtgcaatggcc

SEQ ID NO: 11995 - DNA, 25 bp, Mus musculus
aatggccctgggagtctgctgtgct

SEQ ID NO: 11996 - DNA, 25 bp, Mus musculus
cctgggagtctgctgtgctggtaca

SEQ ID NO: 11997 - DNA, 25 bp, Mus musculus
taatttactggagccaatgaccaat

SEQ ID NO: 11998 - DNA, 25 bp, Mus musculus
gaccaatgaccctgtgaactacgtg

SEQ ID NO: 11999 - DNA, 25 bp, Mus musculus
tgaccctgtgaactacgtgcggcaa

SEQ ID NO: 12000 - DNA, 25 bp, Mus musculus
tgtgaactacgtgcggcaaggggct

SEQ ID NO: 12001 - DNA, 25 bp, Mus musculus
ctacgtgcggcaaggggctctgata

SEQ ID NO: 12002 - DNA, 25 bp, Mus musculus
agagccatctgcatgggatcaaacc

SEQ ID NO: 12003 - DNA, 25 bp, Mus musculus
gagttatagccaccacagaaagctt

SEQ ID NO: 12004 - DNA, 25 bp, Mus musculus
acccaagcgtaccaagctgtgcgat

SEQ ID NO: 12005 - DNA, 25 bp, Mus musculus
gcgtaccaagctgtgcgatgtccat

SEQ ID NO: 12006 - DNA, 25 bp, Mus musculus
caagctgtgcgatgtccatgtacac

SEQ ID NO: 12007 - DNA, 25 bp, Mus musculus
ggtttgtggcttcttttctgcgact

SEQ ID NO: 12008 - DNA, 25 bp, Mus musculus
tggcttcttttctgcgactcgggtc

SEQ ID NO: 12009 - DNA, 25 bp, Mus musculus
cctggaacgtcatcatgtttgtgtg

SEQ ID NO: 12010 - DNA, 25 bp, Mus musculus
acgtcatcatgtttgtgtgctttga

SEQ ID NO: 12011 - DNA, 25 bp, Mus musculus
tcatgtttgtgtgctttgaacagct

SEQ ID NO: 12012 - DNA, 25 bp, Mus musculus
attgtaccacataagcaacttggag

SEQ ID NO: 12013 - DNA, 25 bp, Mus musculus
gcttctatgctgggagaccacgaat

SEQ ID NO: 12014 - DNA, 25 bp, Mus musculus
tagccaccacagaaagcttgtcaac

SEQ ID NO: 12015 - DNA, 25 bp, Mus musculus
atgtcatcatcaattgtacagagct

SEQ ID NO: 12016 - DNA, 25 bp, Mus musculus
tggtaacatatgacctcatgaaggg

SEQ ID NO: 12017 - DNA, 25 bp, Mus musculus
ttgtaaacaacaaaatactggcaga

SEQ ID NO: 12018 - DNA, 25 bp, Mus musculus
gccatttactgtcagctcttgttgc

SEQ ID NO: 12019 - DNA, 25 bp, Mus musculus
ttgttgccgggttttgcaccacact

SEQ ID NO: 12020 - DNA, 25 bp, Mus musculus
caagattcatcaactctctgccagg

SEQ ID NO: 12021 - DNA, 25 bp, Mus musculus
tgccaggacagtacccaagcgtacc

SEQ ID NO: 12022 - DNA, 25 bp, Mus musculus
cttgtccgcaaaactctggacatga

SEQ ID NO: 12023 - DNA, 25 bp, Mus musculus
tataatgacactttctggaaagaat

SEQ ID NO: 12024 - DNA, 25 bp, Mus musculus
cactcaaatcgaacacggcttgcta

SEQ ID NO: 12025 - DNA, 25 bp, Mus musculus
tcaaatcgaacacggcttgctaaac

SEQ ID NO: 12026 - DNA, 25 bp, Mus musculus
aggttccagtcttctcaccattcaa

SEQ ID NO: 12027 - DNA, 25 bp, Mus musculus
ttccagtcttctcaccattcaactg

SEQ ID NO: 12028 - DNA, 25 bp, Mus musculus
cagtcttctcaccattcaactgaca

SEQ ID NO: 12029 - DNA, 25 bp, Mus musculus
tctcaccattcaactgacattacta

SEQ ID NO: 12030 - DNA, 25 bp, Mus musculus
caccattcaactgacattactagtt

SEQ ID NO: 12031 - DNA, 25 bp, Mus musculus
cattcaactgacattactagtttag

SEQ ID NO: 12032 - DNA, 25 bp, Mus musculus
gacaaaatctacttcatggctgggt

SEQ ID NO: 12033 - DNA, 25 bp, Mus musculus
ttcatggctgggtcaagcagaaaag

SEQ ID NO: 12034 - DNA, 25 bp, Mus musculus
aatgacactttctggaaagaatttg

SEQ ID NO: 12035 - DNA, 25 bp, Mus musculus
gaatttggcaccaatatcaagcttg

SEQ ID NO: 12036 - DNA, 25 bp, Mus musculus
tttggcaccaatatcaagcttggtg

SEQ ID NO: 12037 - DNA, 25 bp, Mus musculus
ggcaccaatatcaagcttggtgtga

SEQ ID NO: 12038 - DNA, 25 bp, Mus musculus
aatatcaagcttggtgtgattgaag

SEQ ID NO: 12039 - DNA, 25 bp, Mus musculus
atcaagcttggtgtgattgaagatc

SEQ ID NO: 12040 - DNA, 25 bp, Mus musculus
attgaagatcactcaaatcgaacac

SEQ ID NO: 12041 - DNA, 25 bp, Mus musculus
gatcactcaaatcgaacacggcttg

SEQ ID NO: 12042 - DNA, 25 bp, Mus musculus
acagcacatgggggctttgcacttt

SEQ ID NO: 12043 - DNA, 25 bp, Mus musculus
caggaactgcatccttgggaccatc

SEQ ID NO: 12044 - DNA, 25 bp, Mus musculus
agctcctttggccatattaaccaca

SEQ ID NO: 12045 - DNA, 25 bp, Mus musculus
tttggccatattaaccacacaagct

SEQ ID NO: 12046 - DNA, 25 bp, Mus musculus
cgacccagaggtgcctttgtgcctt

SEQ ID NO: 12047 - DNA, 25 bp, Mus musculus
agaggtgcctttgtgccttcctcag

SEQ ID NO: 12048 - DNA, 25 bp, Mus musculus
gcctttgtgccttcctcagcctgga

SEQ ID NO: 12049 - DNA, 25 bp, Mus musculus
gtgccttcctcagcctggagggcct

SEQ ID NO: 12050 - DNA, 25 bp, Mus musculus
ttggctcccaaccagatgtcccaca

SEQ ID NO: 12051 - DNA, 25 bp, Mus musculus
cccaaccagatgtcccacagggtgg

SEQ ID NO: 12052 - DNA, 25 bp, Mus musculus
caccgcctggattgaccactgttaa

SEQ ID NO: 12053 - DNA, 25 bp, Mus musculus
agtgcctgcctctgtatatcctatt

SEQ ID NO: 12054 - DNA, 25 bp, Mus musculus
ctgcatccttgggaccatcaggaaa

SEQ ID NO: 12055 - DNA, 25 bp, Mus musculus
ttctggagctcctccagagcctttg

SEQ ID NO: 12056 - DNA, 25 bp, Mus musculus
agctcctccagagcctttgttcttt

SEQ ID NO: 12057 - DNA, 25 bp, Mus musculus
tccagagcctttgttctttctgggg

SEQ ID NO: 12058 - DNA, 25 bp, Mus musculus
tcctcaggagtgagccaggcccagc

SEQ ID NO: 12059 - DNA, 25 bp, Mus musculus
tgacccacctggctcaagttgtata

SEQ ID NO: 12060 - DNA, 25 bp, Mus musculus
acctggctcaagttgtatatataga

SEQ ID NO: 12061 - DNA, 25 bp, Mus musculus
atatagagctcctttggccatatta

SEQ ID NO: 12062 - DNA, 25 bp, Mus musculus
tgtcgaactgtccccctggctggac

SEQ ID NO: 12063 - DNA, 25 bp, Mus musculus
ctggctggacatgtggggtttgaca

SEQ ID NO: 12064 - DNA, 25 bp, Mus musculus
ggcttctgcttcaacatcctgtgcg

SEQ ID NO: 12065 - DNA, 25 bp, Mus musculus
ttctgcttcaacatcctgtgcgtgg

SEQ ID NO: 12066 - DNA, 25 bp, Mus musculus
ctcatggataccctgttcaacacca

SEQ ID NO: 12067 - DNA, 25 bp, Mus musculus
atggataccctgttcaacaccaagt

SEQ ID NO: 12068 - DNA, 25 bp, Mus musculus
gataccctgttcaacaccaagtttg

SEQ ID NO: 12069 - DNA, 25 bp, Mus musculus
gagccaacgactcacacacagccag

SEQ ID NO: 12070 - DNA, 25 bp, Mus musculus
ccaacgactcacacacagccaggtg

SEQ ID NO: 12071 - DNA, 25 bp, Mus musculus
actcacacacagccaggtgttcagc

SEQ ID NO: 12072 - DNA, 25 bp, Mus musculus
cacacacagccaggtgttcagctcc

SEQ ID NO: 12073 - DNA, 25 bp, Mus musculus
acacagccaggtgttcagctccggt

SEQ ID NO: 12074 - DNA, 25 bp, Mus musculus
tttgacagcttgcctgaccagctgg

SEQ ID NO: 12075 - DNA, 25 bp, Mus musculus
cagccaggtgttcagctccggtcca

SEQ ID NO: 12076 - DNA, 25 bp, Mus musculus
gacagcttgcctgaccagctggtga

SEQ ID NO: 12077 - DNA, 25 bp, Mus musculus
ttgcctgaccagctggtgaataagt

SEQ ID NO: 12078 - DNA, 25 bp, Mus musculus
cctgaccagctggtgaataagtcag

SEQ ID NO: 12079 - DNA, 25 bp, Mus musculus
tcagtcagccagggcttctgcttca

SEQ ID NO: 12080 - DNA, 25 bp, Mus musculus
gtcagccagggcttctgcttcaaca

SEQ ID NO: 12081 - DNA, 25 bp, Mus musculus
agccagggcttctgcttcaacatcc

SEQ ID NO: 12082 - DNA, 25 bp, Mus musculus
cagggcttctgcttcaacatcctgt

SEQ ID NO: 12083 - DNA, 25 bp, Mus musculus
accagtgcggcctgcgacgactaaa

SEQ ID NO: 12084 - DNA, 25 bp, Mus musculus
gcggcctgcgacgactaaagccacc

SEQ ID NO: 12085 - DNA, 25 bp, Mus musculus
cctctgacggctcgggcacacttgt

SEQ ID NO: 12086 - DNA, 25 bp, Mus musculus
ctgacggctcgggcacacttgtgga

SEQ ID NO: 12087 - DNA, 25 bp, Mus musculus
cgggcacacttgtggacactcgagg

SEQ ID NO: 12088 - DNA, 25 bp, Mus musculus
gcacacttgtggacactcgagggca

SEQ ID NO: 12089 - DNA, 25 bp, Mus musculus
cacttgtggacactcgagggcacac

SEQ ID NO: 12090 - DNA, 25 bp, Mus musculus
tggacactcgagggcacacacacac

SEQ ID NO: 12091 - DNA, 25 bp, Mus musculus
gagggcacacacacacccatgcaca

SEQ ID NO: 12092 - DNA, 25 bp, Mus musculus
acacactcacactgtatgtatgtct

SEQ ID NO: 12093 - DNA, 25 bp, Mus musculus
cactcacactgtatgtatgtctgta

SEQ ID NO: 12094 - DNA, 25 bp, Mus musculus
tcacactgtatgtatgtctgtagct

SEQ ID NO: 12095 - DNA, 25 bp, Mus musculus
gcctgcgacgactaaagccaccagc

SEQ ID NO: 12096 - DNA, 25 bp, Mus musculus
agcacatatggctacaggcctagat

SEQ ID NO: 12097 - DNA, 25 bp, Mus musculus
gacgactaaagccaccagcgtctca

SEQ ID NO: 12098 - DNA, 25 bp, Mus musculus
gactaaagccaccagcgtctcagtg

SEQ ID NO: 12099 - DNA, 25 bp, Mus musculus
taaagccaccagcgtctcagtgttg

SEQ ID NO: 12100 - DNA, 25 bp, Mus musculus
agccaccagcgtctcagtgttgacg

SEQ ID NO: 12101 - DNA, 25 bp, Mus musculus
ggatgtttccagtgtgtgcctctga

SEQ ID NO: 12102 - DNA, 25 bp, Mus musculus
tgtttccagtgtgtgcctctgacgg

SEQ ID NO: 12103 - DNA, 25 bp, Mus musculus
gtgcctctgacggctcgggcacact

SEQ ID NO: 12104 - DNA, 25 bp, Mus musculus
ctccttcctctttgcaataaactgc

SEQ ID NO: 12105 - DNA, 25 bp, Mus musculus
ccttcctctttgcaataaactgcga

SEQ ID NO: 12106 - DNA, 25 bp, Mus musculus
tctcacctgcctgtgtgcaatggtc

SEQ ID NO: 12107 - DNA, 25 bp, Mus musculus
tcacctgcctgtgtgcaatggtctt

SEQ ID NO: 12108 - DNA, 25 bp, Mus musculus
acctgcctgtgtgcaatggtctttt

SEQ ID NO: 12109 - DNA, 25 bp, Mus musculus
ttctgtacctgctggagccagagca

SEQ ID NO: 12110 - DNA, 25 bp, Mus musculus
ctgtacctgctggagccagagcatt

SEQ ID NO: 12111 - DNA, 25 bp, Mus musculus
gtacctgctggagccagagcattgg

SEQ ID NO: 12112 - DNA, 25 bp, Mus musculus
acctgctggagccagagcattggag

SEQ ID NO: 12113 - DNA, 25 bp, Mus musculus
acagctgagtcctgccctggtgcca

SEQ ID NO: 12114 - DNA, 25 bp, Mus musculus
gtcctgccctggtgccacacaagat

SEQ ID NO: 12115 - DNA, 25 bp, Mus musculus
tgccctggtgccacacaagatccca

SEQ ID NO: 12116 - DNA, 25 bp, Mus musculus
ttcctctttgcaataaactgcgagc

SEQ ID NO: 12117 - DNA, 25 bp, Mus musculus
tctttgcaataaactgcgagcatct

SEQ ID NO: 12118 - DNA, 25 bp, Mus musculus
caataaactgcgagcatctcacctg

SEQ ID NO: 12119 - DNA, 25 bp, Mus musculus
aaactgcgagcatctcacctgcctg

SEQ ID NO: 12120 - DNA, 25 bp, Mus musculus
actgcgagcatctcacctgcctgtg

SEQ ID NO: 12121 - DNA, 25 bp, Mus musculus
tgcgagcatctcacctgcctgtgtg

SEQ ID NO: 12122 - DNA, 25 bp, Mus musculus
cgagcatctcacctgcctgtgtgca

SEQ ID NO: 12123 - DNA, 25 bp, Mus musculus
catctcacctgcctgtgtgcaatgg

SEQ ID NO: 12124 - DNA, 25 bp, Mus musculus
tagttcattatctgatcagttgaaa

SEQ ID NO: 12125 - DNA, 25 bp, Mus musculus
tacattatacattcagcacatttaa

SEQ ID NO: 12126 - DNA, 25 bp, Mus musculus
tttcagtgacagcccacagtttccc

SEQ ID NO: 12127 - DNA, 25 bp, Mus musculus
agctgacggctttctcccctggatt

SEQ ID NO: 12128 - DNA, 25 bp, Mus musculus
actgccgtggccttctccagtgtta

SEQ ID NO: 12129 - DNA, 25 bp, Mus musculus
ttctccagtgttagtcattcttcat

SEQ ID NO: 12130 - DNA, 25 bp, Mus musculus
agtcattcttcattgtgttcatgca

SEQ ID NO: 12131 - DNA, 25 bp, Mus musculus
tcttcattgtgttcatgcattatgg

SEQ ID NO: 12132 - DNA, 25 bp, Mus musculus
tcatgcattatgggtggcaagacct

SEQ ID NO: 12133 - DNA, 25 bp, Mus musculus
tgatggccctgtgtttgagataata

SEQ ID NO: 12134 - DNA, 25 bp, Mus musculus
tgcttgtgccggaatttgatgaaaa

SEQ ID NO: 12135 - DNA, 25 bp, Mus musculus
gcaagtacatcttctattgtgttcc

SEQ ID NO: 12136 - DNA, 25 bp, Mus musculus
ataacaatctaattgctggccacac

SEQ ID NO: 12137 - DNA, 25 bp, Mus musculus
gtgcttttccagtatcttcagtcta

SEQ ID NO: 12138 - DNA, 25 bp, Mus musculus
ttccagtatcttcagtctagacaac

SEQ ID NO: 12139 - DNA, 25 bp, Mus musculus
tatcttcagtctagacaactcttgc

SEQ ID NO: 12140 - DNA, 25 bp, Mus musculus
cagtctagacaactcttgccatctg

SEQ ID NO: 12141 - DNA, 25 bp, Mus musculus
ctcttgccatctgtggtaatttaca

SEQ ID NO: 12142 - DNA, 25 bp, Mus musculus
ctggcactctgctttcagtgacagc

SEQ ID NO: 12143 - DNA, 25 bp, Mus musculus
ctctgctttcagtgacagcccacag

SEQ ID NO: 12144 - DNA, 25 bp, Mus musculus
attcggcactagggcagcagcagcg

SEQ ID NO: 12145 - DNA, 25 bp, Mus musculus
cagacggacgctggtaccaaggcct

SEQ ID NO: 12146 - DNA, 25 bp, Mus musculus
gcatcatgtctgtgaatggaaagaa

SEQ ID NO: 12147 - DNA, 25 bp, Mus musculus
aggtgctgcacatggaccgaaaccc

SEQ ID NO: 12148 - DNA, 25 bp, Mus musculus
gtgctgcacatggaccgaaacccct

SEQ ID NO: 12149 - DNA, 25 bp, Mus musculus
tgcacatggaccgaaacccctacta

SEQ ID NO: 12150 - DNA, 25 bp, Mus musculus
cacatggaccgaaacccctactatg

SEQ ID NO: 12151 - DNA, 25 bp, Mus musculus
cacccctggaggagctatataagcg

SEQ ID NO: 12152 - DNA, 25 bp, Mus musculus
agctatataagcgctttcagatact

SEQ ID NO: 12153 - DNA, 25 bp, Mus musculus
ctatataagcgctttcagatactgg

SEQ ID NO: 12154 - DNA, 25 bp, Mus musculus
tatataagcgctttcagatactgga

SEQ ID NO: 12155 - DNA, 25 bp, Mus musculus
atataagcgctttcagatactggaa

SEQ ID NO: 12156 - DNA, 25 bp, Mus musculus
gacgctggtaccaaggcctgatcat

SEQ ID NO: 12157 - DNA, 25 bp, Mus musculus
ataagcgctttcagatactggaagg

SEQ ID NO: 12158 - DNA, 25 bp, Mus musculus
cgctggtaccaaggcctgatcatgg

SEQ ID NO: 12159 - DNA, 25 bp, Mus musculus
ctggtaccaaggcctgatcatggat

SEQ ID NO: 12160 - DNA, 25 bp, Mus musculus
atacgatgtgattgtgctggggaca

SEQ ID NO: 12161 - DNA, 25 bp, Mus musculus
gaatgcatcctgtctggcatcatgt

SEQ ID NO: 12162 - DNA, 25 bp, Mus musculus
atgcatcctgtctggcatcatgtct

SEQ ID NO: 12163 - DNA, 25 bp, Mus musculus
tctggcatcatgtctgtgaatggaa

SEQ ID NO: 12164 - DNA, 25 bp, Mus musculus
tggcatcatgtctgtgaatggaaag

SEQ ID NO: 12165 - DNA, 25 bp, Mus musculus
tttgaaggactccactgtcttgcag

SEQ ID NO: 12166 - DNA, 25 bp, Mus musculus
ggactccactgtcttgcagaatact

SEQ ID NO: 12167 - DNA, 25 bp, Mus musculus
gtctcggacagacaaggtggaagtc

SEQ ID NO: 12168 - DNA, 25 bp, Mus musculus
tgaccaacaggttcagtttgggaga

SEQ ID NO: 12169 - DNA, 25 bp, Mus musculus
tgacaacactgagtgtctggccaag

SEQ ID NO: 12170 - DNA, 25 bp, Mus musculus
cggcaaaaccacatcggagaagtat

SEQ ID NO: 12171 - DNA, 25 bp, Mus musculus
gtacgtcatagcgaccgagcgcctg

SEQ ID NO: 12172 - DNA, 25 bp, Mus musculus
catagcgaccgagcgcctgaagcag

SEQ ID NO: 12173 - DNA, 25 bp, Mus musculus
agcctgcgcttttcttacccagtga

SEQ ID NO: 12174 - DNA, 25 bp, Mus musculus
tcttacccagtgaaaacactgagca

SEQ ID NO: 12175 - DNA, 25 bp, Mus musculus
cttcccaggaagtctcatcccggag

SEQ ID NO: 12176 - DNA, 25 bp, Mus musculus
aggaagtctcatcccggagccacgg

SEQ ID NO: 12177 - DNA, 25 bp, Mus musculus
cactgtcttgcagaatactgacggg

SEQ ID NO: 12178 - DNA, 25 bp, Mus musculus
ctttgagcttttgtgccttgatgac

SEQ ID NO: 12179 - DNA, 25 bp, Mus musculus
gcttttgtgccttgatgacacccgg

SEQ ID NO: 12180 - DNA, 25 bp, Mus musculus
gtgccttgatgacacccggaaacct

SEQ ID NO: 12181 - DNA, 25 bp, Mus musculus
taagaactgccacctagccatagcc

SEQ ID NO: 12182 - DNA, 25 bp, Mus musculus
cccaaaccatgctgtagtgtctcgg

SEQ ID NO: 12183 - DNA, 25 bp, Mus musculus
ccatgctgtagtgtctcggacagac

SEQ ID NO: 12184 - DNA, 25 bp, Mus musculus
tgtagtgtctcggacagacaaggtg

SEQ ID NO: 12185 - DNA, 25 bp, Mus musculus
ttaatgttgcaactcaggctatgaa

SEQ ID NO: 12186 - DNA, 25 bp, Mus musculus
atgttgcaactcaggctatgaacag

SEQ ID NO: 12187 - DNA, 25 bp, Mus musculus
aatgtggccttgttacacaaagtgc

SEQ ID NO: 12188 - DNA, 25 bp, Mus musculus
cacaaagtgcaacccagaaaactga

SEQ ID NO: 12189 - DNA, 25 bp, Mus musculus
gtgcaacccagaaaactgatccaaa

SEQ ID NO: 12190 - DNA, 25 bp, Mus musculus
caacccagaaaactgatccaaagag

SEQ ID NO: 12191 - DNA, 25 bp, Mus musculus
cccagaaaactgatccaaagagact

SEQ ID NO: 12192 - DNA, 25 bp, Mus musculus
atgaaacttgtctctcattttaaga

SEQ ID NO: 12193 - DNA, 25 bp, Mus musculus
gagttgtcagatcccatggagctgg

SEQ ID NO: 12194 - DNA, 25 bp, Mus musculus
ttgtcagatcccatggagctggcat

SEQ ID NO: 12195 - DNA, 25 bp, Mus musculus
tcagatcccatggagctggcattaa

SEQ ID NO: 12196 - DNA, 25 bp, Mus musculus
gatcccatggagctggcattaaagc

SEQ ID NO: 12197 - DNA, 25 bp, Mus musculus
caactcaggctatgaacagtgcata

SEQ ID NO: 12198 - DNA, 25 bp, Mus musculus
catacatctaatatcacacaggcta

SEQ ID NO: 12199 - DNA, 25 bp, Mus musculus
acatctaatatcacacaggctaaaa

SEQ ID NO: 12200 - DNA, 25 bp, Mus musculus
tctaatatcacacaggctaaaatgg

SEQ ID NO: 12201 - DNA, 25 bp, Mus musculus
aatatcacacaggctaaaatggaca

SEQ ID NO: 12202 - DNA, 25 bp, Mus musculus
atcacacaggctaaaatggacagga

SEQ ID NO: 12203 - DNA, 25 bp, Mus musculus
tagattctgtggtctgcatagtgag

SEQ ID NO: 12204 - DNA, 25 bp, Mus musculus
attctgtggtctgcatagtgagcaa

SEQ ID NO: 12205 - DNA, 25 bp, Mus musculus
cttccagccacatcagcaaggagag

SEQ ID NO: 12206 - DNA, 25 bp, Mus musculus
tccagccacatcagcaaggagagca

SEQ ID NO: 12207 - DNA, 25 bp, Mus musculus
agagaccacctcagctgcaacctca

SEQ ID NO: 12208 - DNA, 25 bp, Mus musculus
agaccacctcagctgcaacctcaga

SEQ ID NO: 12209 - DNA, 25 bp, Mus musculus
accacctcagctgcaacctcagagg

SEQ ID NO: 12210 - DNA, 25 bp, Mus musculus
cacctcagctgcaacctcagaggga

SEQ ID NO: 12211 - DNA, 25 bp, Mus musculus
cctcagctgcaacctcagagggaaa

SEQ ID NO: 12212 - DNA, 25 bp, Mus musculus
tcagctgcaacctcagagggaaaac

SEQ ID NO: 12213 - DNA, 25 bp, Mus musculus
agctgcaacctcagagggaaaactg

SEQ ID NO: 12214 - DNA, 25 bp, Mus musculus
ctgcaacctcagagggaaaactgac

SEQ ID NO: 12215 - DNA, 25 bp, Mus musculus
ggaaaactgaccatgctgagccagg

SEQ ID NO: 12216 - DNA, 25 bp, Mus musculus
gctgagccaggcagtgcagaaagaa

SEQ ID NO: 12217 - DNA, 25 bp, Mus musculus
cagccacatcagcaaggagagcact

SEQ ID NO: 12218 - DNA, 25 bp, Mus musculus
tccatcttcaacgaagagctggtgt

SEQ ID NO: 12219 - DNA, 25 bp, Mus musculus
catcttcaacgaagagctggtgtcc

SEQ ID NO: 12220 - DNA, 25 bp, Mus musculus
tcttcaacgaagagctggtgtccga

SEQ ID NO: 12221 - DNA, 25 bp, Mus musculus
ggacagaatctaccaaaccacagag

SEQ ID NO: 12222 - DNA, 25 bp, Mus musculus
acagaatctaccaaaccacagagtc

SEQ ID NO: 12223 - DNA, 25 bp, Mus musculus
aggaagagaccacctcagctgcaac

SEQ ID NO: 12224 - DNA, 25 bp, Mus musculus
gaagagaccacctcagctgcaacct

SEQ ID NO: 12225 - DNA, 25 bp, Mus musculus
caatcaaacactatcaaaagctgcc

SEQ ID NO: 12226 - DNA, 25 bp, Mus musculus
atcaaacactatcaaaagctgccca

SEQ ID NO: 12227 - DNA, 25 bp, Mus musculus
ctgcccagtctggccgatggaaata

SEQ ID NO: 12228 - DNA, 25 bp, Mus musculus
gaaatacggtcagcacacaagcttt

SEQ ID NO: 12229 - DNA, 25 bp, Mus musculus
aatacggtcagcacacaagcttttg

SEQ ID NO: 12230 - DNA, 25 bp, Mus musculus
atacggtcagcacacaagcttttgt

SEQ ID NO: 12231 - DNA, 25 bp, Mus musculus
acggtcagcacacaagcttttgtca

SEQ ID NO: 12232 - DNA, 25 bp, Mus musculus
cggtcagcacacaagcttttgtcag

SEQ ID NO: 12233 - DNA, 25 bp, Mus musculus
gtcagcacacaagcttttgtcagaa

SEQ ID NO: 12234 - DNA, 25 bp, Mus musculus
tcagcacacaagcttttgtcagaaa

SEQ ID NO: 12235 - DNA, 25 bp, Mus musculus
agcacacaagcttttgtcagaaaca

SEQ ID NO: 12236 - DNA, 25 bp, Mus musculus
gcacacaagcttttgtcagaaacaa

SEQ ID NO: 12237 - DNA, 25 bp, Mus musculus
tcaaacactatcaaaagctgcccag

SEQ ID NO: 12238 - DNA, 25 bp, Mus musculus
aacactatcaaaagctgcccagtct

SEQ ID NO: 12239 - DNA, 25 bp, Mus musculus
cactatcaaaagctgcccagtctgg

SEQ ID NO: 12240 - DNA, 25 bp, Mus musculus
actatcaaaagctgcccagtctggc

SEQ ID NO: 12241 - DNA, 25 bp, Mus musculus
tatcaaaagctgcccagtctggccg

SEQ ID NO: 12242 - DNA, 25 bp, Mus musculus
atcaaaagctgcccagtctggccga

SEQ ID NO: 12243 - DNA, 25 bp, Mus musculus
aagctgcccagtctggccgatggaa

SEQ ID NO: 12244 - DNA, 25 bp, Mus musculus
agctgcccagtctggccgatggaaa

SEQ ID NO: 12245 - DNA, 25 bp, Mus musculus
aagagaaaccctgctttctgagaag

SEQ ID NO: 12246 - DNA, 25 bp, Mus musculus
gtttggtgcacagtggcatgtgtct

SEQ ID NO: 12247 - DNA, 25 bp, Mus musculus
aaccaagcctccagcaaatttgatg

SEQ ID NO: 12248 - DNA, 25 bp, Mus musculus
gcctccagcaaatttgatgttgtcc

SEQ ID NO: 12249 - DNA, 25 bp, Mus musculus
ctctagttctttgctgttcattgag

SEQ ID NO: 12250 - DNA, 25 bp, Mus musculus
ttctttgctgttcattgagatgggc

SEQ ID NO: 12251 - DNA, 25 bp, Mus musculus
cttgttctctcagaattttccagcc

SEQ ID NO: 12252 - DNA, 25 bp, Mus musculus
ctctcagaattttccagccgccttc

SEQ ID NO: 12253 - DNA, 25 bp, Mus musculus
tttcagtttctcacagactcctaga

SEQ ID NO: 12254 - DNA, 25 bp, Mus musculus
acagactcctagaagttctgttttg

SEQ ID NO: 12255 - DNA, 25 bp, Mus musculus
ccccactgcccttgataaagtgatt

SEQ ID NO: 12256 - DNA, 25 bp, Mus musculus
cactgcccttgataaagtgattcta

SEQ ID NO: 12257 - DNA, 25 bp, Mus musculus
tgtgtctcatggattccaaagagtg

SEQ ID NO: 12258 - DNA, 25 bp, Mus musculus
gaagaccctgcaatgagcatggtgc

SEQ ID NO: 12259 - DNA, 25 bp, Mus musculus
atgagcatggtgcagccatgaagac

SEQ ID NO: 12260 - DNA, 25 bp, Mus musculus
cagccatgaagacccacctgcaggg

SEQ ID NO: 12261 - DNA, 25 bp, Mus musculus
caccccagtagtctggccacagtaa

SEQ ID NO: 12262 - DNA, 25 bp, Mus musculus
agtagtctggccacagtaaaccaag

SEQ ID NO: 12263 - DNA, 25 bp, Mus musculus
ctggccacagtaaaccaagcctcca

SEQ ID NO: 12264 - DNA, 25 bp, Mus musculus
acagtaaaccaagcctccagcaaat

SEQ ID NO: 12265 - DNA, 25 bp, Mus musculus
ggtcgggaccaggctctgagaattg

SEQ ID NO: 12266 - DNA, 25 bp, Mus musculus
tcgggaccaggctctgagaattgga

SEQ ID NO: 12267 - DNA, 25 bp, Mus musculus
gaggcctcgtgttgttttcagcaaa

SEQ ID NO: 12268 - DNA, 25 bp, Mus musculus
ggcctcgtgttgttttcagcaaatt

SEQ ID NO: 12269 - DNA, 25 bp, Mus musculus
ttttcagcaaattccaattcatcat

SEQ ID NO: 12270 - DNA, 25 bp, Mus musculus
ttcagcaaattccaattcatcatgt

SEQ ID NO: 12271 - DNA, 25 bp, Mus musculus
cagcaaattccaattcatcatgtat

SEQ ID NO: 12272 - DNA, 25 bp, Mus musculus
gcaaattccaattcatcatgtatgg

SEQ ID NO: 12273 - DNA, 25 bp, Mus musculus
aaattccaattcatcatgtatggag

SEQ ID NO: 12274 - DNA, 25 bp, Mus musculus
attccaattcatcatgtatggagct

SEQ ID NO: 12275 - DNA, 25 bp, Mus musculus
tccaattcatcatgtatggagcttt

SEQ ID NO: 12276 - DNA, 25 bp, Mus musculus
caattcatcatgtatggagctttca

SEQ ID NO: 12277 - DNA, 25 bp, Mus musculus
tgatgttttgtgtggcgcctcctga

SEQ ID NO: 12278 - DNA, 25 bp, Mus musculus
atgttttgtgtggcgcctcctgaat

SEQ ID NO: 12279 - DNA, 25 bp, Mus musculus
gttttgtgtggcgcctcctgaatta

SEQ ID NO: 12280 - DNA, 25 bp, Mus musculus
tttgtgtggcgcctcctgaattaga

SEQ ID NO: 12281 - DNA, 25 bp, Mus musculus
tggcgcctcctgaattagaaaccaa

SEQ ID NO: 12282 - DNA, 25 bp, Mus musculus
gcgcctcctgaattagaaaccaaga

SEQ ID NO: 12283 - DNA, 25 bp, Mus musculus
acataaccaatggaggcctcgtgtt

SEQ ID NO: 12284 - DNA, 25 bp, Mus musculus
aatggaggcctcgtgttgttttcag

SEQ ID NO: 12285 - DNA, 25 bp, Mus musculus
actggaacgcacttctgtgaggtgg

SEQ ID NO: 12286 - DNA, 25 bp, Mus musculus
acgcacttctgtgaggtggagcaga

SEQ ID NO: 12287 - DNA, 25 bp, Mus musculus
gtgcagaagaccctctatgatatac

SEQ ID NO: 12288 - DNA, 25 bp, Mus musculus
aagaccctctatgatatacaagtgc

SEQ ID NO: 12289 - DNA, 25 bp, Mus musculus
ctgtccctgagccagcttcctgaga

SEQ ID NO: 12290 - DNA, 25 bp, Mus musculus
gaaatcagccttccgaacattcact

SEQ ID NO: 12291 - DNA, 25 bp, Mus musculus
attcactactttaacatcgacatgt

SEQ ID NO: 12292 - DNA, 25 bp, Mus musculus
tactttaacatcgacatgtccaaaa

SEQ ID NO: 12293 - DNA, 25 bp, Mus musculus
aacatcgacatgtccaaaatgggac

SEQ ID NO: 12294 - DNA, 25 bp, Mus musculus
gttttgctgcctctcgacaatccct

SEQ ID NO: 12295 - DNA, 25 bp, Mus musculus
aagctgccttccaggctgtgacgtc

SEQ ID NO: 12296 - DNA, 25 bp, Mus musculus
ccttccaggctgtgacgtcatggct

SEQ ID NO: 12297 - DNA, 25 bp, Mus musculus
gtcattcactctggaatcaaagacc

SEQ ID NO: 12298 - DNA, 25 bp, Mus musculus
cttccaggctgtgacgtcatggctc

SEQ ID NO: 12299 - DNA, 25 bp, Mus musculus
gaccgatgctttgccactcaagtgt

SEQ ID NO: 12300 - DNA, 25 bp, Mus musculus
tgctttgccactcaagtgtactgca

SEQ ID NO: 12301 - DNA, 25 bp, Mus musculus
tactgcaagtggcgctaccagagac

SEQ ID NO: 12302 - DNA, 25 bp, Mus musculus
attgtcctgcagaaatttgctgggc

SEQ ID NO: 12303 - DNA, 25 bp, Mus musculus
aaatttgctgggccctatgacaaag

SEQ ID NO: 12304 - DNA, 25 bp, Mus musculus
ggtgaatactcaccttccgtgcaga

SEQ ID NO: 12305 - DNA, 25 bp, Mus musculus
tactcaccttccgtgcagaagaccc

SEQ ID NO: 12306 - DNA, 25 bp, Mus musculus
gcgatcacctcaagcagagaagaaa

SEQ ID NO: 12307 - DNA, 25 bp, Mus musculus
cgatcacctcaagcagagaagaaag

SEQ ID NO: 12308 - DNA, 25 bp, Mus musculus
tctgttttggtccttccatagcagt

SEQ ID NO: 12309 - DNA, 25 bp, Mus musculus
tgttttggtccttccatagcagtca

SEQ ID NO: 12310 - DNA, 25 bp, Mus musculus
gttttggtccttccatagcagtcaa

SEQ ID NO: 12311 - DNA, 25 bp, Mus musculus
tttggtccttccatagcagtcaaga

SEQ ID NO: 12312 - DNA, 25 bp, Mus musculus
ttggtccttccatagcagtcaagac

SEQ ID NO: 12313 - DNA, 25 bp, Mus musculus
ggtccttccatagcagtcaagactt

SEQ ID NO: 12314 - DNA, 25 bp, Mus musculus
gtccttccatagcagtcaagacttg

SEQ ID NO: 12315 - DNA, 25 bp, Mus musculus
ccttccatagcagtcaagacttgga

SEQ ID NO: 12316 - DNA, 25 bp, Mus musculus
cttccatagcagtcaagacttggat

SEQ ID NO: 12317 - DNA, 25 bp, Mus musculus
tccatagcagtcaagacttggatga

SEQ ID NO: 12318 - DNA, 25 bp, Mus musculus
atcacctcaagcagagaagaaagat

SEQ ID NO: 12319 - DNA, 25 bp, Mus musculus
tcacctcaagcagagaagaaagatg

SEQ ID NO: 12320 - DNA, 25 bp, Mus musculus
aggaggttccccatcacctatgctg

SEQ ID NO: 12321 - DNA, 25 bp, Mus musculus
ggaggttccccatcacctatgctgg

SEQ ID NO: 12322 - DNA, 25 bp, Mus musculus
atcacctatgctggactctgttttg

SEQ ID NO: 12323 - DNA, 25 bp, Mus musculus
tcacctatgctggactctgttttgg

SEQ ID NO: 12324 - DNA, 25 bp, Mus musculus
gactctgttttggtccttccatagc

SEQ ID NO: 12325 - DNA, 25 bp, Mus musculus
ctctgttttggtccttccatagcag

SEQ ID NO: 12326 - DNA, 25 bp, Mus musculus
ggagctcgcagcatctcttctagac

SEQ ID NO: 12327 - DNA, 25 bp, Mus musculus
gagctcgcagcatctcttctagaca

SEQ ID NO: 12328 - DNA, 25 bp, Mus musculus
ctccagggtctgtgggagtcaaaca

SEQ ID NO: 12329 - DNA, 25 bp, Mus musculus
tccagggtctgtgggagtcaaacaa

SEQ ID NO: 12330 - DNA, 25 bp, Mus musculus
tgcttacggactcccgggtcatggg

SEQ ID NO: 12331 - DNA, 25 bp, Mus musculus
gggaacacggcgatcgccaagaaag

SEQ ID NO: 12332 - DNA, 25 bp, Mus musculus
ggaacacggcgatcgccaagaaagg

SEQ ID NO: 12333 - DNA, 25 bp, Mus musculus
aacacggcgatcgccaagaaaggca

SEQ ID NO: 12334 - DNA, 25 bp, Mus musculus
tcccccgagtaatgctgggcttgag

SEQ ID NO: 12335 - DNA, 25 bp, Mus musculus
cccccgagtaatgctgggcttgagg

SEQ ID NO: 12336 - DNA, 25 bp, Mus musculus
ccccgagtaatgctgggcttgagga

SEQ ID NO: 12337 - DNA, 25 bp, Mus musculus
cccgagtaatgctgggcttgaggat

SEQ ID NO: 12338 - DNA, 25 bp, Mus musculus
agctcgcagcatctcttctagacac

SEQ ID NO: 12339 - DNA, 25 bp, Mus musculus
gctcgcagcatctcttctagacacc

SEQ ID NO: 12340 - DNA, 25 bp, Mus musculus
tcgcagcatctcttctagacaccca

SEQ ID NO: 12341 - DNA, 25 bp, Mus musculus
agcatctcttctagacacccagccg

SEQ ID NO: 12342 - DNA, 25 bp, Mus musculus
tcttctagacacccagccgctctgt

SEQ ID NO: 12343 - DNA, 25 bp, Mus musculus
ttctagacacccagccgctctgtgc

SEQ ID NO: 12344 - DNA, 25 bp, Mus musculus
cgctccagggtctgtgggagtcaaa

SEQ ID NO: 12345 - DNA, 25 bp, Mus musculus
gctccagggtctgtgggagtcaaac

SEQ ID NO: 12346 - DNA, 25 bp, Mus musculus
ccaccatggttcagtgcttcggcca

SEQ ID NO: 12347 - DNA, 25 bp, Mus musculus
cacatcaacccagcggtgacagtgg

SEQ ID NO: 12348 - DNA, 25 bp, Mus musculus
tcatcggagctgggatctctacctg

SEQ ID NO: 12349 - DNA, 25 bp, Mus musculus
gctgggatctctacctggtcacacc

SEQ ID NO: 12350 - DNA, 25 bp, Mus musculus
ctgggatctctacctggtcacaccc

SEQ ID NO: 12351 - DNA, 25 bp, Mus musculus
tgggagtcacacggttcatggaaac

SEQ ID NO: 12352 - DNA, 25 bp, Mus musculus
gagtcacacggttcatggaaacctc

SEQ ID NO: 12353 - DNA, 25 bp, Mus musculus
agtcacacggttcatggaaacctca

SEQ ID NO: 12354 - DNA, 25 bp, Mus musculus
tcatggaaacctcactgctggcatg

SEQ ID NO: 12355 - DNA, 25 bp, Mus musculus
catggaaacctcactgctggcatgg

SEQ ID NO: 12356 - DNA, 25 bp, Mus musculus
tggaaacctcactgctggcatgggt

SEQ ID NO: 12357 - DNA, 25 bp, Mus musculus
cctcactgctggcatgggtcctggt

SEQ ID NO: 12358 - DNA, 25 bp, Mus musculus
acatcaacccagcggtgacagtggc

SEQ ID NO: 12359 - DNA, 25 bp, Mus musculus
actgctggcatgggtcctggtggac

SEQ ID NO: 12360 - DNA, 25 bp, Mus musculus
atcaacccagcggtgacagtggcca

SEQ ID NO: 12361 - DNA, 25 bp, Mus musculus
tcaacccagcggtgacagtggccat

SEQ ID NO: 12362 - DNA, 25 bp, Mus musculus
aacccagcggtgacagtggccatgg

SEQ ID NO: 12363 - DNA, 25 bp, Mus musculus
acccagcggtgacagtggccatggt

SEQ ID NO: 12364 - DNA, 25 bp, Mus musculus
gccatcatcggagctgggatctcta

SEQ ID NO: 12365 - DNA, 25 bp, Mus musculus
ccatcatcggagctgggatctctac

SEQ ID NO: 12366 - DNA, 25 bp, Mus musculus
atcatcggagctgggatctctacct

SEQ ID NO: 12367 - DNA, 25 bp, Mus musculus
gctgtttcccttaatgggtcattca

SEQ ID NO: 12368 - DNA, 25 bp, Mus musculus
tcccttaatgggtcattcatgagat

SEQ ID NO: 12369 - DNA, 25 bp, Mus musculus
ctgtatctaactgcaagtctaggta

SEQ ID NO: 12370 - DNA, 25 bp, Mus musculus
atttccctaactccagactgtgatg

SEQ ID NO: 12371 - DNA, 25 bp, Mus musculus
ctaactccagactgtgatgcggggc

SEQ ID NO: 12372 - DNA, 25 bp, Mus musculus
tgtgatgcggggccatttggtcttc

SEQ ID NO: 12373 - DNA, 25 bp, Mus musculus
ccatttggtcttccatgtgatgctc

SEQ ID NO: 12374 - DNA, 25 bp, Mus musculus
gatgctccacgtgaatgtatcattc

SEQ ID NO: 12375 - DNA, 25 bp, Mus musculus
gaatgtatcattcccgggcgtgacc

SEQ ID NO: 12376 - DNA, 25 bp, Mus musculus
gtccacttcttggccagttatcttt

SEQ ID NO: 12377 - DNA, 25 bp, Mus musculus
ctaattagcctagttcatccaatcc

SEQ ID NO: 12378 - DNA, 25 bp, Mus musculus
agcctagttcatccaatcctcactg

SEQ ID NO: 12379 - DNA, 25 bp, Mus musculus
tcattcatgagatctgctgttggga

SEQ ID NO: 12380 - DNA, 25 bp, Mus musculus
atgatttcccaattaggaagtgcaa

SEQ ID NO: 12381 - DNA, 25 bp, Mus musculus
acactaacggcttgagggaacagct

SEQ ID NO: 12382 - DNA, 25 bp, Mus musculus
tctagcatcccatgaatggatcagg

SEQ ID NO: 12383 - DNA, 25 bp, Mus musculus
atcccatgaatggatcaggaaatgt

SEQ ID NO: 12384 - DNA, 25 bp, Mus musculus
gtatgtttgttcactctgcacaggc

SEQ ID NO: 12385 - DNA, 25 bp, Mus musculus
actctgcacaggctgtgagtataag

SEQ ID NO: 12386 - DNA, 25 bp, Mus musculus
gtatttctgtatctaactgcaagtc

SEQ ID NO: 12387 - DNA, 25 bp, Mus musculus
tgggccatcaggtctcttgtggctg

SEQ ID NO: 12388 - DNA, 25 bp, Mus musculus
atcaggtctcttgtggctgaaacat

SEQ ID NO: 12389 - DNA, 25 bp, Mus musculus
cttcacaaacgctcccttctgtgtt

SEQ ID NO: 12390 - DNA, 25 bp, Mus musculus
aagtgccctctttggtcgccacaag

SEQ ID NO: 12391 - DNA, 25 bp, Mus musculus
tggtcgccacaagccatggcacggg

SEQ ID NO: 12392 - DNA, 25 bp, Mus musculus
ccacaagccatggcacgggacgtct

SEQ ID NO: 12393 - DNA, 25 bp, Mus musculus
tatgttcaatacaactgtggatcac

SEQ ID NO: 12394 - DNA, 25 bp, Mus musculus
caatacaactgtggatcacagcagc

SEQ ID NO: 12395 - DNA, 25 bp, Mus musculus
cagcagctgagctgtgatgagctcg

SEQ ID NO: 12396 - DNA, 25 bp, Mus musculus
tgtgatgagctcggggctgccttct

SEQ ID NO: 12397 - DNA, 25 bp, Mus musculus
gccttctgctagtgctgggctggtt

SEQ ID NO: 12398 - DNA, 25 bp, Mus musculus
tgctgggctggttttgttgaactga

SEQ ID NO: 12399 - DNA, 25 bp, Mus musculus
tctcttgtggctgaaacattgtctc

SEQ ID NO: 12400 - DNA, 25 bp, Mus musculus
ttgtctcccaattctgcaggcagcc

SEQ ID NO: 12401 - DNA, 25 bp, Mus musculus
cccaattctgcaggcagccttgaac

SEQ ID NO: 12402 - DNA, 25 bp, Mus musculus
agttcatggctagcatgccaggcag

SEQ ID NO: 12403 - DNA, 25 bp, Mus musculus
tggctagcatgccaggcaggctctc

SEQ ID NO: 12404 - DNA, 25 bp, Mus musculus
caggtgaccgtggctgcctaaagcc

SEQ ID NO: 12405 - DNA, 25 bp, Mus musculus
accgtggctgcctaaagccagctag

SEQ ID NO: 12406 - DNA, 25 bp, Mus musculus
tcaagctcctggcttcacaaacgct

SEQ ID NO: 12407 - DNA, 25 bp, Mus musculus
ggcacaagccgccatcaacgctcta

SEQ ID NO: 12408 - DNA, 25 bp, Mus musculus
acaagccgccatcaacgctctacat

SEQ ID NO: 12409 - DNA, 25 bp, Mus musculus
cacaatgcgacggatgcagcagatg

SEQ ID NO: 12410 - DNA, 25 bp, Mus musculus
aatgcgacggatgcagcagatggct

SEQ ID NO: 12411 - DNA, 25 bp, Mus musculus
gggcatgttcaaccccatggccatc

SEQ ID NO: 12412 - DNA, 25 bp, Mus musculus
agcctatggcgcctatgctcaggca

SEQ ID NO: 12413 - DNA, 25 bp, Mus musculus
tgctcaggcactgatgcagcagcaa

SEQ ID NO: 12414 - DNA, 25 bp, Mus musculus
tcaggcactgatgcagcagcaagca

SEQ ID NO: 12415 - DNA, 25 bp, Mus musculus
actgatgcagcagcaagcagccctc

SEQ ID NO: 12416 - DNA, 25 bp, Mus musculus
gcagcagcaagcagccctcatggca

SEQ ID NO: 12417 - DNA, 25 bp, Mus musculus
gcaagcagccctcatggcatcggtc

SEQ ID NO: 12418 - DNA, 25 bp, Mus musculus
agcagccctcatggcatcggtcgcg

SEQ ID NO: 12419 - DNA, 25 bp, Mus musculus
catcaacgctctacatggcagccag

SEQ ID NO: 12420 - DNA, 25 bp, Mus musculus
caacgctctacatggcagccagacc

SEQ ID NO: 12421 - DNA, 25 bp, Mus musculus
tctacatggcagccagaccatgcct

SEQ ID NO: 12422 - DNA, 25 bp, Mus musculus
acatggcagccagaccatgcctgga

SEQ ID NO: 12423 - DNA, 25 bp, Mus musculus
ctcctccagcctggtggtcaagttt

SEQ ID NO: 12424 - DNA, 25 bp, Mus musculus
cagcctggtggtcaagtttgcagac

SEQ ID NO: 12425 - DNA, 25 bp, Mus musculus
gtttgcagacactgacaaggagcgc

SEQ ID NO: 12426 - DNA, 25 bp, Mus musculus
gcgcacaatgcgacggatgcagcag

SEQ ID NO: 12427 - DNA, 25 bp, Mus musculus
aggtggcacctgattcacaggccta

SEQ ID NO: 12428 - DNA, 25 bp, Mus musculus
cacctgattcacaggcctaagacag

SEQ ID NO: 12429 - DNA, 25 bp, Mus musculus
caatgtgctgcaaacaccccttctt

SEQ ID NO: 12430 - DNA, 25 bp, Mus musculus
cttgtggcttttctgtcatttggca

SEQ ID NO: 12431 - DNA, 25 bp, Mus musculus
tgtttcttgaccttaactgagtgga

SEQ ID NO: 12432 - DNA, 25 bp, Mus musculus
gagtggatctacacctccttcatca

SEQ ID NO: 12433 - DNA, 25 bp, Mus musculus
agcaccaagtccaagtgtcttcaaa

SEQ ID NO: 12434 - DNA, 25 bp, Mus musculus
aacatcaattgcactccaagagctt

SEQ ID NO: 12435 - DNA, 25 bp, Mus musculus
aattgcactccaagagcttccagcc

SEQ ID NO: 12436 - DNA, 25 bp, Mus musculus
actccaagagcttccagcctgctgc

SEQ ID NO: 12437 - DNA, 25 bp, Mus musculus
agagcttccagcctgctgctggaaa

SEQ ID NO: 12438 - DNA, 25 bp, Mus musculus
aagaccgagcattccgctgtgttgc

SEQ ID NO: 12439 - DNA, 25 bp, Mus musculus
gctgactcaggaccaatttatgacc

SEQ ID NO: 12440 - DNA, 25 bp, Mus musculus
tatgaccaaacctacgctggtggac

SEQ ID NO: 12441 - DNA, 25 bp, Mus musculus
caaacctacgctggtggacggctgg

SEQ ID NO: 12442 - DNA, 25 bp, Mus musculus
ggcctgtttgtcttctcccaagaga

SEQ ID NO: 12443 - DNA, 25 bp, Mus musculus
tttgtcttctcccaagagatggtct

SEQ ID NO: 12444 - DNA, 25 bp, Mus musculus
ttctcccaagagatggtctatttct

SEQ ID NO: 12445 - DNA, 25 bp, Mus musculus
tatttctcggacctcaagtatgagt

SEQ ID NO: 12446 - DNA, 25 bp, Mus musculus
ctccagctccagcaatgtgctgcaa

SEQ ID NO: 12447 - DNA, 25 bp, Mus musculus
agcctgagctgcacacagtgcccac

SEQ ID NO: 12448 - DNA, 25 bp, Mus musculus
agctgcacacagtgcccacctatgc

SEQ ID NO: 12449 - DNA, 25 bp, Mus musculus
aagagggccatctctgacatggagc

SEQ ID NO: 12450 - DNA, 25 bp, Mus musculus
ggcatctgctgcagcgacgagagct

SEQ ID NO: 12451 - DNA, 25 bp, Mus musculus
acccgcgctcgggagccaagcaacg

SEQ ID NO: 12452 - DNA, 25 bp, Mus musculus
gagccaagcaacgccacacagctgg

SEQ ID NO: 12453 - DNA, 25 bp, Mus musculus
agcaacgccacacagctggacggcc

SEQ ID NO: 12454 - DNA, 25 bp, Mus musculus
acacgggagtccgtggattctgcca

SEQ ID NO: 12455 - DNA, 25 bp, Mus musculus
gagtccgtggattctgccaagcccc

SEQ ID NO: 12456 - DNA, 25 bp, Mus musculus
gtggattctgccaagccccgggtct

SEQ ID NO: 12457 - DNA, 25 bp, Mus musculus
tctgccaagccccgggtctactgag

SEQ ID NO: 12458 - DNA, 25 bp, Mus musculus
aagccccgggtctactgagccatcg

SEQ ID NO: 12459 - DNA, 25 bp, Mus musculus
tgcccacctatgctcgccaggatgc

SEQ ID NO: 12460 - DNA, 25 bp, Mus musculus
cctatgctcgccaggatgctcaaca

SEQ ID NO: 12461 - DNA, 25 bp, Mus musculus
ctcgccaggatgctcaacactacgc

SEQ ID NO: 12462 - DNA, 25 bp, Mus musculus
aggatgctcaacactacgctctccg

SEQ ID NO: 12463 - DNA, 25 bp, Mus musculus
gcttgtttcctgagcctgctggcct

SEQ ID NO: 12464 - DNA, 25 bp, Mus musculus
tgctacttccagaactgcccaagag

SEQ ID NO: 12465 - DNA, 25 bp, Mus musculus
ttccagaactgcccaagaggcggca

SEQ ID NO: 12466 - DNA, 25 bp, Mus musculus
aactgcccaagaggcggcaagaggg

SEQ ID NO: 12467 - DNA, 25 bp, Mus musculus
ccatgcagatcatgcggatcaaacc

SEQ ID NO: 12468 - DNA, 25 bp, Mus musculus
agatcatgcggatcaaacctcacca

SEQ ID NO: 12469 - DNA, 25 bp, Mus musculus
ccggcagacgcattcccgggcaggt

SEQ ID NO: 12470 - DNA, 25 bp, Mus musculus
gacgcattcccgggcaggtgaccaa

SEQ ID NO: 12471 - DNA, 25 bp, Mus musculus
ttcccgggcaggtgaccaagcacgt

SEQ ID NO: 12472 - DNA, 25 bp, Mus musculus
tgcctcgtgggactggattcgccat

SEQ ID NO: 12473 - DNA, 25 bp, Mus musculus
tcgccattttcttatatctgctgct

SEQ ID NO: 12474 - DNA, 25 bp, Mus musculus
ttttcttatatctgctgctaaatcg

SEQ ID NO: 12475 - DNA, 25 bp, Mus musculus
tatatctgctgctaaatcgccaagc

SEQ ID NO: 12476 - DNA, 25 bp, Mus musculus
tgctgctaaatcgccaagcccggaa

SEQ ID NO: 12477 - DNA, 25 bp, Mus musculus
taaatcgccaagcccggaagattag

SEQ ID NO: 12478 - DNA, 25 bp, Mus musculus
tttctgggattcctgtagagctcgt

SEQ ID NO: 12479 - DNA, 25 bp, Mus musculus
tgcggatcaaacctcaccaaagcca

SEQ ID NO: 12480 - DNA, 25 bp, Mus musculus
ttctgggattcctgtagagctcgtg

SEQ ID NO: 12481 - DNA, 25 bp, Mus musculus
aaagccagcacatagagagaatgag

SEQ ID NO: 12482 - DNA, 25 bp, Mus musculus
gaatgagcttcctacagcacagcag

SEQ ID NO: 12483 - DNA, 25 bp, Mus musculus
tacagcacagcagatgtgaatgcag

SEQ ID NO: 12484 - DNA, 25 bp, Mus musculus
ccgattaaccatgtcaccaccatgc

SEQ ID NO: 12485 - DNA, 25 bp, Mus musculus
accatgccatcatcgtcaccgttga

SEQ ID NO: 12486 - DNA, 25 bp, Mus musculus
cagtccttaatccagaaagcctgat

SEQ ID NO: 12487 - DNA, 25 bp, Mus musculus
gagactccggcagacgcattcccgg

SEQ ID NO: 12488 - DNA, 25 bp, Mus musculus
atcctgtctcctgctccagagtaga

SEQ ID NO: 12489 - DNA, 25 bp, Mus musculus
cgggcacctctctgagggagctgat

SEQ ID NO: 12490 - DNA, 25 bp, Mus musculus
agacactgcctgtcccatctcactt

SEQ ID NO: 12491 - DNA, 25 bp, Mus musculus
ctcacttactcacccagtgtgactc

SEQ ID NO: 12492 - DNA, 25 bp, Mus musculus
tttaacttaggcccagatgcttctg

SEQ ID NO: 12493 - DNA, 25 bp, Mus musculus
ccagatgcttctgggctacaccagt

SEQ ID NO: 12494 - DNA, 25 bp, Mus musculus
gcttctgggctacaccagttcctgt

SEQ ID NO: 12495 - DNA, 25 bp, Mus musculus
caccagttcctgtttcgatgtgagt

SEQ ID NO: 12496 - DNA, 25 bp, Mus musculus
ttcctgtttcgatgtgagttttgaa

SEQ ID NO: 12497 - DNA, 25 bp, Mus musculus
ttttgaaatgctccgtgaagggctg

SEQ ID NO: 12498 - DNA, 25 bp, Mus musculus
gcagtaccaacttcctggcgaagaa

SEQ ID NO: 12499 - DNA, 25 bp, Mus musculus
ccaacttcctggcgaagaagccaag

SEQ ID NO: 12500 - DNA, 25 bp, Mus musculus
cctctctgagggagctgatgtggag

SEQ ID NO: 12501 - DNA, 25 bp, Mus musculus
atggcagccgcgtggctttgtagac

SEQ ID NO: 12502 - DNA, 25 bp, Mus musculus
ctgctacaatactccctggtggcat

SEQ ID NO: 12503 - DNA, 25 bp, Mus musculus
caatactccctggtggcattggttg

SEQ ID NO: 12504 - DNA, 25 bp, Mus musculus
tccctggtggcattggttgtctcag

SEQ ID NO: 12505 - DNA, 25 bp, Mus musculus
tctggaactccaggactcagacact

SEQ ID NO: 12506 - DNA, 25 bp, Mus musculus
actccaggactcagacactgcctgt

SEQ ID NO: 12507 - DNA, 25 bp, Mus musculus
ggactcagacactgcctgtcccatc

SEQ ID NO: 12508 - DNA, 25 bp, Mus musculus
tctgccttaaaccacgaacaacagc

SEQ ID NO: 12509 - DNA, 25 bp, Mus musculus
ttaaaccacgaacaacagcacagcg

SEQ ID NO: 12510 - DNA, 25 bp, Mus musculus
ctttcaggttccattcccagcaagg

SEQ ID NO: 12511 - DNA, 25 bp, Mus musculus
ggcagctcacacaggacctgcagcc

SEQ ID NO: 12512 - DNA, 25 bp, Mus musculus
tcacacaggacctgcagcctggcca

SEQ ID NO: 12513 - DNA, 25 bp, Mus musculus
aggacctgcagcctggccatcagca

SEQ ID NO: 12514 - DNA, 25 bp, Mus musculus
tgcagcctggccatcagcaggctct

SEQ ID NO: 12515 - DNA, 25 bp, Mus musculus
ggtgccttctgtctactgttgtagt

SEQ ID NO: 12516 - DNA, 25 bp, Mus musculus
ttctgtctactgttgtagttacgtg

SEQ ID NO: 12517 - DNA, 25 bp, Mus musculus
gttttgtgttgactctcggtggtgt

SEQ ID NO: 12518 - DNA, 25 bp, Mus musculus
tgttgactctcggtggtgtgagaat

SEQ ID NO: 12519 - DNA, 25 bp, Mus musculus
tgtactaatctctgtcaagacaaac

SEQ ID NO: 12520 - DNA, 25 bp, Mus musculus
cacgaacaacagcacagcgaagcgg

SEQ ID NO: 12521 - DNA, 25 bp, Mus musculus
caacagcacagcgaagcgggatggt

SEQ ID NO: 12522 - DNA, 25 bp, Mus musculus
gctttcccagttcctaactgagcag

SEQ ID NO: 12523 - DNA, 25 bp, Mus musculus
tgagcagttgctggtctgcaggaag

SEQ ID NO: 12524 - DNA, 25 bp, Mus musculus
ctgcagttacctaatgttcgcctcc

SEQ ID NO: 12525 - DNA, 25 bp, Mus musculus
ttagatctagctgcttgtggtgtaa

SEQ ID NO: 12526 - DNA, 25 bp, Mus musculus
ctagctgcttgtggtgtaagtaaac

SEQ ID NO: 12527 - DNA, 25 bp, Mus musculus
ggcactctttcaggttccattccca

SEQ ID NO: 12528 - DNA, 25 bp, Mus musculus
atttgcccattccttcagacgcatg

SEQ ID NO: 12529 - DNA, 25 bp, Mus musculus
ccattccttcagacgcatgccacag

SEQ ID NO: 12530 - DNA, 25 bp, Mus musculus
tccacactcaaaagggaggctaagg

SEQ ID NO: 12531 - DNA, 25 bp, Mus musculus
cttacagctctaacccagagccttt

SEQ ID NO: 12532 - DNA, 25 bp, Mus musculus
acccagagcctttgcaaagctccac

SEQ ID NO: 12533 - DNA, 25 bp, Mus musculus
agcctttgcaaagctccacagactc

SEQ ID NO: 12534 - DNA, 25 bp, Mus musculus
tgcaaagctccacagactcctcaaa

SEQ ID NO: 12535 - DNA, 25 bp, Mus musculus
gctccacagactcctcaaatgacaa

SEQ ID NO: 12536 - DNA, 25 bp, Mus musculus
cctcaaatgacaacaccaggaacat

SEQ ID NO: 12537 - DNA, 25 bp, Mus musculus
atgacaacaccaggaacatgggttt

SEQ ID NO: 12538 - DNA, 25 bp, Mus musculus
acaccaggaacatgggtttgctacg

SEQ ID NO: 12539 - DNA, 25 bp, Mus musculus
tccaatcagaagccaataggtgatt

SEQ ID NO: 12540 - DNA, 25 bp, Mus musculus
cttcagacgcatgccacagacccat

SEQ ID NO: 12541 - DNA, 25 bp, Mus musculus
gccacagacccatggaaatcttgta

SEQ ID NO: 12542 - DNA, 25 bp, Mus musculus
ttcttttcttagatggacagctaag

SEQ ID NO: 12543 - DNA, 25 bp, Mus musculus
cattagcgtctgggggtttctctgg

SEQ ID NO: 12544 - DNA, 25 bp, Mus musculus
gcaccgtcactcactcaggatctta

SEQ ID NO: 12545 - DNA, 25 bp, Mus musculus
tcactcactcaggatcttatcctga

SEQ ID NO: 12546 - DNA, 25 bp, Mus musculus
actcaggatcttatcctgatcttac

SEQ ID NO: 12547 - DNA, 25 bp, Mus musculus
gatcttatcctgatcttaccctcct

SEQ ID NO: 12548 - DNA, 25 bp, Mus musculus
aggatttctctgcctctgccaacct

SEQ ID NO: 12549 - DNA, 25 bp, Mus musculus
gagtcacttcctctggttgacaccc

SEQ ID NO: 12550 - DNA, 25 bp, Mus musculus
acacttggtgcaacagtgcagtacc

SEQ ID NO: 12551 - DNA, 25 bp, Mus musculus
acagctttcaagtgcctttactgca

SEQ ID NO: 12552 - DNA, 25 bp, Mus musculus
ttcaagtgcctttactgcagttttt

SEQ ID NO: 12553 - DNA, 25 bp, Mus musculus
aagtgcctttactgcagtttttcag

SEQ ID NO: 12554 - DNA, 25 bp, Mus musculus
tgcctttactgcagtttttcaggag

SEQ ID NO: 12555 - DNA, 25 bp, Mus musculus
tgcagtttttcaggagcgcaagata

SEQ ID NO: 12556 - DNA, 25 bp, Mus musculus
agtttttcaggagcgcaagatagat

SEQ ID NO: 12557 - DNA, 25 bp, Mus musculus
agaagctcagcacttaacaactgac

SEQ ID NO: 12558 - DNA, 25 bp, Mus musculus
tcagcacttaacaactgacacccca

SEQ ID NO: 12559 - DNA, 25 bp, Mus musculus
actgcttttttccagtaaatatctg

SEQ ID NO: 12560 - DNA, 25 bp, Mus musculus
tcacttcctctggttgacacccact

SEQ ID NO: 12561 - DNA, 25 bp, Mus musculus
tatctgaccaacttgttactgcttc

SEQ ID NO: 12562 - DNA, 25 bp, Mus musculus
cttcctctggttgacacccactcaa

SEQ ID NO: 12563 - DNA, 25 bp, Mus musculus
acactcctgattaagacggttgaga

SEQ ID NO: 12564 - DNA, 25 bp, Mus musculus
atcaatgagacttctcagcatcacg

SEQ ID NO: 12565 - DNA, 25 bp, Mus musculus
acttctcagcatcacgatgaccttg

SEQ ID NO: 12566 - DNA, 25 bp, Mus musculus
tctcagcatcacgatgaccttgaat

SEQ ID NO: 12567 - DNA, 25 bp, Mus musculus
ttgcacacacttggtgcaacagtgc

SEQ ID NO: 12568 - DNA, 25 bp, Mus musculus
cacacacttggtgcaacagtgcagt

SEQ ID NO: 12569 - DNA, 25 bp, Mus musculus
cgggtcaacaccaagcgcacgagtc

SEQ ID NO: 12570 - DNA, 25 bp, Mus musculus
gtcaacaccaagcgcacgagtcgag

SEQ ID NO: 12571 - DNA, 25 bp, Mus musculus
cctgaagacaccactcaaggatgct

SEQ ID NO: 12572 - DNA, 25 bp, Mus musculus
gaagacaccactcaaggatgctgcc

SEQ ID NO: 12573 - DNA, 25 bp, Mus musculus
aagacaccactcaaggatgctgccc

SEQ ID NO: 12574 - DNA, 25 bp, Mus musculus
gacaccactcaaggatgctgcccgc

SEQ ID NO: 12575 - DNA, 25 bp, Mus musculus
ccactcaaggatgctgcccgccgag

SEQ ID NO: 12576 - DNA, 25 bp, Mus musculus
cactcaaggatgctgcccgccgagc

SEQ ID NO: 12577 - DNA, 25 bp, Mus musculus
actcaaggatgctgcccgccgagct

SEQ ID NO: 12578 - DNA, 25 bp, Mus musculus
gtcaacaccagctctctcttcctga

SEQ ID NO: 12579 - DNA, 25 bp, Mus musculus
tcttcctgatccattccaccacggg

SEQ ID NO: 12580 - DNA, 25 bp, Mus musculus
tcctgatccattccaccacgggcta

SEQ ID NO: 12581 - DNA, 25 bp, Mus musculus
tcaacaccaagcgcacgagtcgagc

SEQ ID NO: 12582 - DNA, 25 bp, Mus musculus
caacaccaagcgcacgagtcgagct

SEQ ID NO: 12583 - DNA, 25 bp, Mus musculus
acaccaagcgcacgagtcgagcttt

SEQ ID NO: 12584 - DNA, 25 bp, Mus musculus
accaagcgcacgagtcgagctttca

SEQ ID NO: 12585 - DNA, 25 bp, Mus musculus
caagcgcacgagtcgagctttcaga

SEQ ID NO: 12586 - DNA, 25 bp, Mus musculus
aagcgcacgagtcgagctttcagag

SEQ ID NO: 12587 - DNA, 25 bp, Mus musculus
agcgcacgagtcgagctttcagagc

SEQ ID NO: 12588 - DNA, 25 bp, Mus musculus
acctgaagacaccactcaaggatgc

SEQ ID NO: 12589 - DNA, 25 bp, Mus musculus
gttccctgagcagaaagctggtgag

SEQ ID NO: 12590 - DNA, 25 bp, Mus musculus
taaccagccaatgatgatggccgcc

SEQ ID NO: 12591 - DNA, 25 bp, Mus musculus
tataagcacccagctcaaaatccta

SEQ ID NO: 12592 - DNA, 25 bp, Mus musculus
gctcaaaatcctatccacagtgaag

SEQ ID NO: 12593 - DNA, 25 bp, Mus musculus
gaccaacatcagtgatgaggagtct

SEQ ID NO: 12594 - DNA, 25 bp, Mus musculus
tcataatgcccagaacctcatgcag

SEQ ID NO: 12595 - DNA, 25 bp, Mus musculus
tgcccagaacctcatgcagtctgtg

SEQ ID NO: 12596 - DNA, 25 bp, Mus musculus
gaacctcatgcagtctgtgaaggag

SEQ ID NO: 12597 - DNA, 25 bp, Mus musculus
ggctgaagctgcttcaatcaaaatc

SEQ ID NO: 12598 - DNA, 25 bp, Mus musculus
ttcaatcaaaatccgaacagatgct

SEQ ID NO: 12599 - DNA, 25 bp, Mus musculus
agatgctggctttactctgcgctgg

SEQ ID NO: 12600 - DNA, 25 bp, Mus musculus
tggctttactctgcgctgggtcaga

SEQ ID NO: 12601 - DNA, 25 bp, Mus musculus
gctccacgatgaagctcggaaatgg

SEQ ID NO: 12602 - DNA, 25 bp, Mus musculus
tactctgcgctgggtcagaaagact

SEQ ID NO: 12603 - DNA, 25 bp, Mus musculus
caatgacatcattgcagcagccaag

SEQ ID NO: 12604 - DNA, 25 bp, Mus musculus
gcgcatggctctgctgatggcagag

SEQ ID NO: 12605 - DNA, 25 bp, Mus musculus
ggctctgctgatggcagagatgtct

SEQ ID NO: 12606 - DNA, 25 bp, Mus musculus
acttattcagtgtgccaaggatatc

SEQ ID NO: 12607 - DNA, 25 bp, Mus musculus
tgccaagcagtgcacagataagcgg

SEQ ID NO: 12608 - DNA, 25 bp, Mus musculus
tctcttacaggtatgcgagcgaatc

SEQ ID NO: 12609 - DNA, 25 bp, Mus musculus
atgcgagcgaatcccaactataagc

SEQ ID NO: 12610 - DNA, 25 bp, Mus musculus
tggccgagctgcgctgtgctacgct

SEQ ID NO: 12611 - DNA, 25 bp, Mus musculus
ccgagctgcgctgtgctacgctcct

SEQ ID NO: 12612 - DNA, 25 bp, Mus musculus
agatttctcaagcttatgaagttct

SEQ ID NO: 12613 - DNA, 25 bp, Mus musculus
atttctcaagcttatgaagttcttg

SEQ ID NO: 12614 - DNA, 25 bp, Mus musculus
tttctcaagcttatgaagttcttgc

SEQ ID NO: 12615 - DNA, 25 bp, Mus musculus
gaagttcttgctgattccaagaaaa

SEQ ID NO: 12616 - DNA, 25 bp, Mus musculus
aagttcttgctgattccaagaaaag

SEQ ID NO: 12617 - DNA, 25 bp, Mus musculus
agttcttgctgattccaagaaaagg

SEQ ID NO: 12618 - DNA, 25 bp, Mus musculus
gttcttgctgattccaagaaaaggg

SEQ ID NO: 12619 - DNA, 25 bp, Mus musculus
ttcttgctgattccaagaaaaggga

SEQ ID NO: 12620 - DNA, 25 bp, Mus musculus
tcttgctgattccaagaaaagggaa

SEQ ID NO: 12621 - DNA, 25 bp, Mus musculus
ttgctgattccaagaaaagggaact

SEQ ID NO: 12622 - DNA, 25 bp, Mus musculus
agctgcgctgtgctacgctcctctt

SEQ ID NO: 12623 - DNA, 25 bp, Mus musculus
gcccgctcaccggctgtaaaaaatg

SEQ ID NO: 12624 - DNA, 25 bp, Mus musculus
aaactacttactatgatgttgctgg

SEQ ID NO: 12625 - DNA, 25 bp, Mus musculus
tcaaacccaatgccacccaggaaga

SEQ ID NO: 12626 - DNA, 25 bp, Mus musculus
cccaatgccacccaggaagaattga

SEQ ID NO: 12627 - DNA, 25 bp, Mus musculus
ccaatgccacccaggaagaattgaa

SEQ ID NO: 12628 - DNA, 25 bp, Mus musculus
aacagatttctcaagcttatgaagt

SEQ ID NO: 12629 - DNA, 25 bp, Mus musculus
cagatttctcaagcttatgaagttc

SEQ ID NO: 12630 - DNA, 25 bp, Mus musculus
cctcttctggggcagatcctctgat

SEQ ID NO: 12631 - DNA, 25 bp, Mus musculus
cagagaaccccaattcatcagccgg

SEQ ID NO: 12632 - DNA, 25 bp, Mus musculus
gctaggaacctacaacaactatgat

SEQ ID NO: 12633 - DNA, 25 bp, Mus musculus
tgccacctgcgagcccattcagagc

SEQ ID NO: 12634 - DNA, 25 bp, Mus musculus
ctgcgagcccattcagagcgtctat

SEQ ID NO: 12635 - DNA, 25 bp, Mus musculus
gcccattcagagcgtctatttcttc

SEQ ID NO: 12636 - DNA, 25 bp, Mus musculus
tttcttctctggagacaaatactac

SEQ ID NO: 12637 - DNA, 25 bp, Mus musculus
cccacgctccattgctcagtattgg

SEQ ID NO: 12638 - DNA, 25 bp, Mus musculus
ctccattgctcagtattggctgggc

SEQ ID NO: 12639 - DNA, 25 bp, Mus musculus
atcagagcccactcggctgagcttc

SEQ ID NO: 12640 - DNA, 25 bp, Mus musculus
gcccactcggctgagcttcaggagc

SEQ ID NO: 12641 - DNA, 25 bp, Mus musculus
gagcttcaggagcctcatctctttc

SEQ ID NO: 12642 - DNA, 25 bp, Mus musculus
accccaattcatcagccggaactgg

SEQ ID NO: 12643 - DNA, 25 bp, Mus musculus
attcatcagccggaactggcatggt

SEQ ID NO: 12644 - DNA, 25 bp, Mus musculus
cagccggaactggcatggtgtgcca

SEQ ID NO: 12645 - DNA, 25 bp, Mus musculus
catctacgtcactggctccttatcc

SEQ ID NO: 12646 - DNA, 25 bp, Mus musculus
tggccacagacgcagccagagctcg

SEQ ID NO: 12647 - DNA, 25 bp, Mus musculus
gagctcgaactcccgtcgttcatca

SEQ ID NO: 12648 - DNA, 25 bp, Mus musculus
ccgtcgttcatcacgttcaatctgg

SEQ ID NO: 12649 - DNA, 25 bp, Mus musculus
aatctggttctctttgttctccagc

SEQ ID NO: 12650 - DNA, 25 bp, Mus musculus
tcgtctgcccgaccttcaaggttct

SEQ ID NO: 12651 - DNA, 25 bp, Mus musculus
tgcccgaccttcaaggttctaccat

SEQ ID NO: 12652 - DNA, 25 bp, Mus musculus
ggttctaccatgttctcgcgggcga

SEQ ID NO: 12653 - DNA, 25 bp, Mus musculus
gttctaccatgttctcgcgggcgag

SEQ ID NO: 12654 - DNA, 25 bp, Mus musculus
caaccctgaaagacattaccatgag

SEQ ID NO: 12655 - DNA, 25 bp, Mus musculus
tgaagcagctcgagtgtatgggaca

SEQ ID NO: 12656 - DNA, 25 bp, Mus musculus
gaagcagctcgagtgtatgggacag

SEQ ID NO: 12657 - DNA, 25 bp, Mus musculus
aagcagctcgagtgtatgggacagg

SEQ ID NO: 12658 - DNA, 25 bp, Mus musculus
agcagctcgagtgtatgggacaggc

SEQ ID NO: 12659 - DNA, 25 bp, Mus musculus
gcccgaccttcaaggttctaccatg

SEQ ID NO: 12660 - DNA, 25 bp, Mus musculus
gaccttcaaggttctaccatgttct

SEQ ID NO: 12661 - DNA, 25 bp, Mus musculus
ccttcaaggttctaccatgttctcg

SEQ ID NO: 12662 - DNA, 25 bp, Mus musculus
cttcaaggttctaccatgttctcgc

SEQ ID NO: 12663 - DNA, 25 bp, Mus musculus
ttcaaggttctaccatgttctcgcg

SEQ ID NO: 12664 - DNA, 25 bp, Mus musculus
tcaaggttctaccatgttctcgcgg

SEQ ID NO: 12665 - DNA, 25 bp, Mus musculus
caaggttctaccatgttctcgcggg

SEQ ID NO: 12666 - DNA, 25 bp, Mus musculus
aggttctaccatgttctcgcgggcg

SEQ ID NO: 12667 - DNA, 25 bp, Mus musculus
cccggtaccatgagttgcctcatca

SEQ ID NO: 12668 - DNA, 25 bp, Mus musculus
agttgcctcatcagcctcgttcttg

SEQ ID NO: 12669 - DNA, 25 bp, Mus musculus
tgcaacgtcgactgtgtcatgacat

SEQ ID NO: 12670 - DNA, 25 bp, Mus musculus
gtcgactgtgtcatgacatgtacac

SEQ ID NO: 12671 - DNA, 25 bp, Mus musculus
gtgccagtgataacccttcagtgag

SEQ ID NO: 12672 - DNA, 25 bp, Mus musculus
gtgataacccttcagtgagcagccg

SEQ ID NO: 12673 - DNA, 25 bp, Mus musculus
gagcgaccagcccaagtctatacag

SEQ ID NO: 12674 - DNA, 25 bp, Mus musculus
ccagcccaagtctatacagcaagac

SEQ ID NO: 12675 - DNA, 25 bp, Mus musculus
tatacagcaagacccttcactcgtg

SEQ ID NO: 12676 - DNA, 25 bp, Mus musculus
cccttcactcgtggatcccagagag

SEQ ID NO: 12677 - DNA, 25 bp, Mus musculus
actcgtggatcccagagagaacata

SEQ ID NO: 12678 - DNA, 25 bp, Mus musculus
aatgctttcaatctgctgctaataa

SEQ ID NO: 12679 - DNA, 25 bp, Mus musculus
gttcttggcctgctggccctggagg

SEQ ID NO: 12680 - DNA, 25 bp, Mus musculus
gtggccctcgctcagaacctagagg

SEQ ID NO: 12681 - DNA, 25 bp, Mus musculus
ctcgctcagaacctagaggaacaag

SEQ ID NO: 12682 - DNA, 25 bp, Mus musculus
gtcttcaactcagttcagtccatgt

SEQ ID NO: 12683 - DNA, 25 bp, Mus musculus
agccccattgagggcacagagtgta

SEQ ID NO: 12684 - DNA, 25 bp, Mus musculus
atcatctgccaaaccaacgaggagt

SEQ ID NO: 12685 - DNA, 25 bp, Mus musculus
gctggcttctgcccttggaattcac

SEQ ID NO: 12686 - DNA, 25 bp, Mus musculus
gaatgctccagcgaccgtgagtgtt

SEQ ID NO: 12687 - DNA, 25 bp, Mus musculus
tgtattctcggatgatatctctcag

SEQ ID NO: 12688 - DNA, 25 bp, Mus musculus
ttctcggatgatatctctcagcatt

SEQ ID NO: 12689 - DNA, 25 bp, Mus musculus
aacgcgcatgtttgtccttgagctg

SEQ ID NO: 12690 - DNA, 25 bp, Mus musculus
cgcgcatgtttgtccttgagctgga

SEQ ID NO: 12691 - DNA, 25 bp, Mus musculus
catgtttgtccttgagctggattcc

SEQ ID NO: 12692 - DNA, 25 bp, Mus musculus
tgtttgtccttgagctggattccaa

SEQ ID NO: 12693 - DNA, 25 bp, Mus musculus
tgtccttgagctggattccaaattt

SEQ ID NO: 12694 - DNA, 25 bp, Mus musculus
tccttgagctggattccaaatttct

SEQ ID NO: 12695 - DNA, 25 bp, Mus musculus
caaatttcttctccaggacaaagca

SEQ ID NO: 12696 - DNA, 25 bp, Mus musculus
aatttcttctccaggacaaagcatg

SEQ ID NO: 12697 - DNA, 25 bp, Mus musculus
tcttctccaggacaaagcatgcgcg

SEQ ID NO: 12698 - DNA, 25 bp, Mus musculus
ttctccaggacaaagcatgcgcgtt

SEQ ID NO: 12699 - DNA, 25 bp, Mus musculus
gatgatatctctcagcattcattga

SEQ ID NO: 12700 - DNA, 25 bp, Mus musculus
tgatatctctcagcattcattgaac

SEQ ID NO: 12701 - DNA, 25 bp, Mus musculus
atctctcagcattcattgaacgcgc

SEQ ID NO: 12702 - DNA, 25 bp, Mus musculus
ctctcagcattcattgaacgcgcat

SEQ ID NO: 12703 - DNA, 25 bp, Mus musculus
cagcattcattgaacgcgcatgttt

SEQ ID NO: 12704 - DNA, 25 bp, Mus musculus
gcattcattgaacgcgcatgtttgt

SEQ ID NO: 12705 - DNA, 25 bp, Mus musculus
tcattgaacgcgcatgtttgtcctt

SEQ ID NO: 12706 - DNA, 25 bp, Mus musculus
attgaacgcgcatgtttgtccttga

SEQ ID NO: 12707 - DNA, 25 bp, Mus musculus
gcgtagccttctcacagtcctttgt

SEQ ID NO: 12708 - DNA, 25 bp, Mus musculus
cctccagccgggcactcatgaatct

SEQ ID NO: 12709 - DNA, 25 bp, Mus musculus
tcaagccacatacagatgaggacct

SEQ ID NO: 12710 - DNA, 25 bp, Mus musculus
aggacctggtatacctggagcctag

SEQ ID NO: 12711 - DNA, 25 bp, Mus musculus
tggtatacctggagcctagcccgga

SEQ ID NO: 12712 - DNA, 25 bp, Mus musculus
acctggagcctagcccggacttctg

SEQ ID NO: 12713 - DNA, 25 bp, Mus musculus
acttctgtgagcaggacatccgcag

SEQ ID NO: 12714 - DNA, 25 bp, Mus musculus
ccattgacggctgcgagctactgtg

SEQ ID NO: 12715 - DNA, 25 bp, Mus musculus
agcgctgtggctgcaggttccactg

SEQ ID NO: 12716 - DNA, 25 bp, Mus musculus
gcttcgtcaagtgccggcagtgcca

SEQ ID NO: 12717 - DNA, 25 bp, Mus musculus
tcaagtgccggcagtgccagcggct

SEQ ID NO: 12718 - DNA, 25 bp, Mus musculus
agtgccagcggctcgtggagatgca

SEQ ID NO: 12719 - DNA, 25 bp, Mus musculus
gccgggcactcatgaatcttcacaa

SEQ ID NO: 12720 - DNA, 25 bp, Mus musculus
acaacgaggctggcaggaaggccat

SEQ ID NO: 12721 - DNA, 25 bp, Mus musculus
aggccatcttgacacacatgcgggt

SEQ ID NO: 12722 - DNA, 25 bp, Mus musculus
cgggctcctgcgaggtaaagacgtg

SEQ ID NO: 12723 - DNA, 25 bp, Mus musculus
agacgtgctggcgtgctgtaccgcc

SEQ ID NO: 12724 - DNA, 25 bp, Mus musculus
ttggccacgcgctaaaggagaagtt

SEQ ID NO: 12725 - DNA, 25 bp, Mus musculus
tgcctcggaatgcacagttcaagcc

SEQ ID NO: 12726 - DNA, 25 bp, Mus musculus
cacagttcaagccacatacagatga

SEQ ID NO: 12727 - DNA, 25 bp, Mus musculus
tgtggaaactgccttcatcgtatct

SEQ ID NO: 12728 - DNA, 25 bp, Mus musculus
gtggaaactgccttcatcgtatctg

SEQ ID NO: 12729 - DNA, 25 bp, Mus musculus
actggattcaagccaactacctcgc

SEQ ID NO: 12730 - DNA, 25 bp, Mus musculus
attcaagccaactacctcgctgatt

SEQ ID NO: 12731 - DNA, 25 bp, Mus musculus
ttcaagccaactacctcgctgattg

SEQ ID NO: 12732 - DNA, 25 bp, Mus musculus
caagccaactacctcgctgattgga

SEQ ID NO: 12733 - DNA, 25 bp, Mus musculus
aagccaactacctcgctgattggag

SEQ ID NO: 12734 - DNA, 25 bp, Mus musculus
gccaactacctcgctgattggagaa

SEQ ID NO: 12735 - DNA, 25 bp, Mus musculus
ccaactacctcgctgattggagaac

SEQ ID NO: 12736 - DNA, 25 bp, Mus musculus
aactacctcgctgattggagaacgg

SEQ ID NO: 12737 - DNA, 25 bp, Mus musculus
actacctcgctgattggagaacgga

SEQ ID NO: 12738 - DNA, 25 bp, Mus musculus
tacctcgctgattggagaacggaaa

SEQ ID NO: 12739 - DNA, 25 bp, Mus musculus
atggcgaccatgctgttgctccatg

SEQ ID NO: 12740 - DNA, 25 bp, Mus musculus
tcttcaccacaaccgaacgacaaag

SEQ ID NO: 12741 - DNA, 25 bp, Mus musculus
ttcaccacaaccgaacgacaaagct

SEQ ID NO: 12742 - DNA, 25 bp, Mus musculus
tcaccacaaccgaacgacaaagctt

SEQ ID NO: 12743 - DNA, 25 bp, Mus musculus
caaccgaacgacaaagcttccatct

SEQ ID NO: 12744 - DNA, 25 bp, Mus musculus
ccgaacgacaaagcttccatcttgg

SEQ ID NO: 12745 - DNA, 25 bp, Mus musculus
gaacgacaaagcttccatcttggga

SEQ ID NO: 12746 - DNA, 25 bp, Mus musculus
aactggattcaagccaactacctcg

SEQ ID NO: 12747 - DNA, 25 bp, Mus musculus
tcgactatggtcacccgttcgccaa

SEQ ID NO: 12748 - DNA, 25 bp, Mus musculus
tccacgctaagggttcctatgagag

SEQ ID NO: 12749 - DNA, 25 bp, Mus musculus
acaacctggcagatgtagcctgtaa

SEQ ID NO: 12750 - DNA, 25 bp, Mus musculus
gcgatgccctcaaggagaagtatga

SEQ ID NO: 12751 - DNA, 25 bp, Mus musculus
atgatagcgccgcggccatgaggct

SEQ ID NO: 12752 - DNA, 25 bp, Mus musculus
ccatgaggctcaacagccggggcaa

SEQ ID NO: 12753 - DNA, 25 bp, Mus musculus
tcgaccccagtccggactactgtgt

SEQ ID NO: 12754 - DNA, 25 bp, Mus musculus
gtccggactactgtgtgcgcaacga

SEQ ID NO: 12755 - DNA, 25 bp, Mus musculus
actactgtgtgcgcaacgagagcac

SEQ ID NO: 12756 - DNA, 25 bp, Mus musculus
cagtgcagaccgaacgctgtcattg

SEQ ID NO: 12757 - DNA, 25 bp, Mus musculus
agaccgaacgctgtcattgcaagtt

SEQ ID NO: 12758 - DNA, 25 bp, Mus musculus
aacgctgtcattgcaagtttcactg

SEQ ID NO: 12759 - DNA, 25 bp, Mus musculus
acgctaagggttcctatgagagcgc

SEQ ID NO: 12760 - DNA, 25 bp, Mus musculus
gttcctatgagagcgcacgcatcct

SEQ ID NO: 12761 - DNA, 25 bp, Mus musculus
gcgcacgcatcctcatgaacttaca

SEQ ID NO: 12762 - DNA, 25 bp, Mus musculus
cacgcatcctcatgaacttacacaa

SEQ ID NO: 12763 - DNA, 25 bp, Mus musculus
acaatgaagcaggccgtaggacagt

SEQ ID NO: 12764 - DNA, 25 bp, Mus musculus
atgaagcaggccgtaggacagtata

SEQ ID NO: 12765 - DNA, 25 bp, Mus musculus
cagtatacaacctggcagatgtagc

SEQ ID NO: 12766 - DNA, 25 bp, Mus musculus
tatacaacctggcagatgtagcctg

SEQ ID NO: 12767 - DNA, 25 bp, Mus musculus
gaccgcttcaagagcgttcaggtgg

SEQ ID NO: 12768 - DNA, 25 bp, Mus musculus
tggtgttgctttgtcagatgcaaaa

SEQ ID NO: 12769 - DNA, 25 bp, Mus musculus
ctggacttattccacatctacagtc

SEQ ID NO: 12770 - DNA, 25 bp, Mus musculus
gacttattccacatctacagtcctg

SEQ ID NO: 12771 - DNA, 25 bp, Mus musculus
cacatctacagtcctgtggggaaga

SEQ ID NO: 12772 - DNA, 25 bp, Mus musculus
atctacagtcctgtggggaagatga

SEQ ID NO: 12773 - DNA, 25 bp, Mus musculus
atgagtgtctgtgaccctggccatt

SEQ ID NO: 12774 - DNA, 25 bp, Mus musculus
tgtgaccctggccattagacccaga

SEQ ID NO: 12775 - DNA, 25 bp, Mus musculus
gaccctggccattagacccagaggc

SEQ ID NO: 12776 - DNA, 25 bp, Mus musculus
cctggccattagacccagaggccct

SEQ ID NO: 12777 - DNA, 25 bp, Mus musculus
cattagacccagaggccctgtggaa

SEQ ID NO: 12778 - DNA, 25 bp, Mus musculus
tagacccagaggccctgtggaaaga

SEQ ID NO: 12779 - DNA, 25 bp, Mus musculus
aaatgcaccgaggttgtggaccagt

SEQ ID NO: 12780 - DNA, 25 bp, Mus musculus
aagtgactgcaccacacggcctcag

SEQ ID NO: 12781 - DNA, 25 bp, Mus musculus
ggccctctgtgaggactggatttgc

SEQ ID NO: 12782 - DNA, 25 bp, Mus musculus
ttgcggaaatccacaaccagtggga

SEQ ID NO: 12783 - DNA, 25 bp, Mus musculus
cggaaatccacaaccagtgggagag

SEQ ID NO: 12784 - DNA, 25 bp, Mus musculus
tctggccaggacttttgggacatgg

SEQ ID NO: 12785 - DNA, 25 bp, Mus musculus
tctgtgcgccatagcctccaggaga

SEQ ID NO: 12786 - DNA, 25 bp, Mus musculus
gtgcgccatagcctccaggagacag

SEQ ID NO: 12787 - DNA, 25 bp, Mus musculus
gcaccgccaggagagcgtacagctc

SEQ ID NO: 12788 - DNA, 25 bp, Mus musculus
gagcgtacagctcgaggagaactgt

SEQ ID NO: 12789 - DNA, 25 bp, Mus musculus
gtctgagtccagcagctccctagga

SEQ ID NO: 12790 - DNA, 25 bp, Mus musculus
tgagtccagcagctccctaggaaaa

SEQ ID NO: 12791 - DNA, 25 bp, Mus musculus
cagcagctccctaggaaaagtacct

SEQ ID NO: 12792 - DNA, 25 bp, Mus musculus
tatccaggccttgggaaattacagg

SEQ ID NO: 12793 - DNA, 25 bp, Mus musculus
ttacaggggccagccaggaacttgg

SEQ ID NO: 12794 - DNA, 25 bp, Mus musculus
ccctttgctagttctgcaggacatc

SEQ ID NO: 12795 - DNA, 25 bp, Mus musculus
gctagttctgcaggacatcactccc

SEQ ID NO: 12796 - DNA, 25 bp, Mus musculus
ccagactctgccctctggaaataat

SEQ ID NO: 12797 - DNA, 25 bp, Mus musculus
tcctcagaattactgggatggatgg

SEQ ID NO: 12798 - DNA, 25 bp, Mus musculus
ttactgggatggatgggtgagttta

SEQ ID NO: 12799 - DNA, 25 bp, Mus musculus
tctgtgccgcttccactggtgctgc

SEQ ID NO: 12800 - DNA, 25 bp, Mus musculus
ggaactcagcctgtgcctctgaccc

SEQ ID NO: 12801 - DNA, 25 bp, Mus musculus
ctgcctcggaactgctggcagccac

SEQ ID NO: 12802 - DNA, 25 bp, Mus musculus
aactgctggcagccacctctgggcc

SEQ ID NO: 12803 - DNA, 25 bp, Mus musculus
cagccacctctgggccatctacagg

SEQ ID NO: 12804 - DNA, 25 bp, Mus musculus
ccacctctgggccatctacaggact

SEQ ID NO: 12805 - DNA, 25 bp, Mus musculus
cctctgggccatctacaggactatt

SEQ ID NO: 12806 - DNA, 25 bp, Mus musculus
gctgtctgagtccagcagctcccta

SEQ ID NO: 12807 - DNA, 25 bp, Mus musculus
gcactatctattcatcttcatctgt

SEQ ID NO: 12808 - DNA, 25 bp, Mus musculus
tctattcatcttcatctgtgtcagt

SEQ ID NO: 12809 - DNA, 25 bp, Mus musculus
agcgcaggcagctgctgctggaagc

SEQ ID NO: 12810 - DNA, 25 bp, Mus musculus
acccctggttctgctttcatgctga

SEQ ID NO: 12811 - DNA, 25 bp, Mus musculus
ggttctgctttcatgctgataatgt

SEQ ID NO: 12812 - DNA, 25 bp, Mus musculus
tactgagacttcggtatttgactct

SEQ ID NO: 12813 - DNA, 25 bp, Mus musculus
tgactctatttgtatcctagcagca

SEQ ID NO: 12814 - DNA, 25 bp, Mus musculus
atgtttcctgtttcgtgactatata

SEQ ID NO: 12815 - DNA, 25 bp, Mus musculus
cctgtttcgtgactatatagagatg

SEQ ID NO: 12816 - DNA, 25 bp, Mus musculus
tttcaatgtaattctctggtcttca

SEQ ID NO: 12817 - DNA, 25 bp, Mus musculus
tctctggtcttcagtcattgtatga

SEQ ID NO: 12818 - DNA, 25 bp, Mus musculus
gtcttcagtcattgtatgatgtgtt

SEQ ID NO: 12819 - DNA, 25 bp, Mus musculus
catctgtgtcagtgagcagtgaacg

SEQ ID NO: 12820 - DNA, 25 bp, Mus musculus
ttatttaacacatgttgttgtgagt

SEQ ID NO: 12821 - DNA, 25 bp, Mus musculus
aacacatgttgttgtgagtgaaaaa

SEQ ID NO: 12822 - DNA, 25 bp, Mus musculus
ctgtccaagcttgccagtgacgcag

SEQ ID NO: 12823 - DNA, 25 bp, Mus musculus
aagcttgccagtgacgcagtctcca

SEQ ID NO: 12824 - DNA, 25 bp, Mus musculus
gccagtgacgcagtctccaaagaaa

SEQ ID NO: 12825 - DNA, 25 bp, Mus musculus
agggcccttctgtgagccagcgcag

SEQ ID NO: 12826 - DNA, 25 bp, Mus musculus
cttctgtgagccagcgcaggcagct

SEQ ID NO: 12827 - DNA, 25 bp, Mus musculus
tcgtggatgcccgggagatcaagca

SEQ ID NO: 12828 - DNA, 25 bp, Mus musculus
atgcccgggagatcaagcagaatgc

SEQ ID NO: 12829 - DNA, 25 bp, Mus musculus
tcaagaagcccctgtcctaccgcaa

SEQ ID NO: 12830 - DNA, 25 bp, Mus musculus
tggacactgacctggtgtatatcga

SEQ ID NO: 12831 - DNA, 25 bp, Mus musculus
ctgacctggtgtatatcgagttgtc

SEQ ID NO: 12832 - DNA, 25 bp, Mus musculus
atatcgagttgtcacccaattactg

SEQ ID NO: 12833 - DNA, 25 bp, Mus musculus
agggccgagcctgcaataagacagc

SEQ ID NO: 12834 - DNA, 25 bp, Mus musculus
gcaataagacagcccctcaggccag

SEQ ID NO: 12835 - DNA, 25 bp, Mus musculus
cccctcaggccagtggctgtgacct

SEQ ID NO: 12836 - DNA, 25 bp, Mus musculus
aggccagtggctgtgacctcatgtg

SEQ ID NO: 12837 - DNA, 25 bp, Mus musculus
gccgtggctacaacacacaccagta

SEQ ID NO: 12838 - DNA, 25 bp, Mus musculus
acacacaccagtacgcccgggtgtg

SEQ ID NO: 12839 - DNA, 25 bp, Mus musculus
agaatgcccggacgctcatgaactt

SEQ ID NO: 12840 - DNA, 25 bp, Mus musculus
cgctcatgaacttacacaataacga

SEQ ID NO: 12841 - DNA, 25 bp, Mus musculus
gctggaccacactgccacagttccg

SEQ ID NO: 12842 - DNA, 25 bp, Mus musculus
ccacactgccacagttccgagagct

SEQ ID NO: 12843 - DNA, 25 bp, Mus musculus
agttccgagagctaggctacgtgct

SEQ ID NO: 12844 - DNA, 25 bp, Mus musculus
taggctacgtgctcaaggacaaata

SEQ ID NO: 12845 - DNA, 25 bp, Mus musculus
tggagcctgtgcgtgccagtcgaaa

SEQ ID NO: 12846 - DNA, 25 bp, Mus musculus
ggcccacctttctgaagatcaagaa

SEQ ID NO: 12847 - DNA, 25 bp, Mus musculus
caacaccctgaatccaactcagcgg

SEQ ID NO: 12848 - DNA, 25 bp, Mus musculus
aacaccctgaatccaactcagcggg

SEQ ID NO: 12849 - DNA, 25 bp, Mus musculus
tccaactcagcgggaaatgacgttt

SEQ ID NO: 12850 - DNA, 25 bp, Mus musculus
tttttgccaaattctcagcgtttat

SEQ ID NO: 12851 - DNA, 25 bp, Mus musculus
ttttgccaaattctcagcgtttatt

SEQ ID NO: 12852 - DNA, 25 bp, Mus musculus
tttgccaaattctcagcgtttatta

SEQ ID NO: 12853 - DNA, 25 bp, Mus musculus
ttgccaaattctcagcgtttattaa

SEQ ID NO: 12854 - DNA, 25 bp, Mus musculus
tgccaaattctcagcgtttattaag

SEQ ID NO: 12855 - DNA, 25 bp, Mus musculus
gccaaattctcagcgtttattaaga

SEQ ID NO: 12856 - DNA, 25 bp, Mus musculus
ttctcagcgtttattaagaacacca

SEQ ID NO: 12857 - DNA, 25 bp, Mus musculus
acaccctgaatccaactcagcggga

SEQ ID NO: 12858 - DNA, 25 bp, Mus musculus
caccctgaatccaactcagcgggaa

SEQ ID NO: 12859 - DNA, 25 bp, Mus musculus
ccctgaatccaactcagcgggaaat

SEQ ID NO: 12860 - DNA, 25 bp, Mus musculus
cctgaatccaactcagcgggaaatg

SEQ ID NO: 12861 - DNA, 25 bp, Mus musculus
ctgaatccaactcagcgggaaatga

SEQ ID NO: 12862 - DNA, 25 bp, Mus musculus
tgaatccaactcagcgggaaatgac

SEQ ID NO: 12863 - DNA, 25 bp, Mus musculus
aatccaactcagcgggaaatgacgt

SEQ ID NO: 12864 - DNA, 25 bp, Mus musculus
atccaactcagcgggaaatgacgtt

SEQ ID NO: 12865 - DNA, 25 bp, Mus musculus
ccgacggctgtgacaccatgtgctg

SEQ ID NO: 12866 - DNA, 25 bp, Mus musculus
gctgtgacaccatgtgctgcggccg

SEQ ID NO: 12867 - DNA, 25 bp, Mus musculus
agcgcaccgaggtcttcacctgcaa

SEQ ID NO: 12868 - DNA, 25 bp, Mus musculus
ccgaggtcttcacctgcaagtgagg

SEQ ID NO: 12869 - DNA, 25 bp, Mus musculus
atccttctttgcttctggagctgcc

SEQ ID NO: 12870 - DNA, 25 bp, Mus musculus
agctgccagctgcaggcacaggagg

SEQ ID NO: 12871 - DNA, 25 bp, Mus musculus
gagatactccaggctccttcctact

SEQ ID NO: 12872 - DNA, 25 bp, Mus musculus
gcatccaaggtcaacgcaatggtgg

SEQ ID NO: 12873 - DNA, 25 bp, Mus musculus
tccaaggtcaacgcaatggtggtct

SEQ ID NO: 12874 - DNA, 25 bp, Mus musculus
aaggtcaacgcaatggtggtctggt

SEQ ID NO: 12875 - DNA, 25 bp, Mus musculus
gaaccacaaagggaccatgagactc

SEQ ID NO: 12876 - DNA, 25 bp, Mus musculus
tccctgcctgtgactggacacagaa

SEQ ID NO: 12877 - DNA, 25 bp, Mus musculus
gtgacaccatgtgctgcggccgcgg

SEQ ID NO: 12878 - DNA, 25 bp, Mus musculus
gcggctacaacacgcaccagtacac

SEQ ID NO: 12879 - DNA, 25 bp, Mus musculus
gctacaacacgcaccagtacaccaa

SEQ ID NO: 12880 - DNA, 25 bp, Mus musculus
agtacaccaaggtgtggcagtgtaa

SEQ ID NO: 12881 - DNA, 25 bp, Mus musculus
gtaactgcaaattccactggtgttg

SEQ ID NO: 12882 - DNA, 25 bp, Mus musculus
gttgcttcgtcaagtgcaacacgtg

SEQ ID NO: 12883 - DNA, 25 bp, Mus musculus
gcttcgtcaagtgcaacacgtgcag

SEQ ID NO: 12884 - DNA, 25 bp, Mus musculus
gcaacacgtgcagcgagcgcaccga

SEQ ID NO: 12885 - DNA, 25 bp, Mus musculus
gccattgccactacgagcaatctgc

SEQ ID NO: 12886 - DNA, 25 bp, Mus musculus
ccattgccactacgagcaatctgca

SEQ ID NO: 12887 - DNA, 25 bp, Mus musculus
tcctgtcttgaagggacttgctact

SEQ ID NO: 12888 - DNA, 25 bp, Mus musculus
gacttgctactgtcccttcatgccc

SEQ ID NO: 12889 - DNA, 25 bp, Mus musculus
gctggctacgcgcacagctggagca

SEQ ID NO: 12890 - DNA, 25 bp, Mus musculus
ctggctacgcgcacagctggagcag

SEQ ID NO: 12891 - DNA, 25 bp, Mus musculus
tggctacgcgcacagctggagcagt

SEQ ID NO: 12892 - DNA, 25 bp, Mus musculus
ggctacgcgcacagctggagcagta

SEQ ID NO: 12893 - DNA, 25 bp, Mus musculus
gctacgcgcacagctggagcagtac

SEQ ID NO: 12894 - DNA, 25 bp, Mus musculus
ctacgcgcacagctggagcagtacc

SEQ ID NO: 12895 - DNA, 25 bp, Mus musculus
tacgcgcacagctggagcagtacca

SEQ ID NO: 12896 - DNA, 25 bp, Mus musculus
cattgccactacgagcaatctgcag

SEQ ID NO: 12897 - DNA, 25 bp, Mus musculus
attgccactacgagcaatctgcaga

SEQ ID NO: 12898 - DNA, 25 bp, Mus musculus
ttgccactacgagcaatctgcagac

SEQ ID NO: 12899 - DNA, 25 bp, Mus musculus
tgccactacgagcaatctgcagact

SEQ ID NO: 12900 - DNA, 25 bp, Mus musculus
gccactacgagcaatctgcagacta

SEQ ID NO: 12901 - DNA, 25 bp, Mus musculus
ccctcctgtcttgaagggacttgct

SEQ ID NO: 12902 - DNA, 25 bp, Mus musculus
cctcctgtcttgaagggacttgcta

SEQ ID NO: 12903 - DNA, 25 bp, Mus musculus
ctcctgtcttgaagggacttgctac

SEQ ID NO: 12904 - DNA, 25 bp, Mus musculus
agcactgggctcttaagaaatgatg

SEQ ID NO: 12905 - DNA, 25 bp, Mus musculus
taattaggtacatcctcagagatgt

SEQ ID NO: 12906 - DNA, 25 bp, Mus musculus
aggatctcactggtaagactgttct

SEQ ID NO: 12907 - DNA, 25 bp, Mus musculus
atctcactggtaagactgttcttaa

SEQ ID NO: 12908 - DNA, 25 bp, Mus musculus
agtatctttgaatctgcaagtatgt

SEQ ID NO: 12909 - DNA, 25 bp, Mus musculus
atgatgtgctctttgtcaactaaaa

SEQ ID NO: 12910 - DNA, 25 bp, Mus musculus
gcatcactgtgtggatgtcaatctt

SEQ ID NO: 12911 - DNA, 25 bp, Mus musculus
taacctgcatctttttccacttggc

SEQ ID NO: 12912 - DNA, 25 bp, Mus musculus
cctgcatctttttccacttggctgt

SEQ ID NO: 12913 - DNA, 25 bp, Mus musculus
gcatctttttccacttggctgtcaa

SEQ ID NO: 12914 - DNA, 25 bp, Mus musculus
ttttccacttggctgtcaattaaag

SEQ ID NO: 12915 - DNA, 25 bp, Mus musculus
tccacttggctgtcaattaaagtct

SEQ ID NO: 12916 - DNA, 25 bp, Mus musculus
cctcttgtgcaggatgtggaggact

SEQ ID NO: 12917 - DNA, 25 bp, Mus musculus
gactcgttccatcatctggggcatc

SEQ ID NO: 12918 - DNA, 25 bp, Mus musculus
tcgttccatcatctggggcatcttt

SEQ ID NO: 12919 - DNA, 25 bp, Mus musculus
ttccatcatctggggcatctttaga

SEQ ID NO: 12920 - DNA, 25 bp, Mus musculus
agtgtatagaccacactggttatgt

SEQ ID NO: 12921 - DNA, 25 bp, Mus musculus
tagaccacactggttatgtggcttc

SEQ ID NO: 12922 - DNA, 25 bp, Mus musculus
accacactggttatgtggcttcaag

SEQ ID NO: 12923 - DNA, 25 bp, Mus musculus
ggctggtccaggatctcactggtaa

SEQ ID NO: 12924 - DNA, 25 bp, Mus musculus
ccttgctaggcactgggatgcaaag

SEQ ID NO: 12925 - DNA, 25 bp, Mus musculus
cattctcattgtcctgtgtatctaa

SEQ ID NO: 12926 - DNA, 25 bp, Mus musculus
acctaactgttggctttatcagtga

SEQ ID NO: 12927 - DNA, 25 bp, Mus musculus
gattactttctaagtttcataatgg

SEQ ID NO: 12928 - DNA, 25 bp, Mus musculus
tactttctaagtttcataatggctg

SEQ ID NO: 12929 - DNA, 25 bp, Mus musculus
taatgcttatcacctaacaccacct

SEQ ID NO: 12930 - DNA, 25 bp, Mus musculus
tgcttatcacctaacaccacctaat

SEQ ID NO: 12931 - DNA, 25 bp, Mus musculus
ttttaccatgctatgtgttgagcga

SEQ ID NO: 12932 - DNA, 25 bp, Mus musculus
taccatgctatgtgttgagcgaaca

SEQ ID NO: 12933 - DNA, 25 bp, Mus musculus
tagattgctttctagcattatgtag

SEQ ID NO: 12934 - DNA, 25 bp, Mus musculus
tctagaccaaaacttcaattcactt

SEQ ID NO: 12935 - DNA, 25 bp, Mus musculus
ccaaaacttcaattcacttcaatga

SEQ ID NO: 12936 - DNA, 25 bp, Mus musculus
tctcattgtcctgtgtatctaaaga

SEQ ID NO: 12937 - DNA, 25 bp, Mus musculus
ttcaattcacttcaatgaggaaatg

SEQ ID NO: 12938 - DNA, 25 bp, Mus musculus
taaactgccatatatatgtgtatat

SEQ ID NO: 12939 - DNA, 25 bp, Mus musculus
atgactttgcttttatcccaggcat

SEQ ID NO: 12940 - DNA, 25 bp, Mus musculus
actttgcttttatcccaggcatgca

SEQ ID NO: 12941 - DNA, 25 bp, Mus musculus
ttgcttttatcccaggcatgcacaa

SEQ ID NO: 12942 - DNA, 25 bp, Mus musculus
ttatcccaggcatgcacaacagatc

SEQ ID NO: 12943 - DNA, 25 bp, Mus musculus
tcccaggcatgcacaacagatctgt

SEQ ID NO: 12944 - DNA, 25 bp, Mus musculus
gggacctaactgttggctttatcag

SEQ ID NO: 12945 - DNA, 25 bp, Mus musculus
acagacccatgggcttggtagtgcc

SEQ ID NO: 12946 - DNA, 25 bp, Mus musculus
agacccatgggcttggtagtgcccg

SEQ ID NO: 12947 - DNA, 25 bp, Mus musculus
cctgcgatatcccagatcatgtctc

SEQ ID NO: 12948 - DNA, 25 bp, Mus musculus
tgcgatatcccagatcatgtctctg

SEQ ID NO: 12949 - DNA, 25 bp, Mus musculus
cctgcggcatcttctggccgaatgg

SEQ ID NO: 12950 - DNA, 25 bp, Mus musculus
ctgcggcatcttctggccgaatggt

SEQ ID NO: 12951 - DNA, 25 bp, Mus musculus
gcggcatcttctggccgaatggtcg

SEQ ID NO: 12952 - DNA, 25 bp, Mus musculus
gcatcttctggccgaatggtcggag

SEQ ID NO: 12953 - DNA, 25 bp, Mus musculus
catcttctggccgaatggtcggaga

SEQ ID NO: 12954 - DNA, 25 bp, Mus musculus
tcttctggccgaatggtcggagaat

SEQ ID NO: 12955 - DNA, 25 bp, Mus musculus
cttctggccgaatggtcggagaatc

SEQ ID NO: 12956 - DNA, 25 bp, Mus musculus
tctggccgaatggtcggagaatcag

SEQ ID NO: 12957 - DNA, 25 bp, Mus musculus
gacccatgggcttggtagtgcccgc

SEQ ID NO: 12958 - DNA, 25 bp, Mus musculus
cccatgggcttggtagtgcccgctg

SEQ ID NO: 12959 - DNA, 25 bp, Mus musculus
tgcgaggcaccctgcgatatcccag

SEQ ID NO: 12960 - DNA, 25 bp, Mus musculus
gaggcaccctgcgatatcccagatc

SEQ ID NO: 12961 - DNA, 25 bp, Mus musculus
aggcaccctgcgatatcccagatca

SEQ ID NO: 12962 - DNA, 25 bp, Mus musculus
gcaccctgcgatatcccagatcatg

SEQ ID NO: 12963 - DNA, 25 bp, Mus musculus
caccctgcgatatcccagatcatgt

SEQ ID NO: 12964 - DNA, 25 bp, Mus musculus
ccctgcgatatcccagatcatgtct

SEQ ID NO: 12965 - DNA, 25 bp, Mus musculus
ttaccaagcgacagaaccagagtca

SEQ ID NO: 12966 - DNA, 25 bp, Mus musculus
acagtagtcacaacaacaagagcgg

SEQ ID NO: 12967 - DNA, 25 bp, Mus musculus
tcactgagcgtccgcaaaactgaaa

SEQ ID NO: 12968 - DNA, 25 bp, Mus musculus
actgaaactgcgatcgcaccagact

SEQ ID NO: 12969 - DNA, 25 bp, Mus musculus
actgcgatcgcaccagacttagaaa

SEQ ID NO: 12970 - DNA, 25 bp, Mus musculus
gcgatcgcaccagacttagaaacag

SEQ ID NO: 12971 - DNA, 25 bp, Mus musculus
cacagacatcagaacacagacatca

SEQ ID NO: 12972 - DNA, 25 bp, Mus musculus
catcagaacacagacatcagaccaa

SEQ ID NO: 12973 - DNA, 25 bp, Mus musculus
gctgtttcccggccaatgcaccaaa

SEQ ID NO: 12974 - DNA, 25 bp, Mus musculus
tcccggccaatgcaccaaatgaaag

SEQ ID NO: 12975 - DNA, 25 bp, Mus musculus
cggccaatgcaccaaatgaaagatt

SEQ ID NO: 12976 - DNA, 25 bp, Mus musculus
ccaatgcaccaaatgaaagattttc

SEQ ID NO: 12977 - DNA, 25 bp, Mus musculus
gtcacaacaacaagagcggacacga

SEQ ID NO: 12978 - DNA, 25 bp, Mus musculus
acaacaagagcggacacgagactaa

SEQ ID NO: 12979 - DNA, 25 bp, Mus musculus
gaatcagatggcctctctaaggccg

SEQ ID NO: 12980 - DNA, 25 bp, Mus musculus
tctaaggccggccaattgagaccct

SEQ ID NO: 12981 - DNA, 25 bp, Mus musculus
ggccaattgagaccctctgcacgag

SEQ ID NO: 12982 - DNA, 25 bp, Mus musculus
caattgagaccctctgcacgaggtg

SEQ ID NO: 12983 - DNA, 25 bp, Mus musculus
tgttcctcctgggacgtctcccagg

SEQ ID NO: 12984 - DNA, 25 bp, Mus musculus
acggtggacacctggacacgtctat

SEQ ID NO: 12985 - DNA, 25 bp, Mus musculus
ccaccagctgagaattcgtccgctc

SEQ ID NO: 12986 - DNA, 25 bp, Mus musculus
taaatgccggcttaccatctctacc

SEQ ID NO: 12987 - DNA, 25 bp, Mus musculus
aagtgcttgctttttgcccgctgac

SEQ ID NO: 12988 - DNA, 25 bp, Mus musculus
ctttttgcccgctgaccagatacat

SEQ ID NO: 12989 - DNA, 25 bp, Mus musculus
tttgcccgctgaccagatacattag

SEQ ID NO: 12990 - DNA, 25 bp, Mus musculus
cgctgaccagatacattagaactat

SEQ ID NO: 12991 - DNA, 25 bp, Mus musculus
acattagaactatctgcattatcat

SEQ ID NO: 12992 - DNA, 25 bp, Mus musculus
tctgcattatcattgcacatggggt

SEQ ID NO: 12993 - DNA, 25 bp, Mus musculus
gcattatcattgcacatggggtttt

SEQ ID NO: 12994 - DNA, 25 bp, Mus musculus
ttatcattgcacatggggtttttat

SEQ ID NO: 12995 - DNA, 25 bp, Mus musculus
attgtttcatatctggtcaagttga

SEQ ID NO: 12996 - DNA, 25 bp, Mus musculus
gtttcatatctggtcaagttgagat

SEQ ID NO: 12997 - DNA, 25 bp, Mus musculus
atgccggcttaccatctctaccatc

SEQ ID NO: 12998 - DNA, 25 bp, Mus musculus
gcttaccatctctaccatcatccgg

SEQ ID NO: 12999 - DNA, 25 bp, Mus musculus
catctctaccatcatccggtttggt

SEQ ID NO: 13000 - DNA, 25 bp, Mus musculus
taccatcatccggtttggtcatcca

SEQ ID NO: 13001 - DNA, 25 bp, Mus musculus
catcatccggtttggtcatccacca

SEQ ID NO: 13002 - DNA, 25 bp, Mus musculus
gtttggtcatccaccaagaagaaat

SEQ ID NO: 13003 - DNA, 25 bp, Mus musculus
tggtcatccaccaagaagaaatgaa

SEQ ID NO: 13004 - DNA, 25 bp, Mus musculus
tcatccaccaagaagaaatgaatat

SEQ ID NO: 13005 - DNA, 25 bp, Mus musculus
ttaggctccatgaagaaggggtcat

SEQ ID NO: 13006 - DNA, 25 bp, Mus musculus
tcatttaccgcagtacccgcctggt

SEQ ID NO: 13007 - DNA, 25 bp, Mus musculus
ctgtgcctggctacaaggagaaggt

SEQ ID NO: 13008 - DNA, 25 bp, Mus musculus
tcctcgtgtcctttgcctacaaggt

SEQ ID NO: 13009 - DNA, 25 bp, Mus musculus
tcgtgtcctttgcctacaaggtcca

SEQ ID NO: 13010 - DNA, 25 bp, Mus musculus
cctacaaggtccaaggctcagacag

SEQ ID NO: 13011 - DNA, 25 bp, Mus musculus
acaaggtccaaggctcagacagcga

SEQ ID NO: 13012 - DNA, 25 bp, Mus musculus
tccaaggctcagacagcgacgagga

SEQ ID NO: 13013 - DNA, 25 bp, Mus musculus
aaggctcagacagcgacgaggaggt

SEQ ID NO: 13014 - DNA, 25 bp, Mus musculus
tggcaacaacccggatcgagacaat

SEQ ID NO: 13015 - DNA, 25 bp, Mus musculus
caacaacccggatcgagacaatgct

SEQ ID NO: 13016 - DNA, 25 bp, Mus musculus
caacccggatcgagacaatgctggg

SEQ ID NO: 13017 - DNA, 25 bp, Mus musculus
accgcagtacccgcctggtcaactg

SEQ ID NO: 13018 - DNA, 25 bp, Mus musculus
gcctggtcaactggtcctgcaccct

SEQ ID NO: 13019 - DNA, 25 bp, Mus musculus
tggtcaactggtcctgcaccctcaa

SEQ ID NO: 13020 - DNA, 25 bp, Mus musculus
ccctcaactctgccatttctgacat

SEQ ID NO: 13021 - DNA, 25 bp, Mus musculus
ctgccatttctgacatcgaggtgga

SEQ ID NO: 13022 - DNA, 25 bp, Mus musculus
ccatttctgacatcgaggtggataa

SEQ ID NO: 13023 - DNA, 25 bp, Mus musculus
tttctgacatcgaggtggataagaa

SEQ ID NO: 13024 - DNA, 25 bp, Mus musculus
ccctgctctctgtgcctggctacaa

SEQ ID NO: 13025 - DNA, 25 bp, Mus musculus
cagaagttctctttgatgagaagat

SEQ ID NO: 13026 - DNA, 25 bp, Mus musculus
agttctctttgatgagaagataaga

SEQ ID NO: 13027 - DNA, 25 bp, Mus musculus
agcaatgcatcaagctcagctgatc

SEQ ID NO: 13028 - DNA, 25 bp, Mus musculus
caatgcatcaagctcagctgatctc

SEQ ID NO: 13029 - DNA, 25 bp, Mus musculus
agctcagctgatctccaagatccca

SEQ ID NO: 13030 - DNA, 25 bp, Mus musculus
ctcagctgatctccaagatcccaca

SEQ ID NO: 13031 - DNA, 25 bp, Mus musculus
gctgatctccaagatcccacacatc

SEQ ID NO: 13032 - DNA, 25 bp, Mus musculus
tgatctccaagatcccacacatcct

SEQ ID NO: 13033 - DNA, 25 bp, Mus musculus
gatcccacacatcctgaaggagatg

SEQ ID NO: 13034 - DNA, 25 bp, Mus musculus
tcccacacatcctgaaggagatgta

SEQ ID NO: 13035 - DNA, 25 bp, Mus musculus
gtatgatgccgacctgttagaggag

SEQ ID NO: 13036 - DNA, 25 bp, Mus musculus
atgatgccgacctgttagaggagga

SEQ ID NO: 13037 - DNA, 25 bp, Mus musculus
gaaatacaggcgccattttctaaga

SEQ ID NO: 13038 - DNA, 25 bp, Mus musculus
aatacaggcgccattttctaagatt

SEQ ID NO: 13039 - DNA, 25 bp, Mus musculus
caggcgccattttctaagattttgt

SEQ ID NO: 13040 - DNA, 25 bp, Mus musculus
ggcgccattttctaagattttgtca

SEQ ID NO: 13041 - DNA, 25 bp, Mus musculus
aaaggctcagcggtaccttcttcat

SEQ ID NO: 13042 - DNA, 25 bp, Mus musculus
aggctcagcggtaccttcttcatgg

SEQ ID NO: 13043 - DNA, 25 bp, Mus musculus
gtaccttcttcatggtttggaatgt

SEQ ID NO: 13044 - DNA, 25 bp, Mus musculus
accttcttcatggtttggaatgtgt

SEQ ID NO: 13045 - DNA, 25 bp, Mus musculus
aagatgaagaccctcttaagacgag

SEQ ID NO: 13046 - DNA, 25 bp, Mus musculus
gatgaagaccctcttaagacgagaa

SEQ ID NO: 13047 - DNA, 25 bp, Mus musculus
tacctcctgggacgagatcaggcct

SEQ ID NO: 13048 - DNA, 25 bp, Mus musculus
cctcctgggacgagatcaggccttt

SEQ ID NO: 13049 - DNA, 25 bp, Mus musculus
ctcctgggacgagatcaggcctttc

SEQ ID NO: 13050 - DNA, 25 bp, Mus musculus
actgaaagctgcagggcctgtgctc

SEQ ID NO: 13051 - DNA, 25 bp, Mus musculus
tgaaagctgcagggcctgtgctcag

SEQ ID NO: 13052 - DNA, 25 bp, Mus musculus
aagctgcagggcctgtgctcaggta

SEQ ID NO: 13053 - DNA, 25 bp, Mus musculus
agctgcagggcctgtgctcaggtaa

SEQ ID NO: 13054 - DNA, 25 bp, Mus musculus
cagggcctgtgctcaggtaaaccca

SEQ ID NO: 13055 - DNA, 25 bp, Mus musculus
agggcctgtgctcaggtaaacccag

SEQ ID NO: 13056 - DNA, 25 bp, Mus musculus
tgctcaggtaaacccaggaaaagct

SEQ ID NO: 13057 - DNA, 25 bp, Mus musculus
gaagaccctcttaagacgagaagag

SEQ ID NO: 13058 - DNA, 25 bp, Mus musculus
accctcttaagacgagaagagattg

SEQ ID NO: 13059 - DNA, 25 bp, Mus musculus
agagattgacacctacctcctggga

SEQ ID NO: 13060 - DNA, 25 bp, Mus musculus
gagattgacacctacctcctgggac

SEQ ID NO: 13061 - DNA, 25 bp, Mus musculus
gattgacacctacctcctgggacga

SEQ ID NO: 13062 - DNA, 25 bp, Mus musculus
attgacacctacctcctgggacgag

SEQ ID NO: 13063 - DNA, 25 bp, Mus musculus
tgacacctacctcctgggacgagat

SEQ ID NO: 13064 - DNA, 25 bp, Mus musculus
cacctacctcctgggacgagatcag

SEQ ID NO: 13065 - DNA, 25 bp, Mus musculus
caacttctgaaacactttggatgtc

SEQ ID NO: 13066 - DNA, 25 bp, Mus musculus
cttctgaaacactttggatgtccta

SEQ ID NO: 13067 - DNA, 25 bp, Mus musculus
cacatcttcaacatgaatttgcacc

SEQ ID NO: 13068 - DNA, 25 bp, Mus musculus
atcttcaacatgaatttgcacctta

SEQ ID NO: 13069 - DNA, 25 bp, Mus musculus
aacatgaatttgcaccttacagaaa

SEQ ID NO: 13070 - DNA, 25 bp, Mus musculus
atgaatttgcaccttacagaaaact

SEQ ID NO: 13071 - DNA, 25 bp, Mus musculus
ttgcaccttacagaaaactttcagg

SEQ ID NO: 13072 - DNA, 25 bp, Mus musculus
tatgttcaaaactcacttgccataa

SEQ ID NO: 13073 - DNA, 25 bp, Mus musculus
gttcaaaactcacttgccataaagg

SEQ ID NO: 13074 - DNA, 25 bp, Mus musculus
aactcacttgccataaaggccaaat

SEQ ID NO: 13075 - DNA, 25 bp, Mus musculus
tcacttgccataaaggccaaatagt

SEQ ID NO: 13076 - DNA, 25 bp, Mus musculus
cttgccataaaggccaaatagttat

SEQ ID NO: 13077 - DNA, 25 bp, Mus musculus
atcacttcaaatgcatattagttga

SEQ ID NO: 13078 - DNA, 25 bp, Mus musculus
gtttcaaatgaactctcttaataga

SEQ ID NO: 13079 - DNA, 25 bp, Mus musculus
tcaaatgaactctcttaatagataa

SEQ ID NO: 13080 - DNA, 25 bp, Mus musculus
aatgaactctcttaatagataatat

SEQ ID NO: 13081 - DNA, 25 bp, Mus musculus
ggtgacattcacatatactgaaaga

SEQ ID NO: 13082 - DNA, 25 bp, Mus musculus
gacattcacatatactgaaagaatg

SEQ ID NO: 13083 - DNA, 25 bp, Mus musculus
atggaacacatcttcaacatgaatt

SEQ ID NO: 13084 - DNA, 25 bp, Mus musculus
gaacacatcttcaacatgaatttgc

SEQ ID NO: 13085 - DNA, 25 bp, Mus musculus
caataggaaccttgtttctgtcgag

SEQ ID NO: 13086 - DNA, 25 bp, Mus musculus
ataggaaccttgtttctgtcgagct

SEQ ID NO: 13087 - DNA, 25 bp, Mus musculus
tcgagctcttcaaggcagtgattct

SEQ ID NO: 13088 - DNA, 25 bp, Mus musculus
cgagctcttcaaggcagtgattctg

SEQ ID NO: 13089 - DNA, 25 bp, Mus musculus
gagctcttcaaggcagtgattctga

SEQ ID NO: 13090 - DNA, 25 bp, Mus musculus
gctcttcaaggcagtgattctgaca

SEQ ID NO: 13091 - DNA, 25 bp, Mus musculus
ctcttcaaggcagtgattctgacag

SEQ ID NO: 13092 - DNA, 25 bp, Mus musculus
tcttcaaggcagtgattctgacagc

SEQ ID NO: 13093 - DNA, 25 bp, Mus musculus
atgataacatgttccgattggaaaa

SEQ ID NO: 13094 - DNA, 25 bp, Mus musculus
tgataacatgttccgattggaaaaa

SEQ ID NO: 13095 - DNA, 25 bp, Mus musculus
gataacatgttccgattggaaaaag

SEQ ID NO: 13096 - DNA, 25 bp, Mus musculus
taacatgttccgattggaaaaagag

SEQ ID NO: 13097 - DNA, 25 bp, Mus musculus
aggaaccttgtttctgtcgagctct

SEQ ID NO: 13098 - DNA, 25 bp, Mus musculus
ggaaccttgtttctgtcgagctctt

SEQ ID NO: 13099 - DNA, 25 bp, Mus musculus
tgtttctgtcgagctcttcaaggca

SEQ ID NO: 13100 - DNA, 25 bp, Mus musculus
gtttctgtcgagctcttcaaggcag

SEQ ID NO: 13101 - DNA, 25 bp, Mus musculus
tttctgtcgagctcttcaaggcagt

SEQ ID NO: 13102 - DNA, 25 bp, Mus musculus
tctgtcgagctcttcaaggcagtga

SEQ ID NO: 13103 - DNA, 25 bp, Mus musculus
ctgtcgagctcttcaaggcagtgat

SEQ ID NO: 13104 - DNA, 25 bp, Mus musculus
tgtcgagctcttcaaggcagtgatt

SEQ ID NO: 13105 - DNA, 25 bp, Mus musculus
atctggcctttctgctctagatcac

SEQ ID NO: 13106 - DNA, 25 bp, Mus musculus
agaatcaatacactgacgctgagct

SEQ ID NO: 13107 - DNA, 25 bp, Mus musculus
ctccattagttcttctcatgtgcca

SEQ ID NO: 13108 - DNA, 25 bp, Mus musculus
ccattagttcttctcatgtgccaga

SEQ ID NO: 13109 - DNA, 25 bp, Mus musculus
cacagcatggcaagggctgcagcag

SEQ ID NO: 13110 - DNA, 25 bp, Mus musculus
cagcatggcaagggctgcagcagaa

SEQ ID NO: 13111 - DNA, 25 bp, Mus musculus
tataaccctgaagggtcacgcattt

SEQ ID NO: 13112 - DNA, 25 bp, Mus musculus
ttgttttgcacagccaaggcagctg

SEQ ID NO: 13113 - DNA, 25 bp, Mus musculus
cacagccaaggcagctgctgacttc

SEQ ID NO: 13114 - DNA, 25 bp, Mus musculus
gccaaggcagctgctgacttctgga

SEQ ID NO: 13115 - DNA, 25 bp, Mus musculus
agctgctgacttctggaggatcaat

SEQ ID NO: 13116 - DNA, 25 bp, Mus musculus
ctgctgacttctggaggatcaatta

SEQ ID NO: 13117 - DNA, 25 bp, Mus musculus
aatacactgacgctgagctgtcctc

SEQ ID NO: 13118 - DNA, 25 bp, Mus musculus
tacactgacgctgagctgtcctcca

SEQ ID NO: 13119 - DNA, 25 bp, Mus musculus
cactgacgctgagctgtcctccatt

SEQ ID NO: 13120 - DNA, 25 bp, Mus musculus
ctgacgctgagctgtcctccattag

SEQ ID NO: 13121 - DNA, 25 bp, Mus musculus
cgctgagctgtcctccattagttct

SEQ ID NO: 13122 - DNA, 25 bp, Mus musculus
ctgagctgtcctccattagttcttc

SEQ ID NO: 13123 - DNA, 25 bp, Mus musculus
gagctgtcctccattagttcttctc

SEQ ID NO: 13124 - DNA, 25 bp, Mus musculus
gctgtcctccattagttcttctcat

SEQ ID NO: 13125 - DNA, 25 bp, Mus musculus
caccctgctgatcgagaagcatgct

SEQ ID NO: 13126 - DNA, 25 bp, Mus musculus
atgctgattatatcgcctcgtacgg

SEQ ID NO: 13127 - DNA, 25 bp, Mus musculus
atcgcctcgtacggctcaaagaaag

SEQ ID NO: 13128 - DNA, 25 bp, Mus musculus
tcgcctcgtacggctcaaagaaaga

SEQ ID NO: 13129 - DNA, 25 bp, Mus musculus
cgcctcgtacggctcaaagaaagat

SEQ ID NO: 13130 - DNA, 25 bp, Mus musculus
tggggcagcttcatcggatgaataa

SEQ ID NO: 13131 - DNA, 25 bp, Mus musculus
ggagtcagtgccagcatcgggcacg

SEQ ID NO: 13132 - DNA, 25 bp, Mus musculus
gagtcagtgccagcatcgggcacga

SEQ ID NO: 13133 - DNA, 25 bp, Mus musculus
tgctgattatatcgcctcgtacggc

SEQ ID NO: 13134 - DNA, 25 bp, Mus musculus
gctgattatatcgcctcgtacggct

SEQ ID NO: 13135 - DNA, 25 bp, Mus musculus
gattatatcgcctcgtacggctcaa

SEQ ID NO: 13136 - DNA, 25 bp, Mus musculus
attatatcgcctcgtacggctcaaa

SEQ ID NO: 13137 - DNA, 25 bp, Mus musculus
ttatatcgcctcgtacggctcaaag

SEQ ID NO: 13138 - DNA, 25 bp, Mus musculus
tatatcgcctcgtacggctcaaaga

SEQ ID NO: 13139 - DNA, 25 bp, Mus musculus
atatcgcctcgtacggctcaaagaa

SEQ ID NO: 13140 - DNA, 25 bp, Mus musculus
tatcgcctcgtacggctcaaagaaa

SEQ ID NO: 13141 - DNA, 25 bp, Mus musculus
tcgccgactaccagcagaccatcaa

SEQ ID NO: 13142 - DNA, 25 bp, Mus musculus
accagcagaccatcaagaagtaccg

SEQ ID NO: 13143 - DNA, 25 bp, Mus musculus
accagcaggaagcgtctgtggagag

SEQ ID NO: 13144 - DNA, 25 bp, Mus musculus
gacagcagcagccaccgtcagagac

SEQ ID NO: 13145 - DNA, 25 bp, Mus musculus
agcagcagccaccgtcagagacttt

SEQ ID NO: 13146 - DNA, 25 bp, Mus musculus
agcagccaccgtcagagacttttga

SEQ ID NO: 13147 - DNA, 25 bp, Mus musculus
caccgtcagagacttttgatttcaa

SEQ ID NO: 13148 - DNA, 25 bp, Mus musculus
agtttgctgagaccaaggctcatgc

SEQ ID NO: 13149 - DNA, 25 bp, Mus musculus
ctcatgccaaggcgatcgagatgga

SEQ ID NO: 13150 - DNA, 25 bp, Mus musculus
atgccaaggcgatcgagatggagtt

SEQ ID NO: 13151 - DNA, 25 bp, Mus musculus
ttgcccaggccaaccggcacatgtc

SEQ ID NO: 13152 - DNA, 25 bp, Mus musculus
acatgtccctgctgacggcctttat

SEQ ID NO: 13153 - DNA, 25 bp, Mus musculus
ccatcaagaagtaccgccagttgac

SEQ ID NO: 13154 - DNA, 25 bp, Mus musculus
catgtccctgctgacggcctttatg

SEQ ID NO: 13155 - DNA, 25 bp, Mus musculus
agaagtaccgccagttgactgccca

SEQ ID NO: 13156 - DNA, 25 bp, Mus musculus
gccagttgactgcccacctacagga

SEQ ID NO: 13157 - DNA, 25 bp, Mus musculus
ctgcccacctacaggatgtcaatcg

SEQ ID NO: 13158 - DNA, 25 bp, Mus musculus
cccacctacaggatgtcaatcggga

SEQ ID NO: 13159 - DNA, 25 bp, Mus musculus
acctacaggatgtcaatcgggagct

SEQ ID NO: 13160 - DNA, 25 bp, Mus musculus
atgtcaatcgggagctgaccaacca

SEQ ID NO: 13161 - DNA, 25 bp, Mus musculus
tgaccaaccagcaggaagcgtctgt

SEQ ID NO: 13162 - DNA, 25 bp, Mus musculus
tctgattcactaacccatctgccca

SEQ ID NO: 13163 - DNA, 25 bp, Mus musculus
acccatctgcccagtgttgcagttc

SEQ ID NO: 13164 - DNA, 25 bp, Mus musculus
ctgatgtcatcactgatttagaaat

SEQ ID NO: 13165 - DNA, 25 bp, Mus musculus
tgtctctgcacaaagcaaagctttg

SEQ ID NO: 13166 - DNA, 25 bp, Mus musculus
tctgagaccctgaagtaggaaacaa

SEQ ID NO: 13167 - DNA, 25 bp, Mus musculus
agattctggattcctcagctatttt

SEQ ID NO: 13168 - DNA, 25 bp, Mus musculus
cctcagctatttttctggagcattt

SEQ ID NO: 13169 - DNA, 25 bp, Mus musculus
tatacttattcaaagagctggtatg

SEQ ID NO: 13170 - DNA, 25 bp, Mus musculus
aatcatgtaccagttgatctcttca

SEQ ID NO: 13171 - DNA, 25 bp, Mus musculus
gtaccagttgatctcttcatcacag

SEQ ID NO: 13172 - DNA, 25 bp, Mus musculus
aatatgctagcagctaagcacaaca

SEQ ID NO: 13173 - DNA, 25 bp, Mus musculus
ctagcagctaagcacaacagatgaa

SEQ ID NO: 13174 - DNA, 25 bp, Mus musculus
agtgttgcagttccagacatcacca

SEQ ID NO: 13175 - DNA, 25 bp, Mus musculus
gcagttccagacatcaccaggccaa

SEQ ID NO: 13176 - DNA, 25 bp, Mus musculus
ccagacatcaccaggccaactcaag

SEQ ID NO: 13177 - DNA, 25 bp, Mus musculus
atcaccaggccaactcaaggtcttt

SEQ ID NO: 13178 - DNA, 25 bp, Mus musculus
actcaaggtctttgttgataagatt

SEQ ID NO: 13179 - DNA, 25 bp, Mus musculus
attgtagcagtatcccaggtcagtg

SEQ ID NO: 13180 - DNA, 25 bp, Mus musculus
gcagtatcccaggtcagtgggaaaa

SEQ ID NO: 13181 - DNA, 25 bp, Mus musculus
aggcctctgatgtcatcactgattt

SEQ ID NO: 13182 - DNA, 25 bp, Mus musculus
accttctctttctcaaagccttctg

SEQ ID NO: 13183 - DNA, 25 bp, Mus musculus
tctttctcaaagccttctgtcccct

SEQ ID NO: 13184 - DNA, 25 bp, Mus musculus
tactgctgccaccttctgttccttt

SEQ ID NO: 13185 - DNA, 25 bp, Mus musculus
tgctgccaccttctgttcctttaga

SEQ ID NO: 13186 - DNA, 25 bp, Mus musculus
tgccaccttctgttcctttagaact

SEQ ID NO: 13187 - DNA, 25 bp, Mus musculus
ctgttcctttagaactatgcaaaga

SEQ ID NO: 13188 - DNA, 25 bp, Mus musculus
ttcctttagaactatgcaaagactg

SEQ ID NO: 13189 - DNA, 25 bp, Mus musculus
aactatgcaaagactgcccttcctc

SEQ ID NO: 13190 - DNA, 25 bp, Mus musculus
tatgcaaagactgcccttcctctcg

SEQ ID NO: 13191 - DNA, 25 bp, Mus musculus
ctgtgccctaagatctcagtttgtt

SEQ ID NO: 13192 - DNA, 25 bp, Mus musculus
tgccctaagatctcagtttgtttga

SEQ ID NO: 13193 - DNA, 25 bp, Mus musculus
tttctctccttgacttacagaacgt

SEQ ID NO: 13194 - DNA, 25 bp, Mus musculus
tcaaagccttctgtcccctgttctt

SEQ ID NO: 13195 - DNA, 25 bp, Mus musculus
aagccttctgtcccctgttcttgca

SEQ ID NO: 13196 - DNA, 25 bp, Mus musculus
gtcccctgttcttgcaaagtgctgc

SEQ ID NO: 13197 - DNA, 25 bp, Mus musculus
ccctgttcttgcaaagtgctgcact

SEQ ID NO: 13198 - DNA, 25 bp, Mus musculus
tgttcttgcaaagtgctgcacttct

SEQ ID NO: 13199 - DNA, 25 bp, Mus musculus
aaagtgctgcacttctgctgagaat

SEQ ID NO: 13200 - DNA, 25 bp, Mus musculus
ttctgctgagaatccacgctgccta

SEQ ID NO: 13201 - DNA, 25 bp, Mus musculus
tgctgagaatccacgctgcctactg

SEQ ID NO: 13202 - DNA, 25 bp, Mus musculus
gccctgaatgcaggtgcagttttgg

SEQ ID NO: 13203 - DNA, 25 bp, Mus musculus
ttgttttcttagccagtgggcaaag

SEQ ID NO: 13204 - DNA, 25 bp, Mus musculus
ctttagcttttattctgtgaacaga

SEQ ID NO: 13205 - DNA, 25 bp, Mus musculus
tttagcttttattctgtgaacagat

SEQ ID NO: 13206 - DNA, 25 bp, Mus musculus
agcttttattctgtgaacagatgtg

SEQ ID NO: 13207 - DNA, 25 bp, Mus musculus
gcttttattctgtgaacagatgtga

SEQ ID NO: 13208 - DNA, 25 bp, Mus musculus
cttttattctgtgaacagatgtgac

SEQ ID NO: 13209 - DNA, 25 bp, Mus musculus
ttttattctgtgaacagatgtgact

SEQ ID NO: 13210 - DNA, 25 bp, Mus musculus
acagatgtgactcctgtgctgtggg

SEQ ID NO: 13211 - DNA, 25 bp, Mus musculus
cagatgtgactcctgtgctgtgggg

SEQ ID NO: 13212 - DNA, 25 bp, Mus musculus
agatgtgactcctgtgctgtgggga

SEQ ID NO: 13213 - DNA, 25 bp, Mus musculus
tccacaatctttgtaagaaaagaat

SEQ ID NO: 13214 - DNA, 25 bp, Mus musculus
tgttttcttagccagtgggcaaagt

SEQ ID NO: 13215 - DNA, 25 bp, Mus musculus
gttttcttagccagtgggcaaagtg

SEQ ID NO: 13216 - DNA, 25 bp, Mus musculus
tttcttagccagtgggcaaagtgaa

SEQ ID NO: 13217 - DNA, 25 bp, Mus musculus
ttcttagccagtgggcaaagtgaaa

SEQ ID NO: 13218 - DNA, 25 bp, Mus musculus
tcttagccagtgggcaaagtgaaat

SEQ ID NO: 13219 - DNA, 25 bp, Mus musculus
cttagccagtgggcaaagtgaaatg

SEQ ID NO: 13220 - DNA, 25 bp, Mus musculus
cagggcttctttagcttttattctg

SEQ ID NO: 13221 - DNA, 25 bp, Mus musculus
tctttagcttttattctgtgaacag

SEQ ID NO: 13222 - DNA, 25 bp, Mus musculus
tcagcctttacccttcatcagagaa

SEQ ID NO: 13223 - DNA, 25 bp, Mus musculus
tttacccttcatcagagaatccaca

SEQ ID NO: 13224 - DNA, 25 bp, Mus musculus
gcacctctctgaaacgagaaaaagg

SEQ ID NO: 13225 - DNA, 25 bp, Mus musculus
tgcctcccaggcggaatcaaagcag

SEQ ID NO: 13226 - DNA, 25 bp, Mus musculus
ttggcagagttcccggcttgctgat

SEQ ID NO: 13227 - DNA, 25 bp, Mus musculus
ccggcttgctgatgcatggaacaat

SEQ ID NO: 13228 - DNA, 25 bp, Mus musculus
aggctcaagtcaagggctgaatctt

SEQ ID NO: 13229 - DNA, 25 bp, Mus musculus
gaatcttctgttgaccttggtggaa

SEQ ID NO: 13230 - DNA, 25 bp, Mus musculus
atactggcttgtggctttgctcccc

SEQ ID NO: 13231 - DNA, 25 bp, Mus musculus
gctccccatggtactgtagtataaa

SEQ ID NO: 13232 - DNA, 25 bp, Mus musculus
gaaatacactcactgctggcgtggt

SEQ ID NO: 13233 - DNA, 25 bp, Mus musculus
cactcactgctggcgtggtaatgac

SEQ ID NO: 13234 - DNA, 25 bp, Mus musculus
ccgtatccctgtgctcagtgtggca

SEQ ID NO: 13235 - DNA, 25 bp, Mus musculus
ttcagtcagcgctctgatctggtta

SEQ ID NO: 13236 - DNA, 25 bp, Mus musculus
atgtgactgatacctgtgtgaagcc

SEQ ID NO: 13237 - DNA, 25 bp, Mus musculus
tgaagccttcagcactgtgaccaat

SEQ ID NO: 13238 - DNA, 25 bp, Mus musculus
cttcagcactgtgaccaatcttact

SEQ ID NO: 13239 - DNA, 25 bp, Mus musculus
cactgtgaccaatcttactggatat

SEQ ID NO: 13240 - DNA, 25 bp, Mus musculus
gatctgcaggagccgtttgcacctc

SEQ ID NO: 13241 - DNA, 25 bp, Mus musculus
ccgtttgcacctctctgaaacgaga

SEQ ID NO: 13242 - DNA, 25 bp, Mus musculus
cgctactggtcggttgacaagctcg

SEQ ID NO: 13243 - DNA, 25 bp, Mus musculus
gctactggtcggttgacaagctcgg

SEQ ID NO: 13244 - DNA, 25 bp, Mus musculus
ctggaggacctgagctcctgcccac

SEQ ID NO: 13245 - DNA, 25 bp, Mus musculus
aggacctgagctcctgcccacgggc

SEQ ID NO: 13246 - DNA, 25 bp, Mus musculus
ggcacacgcaggggctctgcgcact

SEQ ID NO: 13247 - DNA, 25 bp, Mus musculus
gcacacgcaggggctctgcgcactt

SEQ ID NO: 13248 - DNA, 25 bp, Mus musculus
ggctctgcgcacttctccagcctgg

SEQ ID NO: 13249 - DNA, 25 bp, Mus musculus
gctctgcgcacttctccagcctgga

SEQ ID NO: 13250 - DNA, 25 bp, Mus musculus
tctgcgcacttctccagcctggagt

SEQ ID NO: 13251 - DNA, 25 bp, Mus musculus
ctgcgcacttctccagcctggagtc

SEQ ID NO: 13252 - DNA, 25 bp, Mus musculus
cgcacttctccagcctggagtccga

SEQ ID NO: 13253 - DNA, 25 bp, Mus musculus
cacttctccagcctggagtccgagg

SEQ ID NO: 13254 - DNA, 25 bp, Mus musculus
gccactgcgccagcctggagctgct

SEQ ID NO: 13255 - DNA, 25 bp, Mus musculus
actgcgccagcctggagctgctacc

SEQ ID NO: 13256 - DNA, 25 bp, Mus musculus
tgcgccagcctggagctgctaccgc

SEQ ID NO: 13257 - DNA, 25 bp, Mus musculus
ccacctcgcgttcgctggaggacct

SEQ ID NO: 13258 - DNA, 25 bp, Mus musculus
tcgcgttcgctggaggacctgagct

SEQ ID NO: 13259 - DNA, 25 bp, Mus musculus
cgcgttcgctggaggacctgagctc

SEQ ID NO: 13260 - DNA, 25 bp, Mus musculus
cgttcgctggaggacctgagctcct

SEQ ID NO: 13261 - DNA, 25 bp, Mus musculus
gttcgctggaggacctgagctcctg

SEQ ID NO: 13262 - DNA, 25 bp, Mus musculus
tcacttccacagaaacgtgacatgc

SEQ ID NO: 13263 - DNA, 25 bp, Mus musculus
cttccacagaaacgtgacatgcacg

SEQ ID NO: 13264 - DNA, 25 bp, Mus musculus
acacctggaccccggattgcatcat

SEQ ID NO: 13265 - DNA, 25 bp, Mus musculus
ccccggattgcatcataaaacgtgc

SEQ ID NO: 13266 - DNA, 25 bp, Mus musculus
gcatcataaaacgtgcctgctcctg

SEQ ID NO: 13267 - DNA, 25 bp, Mus musculus
ctgcctgtaaggtcctcctgttggc

SEQ ID NO: 13268 - DNA, 25 bp, Mus musculus
ctactctgcatagaagctgcatatg

SEQ ID NO: 13269 - DNA, 25 bp, Mus musculus
tatgaacagcctcaaccccatagca

SEQ ID NO: 13270 - DNA, 25 bp, Mus musculus
caaccccatagcaattatggtttct

SEQ ID NO: 13271 - DNA, 25 bp, Mus musculus
ggtttctgtagtgtcctgcattaaa

SEQ ID NO: 13272 - DNA, 25 bp, Mus musculus
aaatgctatctctcttcgtcaacaa

SEQ ID NO: 13273 - DNA, 25 bp, Mus musculus
tatctctcttcgtcaacaataaagg

SEQ ID NO: 13274 - DNA, 25 bp, Mus musculus
aaacgtgacatgcacgacttctttg

SEQ ID NO: 13275 - DNA, 25 bp, Mus musculus
ttctttgtgggacttatgggcaaga

SEQ ID NO: 13276 - DNA, 25 bp, Mus musculus
aggaacagccaaccagacactccca

SEQ ID NO: 13277 - DNA, 25 bp, Mus musculus
cccagctttggcatcctcaaataat

SEQ ID NO: 13278 - DNA, 25 bp, Mus musculus
tttggcatcctcaaataattcccca

SEQ ID NO: 13279 - DNA, 25 bp, Mus musculus
atcctcaaataattccccagtacag

SEQ ID NO: 13280 - DNA, 25 bp, Mus musculus
taattccccagtacagaaaggcact

SEQ ID NO: 13281 - DNA, 25 bp, Mus musculus
cactctacacctggaccccggattg

SEQ ID NO: 13282 - DNA, 25 bp, Mus musculus
ttctgctccaggctcaggttagtga

SEQ ID NO: 13283 - DNA, 25 bp, Mus musculus
aaagcgatcctagagcacttgagga

SEQ ID NO: 13284 - DNA, 25 bp, Mus musculus
cgtccttcagtgcacgtctgaacag

SEQ ID NO: 13285 - DNA, 25 bp, Mus musculus
ccttcagtgcacgtctgaacagcct

SEQ ID NO: 13286 - DNA, 25 bp, Mus musculus
tgaacagcctgtccctcctactctt

SEQ ID NO: 13287 - DNA, 25 bp, Mus musculus
tcttacatagcccccagtgttgcat

SEQ ID NO: 13288 - DNA, 25 bp, Mus musculus
agtgttgcattcctcaaacgtagga

SEQ ID NO: 13289 - DNA, 25 bp, Mus musculus
gcattcctcaaacgtaggaagactt

SEQ ID NO: 13290 - DNA, 25 bp, Mus musculus
ttcctcaaacgtaggaagacttgat

SEQ ID NO: 13291 - DNA, 25 bp, Mus musculus
tgtgtttaattggcccagagttaat

SEQ ID NO: 13292 - DNA, 25 bp, Mus musculus
ggacattttgctgcattttacaact

SEQ ID NO: 13293 - DNA, 25 bp, Mus musculus
tttgacatctttgctattgtaaata

SEQ ID NO: 13294 - DNA, 25 bp, Mus musculus
agttgtcaaggggctcagcaaaagc

SEQ ID NO: 13295 - DNA, 25 bp, Mus musculus
cagagactgactgcctttagccttt

SEQ ID NO: 13296 - DNA, 25 bp, Mus musculus
agactgactgcctttagcctttccg

SEQ ID NO: 13297 - DNA, 25 bp, Mus musculus
aaagtcctgagtcttgtcagtcact

SEQ ID NO: 13298 - DNA, 25 bp, Mus musculus
agtcttgtcagtcactaagtccgtc

SEQ ID NO: 13299 - DNA, 25 bp, Mus musculus
cttgtcagtcactaagtccgtcctt

SEQ ID NO: 13300 - DNA, 25 bp, Mus musculus
agtcactaagtccgtccttcagtgc

SEQ ID NO: 13301 - DNA, 25 bp, Mus musculus
taagtccgtccttcagtgcacgtct

SEQ ID NO: 13302 - DNA, 25 bp, Mus musculus
ttctaactcacacctcatgcgacat

SEQ ID NO: 13303 - DNA, 25 bp, Mus musculus
cctcatgcgacatcacagaactcat

SEQ ID NO: 13304 - DNA, 25 bp, Mus musculus
tggtcataacctactgctgctaata

SEQ ID NO: 13305 - DNA, 25 bp, Mus musculus
tcataacctactgctgctaatagca

SEQ ID NO: 13306 - DNA, 25 bp, Mus musculus
cctactgctgctaatagcaggcacc

SEQ ID NO: 13307 - DNA, 25 bp, Mus musculus
actgctgctaatagcaggcacctct

SEQ ID NO: 13308 - DNA, 25 bp, Mus musculus
aatagcaggcacctctgttctttat

SEQ ID NO: 13309 - DNA, 25 bp, Mus musculus
agcaggcacctctgttctttattct

SEQ ID NO: 13310 - DNA, 25 bp, Mus musculus
tctttattcttccttggccaaaatg

SEQ ID NO: 13311 - DNA, 25 bp, Mus musculus
ttcttccttggccaaaatgaggact

SEQ ID NO: 13312 - DNA, 25 bp, Mus musculus
ttccttggccaaaatgaggactgta

SEQ ID NO: 13313 - DNA, 25 bp, Mus musculus
taatgtaaacacacatttcaaaggc

SEQ ID NO: 13314 - DNA, 25 bp, Mus musculus
catgcgacatcacagaactcatctt

SEQ ID NO: 13315 - DNA, 25 bp, Mus musculus
gcgacatcacagaactcatcttgtc

SEQ ID NO: 13316 - DNA, 25 bp, Mus musculus
tcacagaactcatcttgtccaatag

SEQ ID NO: 13317 - DNA, 25 bp, Mus musculus
cagaactcatcttgtccaatagcaa

SEQ ID NO: 13318 - DNA, 25 bp, Mus musculus
aactcatcttgtccaatagcaagga

SEQ ID NO: 13319 - DNA, 25 bp, Mus musculus
tcttgtccaatagcaaggaagaggg

SEQ ID NO: 13320 - DNA, 25 bp, Mus musculus
gtgaaaccttgctcttggtcataac

SEQ ID NO: 13321 - DNA, 25 bp, Mus musculus
ccttgctcttggtcataacctactg

SEQ ID NO: 13322 - DNA, 25 bp, Mus musculus
attgtcatggatggctgtgaatatg

SEQ ID NO: 13323 - DNA, 25 bp, Mus musculus
tccggtcactaccagaggtttgatg

SEQ ID NO: 13324 - DNA, 25 bp, Mus musculus
cctattctcttgctgtcagatgtct

SEQ ID NO: 13325 - DNA, 25 bp, Mus musculus
ctcttgctgtcagatgtctcttcat

SEQ ID NO: 13326 - DNA, 25 bp, Mus musculus
ctgtcagatgtctcttcatccaaag

SEQ ID NO: 13327 - DNA, 25 bp, Mus musculus
tccaaaggtgttgaccccagcagct

SEQ ID NO: 13328 - DNA, 25 bp, Mus musculus
gaccccagcagctctgagattacca

SEQ ID NO: 13329 - DNA, 25 bp, Mus musculus
gcttctaaaacactgggtgctgtgg

SEQ ID NO: 13330 - DNA, 25 bp, Mus musculus
ggctcagctgtcattctaggcttca

SEQ ID NO: 13331 - DNA, 25 bp, Mus musculus
gctgtcattctaggcttcatctgtt

SEQ ID NO: 13332 - DNA, 25 bp, Mus musculus
ggcttcatctgttacctgtataaga

SEQ ID NO: 13333 - DNA, 25 bp, Mus musculus
aatcactgattggacttgcaaataa

SEQ ID NO: 13334 - DNA, 25 bp, Mus musculus
cactaccagaggtttgatgtgaaga

SEQ ID NO: 13335 - DNA, 25 bp, Mus musculus
acttttgcctttgtatcagaggcac

SEQ ID NO: 13336 - DNA, 25 bp, Mus musculus
gtatcagaggcacgggggctctcca

SEQ ID NO: 13337 - DNA, 25 bp, Mus musculus
agcctgatctacttccactgcagtg

SEQ ID NO: 13338 - DNA, 25 bp, Mus musculus
atctacttccactgcagtgccttga

SEQ ID NO: 13339 - DNA, 25 bp, Mus musculus
gccttgatctgtaaccaagtctctc

SEQ ID NO: 13340 - DNA, 25 bp, Mus musculus
atctgtaaccaagtctctcttgact

SEQ ID NO: 13341 - DNA, 25 bp, Mus musculus
ctgtgctctgtgacttgccctgcat

SEQ ID NO: 13342 - DNA, 25 bp, Mus musculus
cagcttgttctgctcaagctggaga

SEQ ID NO: 13343 - DNA, 25 bp, Mus musculus
gtgatcctgaaccatcacgtggccc

SEQ ID NO: 13344 - DNA, 25 bp, Mus musculus
ccacttgcctgctatacccatgact

SEQ ID NO: 13345 - DNA, 25 bp, Mus musculus
tatacccatgactgctgggtcctac

SEQ ID NO: 13346 - DNA, 25 bp, Mus musculus
catgactgctgggtcctacagggac

SEQ ID NO: 13347 - DNA, 25 bp, Mus musculus
tgctgggtcctacagggacttatca

SEQ ID NO: 13348 - DNA, 25 bp, Mus musculus
cttatcatcccgaacagagtgtgtg

SEQ ID NO: 13349 - DNA, 25 bp, Mus musculus
atcccgaacagagtgtgtgcacggc

SEQ ID NO: 13350 - DNA, 25 bp, Mus musculus
tggccagctatcttcacacgggtgt

SEQ ID NO: 13351 - DNA, 25 bp, Mus musculus
gctatcttcacacgggtgtctgtgt

SEQ ID NO: 13352 - DNA, 25 bp, Mus musculus
tctgtgttcgtggactggattaaca

SEQ ID NO: 13353 - DNA, 25 bp, Mus musculus
tgcttttgagcccttagagatgtca

SEQ ID NO: 13354 - DNA, 25 bp, Mus musculus
ctgaaccatcacgtggccctgattt

SEQ ID NO: 13355 - DNA, 25 bp, Mus musculus
cataaagcggccttttctctctgtc

SEQ ID NO: 13356 - DNA, 25 bp, Mus musculus
catcacgtggccctgatttgcctgc

SEQ ID NO: 13357 - DNA, 25 bp, Mus musculus
tgcctgcctcctgaacagtatgtgg

SEQ ID NO: 13358 - DNA, 25 bp, Mus musculus
cctcctgaacagtatgtggtacctc

SEQ ID NO: 13359 - DNA, 25 bp, Mus musculus
tccatcggtacaagcaataacacag

SEQ ID NO: 13360 - DNA, 25 bp, Mus musculus
agcaataacacagtccttcatgtgg

SEQ ID NO: 13361 - DNA, 25 bp, Mus musculus
gtccttcatgtggcctcgatgaatg

SEQ ID NO: 13362 - DNA, 25 bp, Mus musculus
gagatatgcacccagggactggtgg

SEQ ID NO: 13363 - DNA, 25 bp, Mus musculus
gcatctgcagcacactctcaacaat

SEQ ID NO: 13364 - DNA, 25 bp, Mus musculus
atctgcagcacactctcaacaatga

SEQ ID NO: 13365 - DNA, 25 bp, Mus musculus
tcccctgaatgctcagcaatgctgt

SEQ ID NO: 13366 - DNA, 25 bp, Mus musculus
cccctgaatgctcagcaatgctgtg

SEQ ID NO: 13367 - DNA, 25 bp, Mus musculus
cctgaatgctcagcaatgctgtgca

SEQ ID NO: 13368 - DNA, 25 bp, Mus musculus
ctgaatgctcagcaatgctgtgcat

SEQ ID NO: 13369 - DNA, 25 bp, Mus musculus
aatgctcagcaatgctgtgcataag

SEQ ID NO: 13370 - DNA, 25 bp, Mus musculus
tgctcagcaatgctgtgcataaggg

SEQ ID NO: 13371 - DNA, 25 bp, Mus musculus
ctcagcaatgctgtgcataagggct

SEQ ID NO: 13372 - DNA, 25 bp, Mus musculus
tcagcaatgctgtgcataagggctg

SEQ ID NO: 13373 - DNA, 25 bp, Mus musculus
cagcaatgctgtgcataagggctgt

SEQ ID NO: 13374 - DNA, 25 bp, Mus musculus
tgaccatcgatgagacagctacacg

SEQ ID NO: 13375 - DNA, 25 bp, Mus musculus
ctgcagcacactctcaacaatgagc

SEQ ID NO: 13376 - DNA, 25 bp, Mus musculus
gcagcacactctcaacaatgagctc

SEQ ID NO: 13377 - DNA, 25 bp, Mus musculus
cagcacactctcaacaatgagctca

SEQ ID NO: 13378 - DNA, 25 bp, Mus musculus
agcacactctcaacaatgagctcat

SEQ ID NO: 13379 - DNA, 25 bp, Mus musculus
ggagaatgctcccctgaatgctcag

SEQ ID NO: 13380 - DNA, 25 bp, Mus musculus
aatgctcccctgaatgctcagcaat

SEQ ID NO: 13381 - DNA, 25 bp, Mus musculus
atgctcccctgaatgctcagcaatg

SEQ ID NO: 13382 - DNA, 25 bp, Mus musculus
ctcccctgaatgctcagcaatgctg

SEQ ID NO: 13383 - DNA, 25 bp, Mus musculus
aacagagtcaaatccacggagctct

SEQ ID NO: 13384 - DNA, 25 bp, Mus musculus
agagtcaaatccacggagctctgtg

SEQ ID NO: 13385 - DNA, 25 bp, Mus musculus
cgtgtctcacggtttgttgattgga

SEQ ID NO: 13386 - DNA, 25 bp, Mus musculus
aggccgagcaaaacctctgcttact

SEQ ID NO: 13387 - DNA, 25 bp, Mus musculus
agcaaaacctctgcttactaaagct

SEQ ID NO: 13388 - DNA, 25 bp, Mus musculus
gcttactaaagcttactgaatatgg

SEQ ID NO: 13389 - DNA, 25 bp, Mus musculus
aatcaaactgggacactacactgaa

SEQ ID NO: 13390 - DNA, 25 bp, Mus musculus
caaactgggacactacactgaacca

SEQ ID NO: 13391 - DNA, 25 bp, Mus musculus
acactacactgaaccacagcttcct

SEQ ID NO: 13392 - DNA, 25 bp, Mus musculus
ctacactgaaccacagcttcctgtc

SEQ ID NO: 13393 - DNA, 25 bp, Mus musculus
gtgacaatagaccatcactgctgtg

SEQ ID NO: 13394 - DNA, 25 bp, Mus musculus
cactgctgtgacctttgttgaaaat

SEQ ID NO: 13395 - DNA, 25 bp, Mus musculus
tccacggagctctgtgccgggcaac

SEQ ID NO: 13396 - DNA, 25 bp, Mus musculus
gagctctgtgccgggcaactggctg

SEQ ID NO: 13397 - DNA, 25 bp, Mus musculus
ggacctctggtttgcttcgagaagg

SEQ ID NO: 13398 - DNA, 25 bp, Mus musculus
cctctggtttgcttcgagaaggaca

SEQ ID NO: 13399 - DNA, 25 bp, Mus musculus
caaggagtcacttcttggggtcttg

SEQ ID NO: 13400 - DNA, 25 bp, Mus musculus
gtcacttcttggggtcttggctgtg

SEQ ID NO: 13401 - DNA, 25 bp, Mus musculus
cgccccaataagcctggtgtctacg

SEQ ID NO: 13402 - DNA, 25 bp, Mus musculus
tacgttcgtgtctcacggtttgttg

SEQ ID NO: 13403 - DNA, 25 bp, Mus musculus
caataactgcagcatcatgcaaagt

SEQ ID NO: 13404 - DNA, 25 bp, Mus musculus
ctgcagcatcatgcaaagtgacatc

SEQ ID NO: 13405 - DNA, 25 bp, Mus musculus
gattgacaatcgcccatctaaactt

SEQ ID NO: 13406 - DNA, 25 bp, Mus musculus
cccatctaaacttgccttgaacaca

SEQ ID NO: 13407 - DNA, 25 bp, Mus musculus
tgccttgaacacaacgaaatacaat

SEQ ID NO: 13408 - DNA, 25 bp, Mus musculus
cttatctaaaactagactagacaat

SEQ ID NO: 13409 - DNA, 25 bp, Mus musculus
ctgtgatcaatcattcatctgtatt

SEQ ID NO: 13410 - DNA, 25 bp, Mus musculus
tcaatcattcatctgtatttgtggg

SEQ ID NO: 13411 - DNA, 25 bp, Mus musculus
attcatctgtatttgtgggaagaga

SEQ ID NO: 13412 - DNA, 25 bp, Mus musculus
attggacaaattccctcattgactc

SEQ ID NO: 13413 - DNA, 25 bp, Mus musculus
caaattccctcattgactctccagt

SEQ ID NO: 13414 - DNA, 25 bp, Mus musculus
ccctcattgactctccagtgagtgt

SEQ ID NO: 13415 - DNA, 25 bp, Mus musculus
taatcttctggaatccctcaacagg

SEQ ID NO: 13416 - DNA, 25 bp, Mus musculus
ttacttacagcacacaggcagaggt

SEQ ID NO: 13417 - DNA, 25 bp, Mus musculus
agtatactggttctgttatggtatg

SEQ ID NO: 13418 - DNA, 25 bp, Mus musculus
ttattatttcgtcatggacagaaaa

SEQ ID NO: 13419 - DNA, 25 bp, Mus musculus
acagagctgccagaattccagctta

SEQ ID NO: 13420 - DNA, 25 bp, Mus musculus
gaattccagcttaacccttctgaag

SEQ ID NO: 13421 - DNA, 25 bp, Mus musculus
cagcttaacccttctgaagatagat

SEQ ID NO: 13422 - DNA, 25 bp, Mus musculus
cgtggttccttcagacagttgctgg

SEQ ID NO: 13423 - DNA, 25 bp, Mus musculus
ctcccttgaaccggcgcatctactg

SEQ ID NO: 13424 - DNA, 25 bp, Mus musculus
tgaaccggcgcatctactgccaccg

SEQ ID NO: 13425 - DNA, 25 bp, Mus musculus
gcggcaagaccttctactggcgcga

SEQ ID NO: 13426 - DNA, 25 bp, Mus musculus
ccttctactggcgcgacacctggtg

SEQ ID NO: 13427 - DNA, 25 bp, Mus musculus
tctactggcgcgacacctggtggcc

SEQ ID NO: 13428 - DNA, 25 bp, Mus musculus
gcgacacctggtggccaccgcaaga

SEQ ID NO: 13429 - DNA, 25 bp, Mus musculus
acacctggtggccaccgcaagacac

SEQ ID NO: 13430 - DNA, 25 bp, Mus musculus
ggtggccaccgcaagacacactctg

SEQ ID NO: 13431 - DNA, 25 bp, Mus musculus
aagacacactctggcgcgcgacctt

SEQ ID NO: 13432 - DNA, 25 bp, Mus musculus
acacactctggcgcgcgacctttcg

SEQ ID NO: 13433 - DNA, 25 bp, Mus musculus
gcgcgacctttcgcctgctgggaat

SEQ ID NO: 13434 - DNA, 25 bp, Mus musculus
ttcgcctgctgggaatgtggcaagg

SEQ ID NO: 13435 - DNA, 25 bp, Mus musculus
ggcgcatctactgccaccggaaagc

SEQ ID NO: 13436 - DNA, 25 bp, Mus musculus
gcatctactgccaccggaaagccac

SEQ ID NO: 13437 - DNA, 25 bp, Mus musculus
gtccctgagtgcggaaggcattccg

SEQ ID NO: 13438 - DNA, 25 bp, Mus musculus
ggaaggcattccggcgtaaggagca

SEQ ID NO: 13439 - DNA, 25 bp, Mus musculus
cattccggcgtaaggagcacctgcg

SEQ ID NO: 13440 - DNA, 25 bp, Mus musculus
agaagccgcacgcgtgctgcgaatg

SEQ ID NO: 13441 - DNA, 25 bp, Mus musculus
cgcacgcgtgctgcgaatgcggcaa

SEQ ID NO: 13442 - DNA, 25 bp, Mus musculus
aatgcggcaagaccttctactggcg

SEQ ID NO: 13443 - DNA, 25 bp, Mus musculus
ctgtaataattcctacttctgcatt

SEQ ID NO: 13444 - DNA, 25 bp, Mus musculus
tgtaataattcctacttctgcattt

SEQ ID NO: 13445 - DNA, 25 bp, Mus musculus
atgggcaccctttgcataaagcctt

SEQ ID NO: 13446 - DNA, 25 bp, Mus musculus
gggcaccctttgcataaagccttca

SEQ ID NO: 13447 - DNA, 25 bp, Mus musculus
ggcaccctttgcataaagccttcag

SEQ ID NO: 13448 - DNA, 25 bp, Mus musculus
gcaccctttgcataaagccttcaga

SEQ ID NO: 13449 - DNA, 25 bp, Mus musculus
accctttgcataaagccttcagaat

SEQ ID NO: 13450 - DNA, 25 bp, Mus musculus
ccctttgcataaagccttcagaatt

SEQ ID NO: 13451 - DNA, 25 bp, Mus musculus
cctttgcataaagccttcagaattt

SEQ ID NO: 13452 - DNA, 25 bp, Mus musculus
tttgcataaagccttcagaattttg

SEQ ID NO: 13453 - DNA, 25 bp, Mus musculus
ttgcataaagccttcagaattttgt

SEQ ID NO: 13454 - DNA, 25 bp, Mus musculus
tgcataaagccttcagaattttgtt

SEQ ID NO: 13455 - DNA, 25 bp, Mus musculus
taataattcctacttctgcatttgt

SEQ ID NO: 13456 - DNA, 25 bp, Mus musculus
ataattcctacttctgcatttgtgg

SEQ ID NO: 13457 - DNA, 25 bp, Mus musculus
cattggactgttctctggtatctat

SEQ ID NO: 13458 - DNA, 25 bp, Mus musculus
attggactgttctctggtatctatt

SEQ ID NO: 13459 - DNA, 25 bp, Mus musculus
ctgttctctggtatctattttgaca

SEQ ID NO: 13460 - DNA, 25 bp, Mus musculus
tgttctctggtatctattttgacag

SEQ ID NO: 13461 - DNA, 25 bp, Mus musculus
gttctctggtatctattttgacaga

SEQ ID NO: 13462 - DNA, 25 bp, Mus musculus
gatgggcaccctttgcataaagcct

SEQ ID NO: 13463 - DNA, 25 bp, Mus musculus
gcctgtatggtcatctctatcattg

SEQ ID NO: 13464 - DNA, 25 bp, Mus musculus
atggtcatctctatcattgttcata

SEQ ID NO: 13465 - DNA, 25 bp, Mus musculus
tattcgtatcttatgtccatctgca

SEQ ID NO: 13466 - DNA, 25 bp, Mus musculus
tcgtatcttatgtccatctgcacca

SEQ ID NO: 13467 - DNA, 25 bp, Mus musculus
ttaatatccaatgcaactaatccat

SEQ ID NO: 13468 - DNA, 25 bp, Mus musculus
atatccaatgcaactaatccatata

SEQ ID NO: 13469 - DNA, 25 bp, Mus musculus
tccaatgcaactaatccatatatta

SEQ ID NO: 13470 - DNA, 25 bp, Mus musculus
taattatcttgtggctatgatctaa

SEQ ID NO: 13471 - DNA, 25 bp, Mus musculus
ttatcttgtggctatgatctaaaac

SEQ ID NO: 13472 - DNA, 25 bp, Mus musculus
caaggagcctaccaatatgcgtttg

SEQ ID NO: 13473 - DNA, 25 bp, Mus musculus
ggagcctaccaatatgcgtttgtat

SEQ ID NO: 13474 - DNA, 25 bp, Mus musculus
gcctaccaatatgcgtttgtatata

SEQ ID NO: 13475 - DNA, 25 bp, Mus musculus
gtcatctctatcattgttcataata

SEQ ID NO: 13476 - DNA, 25 bp, Mus musculus
taccaatatgcgtttgtatatatca

SEQ ID NO: 13477 - DNA, 25 bp, Mus musculus
atctctatcattgttcataatacct

SEQ ID NO: 13478 - DNA, 25 bp, Mus musculus
attgttcataatacctacacctctt

SEQ ID NO: 13479 - DNA, 25 bp, Mus musculus
gttcataatacctacacctcttaca

SEQ ID NO: 13480 - DNA, 25 bp, Mus musculus
cataatacctacacctcttacaata

SEQ ID NO: 13481 - DNA, 25 bp, Mus musculus
tacacctcttacaataagttgcagc

SEQ ID NO: 13482 - DNA, 25 bp, Mus musculus
cagcttatcaattactatcggtata

SEQ ID NO: 13483 - DNA, 25 bp, Mus musculus
cttatcaattactatcggtataaat

SEQ ID NO: 13484 - DNA, 25 bp, Mus musculus
cctgttcatttctactgcatctaat

SEQ ID NO: 13485 - DNA, 25 bp, Mus musculus
tgttcatttctactgcatctaatgt

SEQ ID NO: 13486 - DNA, 25 bp, Mus musculus
ataataagctgtaccatgtttataa

SEQ ID NO: 13487 - DNA, 25 bp, Mus musculus
taagctgtaccatgtttataatgat

SEQ ID NO: 13488 - DNA, 25 bp, Mus musculus
tataatgatctgctgctcgtatttg

SEQ ID NO: 13489 - DNA, 25 bp, Mus musculus
taatgatctgctgctcgtatttgaa

SEQ ID NO: 13490 - DNA, 25 bp, Mus musculus
atgatctgctgctcgtatttgaact

SEQ ID NO: 13491 - DNA, 25 bp, Mus musculus
gatctgctgctcgtatttgaactcc

SEQ ID NO: 13492 - DNA, 25 bp, Mus musculus
tctgctgctcgtatttgaactcctg

SEQ ID NO: 13493 - DNA, 25 bp, Mus musculus
gctcgtatttgaactcctgaaggac

SEQ ID NO: 13494 - DNA, 25 bp, Mus musculus
caatcgcaccgtcaaattgtaaagt

SEQ ID NO: 13495 - DNA, 25 bp, Mus musculus
atcgcaccgtcaaattgtaaagtct

SEQ ID NO: 13496 - DNA, 25 bp, Mus musculus
ttcatttctactgcatctaatgtcg

SEQ ID NO: 13497 - DNA, 25 bp, Mus musculus
catttctactgcatctaatgtcgct

SEQ ID NO: 13498 - DNA, 25 bp, Mus musculus
tctactgcatctaatgtcgctatgt

SEQ ID NO: 13499 - DNA, 25 bp, Mus musculus
tactgcatctaatgtcgctatgtaa

SEQ ID NO: 13500 - DNA, 25 bp, Mus musculus
ctgcatctaatgtcgctatgtaacc

SEQ ID NO: 13501 - DNA, 25 bp, Mus musculus
gcatctaatgtcgctatgtaaccgc

SEQ ID NO: 13502 - DNA, 25 bp, Mus musculus
atctaatgtcgctatgtaaccgccc

SEQ ID NO: 13503 - DNA, 25 bp, Mus musculus
ctaatgtcgctatgtaaccgccctg

SEQ ID NO: 13504 - DNA, 25 bp, Mus musculus
agaacatagacttctttggaataga

SEQ ID NO: 13505 - DNA, 25 bp, Mus musculus
aacatagacttctttggaatagaga

SEQ ID NO: 13506 - DNA, 25 bp, Mus musculus
ttctctggtatctaacttgcagaac

SEQ ID NO: 13507 - DNA, 25 bp, Mus musculus
tctctggtatctaacttgcagaaca

SEQ ID NO: 13508 - DNA, 25 bp, Mus musculus
ctctggtatctaacttgcagaacag

SEQ ID NO: 13509 - DNA, 25 bp, Mus musculus
gtatctaacttgcagaacagaggcc

SEQ ID NO: 13510 - DNA, 25 bp, Mus musculus
acatagacttctttggaatagagac

SEQ ID NO: 13511 - DNA, 25 bp, Mus musculus
aatagagacacagcagcaagagcat

SEQ ID NO: 13512 - DNA, 25 bp, Mus musculus
tagagacacagcagcaagagcattg

SEQ ID NO: 13513 - DNA, 25 bp, Mus musculus
gacacagcagcaagagcattgggac

SEQ ID NO: 13514 - DNA, 25 bp, Mus musculus
actgttctctggtatctaacttgca

SEQ ID NO: 13515 - DNA, 25 bp, Mus musculus
ctgttctctggtatctaacttgcag

SEQ ID NO: 13516 - DNA, 25 bp, Mus musculus
tgttctctggtatctaacttgcaga

SEQ ID NO: 13517 - DNA, 25 bp, Mus musculus
gttctctggtatctaacttgcagaa

SEQ ID NO: 13518 - DNA, 25 bp, Mus musculus
agaacatagacttctttggaataga

SEQ ID NO: 13519 - DNA, 25 bp, Mus musculus
aacatagacttctttggaatagaga

SEQ ID NO: 13520 - DNA, 25 bp, Mus musculus
ttctctggtatctaacttgcagaac

SEQ ID NO: 13521 - DNA, 25 bp, Mus musculus
tctctggtatctaacttgcagaaca

SEQ ID NO: 13522 - DNA, 25 bp, Mus musculus
ctctggtatctaacttgcagaacag

SEQ ID NO: 13523 - DNA, 25 bp, Mus musculus
tctggtatctaacttgcagaacaga

SEQ ID NO: 13524 - DNA, 25 bp, Mus musculus
gtatctaacttgcagaacagaggcc

SEQ ID NO: 13525 - DNA, 25 bp, Mus musculus
acatagacttctttggaatagagac

SEQ ID NO: 13526 - DNA, 25 bp, Mus musculus
aatagagacacagcagcaagagcat

SEQ ID NO: 13527 - DNA, 25 bp, Mus musculus
tagagacacagcagcaagagcattg

SEQ ID NO: 13528 - DNA, 25 bp, Mus musculus
gacacagcagcaagagcattgggac

SEQ ID NO: 13529 - DNA, 25 bp, Mus musculus
actgttctctggtatctaacttgca

SEQ ID NO: 13530 - DNA, 25 bp, Mus musculus
ctgttctctggtatctaacttgcag

SEQ ID NO: 13531 - DNA, 25 bp, Mus musculus
tgttctctggtatctaacttgcaga

SEQ ID NO: 13532 - DNA, 25 bp, Mus musculus
gttctctggtatctaacttgcagaa

SEQ ID NO: 13533 - DNA, 25 bp, Mus musculus
agaacatagacttctttggaataga

SEQ ID NO: 13534 - DNA, 25 bp, Mus musculus
aacatagacttctttggaatagaga

SEQ ID NO: 13535 - DNA, 25 bp, Mus musculus
ttctctggtatctaacttgcagaac

SEQ ID NO: 13536 - DNA, 25 bp, Mus musculus
tctctggtatctaacttgcagaaca

SEQ ID NO: 13537 - DNA, 25 bp, Mus musculus
ctctggtatctaacttgcagaacag

SEQ ID NO: 13538 - DNA, 25 bp, Mus musculus
tctggtatctaacttgcagaacaga

SEQ ID NO: 13539 - DNA, 25 bp, Mus musculus
gtatctaacttgcagaacagaggcc

SEQ ID NO: 13540 - DNA, 25 bp, Mus musculus
acatagacttctttggaatagagac

SEQ ID NO: 13541 - DNA, 25 bp, Mus musculus
aatagagacacagcagcaagagcat

SEQ ID NO: 13542 - DNA, 25 bp, Mus musculus
tagagacacagcagcaagagcattg

SEQ ID NO: 13543 - DNA, 25 bp, Mus musculus
gacacagcagcaagagcattgggac

SEQ ID NO: 13544 - DNA, 25 bp, Mus musculus
actgttctctggtatctaacttgca

SEQ ID NO: 13545 - DNA, 25 bp, Mus musculus
ctgttctctggtatctaacttgcag

SEQ ID NO: 13546 - DNA, 25 bp, Mus musculus
tgttctctggtatctaacttgcaga

SEQ ID NO: 13547 - DNA, 25 bp, Mus musculus
gttctctggtatctaacttgcagaa

SEQ ID NO: 13548 - DNA, 25 bp, Mus musculus
cctcacagcacacaggtagaggttt

SEQ ID NO: 13549 - DNA, 25 bp, Mus musculus
cacagcacacaggtagaggttttga

SEQ ID NO: 13550 - DNA, 25 bp, Mus musculus
gagactgaacagacctactctggtc

SEQ ID NO: 13551 - DNA, 25 bp, Mus musculus
agactgaacagacctactctggtcc

SEQ ID NO: 13552 - DNA, 25 bp, Mus musculus
tgaacagacctactctggtccccca

SEQ ID NO: 13553 - DNA, 25 bp, Mus musculus
tactctggtcccccaaagcttatct

SEQ ID NO: 13554 - DNA, 25 bp, Mus musculus
actctggtcccccaaagcttatctg

SEQ ID NO: 13555 - DNA, 25 bp, Mus musculus
ctggtcccccaaagcttatctgatt

SEQ ID NO: 13556 - DNA, 25 bp, Mus musculus
tggtcccccaaagcttatctgattt

SEQ ID NO: 13557 - DNA, 25 bp, Mus musculus
tcccccaaagcttatctgatttatt

SEQ ID NO: 13558 - DNA, 25 bp, Mus musculus
ccccaaagcttatctgatttatttg

SEQ ID NO: 13559 - DNA, 25 bp, Mus musculus
cccaaagcttatctgatttatttgt

SEQ ID NO: 13560 - DNA, 25 bp, Mus musculus
ttccttcagaacctggctccttcag

SEQ ID NO: 13561 - DNA, 25 bp, Mus musculus
ccttcagaacctggctccttcagac

SEQ ID NO: 13562 - DNA, 25 bp, Mus musculus
ttcagaacctggctccttcagacat

SEQ ID NO: 13563 - DNA, 25 bp, Mus musculus
cagaacctggctccttcagacattt

SEQ ID NO: 13564 - DNA, 25 bp, Mus musculus
agaacctggctccttcagacatttc

SEQ ID NO: 13565 - DNA, 25 bp, Mus musculus
gaacctggctccttcagacatttcc

SEQ ID NO: 13566 - DNA, 25 bp, Mus musculus
acctggctccttcagacatttcctg

SEQ ID NO: 13567 - DNA, 25 bp, Mus musculus
cctggctccttcagacatttcctgg

SEQ ID NO: 13568 - DNA, 25 bp, Mus musculus
cctctactgcaggatctactccttg

SEQ ID NO: 13569 - DNA, 25 bp, Mus musculus
caggatctactccttggtgaggact

SEQ ID NO: 13570 - DNA, 25 bp, Mus musculus
cattgtcctgagtgtcttcattgcc

SEQ ID NO: 13571 - DNA, 25 bp, Mus musculus
tgtcctgagtgtcttcattgcctgc

SEQ ID NO: 13572 - DNA, 25 bp, Mus musculus
gagtgtcttcattgcctgctgggcc

SEQ ID NO: 13573 - DNA, 25 bp, Mus musculus
tgtcttcattgcctgctgggcccct

SEQ ID NO: 13574 - DNA, 25 bp, Mus musculus
tctcttcatcctactacttttagat

SEQ ID NO: 13575 - DNA, 25 bp, Mus musculus
cttcatcctactacttttagatgtg

SEQ ID NO: 13576 - DNA, 25 bp, Mus musculus
gaagacctgtgacatcctgtacaaa

SEQ ID NO: 13577 - DNA, 25 bp, Mus musculus
ctgtgacatcctgtacaaagcagag

SEQ ID NO: 13578 - DNA, 25 bp, Mus musculus
tgacatcctgtacaaagcagagtac

SEQ ID NO: 13579 - DNA, 25 bp, Mus musculus
catcctgtacaaagcagagtacttc

SEQ ID NO: 13580 - DNA, 25 bp, Mus musculus
gatctactccttggtgaggactcga

SEQ ID NO: 13581 - DNA, 25 bp, Mus musculus
ctactccttggtgaggactcgaagc

SEQ ID NO: 13582 - DNA, 25 bp, Mus musculus
gaccttccgcaagaacatctccaag

SEQ ID NO: 13583 - DNA, 25 bp, Mus musculus
cttccgcaagaacatctccaaggcc

SEQ ID NO: 13584 - DNA, 25 bp, Mus musculus
caaggccagccgcagttccgagaag

SEQ ID NO: 13585 - DNA, 25 bp, Mus musculus
cagccgcagttccgagaagtctctg

SEQ ID NO: 13586 - DNA, 25 bp, Mus musculus
cgagaagtctctggccttgctgaag

SEQ ID NO: 13587 - DNA, 25 bp, Mus musculus
gatcattgtcctgagtgtcttcatt

SEQ ID NO: 13588 - DNA, 25 bp, Mus musculus
tgccttcttggccatcgcagtccca

SEQ ID NO: 13589 - DNA, 25 bp, Mus musculus
catcgcagtcccaggaggaacaacg

SEQ ID NO: 13590 - DNA, 25 bp, Mus musculus
aaccactttctgctagagcaaggga

SEQ ID NO: 13591 - DNA, 25 bp, Mus musculus
tttctgctagagcaagggaccccac

SEQ ID NO: 13592 - DNA, 25 bp, Mus musculus
ccctgtcagctcttggctccaggca

SEQ ID NO: 13593 - DNA, 25 bp, Mus musculus
cagctcttggctccaggcaccagca

SEQ ID NO: 13594 - DNA, 25 bp, Mus musculus
gtctgccactagacagagttcacag

SEQ ID NO: 13595 - DNA, 25 bp, Mus musculus
cactagacagagttcacaggagacc

SEQ ID NO: 13596 - DNA, 25 bp, Mus musculus
ttttcatttcctcctcagctggtaa

SEQ ID NO: 13597 - DNA, 25 bp, Mus musculus
tttcctcctcagctggtaactcagg

SEQ ID NO: 13598 - DNA, 25 bp, Mus musculus
actcagggttcatctgtccaaggcc

SEQ ID NO: 13599 - DNA, 25 bp, Mus musculus
ggttcatctgtccaaggcctttcta

SEQ ID NO: 13600 - DNA, 25 bp, Mus musculus
gagtcacatgtgtggccgagactcc

SEQ ID NO: 13601 - DNA, 25 bp, Mus musculus
tggccgagactcccttggtagcttt

SEQ ID NO: 13602 - DNA, 25 bp, Mus musculus
tggggccatctgcacatgacttcga

SEQ ID NO: 13603 - DNA, 25 bp, Mus musculus
agcaggtccagtgtcgcctctcaga

SEQ ID NO: 13604 - DNA, 25 bp, Mus musculus
ctcctggctcctcagcagaacttgg

SEQ ID NO: 13605 - DNA, 25 bp, Mus musculus
gctcctcagcagaacttggtcccca

SEQ ID NO: 13606 - DNA, 25 bp, Mus musculus
tctgttctggggttctagaaccact

SEQ ID NO: 13607 - DNA, 25 bp, Mus musculus
ttctagaaccactttctgctagagc

SEQ ID NO: 13608 - DNA, 25 bp, Mus musculus
atcttcgagatgattctgagcatgg

SEQ ID NO: 13609 - DNA, 25 bp, Mus musculus
gtgctgtgctgtggcatccggaaca

SEQ ID NO: 13610 - DNA, 25 bp, Mus musculus
ctatttctgtattactctgctacac

SEQ ID NO: 13611 - DNA, 25 bp, Mus musculus
tttctgtattactctgctacactta

SEQ ID NO: 13612 - DNA, 25 bp, Mus musculus
tattactctgctacacttagccttc

SEQ ID NO: 13613 - DNA, 25 bp, Mus musculus
tctgctacacttagccttctttact

SEQ ID NO: 13614 - DNA, 25 bp, Mus musculus
ctgtcaccttttggagccgacacca

SEQ ID NO: 13615 - DNA, 25 bp, Mus musculus
ccttttggagccgacaccacacata

SEQ ID NO: 13616 - DNA, 25 bp, Mus musculus
ggagccgacaccacacataggtggc

SEQ ID NO: 13617 - DNA, 25 bp, Mus musculus
gccgacaccacacataggtggcgta

SEQ ID NO: 13618 - DNA, 25 bp, Mus musculus
gacaccacacataggtggcgtatgt

SEQ ID NO: 13619 - DNA, 25 bp, Mus musculus
acacataggtggcgtatgtggggac

SEQ ID NO: 13620 - DNA, 25 bp, Mus musculus
tgctgtggcatccggaacagctccg

SEQ ID NO: 13621 - DNA, 25 bp, Mus musculus
ggcatccggaacagctccgtgtact

SEQ ID NO: 13622 - DNA, 25 bp, Mus musculus
atccggaacagctccgtgtactaag

SEQ ID NO: 13623 - DNA, 25 bp, Mus musculus
taaggcccttcgcttcgcaccagag

SEQ ID NO: 13624 - DNA, 25 bp, Mus musculus
accagagggtccctggaatgaccag

SEQ ID NO: 13625 - DNA, 25 bp, Mus musculus
gggtccctggaatgaccagaggcca

SEQ ID NO: 13626 - DNA, 25 bp, Mus musculus
tgaccagaggccaccttgggggcat

SEQ ID NO: 13627 - DNA, 25 bp, Mus musculus
accttgggggcatggctgctgtata

SEQ ID NO: 13628 - DNA, 25 bp, Mus musculus
taccaaagcatcaacacaaccagtc

SEQ ID NO: 13629 - DNA, 25 bp, Mus musculus
agcatcaacacaaccagtctaacag

SEQ ID NO: 13630 - DNA, 25 bp, Mus musculus
tactttcttgtttgattgagcaaag

SEQ ID NO: 13631 - DNA, 25 bp, Mus musculus
agcaaagtctcctagtgacagcaac

SEQ ID NO: 13632 - DNA, 25 bp, Mus musculus
tagtgacagcaacaccatgaatttt

SEQ ID NO: 13633 - DNA, 25 bp, Mus musculus
cagcaacaccatgaattttacttct

SEQ ID NO: 13634 - DNA, 25 bp, Mus musculus
caagctggccatacaggggacatgg

SEQ ID NO: 13635 - DNA, 25 bp, Mus musculus
ctccgagccagctgtgttttacaca

SEQ ID NO: 13636 - DNA, 25 bp, Mus musculus
ttacacaaagctgtacaattgttat

SEQ ID NO: 13637 - DNA, 25 bp, Mus musculus
ttgtacatttcctacaactgaagcc

SEQ ID NO: 13638 - DNA, 25 bp, Mus musculus
tcccaaacgtgtctggacagtacct

SEQ ID NO: 13639 - DNA, 25 bp, Mus musculus
acgtgtctggacagtacctgattgt

SEQ ID NO: 13640 - DNA, 25 bp, Mus musculus
aacacaaccagtctaacagtgaagc

SEQ ID NO: 13641 - DNA, 25 bp, Mus musculus
atttgatgggcgtccaagcagacca

SEQ ID NO: 13642 - DNA, 25 bp, Mus musculus
cagaccacacggatcactgaggcac

SEQ ID NO: 13643 - DNA, 25 bp, Mus musculus
acacggatcactgaggcactgatgt

SEQ ID NO: 13644 - DNA, 25 bp, Mus musculus
ctgatgtaggcccctctgcaacgac

SEQ ID NO: 13645 - DNA, 25 bp, Mus musculus
taggcccctctgcaacgacttcctt

SEQ ID NO: 13646 - DNA, 25 bp, Mus musculus
ttgcaccaaagacaacagtctacaa

SEQ ID NO: 13647 - DNA, 25 bp, Mus musculus
caaagacaacagtctacaagtttct

SEQ ID NO: 13648 - DNA, 25 bp, Mus musculus
ctcttcctcacagatcagtaccggg

SEQ ID NO: 13649 - DNA, 25 bp, Mus musculus
tcctcacagatcagtaccgggatcg

SEQ ID NO: 13650 - DNA, 25 bp, Mus musculus
cgccgaagacgcatcatgcaaaccg

SEQ ID NO: 13651 - DNA, 25 bp, Mus musculus
agacgcatcatgcaaaccgtggaga

SEQ ID NO: 13652 - DNA, 25 bp, Mus musculus
gaggctgttgctcaccattgtagat

SEQ ID NO: 13653 - DNA, 25 bp, Mus musculus
ggctgttgctcaccattgtagatac

SEQ ID NO: 13654 - DNA, 25 bp, Mus musculus
gttgctcaccattgtagatacttga

SEQ ID NO: 13655 - DNA, 25 bp, Mus musculus
tgctcaccattgtagatacttgagg

SEQ ID NO: 13656 - DNA, 25 bp, Mus musculus
ctcaccattgtagatacttgaggat

SEQ ID NO: 13657 - DNA, 25 bp, Mus musculus
ggaagactctgcccgaatacataga

SEQ ID NO: 13658 - DNA, 25 bp, Mus musculus
aagactctgcccgaatacatagacc

SEQ ID NO: 13659 - DNA, 25 bp, Mus musculus
gactctgcccgaatacatagaccag

SEQ ID NO: 13660 - DNA, 25 bp, Mus musculus
ctcacagatcagtaccgggatcgta

SEQ ID NO: 13661 - DNA, 25 bp, Mus musculus
cagatcagtaccgggatcgtaactg

SEQ ID NO: 13662 - DNA, 25 bp, Mus musculus
gatcgtaactgctaggcgccgaaga

SEQ ID NO: 13663 - DNA, 25 bp, Mus musculus
tcgtaactgctaggcgccgaagacg

SEQ ID NO: 13664 - DNA, 25 bp, Mus musculus
gtaactgctaggcgccgaagacgca

SEQ ID NO: 13665 - DNA, 25 bp, Mus musculus
aactgctaggcgccgaagacgcatc

SEQ ID NO: 13666 - DNA, 25 bp, Mus musculus
gctaggcgccgaagacgcatcatgc

SEQ ID NO: 13667 - DNA, 25 bp, Mus musculus
ggcgccgaagacgcatcatgcaaac

SEQ ID NO: 13668 - DNA, 25 bp, Mus musculus
atctatctatatctaatctatatct

SEQ ID NO: 13669 - DNA, 25 bp, Mus musculus
ctatatctaatctatatctatctat

SEQ ID NO: 13670 - DNA, 25 bp, Mus musculus
gccacagtgcttctaagcatttccc

SEQ ID NO: 13671 - DNA, 25 bp, Mus musculus
gctactctgtttgcagtgagcttta

SEQ ID NO: 13672 - DNA, 25 bp, Mus musculus
gctttaacaatgccttgctgtttcc

SEQ ID NO: 13673 - DNA, 25 bp, Mus musculus
ccttgctgtttcccatctcaagtca

SEQ ID NO: 13674 - DNA, 25 bp, Mus musculus
tgtttcccatctcaagtcaatgcca

SEQ ID NO: 13675 - DNA, 25 bp, Mus musculus
ccatctcaagtcaatgccacttgga

SEQ ID NO: 13676 - DNA, 25 bp, Mus musculus
caagtcaatgccacttggatgccat

SEQ ID NO: 13677 - DNA, 25 bp, Mus musculus
aatgccacttggatgccattcactc

SEQ ID NO: 13678 - DNA, 25 bp, Mus musculus
ttcactcccaagtgtccttacatag

SEQ ID NO: 13679 - DNA, 25 bp, Mus musculus
cacatgctcaatagcataaagaata

SEQ ID NO: 13680 - DNA, 25 bp, Mus musculus
tctatctatctatctatatgctcct

SEQ ID NO: 13681 - DNA, 25 bp, Mus musculus
ccttctctttcaaagggaattgctg

SEQ ID NO: 13682 - DNA, 25 bp, Mus musculus
tactatactgaaataacctaaagca

SEQ ID NO: 13683 - DNA, 25 bp, Mus musculus
aattttgcaatctggggacctctga

SEQ ID NO: 13684 - DNA, 25 bp, Mus musculus
gcaatctggggacctctgaggaagt

SEQ ID NO: 13685 - DNA, 25 bp, Mus musculus
taattttgtcattcagccactgcta

SEQ ID NO: 13686 - DNA, 25 bp, Mus musculus
tgtcattcagccactgctagccaaa

SEQ ID NO: 13687 - DNA, 25 bp, Mus musculus
tcagccactgctagccaaacttgtc

SEQ ID NO: 13688 - DNA, 25 bp, Mus musculus
ttcatgcctttctcctacccagatg

SEQ ID NO: 13689 - DNA, 25 bp, Mus musculus
ttctcctacccagatgtgcttgaac

SEQ ID NO: 13690 - DNA, 25 bp, Mus musculus
tgtctattgccgaagaaaagttgta

SEQ ID NO: 13691 - DNA, 25 bp, Mus musculus
atgctgttctgtaagccatttcttt

SEQ ID NO: 13692 - DNA, 25 bp, Mus musculus
cctttttctaggaaggcagatatag

SEQ ID NO: 13693 - DNA, 25 bp, Mus musculus
ttcacatgttatgtagctgtaagta

SEQ ID NO: 13694 - DNA, 25 bp, Mus musculus
ttgaggtctcactaccctttgagga

SEQ ID NO: 13695 - DNA, 25 bp, Mus musculus
cactaccctttgaggaaggcagctt

SEQ ID NO: 13696 - DNA, 25 bp, Mus musculus
gtctttttatctcatatgtgcagat

SEQ ID NO: 13697 - DNA, 25 bp, Mus musculus
tgcagatcttgcaactgcttgattt

SEQ ID NO: 13698 - DNA, 25 bp, Mus musculus
tcttgcaactgcttgatttacatgg

SEQ ID NO: 13699 - DNA, 25 bp, Mus musculus
tgcaactgcttgatttacatggtag

SEQ ID NO: 13700 - DNA, 25 bp, Mus musculus
tcctacccagatgtgcttgaaccac

SEQ ID NO: 13701 - DNA, 25 bp, Mus musculus
tacccagatgtgcttgaaccactga

SEQ ID NO: 13702 - DNA, 25 bp, Mus musculus
gatgtgcttgaaccactgaggcaag

SEQ ID NO: 13703 - DNA, 25 bp, Mus musculus
accccacaggagcactggagctctg

SEQ ID NO: 13704 - DNA, 25 bp, Mus musculus
cactggagctctgcagttgagacgt

SEQ ID NO: 13705 - DNA, 25 bp, Mus musculus
tggagctctgcagttgagacgttta

SEQ ID NO: 13706 - DNA, 25 bp, Mus musculus
aagtggcactccaaacatgtacagt

SEQ ID NO: 13707 - DNA, 25 bp, Mus musculus
atggtatacagactccttttgaaag

SEQ ID NO: 13708 - DNA, 25 bp, Mus musculus
tgcccggggagctggccaagcacgc

SEQ ID NO: 13709 - DNA, 25 bp, Mus musculus
agctggccaagcacgccgtgtcgga

SEQ ID NO: 13710 - DNA, 25 bp, Mus musculus
ctgttgccagacaccgaatactgtt

SEQ ID NO: 13711 - DNA, 25 bp, Mus musculus
tgttgccagacaccgaatactgttt

SEQ ID NO: 13712 - DNA, 25 bp, Mus musculus
ttgccagacaccgaatactgtttaa

SEQ ID NO: 13713 - DNA, 25 bp, Mus musculus
tgccagacaccgaatactgtttaat

SEQ ID NO: 13714 - DNA, 25 bp, Mus musculus
cagacaccgaatactgtttaatcct

SEQ ID NO: 13715 - DNA, 25 bp, Mus musculus
cgtgcctgtaaattcattggcgtaa

SEQ ID NO: 13716 - DNA, 25 bp, Mus musculus
taatgaaagacccacaacgtgagga

SEQ ID NO: 13717 - DNA, 25 bp, Mus musculus
atgaaagacccacaacgtgaggact

SEQ ID NO: 13718 - DNA, 25 bp, Mus musculus
tgaaagacccacaacgtgaggactc

SEQ ID NO: 13719 - DNA, 25 bp, Mus musculus
gacccacaacgtgaggactccacca

SEQ ID NO: 13720 - DNA, 25 bp, Mus musculus
gctggccaagcacgccgtgtcggag

SEQ ID NO: 13721 - DNA, 25 bp, Mus musculus
ccaagcacgccgtgtcggagggcac

SEQ ID NO: 13722 - DNA, 25 bp, Mus musculus
caagcacgccgtgtcggagggcacc

SEQ ID NO: 13723 - DNA, 25 bp, Mus musculus
gtacaccagctccaagtgagttcct

SEQ ID NO: 13724 - DNA, 25 bp, Mus musculus
gctccaagtgagttcctttaacaca

SEQ ID NO: 13725 - DNA, 25 bp, Mus musculus
gtgagttcctttaacacacactcct

SEQ ID NO: 13726 - DNA, 25 bp, Mus musculus
gagctgttgccagacaccgaatact

SEQ ID NO: 13727 - DNA, 25 bp, Mus musculus
agctgttgccagacaccgaatactg

SEQ ID NO: 13728 - DNA, 25 bp, Mus musculus
cagcacacatagcacagaagtcagc

SEQ ID NO: 13729 - DNA, 25 bp, Mus musculus
cacacatagcacagaagtcagctga

SEQ ID NO: 13730 - DNA, 25 bp, Mus musculus
cgctgacgagcccaatttctgagga

SEQ ID NO: 13731 - DNA, 25 bp, Mus musculus
tgacgagcccaatttctgaggacga

SEQ ID NO: 13732 - DNA, 25 bp, Mus musculus
cgagcccaatttctgaggacgagcc

SEQ ID NO: 13733 - DNA, 25 bp, Mus musculus
gcccaatttctgaggacgagcctct

SEQ ID NO: 13734 - DNA, 25 bp, Mus musculus
caatttctgaggacgagcctctctg

SEQ ID NO: 13735 - DNA, 25 bp, Mus musculus
tttctgaggacgagcctctctgact

SEQ ID NO: 13736 - DNA, 25 bp, Mus musculus
ctgaggacgagcctctctgactatc

SEQ ID NO: 13737 - DNA, 25 bp, Mus musculus
gctcgctttgctgtacgagacattg

SEQ ID NO: 13738 - DNA, 25 bp, Mus musculus
cgctttgctgtacgagacattgtgg

SEQ ID NO: 13739 - DNA, 25 bp, Mus musculus
tttgctgtacgagacattgtggcac

SEQ ID NO: 13740 - DNA, 25 bp, Mus musculus
agtcagctgagcttgcagagaagat

SEQ ID NO: 13741 - DNA, 25 bp, Mus musculus
attgacacaagttcctcgaagtcag

SEQ ID NO: 13742 - DNA, 25 bp, Mus musculus
gacacaagttcctcgaagtcaggca

SEQ ID NO: 13743 - DNA, 25 bp, Mus musculus
acaagttcctcgaagtcaggcagat

SEQ ID NO: 13744 - DNA, 25 bp, Mus musculus
tgctgacactgatgatatggtcgct

SEQ ID NO: 13745 - DNA, 25 bp, Mus musculus
tgatatggtcgctgacgagcccaat

SEQ ID NO: 13746 - DNA, 25 bp, Mus musculus
tatggtcgctgacgagcccaatttc

SEQ ID NO: 13747 - DNA, 25 bp, Mus musculus
ggtcgctgacgagcccaatttctga

SEQ ID NO: 13748 - DNA, 25 bp, Mus musculus
tcatcaaagctgtggacaagaaggc

SEQ ID NO: 13749 - DNA, 25 bp, Mus musculus
aaggctgctggagctggcaaagtca

SEQ ID NO: 13750 - DNA, 25 bp, Mus musculus
aggctgctggagctggcaaagtcac

SEQ ID NO: 13751 - DNA, 25 bp, Mus musculus
gaaacaacttgaccaaaatctgtca

SEQ ID NO: 13752 - DNA, 25 bp, Mus musculus
cttgaccaaaatctgtcacagattt

SEQ ID NO: 13753 - DNA, 25 bp, Mus musculus
ttgaccaaaatctgtcacagatttt

SEQ ID NO: 13754 - DNA, 25 bp, Mus musculus
aaatctgtcacagattttgagacca

SEQ ID NO: 13755 - DNA, 25 bp, Mus musculus
aatctgtcacagattttgagaccat

SEQ ID NO: 13756 - DNA, 25 bp, Mus musculus
atctgtcacagattttgagaccatt

SEQ ID NO: 13757 - DNA, 25 bp, Mus musculus
tcatcaaagctgtggacaagaaggc

SEQ ID NO: 13758 - DNA, 25 bp, Mus musculus
aaggctgctggagctggcaaagtca

SEQ ID NO: 13759 - DNA, 25 bp, Mus musculus
accaaaatctgtcacagattttgag

SEQ ID NO: 13760 - DNA, 25 bp, Mus musculus
ccaaaatctgtcacagattttgaga

SEQ ID NO: 13761 - DNA, 25 bp, Mus musculus
caaaatctgtcacagattttgagac

SEQ ID NO: 13762 - DNA, 25 bp, Mus musculus
aaaatctgtcacagattttgagacc

SEQ ID NO: 13763 - DNA, 25 bp, Mus musculus
aaatctgtcacagattttgagacca

SEQ ID NO: 13764 - DNA, 25 bp, Mus musculus
aatctgtcacagattttgagaccat

SEQ ID NO: 13765 - DNA, 25 bp, Mus musculus
atctgtcacagattttgagaccatt

SEQ ID NO: 13766 - DNA, 25 bp, Mus musculus
aggctgctggagctggcaaagtcac

SEQ ID NO: 13767 - DNA, 25 bp, Mus musculus
gaaacaacttgaccaaaatctgtca

SEQ ID NO: 13768 - DNA, 25 bp, Mus musculus
aacaacttgaccaaaatctgtcaca

SEQ ID NO: 13769 - DNA, 25 bp, Mus musculus
acttgaccaaaatctgtcacagatt

SEQ ID NO: 13770 - DNA, 25 bp, Mus musculus
cttgaccaaaatctgtcacagattt

SEQ ID NO: 13771 - DNA, 25 bp, Mus musculus
ttgaccaaaatctgtcacagatttt

SEQ ID NO: 13772 - DNA, 25 bp, Mus musculus
tgaccaaaatctgtcacagattttg

SEQ ID NO: 13773 - DNA, 25 bp, Mus musculus
gaccaaaatctgtcacagattttga

SEQ ID NO: 13774 - DNA, 25 bp, Mus musculus
aagtgtctttgcgggattgcttcag

SEQ ID NO: 13775 - DNA, 25 bp, Mus musculus
gggattgcttcagccttttcaccaa

SEQ ID NO: 13776 - DNA, 25 bp, Mus musculus
cccgaatcctcgtgctccatctgaa

SEQ ID NO: 13777 - DNA, 25 bp, Mus musculus
tcgtgctccatctgaaccgattttc

SEQ ID NO: 13778 - DNA, 25 bp, Mus musculus
tccatctgaaccgattttccacctc

SEQ ID NO: 13779 - DNA, 25 bp, Mus musculus
cctcccgaggctccatcaagaaaag

SEQ ID NO: 13780 - DNA, 25 bp, Mus musculus
taggtgtagacttcccactgcagag

SEQ ID NO: 13781 - DNA, 25 bp, Mus musculus
gtgtagacttcccactgcagagact

SEQ ID NO: 13782 - DNA, 25 bp, Mus musculus
tagacttcccactgcagagactaag

SEQ ID NO: 13783 - DNA, 25 bp, Mus musculus
acttcccactgcagagactaagcct

SEQ ID NO: 13784 - DNA, 25 bp, Mus musculus
tcccactgcagagactaagcctagg

SEQ ID NO: 13785 - DNA, 25 bp, Mus musculus
cactgcagagactaagcctagggga

SEQ ID NO: 13786 - DNA, 25 bp, Mus musculus
attgcttcagccttttcaccaagga

SEQ ID NO: 13787 - DNA, 25 bp, Mus musculus
gcttcagccttttcaccaaggagga

SEQ ID NO: 13788 - DNA, 25 bp, Mus musculus
gccttttcaccaaggaggaagagct

SEQ ID NO: 13789 - DNA, 25 bp, Mus musculus
ttttcaccaaggaggaagagctaga

SEQ ID NO: 13790 - DNA, 25 bp, Mus musculus
cggagaatgccccagtgtgtgaccg

SEQ ID NO: 13791 - DNA, 25 bp, Mus musculus
agaatgccccagtgtgtgaccgatg

SEQ ID NO: 13792 - DNA, 25 bp, Mus musculus
atgccccagtgtgtgaccgatgtcg

SEQ ID NO: 13793 - DNA, 25 bp, Mus musculus
tgtgtgaccgatgtcggcagaaaac

SEQ ID NO: 13794 - DNA, 25 bp, Mus musculus
acaacacctccattgaagagatgcc

SEQ ID NO: 13795 - DNA, 25 bp, Mus musculus
acacctccattgaagagatgcccct

SEQ ID NO: 13796 - DNA, 25 bp, Mus musculus
cccagccaaatctccaaagtgagtc

SEQ ID NO: 13797 - DNA, 25 bp, Mus musculus
agccaaatctccaaagtgagtcaag

SEQ ID NO: 13798 - DNA, 25 bp, Mus musculus
caaatctccaaagtgagtcaagggg

SEQ ID NO: 13799 - DNA, 25 bp, Mus musculus
atctccaaagtgagtcaaggggcta

SEQ ID NO: 13800 - DNA, 25 bp, Mus musculus
tggcctcattgctggaccaaatcta

SEQ ID NO: 13801 - DNA, 25 bp, Mus musculus
cctcattgctggaccaaatctacag

SEQ ID NO: 13802 - DNA, 25 bp, Mus musculus
cattgctggaccaaatctacaggag

SEQ ID NO: 13803 - DNA, 25 bp, Mus musculus
tgctggaccaaatctacaggagaaa

SEQ ID NO: 13804 - DNA, 25 bp, Mus musculus
tctacaggagaaacccctgagtgaa

SEQ ID NO: 13805 - DNA, 25 bp, Mus musculus
ggagaaacccctgagtgaaggattg

SEQ ID NO: 13806 - DNA, 25 bp, Mus musculus
aagagatgcccctcaacgttgctga

SEQ ID NO: 13807 - DNA, 25 bp, Mus musculus
agatgcccctcaacgttgctgacct

SEQ ID NO: 13808 - DNA, 25 bp, Mus musculus
tgcccctcaacgttgctgacctcat

SEQ ID NO: 13809 - DNA, 25 bp, Mus musculus
ccctcaacgttgctgacctcattta

SEQ ID NO: 13810 - DNA, 25 bp, Mus musculus
tcaacgttgctgacctcatttaggg

SEQ ID NO: 13811 - DNA, 25 bp, Mus musculus
cactaatgcatttccctaacctagt

SEQ ID NO: 13812 - DNA, 25 bp, Mus musculus
taatgcatttccctaacctagtcac

SEQ ID NO: 13813 - DNA, 25 bp, Mus musculus
tgcatttccctaacctagtcacctc

SEQ ID NO: 13814 - DNA, 25 bp, Mus musculus
ggcaccacctcgaaggtcgaccatc

SEQ ID NO: 13815 - DNA, 25 bp, Mus musculus
aaggtcgaccatccgcaacgcacag

SEQ ID NO: 13816 - DNA, 25 bp, Mus musculus
atcgactccgcgcgtcaaaccacag

SEQ ID NO: 13817 - DNA, 25 bp, Mus musculus
ccgctgcacagagagcaccaaacgg

SEQ ID NO: 13818 - DNA, 25 bp, Mus musculus
caaacggaagctgacgtccgctgtg

SEQ ID NO: 13819 - DNA, 25 bp, Mus musculus
gaagctgacgtccgctgtgtgagaa

SEQ ID NO: 13820 - DNA, 25 bp, Mus musculus
gacgtccgctgtgtgagaagcagcg

SEQ ID NO: 13821 - DNA, 25 bp, Mus musculus
ggccctagacggctcctatccctat

SEQ ID NO: 13822 - DNA, 25 bp, Mus musculus
tatagcctcaggttagagactcctc

SEQ ID NO: 13823 - DNA, 25 bp, Mus musculus
actgagactctacagcaaaggacag

SEQ ID NO: 13824 - DNA, 25 bp, Mus musculus
actctacagcaaaggacaggactgg

SEQ ID NO: 13825 - DNA, 25 bp, Mus musculus
tctccaccggtattgctagcatgag

SEQ ID NO: 13826 - DNA, 25 bp, Mus musculus
gaccatccgcaacgcacagagcatc

SEQ ID NO: 13827 - DNA, 25 bp, Mus musculus
tctgattacctgctgctgtagtccc

SEQ ID NO: 13828 - DNA, 25 bp, Mus musculus
ccaccagcgttctcggaagcgcctt

SEQ ID NO: 13829 - DNA, 25 bp, Mus musculus
gcgttctcggaagcgccttagccag

SEQ ID NO: 13830 - DNA, 25 bp, Mus musculus
gcgccttagccaggacacctatcgc

SEQ ID NO: 13831 - DNA, 25 bp, Mus musculus
ctatcgccgcaacagcgtccgattc

SEQ ID NO: 13832 - DNA, 25 bp, Mus musculus
ccgcaacagcgtccgattcctgcag

SEQ ID NO: 13833 - DNA, 25 bp, Mus musculus
cctgcagcagcgcagacgcccgggg

SEQ ID NO: 13834 - DNA, 25 bp, Mus musculus
caatccatcgactccgcgcgtcaaa

SEQ ID NO: 13835 - DNA, 25 bp, Mus musculus
tcatcgagcatctgtatctggtgga

SEQ ID NO: 13836 - DNA, 25 bp, Mus musculus
tcgagcatctgtatctggtggagat

SEQ ID NO: 13837 - DNA, 25 bp, Mus musculus
ccgcatgctagtcgcgtcaaggcac

SEQ ID NO: 13838 - DNA, 25 bp, Mus musculus
catgctagtcgcgtcaaggcacacc

SEQ ID NO: 13839 - DNA, 25 bp, Mus musculus
agtcgcgtcaaggcacacctgcacg

SEQ ID NO: 13840 - DNA, 25 bp, Mus musculus
gtcaaggcacacctgcacgtccatg

SEQ ID NO: 13841 - DNA, 25 bp, Mus musculus
gcacacctgcacgtccatgagtcct

SEQ ID NO: 13842 - DNA, 25 bp, Mus musculus
cacctgcacgtccatgagtcctgta

SEQ ID NO: 13843 - DNA, 25 bp, Mus musculus
ctgcacgtccatgagtcctgtaggc

SEQ ID NO: 13844 - DNA, 25 bp, Mus musculus
gtccatgagtcctgtaggctccacg

SEQ ID NO: 13845 - DNA, 25 bp, Mus musculus
gagtcctgtaggctccacgcgctga

SEQ ID NO: 13846 - DNA, 25 bp, Mus musculus
ctccacgcgctgatcggcgatgcaa

SEQ ID NO: 13847 - DNA, 25 bp, Mus musculus
atctgtatctggtggagattcagtg

SEQ ID NO: 13848 - DNA, 25 bp, Mus musculus
tctagggtgtcctgagcagtcagcg

SEQ ID NO: 13849 - DNA, 25 bp, Mus musculus
gtgtcctgagcagtcagcgctgtca

SEQ ID NO: 13850 - DNA, 25 bp, Mus musculus
tgagcagtcagcgctgtcatcgccg

SEQ ID NO: 13851 - DNA, 25 bp, Mus musculus
gcagtcagcgctgtcatcgccgtgt

SEQ ID NO: 13852 - DNA, 25 bp, Mus musculus
gtcatcgccgtgtgaggagtctcag

SEQ ID NO: 13853 - DNA, 25 bp, Mus musculus
atcgccgtgtgaggagtctcaggtg

SEQ ID NO: 13854 - DNA, 25 bp, Mus musculus
tagccgcatgctagtcgcgtcaagg

SEQ ID NO: 13855 - DNA, 25 bp, Mus musculus
ttctctgtgcaggggatcttcgaga

SEQ ID NO: 13856 - DNA, 25 bp, Mus musculus
aatggctttgacccatcacaactgc

SEQ ID NO: 13857 - DNA, 25 bp, Mus musculus
gtgaacgtatgcactctggtgccac

SEQ ID NO: 13858 - DNA, 25 bp, Mus musculus
gtatgcactctggtgccacgtcggc

SEQ ID NO: 13859 - DNA, 25 bp, Mus musculus
tctggcggacccttggtctgtaaca

SEQ ID NO: 13860 - DNA, 25 bp, Mus musculus
ttggtctgtaacaaccttgtccaag

SEQ ID NO: 13861 - DNA, 25 bp, Mus musculus
tgtaacaaccttgtccaaggcattg

SEQ ID NO: 13862 - DNA, 25 bp, Mus musculus
aaccttgtccaaggcattgactcct

SEQ ID NO: 13863 - DNA, 25 bp, Mus musculus
gtccaaggcattgactccttcatcc

SEQ ID NO: 13864 - DNA, 25 bp, Mus musculus
ttcatccgaggaggctgtggatctg

SEQ ID NO: 13865 - DNA, 25 bp, Mus musculus
ggattgtacccagatgccttcgccc

SEQ ID NO: 13866 - DNA, 25 bp, Mus musculus
atcaattccattatccgaaggcata

SEQ ID NO: 13867 - DNA, 25 bp, Mus musculus
tttgacccatcacaactgctgaacg

SEQ ID NO: 13868 - DNA, 25 bp, Mus musculus
ccatcacaactgctgaacgacattg

SEQ ID NO: 13869 - DNA, 25 bp, Mus musculus
caactgctgaacgacattgtgatta

SEQ ID NO: 13870 - DNA, 25 bp, Mus musculus
atccagctcaatggctccgctacca

SEQ ID NO: 13871 - DNA, 25 bp, Mus musculus
ggctccgctaccattaacgccaacg

SEQ ID NO: 13872 - DNA, 25 bp, Mus musculus
gccaacgtgcaggtggcccagctgc

SEQ ID NO: 13873 - DNA, 25 bp, Mus musculus
gacagaactccatgtctggccatgg

SEQ ID NO: 13874 - DNA, 25 bp, Mus musculus
tcacccagtgtgctacaagagctca

SEQ ID NO: 13875 - DNA, 25 bp, Mus musculus
gagtcatgtctttcacttttagtca

SEQ ID NO: 13876 - DNA, 25 bp, Mus musculus
agttgtctaaccacacaacatctca

SEQ ID NO: 13877 - DNA, 25 bp, Mus musculus
catttgcattgcctacctgcaaaca

SEQ ID NO: 13878 - DNA, 25 bp, Mus musculus
cattgcctacctgcaaacaattact

SEQ ID NO: 13879 - DNA, 25 bp, Mus musculus
aattgctatgcagttctaccttgcg

SEQ ID NO: 13880 - DNA, 25 bp, Mus musculus
tatgcagttctaccttgcgagtgct

SEQ ID NO: 13881 - DNA, 25 bp, Mus musculus
ccttgcgagtgctacacggtaattg

SEQ ID NO: 13882 - DNA, 25 bp, Mus musculus
atatttgcacattttacatgctatg

SEQ ID NO: 13883 - DNA, 25 bp, Mus musculus
gcacattttacatgctatgctatat

SEQ ID NO: 13884 - DNA, 25 bp, Mus musculus
tttacatgctatgctatatgattgc

SEQ ID NO: 13885 - DNA, 25 bp, Mus musculus
tgattgcctttgggttttgtgtaca

SEQ ID NO: 13886 - DNA, 25 bp, Mus musculus
ataatactgttcctatgtgaagtaa

SEQ ID NO: 13887 - DNA, 25 bp, Mus musculus
ctaaccacacaacatctcagtgtgg

SEQ ID NO: 13888 - DNA, 25 bp, Mus musculus
acacaacatctcagtgtggtattca

SEQ ID NO: 13889 - DNA, 25 bp, Mus musculus
cataccatcgtgttatttcaatgtc

SEQ ID NO: 13890 - DNA, 25 bp, Mus musculus
ttatttcaatgtcttcaaatatatg

SEQ ID NO: 13891 - DNA, 25 bp, Mus musculus
tatgtcacatacttgtgtaccaact

SEQ ID NO: 13892 - DNA, 25 bp, Mus musculus
ttgtgtaccaactcttagttgtgcc

SEQ ID NO: 13893 - DNA, 25 bp, Mus musculus
tcttagttgtgccttggacatttgc

SEQ ID NO: 13894 - DNA, 25 bp, Mus musculus
ttgtgccttggacatttgcattgcc

SEQ ID NO: 13895 - DNA, 25 bp, Mus musculus
aggtactgagtgctcctcttcccga

SEQ ID NO: 13896 - DNA, 25 bp, Mus musculus
gtactgagtgctcctcttcccgaca

SEQ ID NO: 13897 - DNA, 25 bp, Mus musculus
caagcttccgaggtctgaggtgaag

SEQ ID NO: 13898 - DNA, 25 bp, Mus musculus
ttccgaggtctgaggtgaagctgct

SEQ ID NO: 13899 - DNA, 25 bp, Mus musculus
gaagctgctgtaggcacatggctgc

SEQ ID NO: 13900 - DNA, 25 bp, Mus musculus
aagctgctgtaggcacatggctgca

SEQ ID NO: 13901 - DNA, 25 bp, Mus musculus
ctgctgtaggcacatggctgcaatg

SEQ ID NO: 13902 - DNA, 25 bp, Mus musculus
ctgtaggcacatggctgcaatggac

SEQ ID NO: 13903 - DNA, 25 bp, Mus musculus
tgtaggcacatggctgcaatggaca

SEQ ID NO: 13904 - DNA, 25 bp, Mus musculus
gtaggcacatggctgcaatggacaa

SEQ ID NO: 13905 - DNA, 25 bp, Mus musculus
taggcacatggctgcaatggacaag

SEQ ID NO: 13906 - DNA, 25 bp, Mus musculus
aggcacatggctgcaatggacaagg

SEQ ID NO: 13907 - DNA, 25 bp, Mus musculus
tactgagtgctcctcttcccgacat

SEQ ID NO: 13908 - DNA, 25 bp, Mus musculus
cccgacatcctcaagcttccgaggt

SEQ ID NO: 13909 - DNA, 25 bp, Mus musculus
ccgacatcctcaagcttccgaggtc

SEQ ID NO: 13910 - DNA, 25 bp, Mus musculus
cgacatcctcaagcttccgaggtct

SEQ ID NO: 13911 - DNA, 25 bp, Mus musculus
gacatcctcaagcttccgaggtctg

SEQ ID NO: 13912 - DNA, 25 bp, Mus musculus
catcctcaagcttccgaggtctgag

SEQ ID NO: 13913 - DNA, 25 bp, Mus musculus
atcctcaagcttccgaggtctgagg

SEQ ID NO: 13914 - DNA, 25 bp, Mus musculus
tcaagcttccgaggtctgaggtgaa

SEQ ID NO: 13915 - DNA, 25 bp, Mus musculus
gtttgttctcgctggtgagtttcat

SEQ ID NO: 13916 - DNA, 25 bp, Mus musculus
tgttctcgctggtgagtttcatact

SEQ ID NO: 13917 - DNA, 25 bp, Mus musculus
cagctgatcaggtggtgttaagacg

SEQ ID NO: 13918 - DNA, 25 bp, Mus musculus
tgttaagacgggctgtcctcgtgtg

SEQ ID NO: 13919 - DNA, 25 bp, Mus musculus
gggctgtcctcgtgtgaagaacttg

SEQ ID NO: 13920 - DNA, 25 bp, Mus musculus
cttgtcaaagttctctgctcctttg

SEQ ID NO: 13921 - DNA, 25 bp, Mus musculus
ctctgctcctttgccacacactttg

SEQ ID NO: 13922 - DNA, 25 bp, Mus musculus
tgctcctttgccacacactttgggc

SEQ ID NO: 13923 - DNA, 25 bp, Mus musculus
tcctttgccacacactttgggcttg

SEQ ID NO: 13924 - DNA, 25 bp, Mus musculus
acacactttgggcttgaatggtggc

SEQ ID NO: 13925 - DNA, 25 bp, Mus musculus
ccagtcgatcctccggaagaaggca

SEQ ID NO: 13926 - DNA, 25 bp, Mus musculus
gatcctccggaagaaggcatgctct

SEQ ID NO: 13927 - DNA, 25 bp, Mus musculus
tctcgctggtgagtttcatactgca

SEQ ID NO: 13928 - DNA, 25 bp, Mus musculus
tgagtttcatactgcactctgtaag

SEQ ID NO: 13929 - DNA, 25 bp, Mus musculus
gtttcatactgcactctgtaagatg

SEQ ID NO: 13930 - DNA, 25 bp, Mus musculus
tactgcactctgtaagatggggtgc

SEQ ID NO: 13931 - DNA, 25 bp, Mus musculus
gacatacgagaacccttcaaaatca

SEQ ID NO: 13932 - DNA, 25 bp, Mus musculus
ttcaaaatcagactggtctatgtta

SEQ ID NO: 13933 - DNA, 25 bp, Mus musculus
atcagactggtctatgttagcaata

SEQ ID NO: 13934 - DNA, 25 bp, Mus musculus
aaccagctgatcaggtggtgttaag

SEQ ID NO: 13935 - DNA, 25 bp, Mus musculus
aacctggtattgcaggctcttcttg

SEQ ID NO: 13936 - DNA, 25 bp, Mus musculus
cagggccgcaagcttcttatcatcg

SEQ ID NO: 13937 - DNA, 25 bp, Mus musculus
atgtccctgcagatggatcctgagt

SEQ ID NO: 13938 - DNA, 25 bp, Mus musculus
aaattcttggccctcatgagagaag

SEQ ID NO: 13939 - DNA, 25 bp, Mus musculus
ttggccctcatgagagaagaaggcg

SEQ ID NO: 13940 - DNA, 25 bp, Mus musculus
gctagtcccctggactttgattgac

SEQ ID NO: 13941 - DNA, 25 bp, Mus musculus
caacggactgtctacaacagtgacc

SEQ ID NO: 13942 - DNA, 25 bp, Mus musculus
tgcagatggcctgggatcgtcactc

SEQ ID NO: 13943 - DNA, 25 bp, Mus musculus
cctcacactcaagacactggactac

SEQ ID NO: 13944 - DNA, 25 bp, Mus musculus
actcaagacactggactacgtgaag

SEQ ID NO: 13945 - DNA, 25 bp, Mus musculus
gacactggactacgtgaagtgtccg

SEQ ID NO: 13946 - DNA, 25 bp, Mus musculus
gatgttctcgtgttcctggactctg

SEQ ID NO: 13947 - DNA, 25 bp, Mus musculus
cttcttatcatcgggaccaccagcc

SEQ ID NO: 13948 - DNA, 25 bp, Mus musculus
atcatcgggaccaccagccgcaaag

SEQ ID NO: 13949 - DNA, 25 bp, Mus musculus
accagccgcaaagatgtcctgcagg

SEQ ID NO: 13950 - DNA, 25 bp, Mus musculus
cccaacattgccacaggagagcagc

SEQ ID NO: 13951 - DNA, 25 bp, Mus musculus
attgccacaggagagcagctgctgg

SEQ ID NO: 13952 - DNA, 25 bp, Mus musculus
gaagctctggagcttttgggcaact

SEQ ID NO: 13953 - DNA, 25 bp, Mus musculus
gataaggaacgcaccacaattgctc

SEQ ID NO: 13954 - DNA, 25 bp, Mus musculus
gaacgcaccacaattgctcagcaag

SEQ ID NO: 13955 - DNA, 25 bp, Mus musculus
acattagcatcatctccacttaccg

SEQ ID NO: 13956 - DNA, 25 bp, Mus musculus
attagcatcatctccacttaccgaa

SEQ ID NO: 13957 - DNA, 25 bp, Mus musculus
tggctctctatctctctcgttgtac

SEQ ID NO: 13958 - DNA, 25 bp, Mus musculus
ggctctctatctctctcgttgtaca

SEQ ID NO: 13959 - DNA, 25 bp, Mus musculus
gctctctatctctctcgttgtacat

SEQ ID NO: 13960 - DNA, 25 bp, Mus musculus
tctctatctctctcgttgtacatct

SEQ ID NO: 13961 - DNA, 25 bp, Mus musculus
ctctatctctctcgttgtacatctc

SEQ ID NO: 13962 - DNA, 25 bp, Mus musculus
tctatctctctcgttgtacatctct

SEQ ID NO: 13963 - DNA, 25 bp, Mus musculus
tatctctctcgttgtacatctctac

SEQ ID NO: 13964 - DNA, 25 bp, Mus musculus
atctctctcgttgtacatctctact

SEQ ID NO: 13965 - DNA, 25 bp, Mus musculus
tctctcgttgtacatctctactgtt

SEQ ID NO: 13966 - DNA, 25 bp, Mus musculus
ctctcgttgtacatctctactgtta

SEQ ID NO: 13967 - DNA, 25 bp, Mus musculus
ttagcatcatctccacttaccgaac

SEQ ID NO: 13968 - DNA, 25 bp, Mus musculus
tctcgttgtacatctctactgttag

SEQ ID NO: 13969 - DNA, 25 bp, Mus musculus
tagcatcatctccacttaccgaaca

SEQ ID NO: 13970 - DNA, 25 bp, Mus musculus
gcatcatctccacttaccgaacatc

SEQ ID NO: 13971 - DNA, 25 bp, Mus musculus
gccacgcgcgacgggagctgatcat

SEQ ID NO: 13972 - DNA, 25 bp, Mus musculus
ccacgcgcgacgggagctgatcatg

SEQ ID NO: 13973 - DNA, 25 bp, Mus musculus
cacgcgcgacgggagctgatcatgg

SEQ ID NO: 13974 - DNA, 25 bp, Mus musculus
atcctagacacgcagatttactgcg

SEQ ID NO: 13975 - DNA, 25 bp, Mus musculus
agacacgcagatttactgcgaccat

SEQ ID NO: 13976 - DNA, 25 bp, Mus musculus
aaattgtcctgatgatctgtggaat

SEQ ID NO: 13977 - DNA, 25 bp, Mus musculus
tttaatgtcccaatgctgggctcaa

SEQ ID NO: 13978 - DNA, 25 bp, Mus musculus
gaagcaaccacaggcagacaaagat

SEQ ID NO: 13979 - DNA, 25 bp, Mus musculus
tttctgccaggaaccacaggtggct

SEQ ID NO: 13980 - DNA, 25 bp, Mus musculus
accacaggtggcttatggctctcct

SEQ ID NO: 13981 - DNA, 25 bp, Mus musculus
tggcctgtctgaaggcctgaattat

SEQ ID NO: 13982 - DNA, 25 bp, Mus musculus
gaattatgcctgtcttgctcacaga

SEQ ID NO: 13983 - DNA, 25 bp, Mus musculus
tgcctgtcttgctcacagagaacat

SEQ ID NO: 13984 - DNA, 25 bp, Mus musculus
tcttgctcacagagaacatggagat

SEQ ID NO: 13985 - DNA, 25 bp, Mus musculus
ataatagtgtctcgtaggaaataca

SEQ ID NO: 13986 - DNA, 25 bp, Mus musculus
tacagcactgagatcaacatcgtgt

SEQ ID NO: 13987 - DNA, 25 bp, Mus musculus
atcaacatcgtgttaagttacttgc

SEQ ID NO: 13988 - DNA, 25 bp, Mus musculus
gtcccaatgctgggctcaagaacct

SEQ ID NO: 13989 - DNA, 25 bp, Mus musculus
atgctgggctcaagaacctgaccaa

SEQ ID NO: 13990 - DNA, 25 bp, Mus musculus
ccataacattcaaaaccaacttcag

SEQ ID NO: 13991 - DNA, 25 bp, Mus musculus
cttaaacaatgtttctcattgtgga

SEQ ID NO: 13992 - DNA, 25 bp, Mus musculus
tgacacgatgccagttgccttgatg

SEQ ID NO: 13993 - DNA, 25 bp, Mus musculus
gatgccagttgccttgatggaaacc

SEQ ID NO: 13994 - DNA, 25 bp, Mus musculus
tatggtcgttccgcaaaaatgtagc

SEQ ID NO: 13995 - DNA, 25 bp, Mus musculus
agacaagaagcaaccacaggcagac

SEQ ID NO: 13996 - DNA, 25 bp, Mus musculus
gccacccggcaggagcgtctgggca

SEQ ID NO: 13997 - DNA, 25 bp, Mus musculus
cacccggcaggagcgtctgggcacc

SEQ ID NO: 13998 - DNA, 25 bp, Mus musculus
gtacaagccctgcttcgtttgccag

SEQ ID NO: 13999 - DNA, 25 bp, Mus musculus
tacaagccctgcttcgtttgccagg

SEQ ID NO: 14000 - DNA, 25 bp, Mus musculus
caagccctgcttcgtttgccaggac

SEQ ID NO: 14001 - DNA, 25 bp, Mus musculus
aagccctgcttcgtttgccaggaca

SEQ ID NO: 14002 - DNA, 25 bp, Mus musculus
ctgcttcgtttgccaggacaagtca

SEQ ID NO: 14003 - DNA, 25 bp, Mus musculus
tgcttcgtttgccaggacaagtcat

SEQ ID NO: 14004 - DNA, 25 bp, Mus musculus
cttcgtttgccaggacaagtcatcg

SEQ ID NO: 14005 - DNA, 25 bp, Mus musculus
cgtttgccaggacaagtcatcgggc

SEQ ID NO: 14006 - DNA, 25 bp, Mus musculus
ttgccaggacaagtcatcgggctac

SEQ ID NO: 14007 - DNA, 25 bp, Mus musculus
tgccaggacaagtcatcgggctacc

SEQ ID NO: 14008 - DNA, 25 bp, Mus musculus
aaatgccatcgagacacagagtacc

SEQ ID NO: 14009 - DNA, 25 bp, Mus musculus
atgccatcgagacacagagtaccag

SEQ ID NO: 14010 - DNA, 25 bp, Mus musculus
tgccatcgagacacagagtaccagc

SEQ ID NO: 14011 - DNA, 25 bp, Mus musculus
acagagtaccagctctgaggagctc

SEQ ID NO: 14012 - DNA, 25 bp, Mus musculus
gagtaccagctctgaggagctcgtc

SEQ ID NO: 14013 - DNA, 25 bp, Mus musculus
taccagctctgaggagctcgtcccg

SEQ ID NO: 14014 - DNA, 25 bp, Mus musculus
ggtgtacaagccctgcttcgtttgc

SEQ ID NO: 14015 - DNA, 25 bp, Mus musculus
gtgtacaagccctgcttcgtttgcc

SEQ ID NO: 14016 - DNA, 25 bp, Mus musculus
ccaggctacaggagcctggctaaaa

SEQ ID NO: 14017 - DNA, 25 bp, Mus musculus
gctacaggagcctggctaaaagggg

SEQ ID NO: 14018 - DNA, 25 bp, Mus musculus
ttaaggcccaattctagagctggcc

SEQ ID NO: 14019 - DNA, 25 bp, Mus musculus
aaggcccaattctagagctggcctc

SEQ ID NO: 14020 - DNA, 25 bp, Mus musculus
ggcccaattctagagctggcctccc

SEQ ID NO: 14021 - DNA, 25 bp, Mus musculus
cccaattctagagctggcctcccag

SEQ ID NO: 14022 - DNA, 25 bp, Mus musculus
tctagagctggcctcccagaaagat

SEQ ID NO: 14023 - DNA, 25 bp, Mus musculus
tagagctggcctcccagaaagatgg

SEQ ID NO: 14024 - DNA, 25 bp, Mus musculus
tggcctcccagaaagatggaggcat

SEQ ID NO: 14025 - DNA, 25 bp, Mus musculus
gcctcccagaaagatggaggcatca

SEQ ID NO: 14026 - DNA, 25 bp, Mus musculus
ggttgctacttcccagcaggcatgg

SEQ ID NO: 14027 - DNA, 25 bp, Mus musculus
ttgctacttcccagcaggcatgggg

SEQ ID NO: 14028 - DNA, 25 bp, Mus musculus
aatgggctggtcccaggatgttcat

SEQ ID NO: 14029 - DNA, 25 bp, Mus musculus
tgggctggtcccaggatgttcatga

SEQ ID NO: 14030 - DNA, 25 bp, Mus musculus
ctggtcccaggatgttcatgaaagg

SEQ ID NO: 14031 - DNA, 25 bp, Mus musculus
ggtcccaggatgttcatgaaaggga

SEQ ID NO: 14032 - DNA, 25 bp, Mus musculus
acacaatacagtgttctgcccactt

SEQ ID NO: 14033 - DNA, 25 bp, Mus musculus
atttacatgtgattggcctgttaag

SEQ ID NO: 14034 - DNA, 25 bp, Mus musculus
atgtgattggcctgttaaggcccaa

SEQ ID NO: 14035 - DNA, 25 bp, Mus musculus
ttggcctgttaaggcccaattctag

SEQ ID NO: 14036 - DNA, 25 bp, Mus musculus
gccaccgcaacatgggcagcctttt

SEQ ID NO: 14037 - DNA, 25 bp, Mus musculus
ccgcaacatgggcagccttttcggg

SEQ ID NO: 14038 - DNA, 25 bp, Mus musculus
atgctgcaggcaccagaaagcatcc

SEQ ID NO: 14039 - DNA, 25 bp, Mus musculus
caccagaaagcatccttgctgagca

SEQ ID NO: 14040 - DNA, 25 bp, Mus musculus
ccagaaagcatccttgctgagcact

SEQ ID NO: 14041 - DNA, 25 bp, Mus musculus
aaagcatccttgctgagcactaccg

SEQ ID NO: 14042 - DNA, 25 bp, Mus musculus
agcatccttgctgagcactaccggg

SEQ ID NO: 14043 - DNA, 25 bp, Mus musculus
tccttgctgagcactaccgggacct

SEQ ID NO: 14044 - DNA, 25 bp, Mus musculus
cttgctgagcactaccgggacctac

SEQ ID NO: 14045 - DNA, 25 bp, Mus musculus
ctgagcactaccgggacctacagag

SEQ ID NO: 14046 - DNA, 25 bp, Mus musculus
gagcactaccgggacctacagagga

SEQ ID NO: 14047 - DNA, 25 bp, Mus musculus
taccgggacctacagaggaagccat

SEQ ID NO: 14048 - DNA, 25 bp, Mus musculus
gcaacatgggcagccttttcgggcg

SEQ ID NO: 14049 - DNA, 25 bp, Mus musculus
ggaagccattctacccagctcttat

SEQ ID NO: 14050 - DNA, 25 bp, Mus musculus
gcgctgttgtgcgggccacgctttc

SEQ ID NO: 14051 - DNA, 25 bp, Mus musculus
ctggccccaagagcggacgtggttg

SEQ ID NO: 14052 - DNA, 25 bp, Mus musculus
ttgctgtgaagccagatggggtaca

SEQ ID NO: 14053 - DNA, 25 bp, Mus musculus
ctgtgatacaacgctttgagaggcg

SEQ ID NO: 14054 - DNA, 25 bp, Mus musculus
ggcttcaagctcgtggggatgaaga

SEQ ID NO: 14055 - DNA, 25 bp, Mus musculus
tcaagctcgtggggatgaagatgct

SEQ ID NO: 14056 - DNA, 25 bp, Mus musculus
agatgctgcaggcaccagaaagcat

SEQ ID NO: 14057 - DNA, 25 bp, Mus musculus
aagattccgaacaattacgacagca

SEQ ID NO: 14058 - DNA, 25 bp, Mus musculus
agattccgaacaattacgacagcat

SEQ ID NO: 14059 - DNA, 25 bp, Mus musculus
gtctatgacatcaccaatgaaaaat

SEQ ID NO: 14060 - DNA, 25 bp, Mus musculus
tctatgacatcaccaatgaaaaatc

SEQ ID NO: 14061 - DNA, 25 bp, Mus musculus
ctatgacatcaccaatgaaaaatcc

SEQ ID NO: 14062 - DNA, 25 bp, Mus musculus
tgacatcaccaatgaaaaatccttt

SEQ ID NO: 14063 - DNA, 25 bp, Mus musculus
acatcaccaatgaaaaatcctttga

SEQ ID NO: 14064 - DNA, 25 bp, Mus musculus
caccaatgaaaaatcctttgacaat

SEQ ID NO: 14065 - DNA, 25 bp, Mus musculus
gattccgaacaattacgacagcata

SEQ ID NO: 14066 - DNA, 25 bp, Mus musculus
attccgaacaattacgacagcatac

SEQ ID NO: 14067 - DNA, 25 bp, Mus musculus
ccgaacaattacgacagcatactat

SEQ ID NO: 14068 - DNA, 25 bp, Mus musculus
caattacgacagcatactatagagg

SEQ ID NO: 14069 - DNA, 25 bp, Mus musculus
aattacgacagcatactatagagga

SEQ ID NO: 14070 - DNA, 25 bp, Mus musculus
attacgacagcatactatagaggag

SEQ ID NO: 14071 - DNA, 25 bp, Mus musculus
aattatgctggtctatgacatcacc

SEQ ID NO: 14072 - DNA, 25 bp, Mus musculus
ggtctatgacatcaccaatgaaaaa

SEQ ID NO: 14073 - DNA, 25 bp, Mus musculus
gctggcaatgcaccttctaaaaaca

SEQ ID NO: 14074 - DNA, 25 bp, Mus musculus
ttccttgcctctcttcttgcatagt

SEQ ID NO: 14075 - DNA, 25 bp, Mus musculus
cctctgagcagcacacacagaagca

SEQ ID NO: 14076 - DNA, 25 bp, Mus musculus
agcagcacacacagaagcattttca

SEQ ID NO: 14077 - DNA, 25 bp, Mus musculus
attttcaggcatgtcaaagaaagga

SEQ ID NO: 14078 - DNA, 25 bp, Mus musculus
gactcactagaactcaccgccaaac

SEQ ID NO: 14079 - DNA, 25 bp, Mus musculus
caacctctgacataggtcctgagat

SEQ ID NO: 14080 - DNA, 25 bp, Mus musculus
ctgacataggtcctgagatgtgggg

SEQ ID NO: 14081 - DNA, 25 bp, Mus musculus
tgtacccaagagatgactgtatgaa

SEQ ID NO: 14082 - DNA, 25 bp, Mus musculus
tactaaatcattttcaggggacaga

SEQ ID NO: 14083 - DNA, 25 bp, Mus musculus
ttgctgcatttccgcatgctgctgg

SEQ ID NO: 14084 - DNA, 25 bp, Mus musculus
gctgattgacccaatcttccacaca

SEQ ID NO: 14085 - DNA, 25 bp, Mus musculus
cttgtaaagcctgagacctgcctca

SEQ ID NO: 14086 - DNA, 25 bp, Mus musculus
gacccaatcttccacacaggcactt

SEQ ID NO: 14087 - DNA, 25 bp, Mus musculus
atgcagttttcgaacccagagtcag

SEQ ID NO: 14088 - DNA, 25 bp, Mus musculus
ttttcgaacccagagtcagcactcg

SEQ ID NO: 14089 - DNA, 25 bp, Mus musculus
gcactcggcctttaacgaatgagaa

SEQ ID NO: 14090 - DNA, 25 bp, Mus musculus
atgcatcttccaagaccatgaagag

SEQ ID NO: 14091 - DNA, 25 bp, Mus musculus
cttccaagaccatgaagagttcctt

SEQ ID NO: 14092 - DNA, 25 bp, Mus musculus
actcacagagccagaacttcttcga

SEQ ID NO: 14093 - DNA, 25 bp, Mus musculus
aggccacctctgagcagcacacaca

SEQ ID NO: 14094 - DNA, 25 bp, Mus musculus
ggttcttgaagccagactgactaga

SEQ ID NO: 14095 - DNA, 25 bp, Mus musculus
tcttgaagccagactgactagagca

SEQ ID NO: 14096 - DNA, 25 bp, Mus musculus
agtcttgcctggcatctcctttaag

SEQ ID NO: 14097 - DNA, 25 bp, Mus musculus
gcctggcatctcctttaagacaaga

SEQ ID NO: 14098 - DNA, 25 bp, Mus musculus
catctcctttaagacaagaaatcct

SEQ ID NO: 14099 - DNA, 25 bp, Mus musculus
cttctcagaagcttctctgtaaggc

SEQ ID NO: 14100 - DNA, 25 bp, Mus musculus
ctcagaagcttctctgtaaggcaaa

SEQ ID NO: 14101 - DNA, 25 bp, Mus musculus
cagactaacctgccctaatatactc

SEQ ID NO: 14102 - DNA, 25 bp, Mus musculus
tgctcctagcctgtgctcctctgtc

SEQ ID NO: 14103 - DNA, 25 bp, Mus musculus
cgtgcacagccttgttctaaccctg

SEQ ID NO: 14104 - DNA, 25 bp, Mus musculus
gcacagccttgttctaaccctggaa

SEQ ID NO: 14105 - DNA, 25 bp, Mus musculus
tctaaccctggaataaaggtgactg

SEQ ID NO: 14106 - DNA, 25 bp, Mus musculus
gactagagcaccctcagttcctagc

SEQ ID NO: 14107 - DNA, 25 bp, Mus musculus
ctcagttcctagctgagcccagatt

SEQ ID NO: 14108 - DNA, 25 bp, Mus musculus
actgctgcagacacctgccttaact

SEQ ID NO: 14109 - DNA, 25 bp, Mus musculus
gcagacacctgccttaactctcaca

SEQ ID NO: 14110 - DNA, 25 bp, Mus musculus
tgccttaactctcacacctcgaaga

SEQ ID NO: 14111 - DNA, 25 bp, Mus musculus
tctcacacctcgaagactccagttt

SEQ ID NO: 14112 - DNA, 25 bp, Mus musculus
ttcctaaatctccctagtcttgcct

SEQ ID NO: 14113 - DNA, 25 bp, Mus musculus
cctagtcttgcctggcatctccttt

SEQ ID NO: 14114 - DNA, 25 bp, Mus musculus
ggaaacaatcgaccaactgcacctg

SEQ ID NO: 14115 - DNA, 25 bp, Mus musculus
gaaacaatcgaccaactgcacctgg

SEQ ID NO: 14116 - DNA, 25 bp, Mus musculus
atcctggccatccagaacagaggtg

SEQ ID NO: 14117 - DNA, 25 bp, Mus musculus
tcctggccatccagaacagaggtgg

SEQ ID NO: 14118 - DNA, 25 bp, Mus musculus
ggccatccagaacagaggtggagaa

SEQ ID NO: 14119 - DNA, 25 bp, Mus musculus
gccatccagaacagaggtggagaag

SEQ ID NO: 14120 - DNA, 25 bp, Mus musculus
cactgtcaccatgtatgagctgcgc

SEQ ID NO: 14121 - DNA, 25 bp, Mus musculus
actgtcaccatgtatgagctgcgca

SEQ ID NO: 14122 - DNA, 25 bp, Mus musculus
ctgtcaccatgtatgagctgcgcaa

SEQ ID NO: 14123 - DNA, 25 bp, Mus musculus
tgtcaccatgtatgagctgcgcaac

SEQ ID NO: 14124 - DNA, 25 bp, Mus musculus
gtcaccatgtatgagctgcgcaaca

SEQ ID NO: 14125 - DNA, 25 bp, Mus musculus
tcaccatgtatgagctgcgcaacaa

SEQ ID NO: 14126 - DNA, 25 bp, Mus musculus
actgcacctggagtttgccaagaga

SEQ ID NO: 14127 - DNA, 25 bp, Mus musculus
caccatgtatgagctgcgcaacaag

SEQ ID NO: 14128 - DNA, 25 bp, Mus musculus
gcccttcaacaactggatggaggga

SEQ ID NO: 14129 - DNA, 25 bp, Mus musculus
gttcaaggccacactgcccgaggcc

SEQ ID NO: 14130 - DNA, 25 bp, Mus musculus
ttcaaggccacactgcccgaggccg

SEQ ID NO: 14131 - DNA, 25 bp, Mus musculus
gtccatcctggccatccagaacaga

SEQ ID NO: 14132 - DNA, 25 bp, Mus musculus
tccatcctggccatccagaacagag

SEQ ID NO: 14133 - DNA, 25 bp, Mus musculus
ccatcctggccatccagaacagagg

SEQ ID NO: 14134 - DNA, 25 bp, Mus musculus
catcctggccatccagaacagaggt

SEQ ID NO: 14135 - DNA, 25 bp, Mus musculus
ctcgcctcaaggcagagacttgacg

SEQ ID NO: 14136 - DNA, 25 bp, Mus musculus
gtgccgtgccactggtacttctgaa

SEQ ID NO: 14137 - DNA, 25 bp, Mus musculus
accatctatttcctgaaattctgac

SEQ ID NO: 14138 - DNA, 25 bp, Mus musculus
tatttcctgaaattctgaccatcca

SEQ ID NO: 14139 - DNA, 25 bp, Mus musculus
ccgatgagcccctggactctgggcc

SEQ ID NO: 14140 - DNA, 25 bp, Mus musculus
agcccctggactctgggcctgcatc

SEQ ID NO: 14141 - DNA, 25 bp, Mus musculus
tggactctgggcctgcatcagactg

SEQ ID NO: 14142 - DNA, 25 bp, Mus musculus
ctgggcctgcatcagactggtgact

SEQ ID NO: 14143 - DNA, 25 bp, Mus musculus
tcccaccaaactgtttctaatattg

SEQ ID NO: 14144 - DNA, 25 bp, Mus musculus
gtttctaatattgtatcccgtggca

SEQ ID NO: 14145 - DNA, 25 bp, Mus musculus
aatattgtatcccgtggcactaagt

SEQ ID NO: 14146 - DNA, 25 bp, Mus musculus
tcccaacggttatctacaaataatg

SEQ ID NO: 14147 - DNA, 25 bp, Mus musculus
tggtacttctgaaactgtgaattag

SEQ ID NO: 14148 - DNA, 25 bp, Mus musculus
tatccatgcaccctggacatgtgtc

SEQ ID NO: 14149 - DNA, 25 bp, Mus musculus
tgcaccctggacatgtgtctttagc

SEQ ID NO: 14150 - DNA, 25 bp, Mus musculus
atgtgtctttagcatcgtctaagga

SEQ ID NO: 14151 - DNA, 25 bp, Mus musculus
ctttagcatcgtctaaggatttatg

SEQ ID NO: 14152 - DNA, 25 bp, Mus musculus
cattcttgtgctctgggcctttggg

SEQ ID NO: 14153 - DNA, 25 bp, Mus musculus
tgtgctctgggcctttgggaggaca

SEQ ID NO: 14154 - DNA, 25 bp, Mus musculus
tcactggataccaccatctatttcc

SEQ ID NO: 14155 - DNA, 25 bp, Mus musculus
gaggcacttctgcaaatctctcttc

SEQ ID NO: 14156 - DNA, 25 bp, Mus musculus
ggtggactacgcctactgtagcatt

SEQ ID NO: 14157 - DNA, 25 bp, Mus musculus
ctgaatccaggtgccactgtgacac

SEQ ID NO: 14158 - DNA, 25 bp, Mus musculus
gaccaaggatcttccaagttgtctg

SEQ ID NO: 14159 - DNA, 25 bp, Mus musculus
tccaagttgtctggggaccaccagt

SEQ ID NO: 14160 - DNA, 25 bp, Mus musculus
tcctggaccagactcccagatgact

SEQ ID NO: 14161 - DNA, 25 bp, Mus musculus
accagactcccagatgactcttgcc

SEQ ID NO: 14162 - DNA, 25 bp, Mus musculus
catgatgctgcctggcctggcctgg

SEQ ID NO: 14163 - DNA, 25 bp, Mus musculus
cacgcctataccagctctgtacagc

SEQ ID NO: 14164 - DNA, 25 bp, Mus musculus
tataccagctctgtacagcaccgcc

SEQ ID NO: 14165 - DNA, 25 bp, Mus musculus
ctatgccctgtgacccaacaaaata

SEQ ID NO: 14166 - DNA, 25 bp, Mus musculus
cctgtgacccaacaaaatacatgtg

SEQ ID NO: 14167 - DNA, 25 bp, Mus musculus
ctacgcctactgtagcattcctacc

SEQ ID NO: 14168 - DNA, 25 bp, Mus musculus
cccaacaaaatacatgtgtattccg

SEQ ID NO: 14169 - DNA, 25 bp, Mus musculus
tagcattcctacctatcccagcggc

SEQ ID NO: 14170 - DNA, 25 bp, Mus musculus
ctatcccagcggccagatcggcttc

SEQ ID NO: 14171 - DNA, 25 bp, Mus musculus
cggcttcatgctgtgtagcaaaaac

SEQ ID NO: 14172 - DNA, 25 bp, Mus musculus
caccaacttccgggagccagtgcag

SEQ ID NO: 14173 - DNA, 25 bp, Mus musculus
cttccgggagccagtgcagcagttg

SEQ ID NO: 14174 - DNA, 25 bp, Mus musculus
ctataactcggacatgcaccgtgcc

SEQ ID NO: 14175 - DNA, 25 bp, Mus musculus
cgtactgcctgagttcacccggaag

SEQ ID NO: 14176 - DNA, 25 bp, Mus musculus
ccttccctgatcacctggcacatga

SEQ ID NO: 14177 - DNA, 25 bp, Mus musculus
tgtctgcacgccaggagctctaagg

SEQ ID NO: 14178 - DNA, 25 bp, Mus musculus
gcagtacctgcattatatcactgac

SEQ ID NO: 14179 - DNA, 25 bp, Mus musculus
gtacctgcattatatcactgacagt

SEQ ID NO: 14180 - DNA, 25 bp, Mus musculus
cctgcattatatcactgacagtgtc

SEQ ID NO: 14181 - DNA, 25 bp, Mus musculus
gcattatatcactgacagtgtcgtt

SEQ ID NO: 14182 - DNA, 25 bp, Mus musculus
ttatatcactgacagtgtcgttgct

SEQ ID NO: 14183 - DNA, 25 bp, Mus musculus
tatcactgacagtgtcgttgctggc

SEQ ID NO: 14184 - DNA, 25 bp, Mus musculus
cactgacagtgtcgttgctggcttc

SEQ ID NO: 14185 - DNA, 25 bp, Mus musculus
tgacagtgtcgttgctggcttccat

SEQ ID NO: 14186 - DNA, 25 bp, Mus musculus
tggcttccatgtgggctactacgga

SEQ ID NO: 14187 - DNA, 25 bp, Mus musculus
gcttccatgtgggctactacggaat

SEQ ID NO: 14188 - DNA, 25 bp, Mus musculus
ctgcacgccaggagctctaaggcac

SEQ ID NO: 14189 - DNA, 25 bp, Mus musculus
cttccatgtgggctactacggaata

SEQ ID NO: 14190 - DNA, 25 bp, Mus musculus
agctctaaggcacgtgctctgctag

SEQ ID NO: 14191 - DNA, 25 bp, Mus musculus
tctaaggcacgtgctctgctagctg

SEQ ID NO: 14192 - DNA, 25 bp, Mus musculus
cgtgctctgctagctggtcgctaag

SEQ ID NO: 14193 - DNA, 25 bp, Mus musculus
gctctgctagctggtcgctaagtct

SEQ ID NO: 14194 - DNA, 25 bp, Mus musculus
ctagctggtcgctaagtctgagtgg

SEQ ID NO: 14195 - DNA, 25 bp, Mus musculus
tggccctgatggtactgggaccaag

SEQ ID NO: 14196 - DNA, 25 bp, Mus musculus
tgtgcagtacctgcattatatcact

SEQ ID NO: 14197 - DNA, 25 bp, Mus musculus
catccagagacctgtcgtcttttgt

SEQ ID NO: 14198 - DNA, 25 bp, Mus musculus
atgttaaactctgccttcagatgtt

SEQ ID NO: 14199 - DNA, 25 bp, Mus musculus
ctgatgatctacccagtaattcttg

SEQ ID NO: 14200 - DNA, 25 bp, Mus musculus
atgatctacccagtaattcttgtat

SEQ ID NO: 14201 - DNA, 25 bp, Mus musculus
atctacccagtaattcttgtataat

SEQ ID NO: 14202 - DNA, 25 bp, Mus musculus
tacccagtaattcttgtataatgct

SEQ ID NO: 14203 - DNA, 25 bp, Mus musculus
atttagaattttctctcaaatgtga

SEQ ID NO: 14204 - DNA, 25 bp, Mus musculus
tagaattttctctcaaatgtgaggg

SEQ ID NO: 14205 - DNA, 25 bp, Mus musculus
aattttctctcaaatgtgagggact

SEQ ID NO: 14206 - DNA, 25 bp, Mus musculus
tttctctcaaatgtgagggactttt

SEQ ID NO: 14207 - DNA, 25 bp, Mus musculus
acatttcaataaacactatggggat

SEQ ID NO: 14208 - DNA, 25 bp, Mus musculus
catttcaataaacactatggggatt

SEQ ID NO: 14209 - DNA, 25 bp, Mus musculus
ttaaactctgccttcagatgttatt

SEQ ID NO: 14210 - DNA, 25 bp, Mus musculus
aactctgccttcagatgttattctt

SEQ ID NO: 14211 - DNA, 25 bp, Mus musculus
ttttaatctctgttatcctaagtgg

SEQ ID NO: 14212 - DNA, 25 bp, Mus musculus
taatctctgttatcctaagtggaca

SEQ ID NO: 14213 - DNA, 25 bp, Mus musculus
ttatcctaagtggacactgcttttc

SEQ ID NO: 14214 - DNA, 25 bp, Mus musculus
tcctaagtggacactgcttttctcc

SEQ ID NO: 14215 - DNA, 25 bp, Mus musculus
taagtggacactgcttttctcctcc

SEQ ID NO: 14216 - DNA, 25 bp, Mus musculus
tgactgatgatctacccagtaattc

SEQ ID NO: 14217 - DNA, 25 bp, Mus musculus
ttgactttctctaaagaagcagctt

SEQ ID NO: 14218 - DNA, 25 bp, Mus musculus
actttctctaaagaagcagctttct

SEQ ID NO: 14219 - DNA, 25 bp, Mus musculus
gagcaattatccattcatgtgatcc

SEQ ID NO: 14220 - DNA, 25 bp, Mus musculus
ttatccattcatgtgatccctggat

SEQ ID NO: 14221 - DNA, 25 bp, Mus musculus
tccattcatgtgatccctggatacc

SEQ ID NO: 14222 - DNA, 25 bp, Mus musculus
gtgatccctggataccagaggccac

SEQ ID NO: 14223 - DNA, 25 bp, Mus musculus
atccctggataccagaggccacttt

SEQ ID NO: 14224 - DNA, 25 bp, Mus musculus
cctggataccagaggccacttttgt

SEQ ID NO: 14225 - DNA, 25 bp, Mus musculus
ttaagggccctgtcaacaagccatc

SEQ ID NO: 14226 - DNA, 25 bp, Mus musculus
gccctgtcaacaagccatccgaagg

SEQ ID NO: 14227 - DNA, 25 bp, Mus musculus
taaaccttccagatggaatgtaagc

SEQ ID NO: 14228 - DNA, 25 bp, Mus musculus
accttccagatggaatgtaagccta

SEQ ID NO: 14229 - DNA, 25 bp, Mus musculus
gaagcagctttctctgtccacagaa

SEQ ID NO: 14230 - DNA, 25 bp, Mus musculus
aagcctatgtgtcctttgaatattt

SEQ ID NO: 14231 - DNA, 25 bp, Mus musculus
ttctctgtccacagaatttagcatc

SEQ ID NO: 14232 - DNA, 25 bp, Mus musculus
tctgtccacagaatttagcatcact

SEQ ID NO: 14233 - DNA, 25 bp, Mus musculus
atttagcatcacttgagatgctctt

SEQ ID NO: 14234 - DNA, 25 bp, Mus musculus
catcacttgagatgctcttctgggg

SEQ ID NO: 14235 - DNA, 25 bp, Mus musculus
cacttgagatgctcttctggggata

SEQ ID NO: 14236 - DNA, 25 bp, Mus musculus
tgctcttctggggataaaaatcaat

SEQ ID NO: 14237 - DNA, 25 bp, Mus musculus
tttcaacaggcctacccatttatca

SEQ ID NO: 14238 - DNA, 25 bp, Mus musculus
ctgtttaccagtccatgtgtcctca

SEQ ID NO: 14239 - DNA, 25 bp, Mus musculus
accagtccatgtgtcctcaatcaat

SEQ ID NO: 14240 - DNA, 25 bp, Mus musculus
gtctaagtaatctccagttcctctg

SEQ ID NO: 14241 - DNA, 25 bp, Mus musculus
gaaatgccggctttgtcttagcaca

SEQ ID NO: 14242 - DNA, 25 bp, Mus musculus
ccggctttgtcttagcacagattca

SEQ ID NO: 14243 - DNA, 25 bp, Mus musculus
ttgtcttagcacagattcagctcat

SEQ ID NO: 14244 - DNA, 25 bp, Mus musculus
agattcagctcatgacagcctatca

SEQ ID NO: 14245 - DNA, 25 bp, Mus musculus
tgacagcctatcatgagccctatta

SEQ ID NO: 14246 - DNA, 25 bp, Mus musculus
cctatcatgagccctattatagacg

SEQ ID NO: 14247 - DNA, 25 bp, Mus musculus
ccacttacacatgccaagaacatgg

SEQ ID NO: 14248 - DNA, 25 bp, Mus musculus
acacatgccaagaacatggcaaacg

SEQ ID NO: 14249 - DNA, 25 bp, Mus musculus
tcctttctgtgtcagagaataaaag

SEQ ID NO: 14250 - DNA, 25 bp, Mus musculus
gtcctcaatcaatatctgcatgacc

SEQ ID NO: 14251 - DNA, 25 bp, Mus musculus
aatcaatatctgcatgaccatgaca

SEQ ID NO: 14252 - DNA, 25 bp, Mus musculus
catgaccatgacatctgagactcac

SEQ ID NO: 14253 - DNA, 25 bp, Mus musculus
atctgagactcacggtgactttgat

SEQ ID NO: 14254 - DNA, 25 bp, Mus musculus
gactcacggtgactttgatggccac

SEQ ID NO: 14255 - DNA, 25 bp, Mus musculus
gccagcctgatattgtgaggctgat

SEQ ID NO: 14256 - DNA, 25 bp, Mus musculus
taatcattcttgtcacaactgacag

SEQ ID NO: 14257 - DNA, 25 bp, Mus musculus
agtgcttgcatttgttgttatgaag

SEQ ID NO: 14258 - DNA, 25 bp, Mus musculus
tccactcagcgtggtcacggctctc

SEQ ID NO: 14259 - DNA, 25 bp, Mus musculus
ctctgccctttctctgggagctgaa

SEQ ID NO: 14260 - DNA, 25 bp, Mus musculus
tgagctccttgcctctgttactgtc

SEQ ID NO: 14261 - DNA, 25 bp, Mus musculus
ccttgcctctgttactgtccctgag

SEQ ID NO: 14262 - DNA, 25 bp, Mus musculus
ctctgttactgtccctgagaagaac

SEQ ID NO: 14263 - DNA, 25 bp, Mus musculus
gagtgctctcatgaatgtgtttgag

SEQ ID NO: 14264 - DNA, 25 bp, Mus musculus
acttctgagcatatccagctttgtt

SEQ ID NO: 14265 - DNA, 25 bp, Mus musculus
gagcatatccagctttgttgtctct

SEQ ID NO: 14266 - DNA, 25 bp, Mus musculus
ctttgttgtctctctggagaagttc

SEQ ID NO: 14267 - DNA, 25 bp, Mus musculus
tgtctctctggagaagttctattgg

SEQ ID NO: 14268 - DNA, 25 bp, Mus musculus
attcttacgggcatacctgagtaga

SEQ ID NO: 14269 - DNA, 25 bp, Mus musculus
cttacgggcatacctgagtagatct

SEQ ID NO: 14270 - DNA, 25 bp, Mus musculus
cctttctctgggagctgaacatcga

SEQ ID NO: 14271 - DNA, 25 bp, Mus musculus
acatcgaacagagtctgtcattcat

SEQ ID NO: 14272 - DNA, 25 bp, Mus musculus
tctctactacgacctgtataccaac

SEQ ID NO: 14273 - DNA, 25 bp, Mus musculus
cctgtataccaaccctgacattcac

SEQ ID NO: 14274 - DNA, 25 bp, Mus musculus
ccctgacattcacagcacctacaat

SEQ ID NO: 14275 - DNA, 25 bp, Mus musculus
cattcacagcacctacaatgagctc

SEQ ID NO: 14276 - DNA, 25 bp, Mus musculus
cagcacctacaatgagctccttgcc

SEQ ID NO: 14277 - DNA, 25 bp, Mus musculus
ctacaatgagctccttgcctctgtt

SEQ ID NO: 14278 - DNA, 25 bp, Mus musculus
tatctgaatgaccacctagagcctt

SEQ ID NO: 14279 - DNA, 25 bp, Mus musculus
cacctagagccttggatccaggaga

SEQ ID NO: 14280 - DNA, 25 bp, Mus musculus
gacggagtcccctgcaattagcttt

SEQ ID NO: 14281 - DNA, 25 bp, Mus musculus
gtcccctgcaattagctttctagga

SEQ ID NO: 14282 - DNA, 25 bp, Mus musculus
tagctttctaggatctaccacactt

SEQ ID NO: 14283 - DNA, 25 bp, Mus musculus
atctaccacacttctgtgaaagcca

SEQ ID NO: 14284 - DNA, 25 bp, Mus musculus
cacacttctgtgaaagccaccttcc

SEQ ID NO: 14285 - DNA, 25 bp, Mus musculus
catctcagttctcttggcctcaaaa

SEQ ID NO: 14286 - DNA, 25 bp, Mus musculus
agttctcttggcctcaaaactcaca

SEQ ID NO: 14287 - DNA, 25 bp, Mus musculus
taaaccagctccttgaggctggcag

SEQ ID NO: 14288 - DNA, 25 bp, Mus musculus
cctgagcctctcgggaatgcttttc

SEQ ID NO: 14289 - DNA, 25 bp, Mus musculus
cctctcgggaatgcttttccagcag

SEQ ID NO: 14290 - DNA, 25 bp, Mus musculus
caggagaacggcggctgggacactt

SEQ ID NO: 14291 - DNA, 25 bp, Mus musculus
gacacttttgtggacgggcatgact

SEQ ID NO: 14292 - DNA, 25 bp, Mus musculus
tttgtggacgggcatgactgtggct

SEQ ID NO: 14293 - DNA, 25 bp, Mus musculus
cttcagtcggaagtgaccagacact

SEQ ID NO: 14294 - DNA, 25 bp, Mus musculus
tctcttcagccaccattgctaccag

SEQ ID NO: 14295 - DNA, 25 bp, Mus musculus
cagccaccattgctaccaggagaac

SEQ ID NO: 14296 - DNA, 25 bp, Mus musculus
ctaccaggagaaccactacatgcaa

SEQ ID NO: 14297 - DNA, 25 bp, Mus musculus
ggagaaccactacatgcaactcacg

SEQ ID NO: 14298 - DNA, 25 bp, Mus musculus
ctgcggttctccagaccagcccatg

SEQ ID NO: 14299 - DNA, 25 bp, Mus musculus
cggttctccagaccagcccatggaa

SEQ ID NO: 14300 - DNA, 25 bp, Mus musculus
caagtatgatccttcagaggccaca

SEQ ID NO: 14301 - DNA, 25 bp, Mus musculus
gtatgatccttcagaggccacagga

SEQ ID NO: 14302 - DNA, 25 bp, Mus musculus
ttcagaggccacaggatcctcaagc

SEQ ID NO: 14303 - DNA, 25 bp, Mus musculus
agaggccacaggatcctcaagctgg

SEQ ID NO: 14304 - DNA, 25 bp, Mus musculus
ggccacaggatcctcaagctgggat

SEQ ID NO: 14305 - DNA, 25 bp, Mus musculus
aggatcctcaagctgggatttccag

SEQ ID NO: 14306 - DNA, 25 bp, Mus musculus
atcctcaagctgggatttccagagc

SEQ ID NO: 14307 - DNA, 25 bp, Mus musculus
ggatttccagagctctttcagaaga

SEQ ID NO: 14308 - DNA, 25 bp, Mus musculus
tttccagagctctttcagaagagag

SEQ ID NO: 14309 - DNA, 25 bp, Mus musculus
gtctaaggccctccaggaagactca

SEQ ID NO: 14310 - DNA, 25 bp, Mus musculus
agaccagcccatggaagaatcatat

SEQ ID NO: 14311 - DNA, 25 bp, Mus musculus
ggccctccaggaagactcacctgga

SEQ ID NO: 14312 - DNA, 25 bp, Mus musculus
ccaacagctaccctgctggactgtc

SEQ ID NO: 14313 - DNA, 25 bp, Mus musculus
accctgctggactgtcatggaagat

SEQ ID NO: 14314 - DNA, 25 bp, Mus musculus
tacgcccagaatgtagcctttttca

SEQ ID NO: 14315 - DNA, 25 bp, Mus musculus
gtagcctttttcagtgaatgtgatg

SEQ ID NO: 14316 - DNA, 25 bp, Mus musculus
gcctttttcagtgaatgtgatgaca

SEQ ID NO: 14317 - DNA, 25 bp, Mus musculus
gacagaagcccacaagtatgatcct

SEQ ID NO: 14318 - DNA, 25 bp, Mus musculus
agcccacaagtatgatccttcagag

SEQ ID NO: 14319 - DNA, 25 bp, Mus musculus
ctctcttctctgtgaacatccctaa

SEQ ID NO: 14320 - DNA, 25 bp, Mus musculus
tctcttctctgtgaacatccctaaa

SEQ ID NO: 14321 - DNA, 25 bp, Mus musculus
ctcttctctgtgaacatccctaaaa

SEQ ID NO: 14322 - DNA, 25 bp, Mus musculus
tctctgtgaacatccctaaaactgc

SEQ ID NO: 14323 - DNA, 25 bp, Mus musculus
ctctgtgaacatccctaaaactgcc

SEQ ID NO: 14324 - DNA, 25 bp, Mus musculus
tctgtgaacatccctaaaactgccc

SEQ ID NO: 14325 - DNA, 25 bp, Mus musculus
ctgtgaacatccctaaaactgccct

SEQ ID NO: 14326 - DNA, 25 bp, Mus musculus
tgtgaacatccctaaaactgccctt

SEQ ID NO: 14327 - DNA, 25 bp, Mus musculus
gtccgccccttgcttgtgtctctct

SEQ ID NO: 14328 - DNA, 25 bp, Mus musculus
ctctcttctctgtgaacatccctaa

SEQ ID NO: 14329 - DNA, 25 bp, Mus musculus
tctcttctctgtgaacatccctaaa

SEQ ID NO: 14330 - DNA, 25 bp, Mus musculus
ctcttctctgtgaacatccctaaaa

SEQ ID NO: 14331 - DNA, 25 bp, Mus musculus
tctctgtgaacatccctaaaactgc

SEQ ID NO: 14332 - DNA, 25 bp, Mus musculus
ctctgtgaacatccctaaaactgcc

SEQ ID NO: 14333 - DNA, 25 bp, Mus musculus
tctgtgaacatccctaaaactgccc

SEQ ID NO: 14334 - DNA, 25 bp, Mus musculus
ctgtgaacatccctaaaactgccct

SEQ ID NO: 14335 - DNA, 25 bp, Mus musculus
tgtgaacatccctaaaactgccctt

SEQ ID NO: 14336 - DNA, 25 bp, Mus musculus
tggatgacctgcactcaatgggagc

SEQ ID NO: 14337 - DNA, 25 bp, Mus musculus
acctgcactcaatgggagcagggga

SEQ ID NO: 14338 - DNA, 25 bp, Mus musculus
ttctaaagttgccagatcttcgatc

SEQ ID NO: 14339 - DNA, 25 bp, Mus musculus
agttgccagatcttcgatctttaaa

SEQ ID NO: 14340 - DNA, 25 bp, Mus musculus
ttcgatctttaaacaacatgcactc

SEQ ID NO: 14341 - DNA, 25 bp, Mus musculus
acaacatgcactctgaggaactctt

SEQ ID NO: 14342 - DNA, 25 bp, Mus musculus
aggtcctgggctgtctctgtagtca

SEQ ID NO: 14343 - DNA, 25 bp, Mus musculus
tgggctgtctctgtagtcagtcacc

SEQ ID NO: 14344 - DNA, 25 bp, Mus musculus
gtctctgtagtcagtcaccagtagc

SEQ ID NO: 14345 - DNA, 25 bp, Mus musculus
agtcaccagtagctgttgggataag

SEQ ID NO: 14346 - DNA, 25 bp, Mus musculus
cctgtagaccaatcagctgtgttgc

SEQ ID NO: 14347 - DNA, 25 bp, Mus musculus
gaccaatcagctgtgttgcacttag

SEQ ID NO: 14348 - DNA, 25 bp, Mus musculus
tcagctctatgtttgagttcagtga

SEQ ID NO: 14349 - DNA, 25 bp, Mus musculus
ccctccagctcagtgatgaggaaat

SEQ ID NO: 14350 - DNA, 25 bp, Mus musculus
tgagcttgttcacagcagttgttct

SEQ ID NO: 14351 - DNA, 25 bp, Mus musculus
actcagtggaggctttgcaggaaac

SEQ ID NO: 14352 - DNA, 25 bp, Mus musculus
tccgtgcactaaggaccttaataat

SEQ ID NO: 14353 - DNA, 25 bp, Mus musculus
tgaaaaaccatccaaatgaggcctc

SEQ ID NO: 14354 - DNA, 25 bp, Mus musculus
accatccaaatgaggcctccatttt

SEQ ID NO: 14355 - DNA, 25 bp, Mus musculus
aattacttctaaagttgccagatct

SEQ ID NO: 14356 - DNA, 25 bp, Mus musculus
ttaaactcatctataatgagtactg

SEQ ID NO: 14357 - DNA, 25 bp, Mus musculus
atgagtactgtgggcctggagccaa

SEQ ID NO: 14358 - DNA, 25 bp, Mus musculus
tcgagtcctgctctcggccaccgtt

SEQ ID NO: 14359 - DNA, 25 bp, Mus musculus
agtcctgctctcggccaccgtttgc

SEQ ID NO: 14360 - DNA, 25 bp, Mus musculus
ctcggccaccgtttgcacaagacac

SEQ ID NO: 14361 - DNA, 25 bp, Mus musculus
ggccaccgtttgcacaagacaccca

SEQ ID NO: 14362 - DNA, 25 bp, Mus musculus
caccgtttgcacaagacacccagca

SEQ ID NO: 14363 - DNA, 25 bp, Mus musculus
ttgcacaagacacccagcactgagc

SEQ ID NO: 14364 - DNA, 25 bp, Mus musculus
cacaagacacccagcactgagcatc

SEQ ID NO: 14365 - DNA, 25 bp, Mus musculus
agcactgagcatcctgctgccgcat

SEQ ID NO: 14366 - DNA, 25 bp, Mus musculus
actgagcatcctgctgccgcatgaa

SEQ ID NO: 14367 - DNA, 25 bp, Mus musculus
catcctgctgccgcatgaacaggga

SEQ ID NO: 14368 - DNA, 25 bp, Mus musculus
agtactgtgggcctggagccaagcc

SEQ ID NO: 14369 - DNA, 25 bp, Mus musculus
ggcctggagccaagcccctcttcag

SEQ ID NO: 14370 - DNA, 25 bp, Mus musculus
agcccctcttcaggagcaaggaaga

SEQ ID NO: 14371 - DNA, 25 bp, Mus musculus
ccctcttcaggagcaaggaagatcc

SEQ ID NO: 14372 - DNA, 25 bp, Mus musculus
aagatcccagtgtctgagtgaacct

SEQ ID NO: 14373 - DNA, 25 bp, Mus musculus
atcccagtgtctgagtgaacctcga

SEQ ID NO: 14374 - DNA, 25 bp, Mus musculus
gagtgaacctcgagtcctgctctcg

SEQ ID NO: 14375 - DNA, 25 bp, Mus musculus
tgaacctcgagtcctgctctcggcc

SEQ ID NO: 14376 - DNA, 25 bp, Mus musculus
cttgttctcgtcgtccacagatcca

SEQ ID NO: 14377 - DNA, 25 bp, Mus musculus
tgttctcgtcgtccacagatccaaa

SEQ ID NO: 14378 - DNA, 25 bp, Mus musculus
agcgtttctgcctgcttgaacttcc

SEQ ID NO: 14379 - DNA, 25 bp, Mus musculus
tctgcctgcttgaacttcccttgtt

SEQ ID NO: 14380 - DNA, 25 bp, Mus musculus
tgcctgcttgaacttcccttgtttc

SEQ ID NO: 14381 - DNA, 25 bp, Mus musculus
cctgcttgaacttcccttgtttcag

SEQ ID NO: 14382 - DNA, 25 bp, Mus musculus
tgcttgaacttcccttgtttcagat

SEQ ID NO: 14383 - DNA, 25 bp, Mus musculus
cttcccttgtttcagataacaggag

SEQ ID NO: 14384 - DNA, 25 bp, Mus musculus
tcccttgtttcagataacaggaggc

SEQ ID NO: 14385 - DNA, 25 bp, Mus musculus
gttgttcttggtcttggccacgttg

SEQ ID NO: 14386 - DNA, 25 bp, Mus musculus
tgttcttggtcttggccacgttggg

SEQ ID NO: 14387 - DNA, 25 bp, Mus musculus
cttggtcttggccacgttgggatcg

SEQ ID NO: 14388 - DNA, 25 bp, Mus musculus
ttctcgtcgtccacagatccaaact

SEQ ID NO: 14389 - DNA, 25 bp, Mus musculus
acagatccaaactcccgctcgtgtg

SEQ ID NO: 14390 - DNA, 25 bp, Mus musculus
gtgagaatctccttgtacagcgttt

SEQ ID NO: 14391 - DNA, 25 bp, Mus musculus
gaatctccttgtacagcgtttctgc

SEQ ID NO: 14392 - DNA, 25 bp, Mus musculus
ctccttgtacagcgtttctgcctgc

SEQ ID NO: 14393 - DNA, 25 bp, Mus musculus
ccttgtacagcgtttctgcctgctt

SEQ ID NO: 14394 - DNA, 25 bp, Mus musculus
gtacagcgtttctgcctgcttgaac

SEQ ID NO: 14395 - DNA, 25 bp, Mus musculus
acagcgtttctgcctgcttgaactt

SEQ ID NO: 14396 - DNA, 25 bp, Mus musculus
agcatctgtgcacccactcttcagc

SEQ ID NO: 14397 - DNA, 25 bp, Mus musculus
tgccaccttggtctgacttggccat

SEQ ID NO: 14398 - DNA, 25 bp, Mus musculus
gctagaaccatggtatcccatggga

SEQ ID NO: 14399 - DNA, 25 bp, Mus musculus
agaaccatggtatcccatgggaagc

SEQ ID NO: 14400 - DNA, 25 bp, Mus musculus
accatggtatcccatgggaagcaga

SEQ ID NO: 14401 - DNA, 25 bp, Mus musculus
atggtatcccatgggaagcagacag

SEQ ID NO: 14402 - DNA, 25 bp, Mus musculus
gtatcccatgggaagcagacagcag

SEQ ID NO: 14403 - DNA, 25 bp, Mus musculus
ccacctatagacaaagcagaacgag

SEQ ID NO: 14404 - DNA, 25 bp, Mus musculus
ttctccctctagcacaagggaacat

SEQ ID NO: 14405 - DNA, 25 bp, Mus musculus
tccctctagcacaagggaacatttc

SEQ ID NO: 14406 - DNA, 25 bp, Mus musculus
aatctacttttgtatcagtgtgaat

SEQ ID NO: 14407 - DNA, 25 bp, Mus musculus
ctacttttgtatcagtgtgaataaa

SEQ ID NO: 14408 - DNA, 25 bp, Mus musculus
caccttggtctgacttggccatggg

SEQ ID NO: 14409 - DNA, 25 bp, Mus musculus
cttggtctgacttggccatgggagc

SEQ ID NO: 14410 - DNA, 25 bp, Mus musculus
ggtctgacttggccatgggagcctt

SEQ ID NO: 14411 - DNA, 25 bp, Mus musculus
ctgacttggccatgggagcctttcc

SEQ ID NO: 14412 - DNA, 25 bp, Mus musculus
tcgccctgctttatccatgctagaa

SEQ ID NO: 14413 - DNA, 25 bp, Mus musculus
ccctgctttatccatgctagaacca

SEQ ID NO: 14414 - DNA, 25 bp, Mus musculus
tgctttatccatgctagaaccatgg

SEQ ID NO: 14415 - DNA, 25 bp, Mus musculus
tttatccatgctagaaccatggtat

SEQ ID NO: 14416 - DNA, 25 bp, Mus musculus
ctccagaaagcacattttctctcct

SEQ ID NO: 14417 - DNA, 25 bp, Mus musculus
aaagcacattttctctcctttcttg

SEQ ID NO: 14418 - DNA, 25 bp, Mus musculus
gcgttcttaggccgatagagctgag

SEQ ID NO: 14419 - DNA, 25 bp, Mus musculus
ttcttaggccgatagagctgagaca

SEQ ID NO: 14420 - DNA, 25 bp, Mus musculus
ccacagtccctgattgtccctggaa

SEQ ID NO: 14421 - DNA, 25 bp, Mus musculus
tctggtccgtttggctcacgccgca

SEQ ID NO: 14422 - DNA, 25 bp, Mus musculus
ccgtttggctcacgccgcagcagtg

SEQ ID NO: 14423 - DNA, 25 bp, Mus musculus
tcacgccgcagcagtgccattggca

SEQ ID NO: 14424 - DNA, 25 bp, Mus musculus
cgcagcagtgccattggcatcgaga

SEQ ID NO: 14425 - DNA, 25 bp, Mus musculus
agcagtgccattggcatcgagaaca

SEQ ID NO: 14426 - DNA, 25 bp, Mus musculus
agtgccattggcatcgagaacatcc

SEQ ID NO: 14427 - DNA, 25 bp, Mus musculus
atcgagaacatccaggaggttcagg

SEQ ID NO: 14428 - DNA, 25 bp, Mus musculus
gcacattttctctcctttcttgctc

SEQ ID NO: 14429 - DNA, 25 bp, Mus musculus
tttctctcctttcttgctcataacc

SEQ ID NO: 14430 - DNA, 25 bp, Mus musculus
ctctcctttcttgctcataacctgt

SEQ ID NO: 14431 - DNA, 25 bp, Mus musculus
tcctttcttgctcataacctgttgg

SEQ ID NO: 14432 - DNA, 25 bp, Mus musculus
gctcataacctgttggcttctgggc

SEQ ID NO: 14433 - DNA, 25 bp, Mus musculus
cataacctgttggcttctgggcgcg

SEQ ID NO: 14434 - DNA, 25 bp, Mus musculus
gggccactggcgttcttaggccgat

SEQ ID NO: 14435 - DNA, 25 bp, Mus musculus
ctggcgttcttaggccgatagagct

SEQ ID NO: 14436 - DNA, 25 bp, Mus musculus
tcgtgcttgtgctcggagctatgcc

SEQ ID NO: 14437 - DNA, 25 bp, Mus musculus
tgcttgtgctcggagctatgccgtc

SEQ ID NO: 14438 - DNA, 25 bp, Mus musculus
ggacgtcccctggagatgatcgagc

SEQ ID NO: 14439 - DNA, 25 bp, Mus musculus
ccgcgcacgctgcagtacaagttac

SEQ ID NO: 14440 - DNA, 25 bp, Mus musculus
gagcctgttttgcttctgggcaagg

SEQ ID NO: 14441 - DNA, 25 bp, Mus musculus
cctgttttgcttctgggcaaggagc

SEQ ID NO: 14442 - DNA, 25 bp, Mus musculus
gttttgcttctgggcaaggagcgat

SEQ ID NO: 14443 - DNA, 25 bp, Mus musculus
ttgcttctgggcaaggagcgatttg

SEQ ID NO: 14444 - DNA, 25 bp, Mus musculus
cttctgggcaaggagcgatttgctg

SEQ ID NO: 14445 - DNA, 25 bp, Mus musculus
gagcgatttgctggtgtggatattc

SEQ ID NO: 14446 - DNA, 25 bp, Mus musculus
cgatttgctggtgtggatattcggg

SEQ ID NO: 14447 - DNA, 25 bp, Mus musculus
gatattcgggtccgtgtgaagggtg

SEQ ID NO: 14448 - DNA, 25 bp, Mus musculus
ttgtgctcggagctatgccgtccaa

SEQ ID NO: 14449 - DNA, 25 bp, Mus musculus
gagctatgccgtccaagggtccgct

SEQ ID NO: 14450 - DNA, 25 bp, Mus musculus
cgtccaagggtccgctgcagtccgt

SEQ ID NO: 14451 - DNA, 25 bp, Mus musculus
tgcagtccgtgcaggtcttcggacg

SEQ ID NO: 14452 - DNA, 25 bp, Mus musculus
agtccgtgcaggtcttcggacgcaa

SEQ ID NO: 14453 - DNA, 25 bp, Mus musculus
tggccccactgcaaacggggaaatg

SEQ ID NO: 14454 - DNA, 25 bp, Mus musculus
cactgcaaacggggaaatgggctca

SEQ ID NO: 14455 - DNA, 25 bp, Mus musculus
aacggacgtcccctggagatgatcg

SEQ ID NO: 14456 - DNA, 25 bp, Mus musculus
tcccttttccggtcgcggcgctgcg

SEQ ID NO: 14457 - DNA, 25 bp, Mus musculus
gcgcgatcgtggagctcgtgcttgt

SEQ ID NO: 14458 - DNA, 25 bp, Mus musculus
gatcgtggagctcgtgcttgtgctc

SEQ ID NO: 14459 - DNA, 25 bp, Mus musculus
tggccccactgcaaacggggaaatg

SEQ ID NO: 14460 - DNA, 25 bp, Mus musculus
gcctgttttgcttctgggcaaggag

SEQ ID NO: 14461 - DNA, 25 bp, Mus musculus
tcccttttccggtcgcggcgctgcg

SEQ ID NO: 14462 - DNA, 25 bp, Mus musculus
gcgcgatcgtggagctcgtgcttgt

SEQ ID NO: 14463 - DNA, 25 bp, Mus musculus
gatcgtggagctcgtgcttgtgctc

SEQ ID NO: 14464 - DNA, 25 bp, Mus musculus
tggccccactgcaaacggggaaatg

SEQ ID NO: 14465 - DNA, 25 bp, Mus musculus
gcctgttttgcttctgggcaaggag

SEQ ID NO: 14466 - DNA, 25 bp, Mus musculus
tggatattcgggtccgtgtgaaggg

SEQ ID NO: 14467 - DNA, 25 bp, Mus musculus
gatattcgggtccgtgtgaagggtg

SEQ ID NO: 14468 - DNA, 25 bp, Mus musculus
aactggaagatcccacagaggtgac

SEQ ID NO: 14469 - DNA, 25 bp, Mus musculus
aagatcccacagaggtgacttcagg

SEQ ID NO: 14470 - DNA, 25 bp, Mus musculus
tctgtctgccgtggacacagtccga

SEQ ID NO: 14471 - DNA, 25 bp, Mus musculus
ttttaggtcttgctattgagaaaat

SEQ ID NO: 14472 - DNA, 25 bp, Mus musculus
tggcctttactatctaagccttcaa

SEQ ID NO: 14473 - DNA, 25 bp, Mus musculus
ttactatctaagccttcaaacaact

SEQ ID NO: 14474 - DNA, 25 bp, Mus musculus
tactttgcttctctagaaggcattg

SEQ ID NO: 14475 - DNA, 25 bp, Mus musculus
gcttctctagaaggcattgagcctt

SEQ ID NO: 14476 - DNA, 25 bp, Mus musculus
ggcattgagccttctactggagaga

SEQ ID NO: 14477 - DNA, 25 bp, Mus musculus
gagccttctactggagagagaacca

SEQ ID NO: 14478 - DNA, 25 bp, Mus musculus
aactgacctgcctgataagtctaga

SEQ ID NO: 14479 - DNA, 25 bp, Mus musculus
cctgcctgataagtctagaggagcc

SEQ ID NO: 14480 - DNA, 25 bp, Mus musculus
ctcccagtagcaagatcctaaaaga

SEQ ID NO: 14481 - DNA, 25 bp, Mus musculus
ggagccagtccccagtacagtctag

SEQ ID NO: 14482 - DNA, 25 bp, Mus musculus
ccatgtttgtctcttcttctgacca

SEQ ID NO: 14483 - DNA, 25 bp, Mus musculus
ttgtctcttcttctgaccacccaga

SEQ ID NO: 14484 - DNA, 25 bp, Mus musculus
gagctctggccagcaataccagctt

SEQ ID NO: 14485 - DNA, 25 bp, Mus musculus
tggccagcaataccagcttcttctc

SEQ ID NO: 14486 - DNA, 25 bp, Mus musculus
gctctcctatccaagaagagtccca

SEQ ID NO: 14487 - DNA, 25 bp, Mus musculus
ctatccaagaagagtcccactgagt

SEQ ID NO: 14488 - DNA, 25 bp, Mus musculus
tttagggccattgtctcttctgtct

SEQ ID NO: 14489 - DNA, 25 bp, Mus musculus
cctacctctcaggtgacgtgctagt

SEQ ID NO: 14490 - DNA, 25 bp, Mus musculus
acatgtatttccgtgaccgcagcgg

SEQ ID NO: 14491 - DNA, 25 bp, Mus musculus
ccacaggcaccttcaagatccagaa

SEQ ID NO: 14492 - DNA, 25 bp, Mus musculus
tcaagatccagaagacccggctgca

SEQ ID NO: 14493 - DNA, 25 bp, Mus musculus
agacccggctgcagcgtgaaggctt

SEQ ID NO: 14494 - DNA, 25 bp, Mus musculus
cagacaggctcttctttctagacct

SEQ ID NO: 14495 - DNA, 25 bp, Mus musculus
ggctcttctttctagacctgaagca

SEQ ID NO: 14496 - DNA, 25 bp, Mus musculus
agggacgctatgtacccctggatga

SEQ ID NO: 14497 - DNA, 25 bp, Mus musculus
gctatgtacccctggatgagagagt

SEQ ID NO: 14498 - DNA, 25 bp, Mus musculus
agagagtccatgcccgcatttgtgc

SEQ ID NO: 14499 - DNA, 25 bp, Mus musculus
tccatgcccgcatttgtgcaggcga

SEQ ID NO: 14500 - DNA, 25 bp, Mus musculus
cccgcatttgtgcaggcgacttctc

SEQ ID NO: 14501 - DNA, 25 bp, Mus musculus
aagccgtgctgagccgcctactggg

SEQ ID NO: 14502 - DNA, 25 bp, Mus musculus
ttgtgcaggcgacttctcactctga

SEQ ID NO: 14503 - DNA, 25 bp, Mus musculus
tggcagccatcgcagatccccacag

SEQ ID NO: 14504 - DNA, 25 bp, Mus musculus
tggaccctaactcaatgtaccagga

SEQ ID NO: 14505 - DNA, 25 bp, Mus musculus
agaaggttcttgcatcctatgctcg

SEQ ID NO: 14506 - DNA, 25 bp, Mus musculus
ttcttgcatcctatgctcggcccat

SEQ ID NO: 14507 - DNA, 25 bp, Mus musculus
tgcgtcttctgccccaggtggatac

SEQ ID NO: 14508 - DNA, 25 bp, Mus musculus
ttctgccccaggtggataccacagg

SEQ ID NO: 14509 - DNA, 25 bp, Mus musculus
tggataccacaggcaccttcaagat

SEQ ID NO: 14510 - DNA, 25 bp, Mus musculus
ccatcaatgcccatccttctaactg

SEQ ID NO: 14511 - DNA, 25 bp, Mus musculus
atgcccatccttctaactgcatctg

SEQ ID NO: 14512 - DNA, 25 bp, Mus musculus
gactagattggcctgtgaggaccct

SEQ ID NO: 14513 - DNA, 25 bp, Mus musculus
ctgtgaggaccctcagttttagcca

SEQ ID NO: 14514 - DNA, 25 bp, Mus musculus
tgaggaccctcagttttagccacga

SEQ ID NO: 14515 - DNA, 25 bp, Mus musculus
tcagttttagccacgatgggaaaat

SEQ ID NO: 14516 - DNA, 25 bp, Mus musculus
gttttagccacgatgggaaaatgct

SEQ ID NO: 14517 - DNA, 25 bp, Mus musculus
aaatgctggcatcggcttcggagga

SEQ ID NO: 14518 - DNA, 25 bp, Mus musculus
tgctggcatcggcttcggaggacca

SEQ ID NO: 14519 - DNA, 25 bp, Mus musculus
tggcatcggcttcggaggaccattt

SEQ ID NO: 14520 - DNA, 25 bp, Mus musculus
cttcggaggaccatttcattgatat

SEQ ID NO: 14521 - DNA, 25 bp, Mus musculus
agtgtgagtccccgactttcactgt

SEQ ID NO: 14522 - DNA, 25 bp, Mus musculus
ctaactgcatctgtatcaagtttga

SEQ ID NO: 14523 - DNA, 25 bp, Mus musculus
agtccccgactttcactgtggcttg

SEQ ID NO: 14524 - DNA, 25 bp, Mus musculus
ggaaatactttgccacaggaagtgc

SEQ ID NO: 14525 - DNA, 25 bp, Mus musculus
gtgcagatgccttggtcagcctttg

SEQ ID NO: 14526 - DNA, 25 bp, Mus musculus
cagatgccttggtcagcctttggga

SEQ ID NO: 14527 - DNA, 25 bp, Mus musculus
atgccttggtcagcctttgggacgt

SEQ ID NO: 14528 - DNA, 25 bp, Mus musculus
tcagcctttgggacgttgacgagtt

SEQ ID NO: 14529 - DNA, 25 bp, Mus musculus
ggtgcttttccagactagattggcc

SEQ ID NO: 14530 - DNA, 25 bp, Mus musculus
ccagactagattggcctgtgaggac

SEQ ID NO: 14531 - DNA, 25 bp, Mus musculus
acttgaaagacccagcaagaacagc

SEQ ID NO: 14532 - DNA, 25 bp, Mus musculus
aagacccagcaagaacagctgaagc

SEQ ID NO: 14533 - DNA, 25 bp, Mus musculus
cagttgtggtacccgacgttgagag

SEQ ID NO: 14534 - DNA, 25 bp, Mus musculus
tacaagggtccttcgaagaactgtg

SEQ ID NO: 14535 - DNA, 25 bp, Mus musculus
atatcaataaagctatcctggacga

SEQ ID NO: 14536 - DNA, 25 bp, Mus musculus
ctatcctggacgacttgttgaaact

SEQ ID NO: 14537 - DNA, 25 bp, Mus musculus
gcattgctgtgcacccggaattatt

SEQ ID NO: 14538 - DNA, 25 bp, Mus musculus
tttctattgacaacggccttctgac

SEQ ID NO: 14539 - DNA, 25 bp, Mus musculus
ttgacaacggccttctgactccaac

SEQ ID NO: 14540 - DNA, 25 bp, Mus musculus
acggccttctgactccaacactgaa

SEQ ID NO: 14541 - DNA, 25 bp, Mus musculus
actatttcaggtcgcagatagatga

SEQ ID NO: 14542 - DNA, 25 bp, Mus musculus
aactgtacgccaccatcaagatcta

SEQ ID NO: 14543 - DNA, 25 bp, Mus musculus
atggctggttacacacgggggacat

SEQ ID NO: 14544 - DNA, 25 bp, Mus musculus
actgtacgccaccatcaagatctaa

SEQ ID NO: 14545 - DNA, 25 bp, Mus musculus
tgccaaatggcaccttgaagattat

SEQ ID NO: 14546 - DNA, 25 bp, Mus musculus
ttgaaaatatctacctgcggagtga

SEQ ID NO: 14547 - DNA, 25 bp, Mus musculus
atatctacctgcggagtgaagccgt

SEQ ID NO: 14548 - DNA, 25 bp, Mus musculus
acctgcggagtgaagccgtggccca

SEQ ID NO: 14549 - DNA, 25 bp, Mus musculus
tggcccaggtgtttgtccacggaga

SEQ ID NO: 14550 - DNA, 25 bp, Mus musculus
aaagcttgcaggcctttctcatagc

SEQ ID NO: 14551 - DNA, 25 bp, Mus musculus
tgcaggcctttctcatagcagttgt

SEQ ID NO: 14552 - DNA, 25 bp, Mus musculus
tttgccaacaatgagcttttcgtct

SEQ ID NO: 14553 - DNA, 25 bp, Mus musculus
aatgagcttttcgtctctggcccca

SEQ ID NO: 14554 - DNA, 25 bp, Mus musculus
ggcttctttgatcagttcataggca

SEQ ID NO: 14555 - DNA, 25 bp, Mus musculus
cagttcataggcacagccgccctta

SEQ ID NO: 14556 - DNA, 25 bp, Mus musculus
ttcataggcacagccgcccttattg

SEQ ID NO: 14557 - DNA, 25 bp, Mus musculus
tgtgtactggccatcgttgaccctt

SEQ ID NO: 14558 - DNA, 25 bp, Mus musculus
gtggtcctggtcattggaacctcca

SEQ ID NO: 14559 - DNA, 25 bp, Mus musculus
ctggtcattggaacctccatgggct

SEQ ID NO: 14560 - DNA, 25 bp, Mus musculus
acctccatgggcttcaattctggct

SEQ ID NO: 14561 - DNA, 25 bp, Mus musculus
tccatgggcttcaattctggctatg

SEQ ID NO: 14562 - DNA, 25 bp, Mus musculus
ttcaattctggctatgcgtcaaccc

SEQ ID NO: 14563 - DNA, 25 bp, Mus musculus
aattctggctatgcgtcaaccctgc

SEQ ID NO: 14564 - DNA, 25 bp, Mus musculus
tctggccccaacggcacagctggaa

SEQ ID NO: 14565 - DNA, 25 bp, Mus musculus
ctgcccgtgactttggacctcgcct

SEQ ID NO: 14566 - DNA, 25 bp, Mus musculus
cccaacggcacagctggaatctttg

SEQ ID NO: 14567 - DNA, 25 bp, Mus musculus
gctggaatctttgccacctatccct

SEQ ID NO: 14568 - DNA, 25 bp, Mus musculus
ggaatctttgccacctatccctctg

SEQ ID NO: 14569 - DNA, 25 bp, Mus musculus
acctatccctctggacacttggaca

SEQ ID NO: 14570 - DNA, 25 bp, Mus musculus
tatccctctggacacttggacatgg

SEQ ID NO: 14571 - DNA, 25 bp, Mus musculus
tctggacacttggacatggtcaatg

SEQ ID NO: 14572 - DNA, 25 bp, Mus musculus
cacttggacatggtcaatggcttct

SEQ ID NO: 14573 - DNA, 25 bp, Mus musculus
tgcccgcgtatcacgggtactagac

SEQ ID NO: 14574 - DNA, 25 bp, Mus musculus
accccacagcctcttagtagagaca

SEQ ID NO: 14575 - DNA, 25 bp, Mus musculus
ccagctgtacttctatgcccatctg

SEQ ID NO: 14576 - DNA, 25 bp, Mus musculus
gctgtacttctatgcccatctgggt

SEQ ID NO: 14577 - DNA, 25 bp, Mus musculus
ctatgcccatctgggtaccaactgg

SEQ ID NO: 14578 - DNA, 25 bp, Mus musculus
tctgggtaccaactgggtgagcctg

SEQ ID NO: 14579 - DNA, 25 bp, Mus musculus
gagcctgtgcagggtttggccttca

SEQ ID NO: 14580 - DNA, 25 bp, Mus musculus
cctgtgcagggtttggccttcacca

SEQ ID NO: 14581 - DNA, 25 bp, Mus musculus
ttggccttcaccaaccgtcgactgt

SEQ ID NO: 14582 - DNA, 25 bp, Mus musculus
accactgtcctacgtgccttctcta

SEQ ID NO: 14583 - DNA, 25 bp, Mus musculus
actgtcctacgtgccttctctaagc

SEQ ID NO: 14584 - DNA, 25 bp, Mus musculus
gtcctacgtgccttctctaagccac

SEQ ID NO: 14585 - DNA, 25 bp, Mus musculus
tcgccgcctcatggaaggcttggag

SEQ ID NO: 14586 - DNA, 25 bp, Mus musculus
ccgcctcatggaaggcttggaggcc

SEQ ID NO: 14587 - DNA, 25 bp, Mus musculus
cctcatggaaggcttggaggccttt

SEQ ID NO: 14588 - DNA, 25 bp, Mus musculus
cttggaggcctttgccagagcccgg

SEQ ID NO: 14589 - DNA, 25 bp, Mus musculus
caccactcatgaccagctgtacttc

SEQ ID NO: 14590 - DNA, 25 bp, Mus musculus
cactcatgaccagctgtacttctat

SEQ ID NO: 14591 - DNA, 25 bp, Mus musculus
tcatgaccagctgtacttctatgcc

SEQ ID NO: 14592 - DNA, 25 bp, Mus musculus
tgaccagctgtacttctatgcccat

SEQ ID NO: 14593 - DNA, 25 bp, Mus musculus
gccctgacaggtcacataacagttt

SEQ ID NO: 14594 - DNA, 25 bp, Mus musculus
cacataacagtttgcatcgaccacg

SEQ ID NO: 14595 - DNA, 25 bp, Mus musculus
gatgtcctcagcactgtcctgcaca

SEQ ID NO: 14596 - DNA, 25 bp, Mus musculus
gtcctcagcactgtcctgcacaggt

SEQ ID NO: 14597 - DNA, 25 bp, Mus musculus
actgtcctgcacaggtggacccttg

SEQ ID NO: 14598 - DNA, 25 bp, Mus musculus
gtcctgcacaggtggacccttgtcc

SEQ ID NO: 14599 - DNA, 25 bp, Mus musculus
cttgtcccaaggagaccatgctggg

SEQ ID NO: 14600 - DNA, 25 bp, Mus musculus
gtcccaaggagaccatgctggggtg

SEQ ID NO: 14601 - DNA, 25 bp, Mus musculus
tcttcaggccaggtgcttttctgtc

SEQ ID NO: 14602 - DNA, 25 bp, Mus musculus
tcaggccaggtgcttttctgtcaat

SEQ ID NO: 14603 - DNA, 25 bp, Mus musculus
atctacatcttctacttgagcctcc

SEQ ID NO: 14604 - DNA, 25 bp, Mus musculus
atcttctacttgagcctccatactt

SEQ ID NO: 14605 - DNA, 25 bp, Mus musculus
acagtttgcatcgaccacgcagcgc

SEQ ID NO: 14606 - DNA, 25 bp, Mus musculus
tcttctacttgagcctccatactta

SEQ ID NO: 14607 - DNA, 25 bp, Mus musculus
catagagaccgtgtggttttgttcg

SEQ ID NO: 14608 - DNA, 25 bp, Mus musculus
tccttcccttgcccatttataggca

SEQ ID NO: 14609 - DNA, 25 bp, Mus musculus
ttcccttgcccatttataggcacag

SEQ ID NO: 14610 - DNA, 25 bp, Mus musculus
acagatacactgtctgacaccgctc

SEQ ID NO: 14611 - DNA, 25 bp, Mus musculus
atgaactaactggtgtgtgagagaa

SEQ ID NO: 14612 - DNA, 25 bp, Mus musculus
aactaactggtgtgtgagagaagaa

SEQ ID NO: 14613 - DNA, 25 bp, Mus musculus
agtgatgtcctcagcactgtcctgc

SEQ ID NO: 14614 - DNA, 25 bp, Mus musculus
actgcaggccactactgaatccagc

SEQ ID NO: 14615 - DNA, 25 bp, Mus musculus
ggccactactgaatccagctcatgt

SEQ ID NO: 14616 - DNA, 25 bp, Mus musculus
atagttgattctcgcactgaagggg

SEQ ID NO: 14617 - DNA, 25 bp, Mus musculus
ctaatcttcccaattctttccatgt

SEQ ID NO: 14618 - DNA, 25 bp, Mus musculus
tcctccaagtgttcacaaggtcaaa

SEQ ID NO: 14619 - DNA, 25 bp, Mus musculus
ggtcaaactcagagtcacccagtaa

SEQ ID NO: 14620 - DNA, 25 bp, Mus musculus
actcagagtcacccagtaagctcat

SEQ ID NO: 14621 - DNA, 25 bp, Mus musculus
agtcacccagtaagctcatcatgcc

SEQ ID NO: 14622 - DNA, 25 bp, Mus musculus
ccagtaagctcatcatgccaccatt

SEQ ID NO: 14623 - DNA, 25 bp, Mus musculus
agctcatcatgccaccattctgagc

SEQ ID NO: 14624 - DNA, 25 bp, Mus musculus
tcatgccaccattctgagcaaaatc

SEQ ID NO: 14625 - DNA, 25 bp, Mus musculus
caccattctgagcaaaatccttgga

SEQ ID NO: 14626 - DNA, 25 bp, Mus musculus
atccagctcatgtacagaaacatcc

SEQ ID NO: 14627 - DNA, 25 bp, Mus musculus
aacatccaatggaccacaatactct

SEQ ID NO: 14628 - DNA, 25 bp, Mus musculus
accacaatactctgtggtatgtgat

SEQ ID NO: 14629 - DNA, 25 bp, Mus musculus
aaagctacctctgacctctagccca

SEQ ID NO: 14630 - DNA, 25 bp, Mus musculus
tagcccagtcaccctctatggaaag

SEQ ID NO: 14631 - DNA, 25 bp, Mus musculus
tcacctttatgttatagtctagtta

SEQ ID NO: 14632 - DNA, 25 bp, Mus musculus
ccctagctgcgtgttgaaaatgaaa

SEQ ID NO: 14633 - DNA, 25 bp, Mus musculus
ttaaaacacagtgtcaactgcagaa

SEQ ID NO: 14634 - DNA, 25 bp, Mus musculus
acagtctccacgtcgacctaacaga

SEQ ID NO: 14635 - DNA, 25 bp, Mus musculus
tccacgtcgacctaacagaatatta

SEQ ID NO: 14636 - DNA, 25 bp, Mus musculus
taaactatagctgtccattgctttt

SEQ ID NO: 14637 - DNA, 25 bp, Mus musculus
atagctgtccattgcttttggcaaa

SEQ ID NO: 14638 - DNA, 25 bp, Mus musculus
gctgtccattgcttttggcaaaata

SEQ ID NO: 14639 - DNA, 25 bp, Mus musculus
gtccattgcttttggcaaaatatac

SEQ ID NO: 14640 - DNA, 25 bp, Mus musculus
tagtttccatatttatccgcatgta

SEQ ID NO: 14641 - DNA, 25 bp, Mus musculus
ccatatttatccgcatgtaaagggt

SEQ ID NO: 14642 - DNA, 25 bp, Mus musculus
tatttatccgcatgtaaagggtctg

SEQ ID NO: 14643 - DNA, 25 bp, Mus musculus
ttatccgcatgtaaagggtctggtt

SEQ ID NO: 14644 - DNA, 25 bp, Mus musculus
ctcgtatgtacactttagtttccag

SEQ ID NO: 14645 - DNA, 25 bp, Mus musculus
tgtacactttagtttccagaactgt

SEQ ID NO: 14646 - DNA, 25 bp, Mus musculus
aatgttgtttcatgtcctgtcaaga

SEQ ID NO: 14647 - DNA, 25 bp, Mus musculus
gttgtttcatgtcctgtcaagaatt

SEQ ID NO: 14648 - DNA, 25 bp, Mus musculus
agtacgagcctggatctacgtgtca

SEQ ID NO: 14649 - DNA, 25 bp, Mus musculus
acgagcctggatctacgtgtcaaac

SEQ ID NO: 14650 - DNA, 25 bp, Mus musculus
agcctggatctacgtgtcaaactgt

SEQ ID NO: 14651 - DNA, 25 bp, Mus musculus
gatctacgtgtcaaactgttccatt

SEQ ID NO: 14652 - DNA, 25 bp, Mus musculus
ctgttccatttgtttatgtaaagtg

SEQ ID NO: 14653 - DNA, 25 bp, Mus musculus
atataaactatagctgtccattgct

SEQ ID NO: 14654 - DNA, 25 bp, Mus musculus
gctctctcaaggatcagttggccct

SEQ ID NO: 14655 - DNA, 25 bp, Mus musculus
atcagttggccctagcgattggtaa

SEQ ID NO: 14656 - DNA, 25 bp, Mus musculus
ttatgtgcacggagtgacgcagagc

SEQ ID NO: 14657 - DNA, 25 bp, Mus musculus
atgtgcacggagtgacgcagagccc

SEQ ID NO: 14658 - DNA, 25 bp, Mus musculus
cctccagaacctggtgctggggaag

SEQ ID NO: 14659 - DNA, 25 bp, Mus musculus
tccagaacctggtgctggggaagta

SEQ ID NO: 14660 - DNA, 25 bp, Mus musculus
cagaacctggtgctggggaagtacg

SEQ ID NO: 14661 - DNA, 25 bp, Mus musculus
atctgtgagactcccgagcagatcg

SEQ ID NO: 14662 - DNA, 25 bp, Mus musculus
ctgtgagactcccgagcagatcgca

SEQ ID NO: 14663 - DNA, 25 bp, Mus musculus
gtgagactcccgagcagatcgcaaa

SEQ ID NO: 14664 - DNA, 25 bp, Mus musculus
ctcccgagcagatcgcaaacctgga

SEQ ID NO: 14665 - DNA, 25 bp, Mus musculus
cgagcagatcgcaaacctggaggag

SEQ ID NO: 14666 - DNA, 25 bp, Mus musculus
atgattcttaagcgagctgcctggg

SEQ ID NO: 14667 - DNA, 25 bp, Mus musculus
gattcttaagcgagctgcctgggtg

SEQ ID NO: 14668 - DNA, 25 bp, Mus musculus
gtgccctctgggttctatgtcggct

SEQ ID NO: 14669 - DNA, 25 bp, Mus musculus
gccctctgggttctatgtcggctct

SEQ ID NO: 14670 - DNA, 25 bp, Mus musculus
tgggttctatgtcggctcttatgtg

SEQ ID NO: 14671 - DNA, 25 bp, Mus musculus
gtcggctcttatgtgcacggagtga

SEQ ID NO: 14672 - DNA, 25 bp, Mus musculus
cggctcttatgtgcacggagtgacg

SEQ ID NO: 14673 - DNA, 25 bp, Mus musculus
gctcttatgtgcacggagtgacgca

SEQ ID NO: 14674 - DNA, 25 bp, Mus musculus
atcatttgcaactgagtggacttca

SEQ ID NO: 14675 - DNA, 25 bp, Mus musculus
gacttcaatttctgtagacccaatt

SEQ ID NO: 14676 - DNA, 25 bp, Mus musculus
tctgacacagagcttatgaaatgga

SEQ ID NO: 14677 - DNA, 25 bp, Mus musculus
ttttagcataccttagctctttgta

SEQ ID NO: 14678 - DNA, 25 bp, Mus musculus
agtatgtcgtcatgttccatgctgc

SEQ ID NO: 14679 - DNA, 25 bp, Mus musculus
tcgtcatgttccatgctgcatagct

SEQ ID NO: 14680 - DNA, 25 bp, Mus musculus
tgttccatgctgcatagctctttaa

SEQ ID NO: 14681 - DNA, 25 bp, Mus musculus
aggtttttctctttctgctcagctg

SEQ ID NO: 14682 - DNA, 25 bp, Mus musculus
ttctctttctgctcagctgcaacta

SEQ ID NO: 14683 - DNA, 25 bp, Mus musculus
ttctgctcagctgcaactaataaca

SEQ ID NO: 14684 - DNA, 25 bp, Mus musculus
tcagctgcaactaataacaaccttg

SEQ ID NO: 14685 - DNA, 25 bp, Mus musculus
gcaactaataacaaccttggagagc

SEQ ID NO: 14686 - DNA, 25 bp, Mus musculus
tgtagacccaattatcctgtttggt

SEQ ID NO: 14687 - DNA, 25 bp, Mus musculus
cccaattatcctgtttggttctgat

SEQ ID NO: 14688 - DNA, 25 bp, Mus musculus
tttactgatttgttccatgttggca

SEQ ID NO: 14689 - DNA, 25 bp, Mus musculus
tggcttgcaactgtcagcacatggc

SEQ ID NO: 14690 - DNA, 25 bp, Mus musculus
gcaactgtcagcacatggcataagt

SEQ ID NO: 14691 - DNA, 25 bp, Mus musculus
caattcacatgtgagccactgctta

SEQ ID NO: 14692 - DNA, 25 bp, Mus musculus
ttggctacagcaaggccagatatca

SEQ ID NO: 14693 - DNA, 25 bp, Mus musculus
ttactctctgacacagagcttatga

SEQ ID NO: 14694 - DNA, 25 bp, Mus musculus
gcattctaaactgtttgaagaacct

SEQ ID NO: 14695 - DNA, 25 bp, Mus musculus
agaacctgaagatcccagcaacagg

SEQ ID NO: 14696 - DNA, 25 bp, Mus musculus
tcagccatagcggtcgttatatgat

SEQ ID NO: 14697 - DNA, 25 bp, Mus musculus
agccatagcggtcgttatatgatga

SEQ ID NO: 14698 - DNA, 25 bp, Mus musculus
ccatagcggtcgttatatgatgact

SEQ ID NO: 14699 - DNA, 25 bp, Mus musculus
tggagaacaggcccgtggagacata

SEQ ID NO: 14700 - DNA, 25 bp, Mus musculus
gaacaggcccgtggagacataccag

SEQ ID NO: 14701 - DNA, 25 bp, Mus musculus
tacatgaatacctcagaagtaaact

SEQ ID NO: 14702 - DNA, 25 bp, Mus musculus
aagtaaactttgctcactgtatgaa

SEQ ID NO: 14703 - DNA, 25 bp, Mus musculus
gtaaactttgctcactgtatgaaaa

SEQ ID NO: 14704 - DNA, 25 bp, Mus musculus
aaactttgctcactgtatgaaaacg

SEQ ID NO: 14705 - DNA, 25 bp, Mus musculus
actttgctcactgtatgaaaacgac

SEQ ID NO: 14706 - DNA, 25 bp, Mus musculus
aacctgaagatcccagcaacaggtc

SEQ ID NO: 14707 - DNA, 25 bp, Mus musculus
cctgaagatcccagcaacaggtcat

SEQ ID NO: 14708 - DNA, 25 bp, Mus musculus
aagatcccagcaacaggtcattttt

SEQ ID NO: 14709 - DNA, 25 bp, Mus musculus
atcatctcctctatttctgatgtaa

SEQ ID NO: 14710 - DNA, 25 bp, Mus musculus
catctcctctatttctgatgtaaaa

SEQ ID NO: 14711 - DNA, 25 bp, Mus musculus
tctcctctatttctgatgtaaaatt

SEQ ID NO: 14712 - DNA, 25 bp, Mus musculus
tgtaaaattcagccatagcggtcgt

SEQ ID NO: 14713 - DNA, 25 bp, Mus musculus
aaattcagccatagcggtcgttata

SEQ ID NO: 14714 - DNA, 25 bp, Mus musculus
aagggcaagcctctgattagccgaa

SEQ ID NO: 14715 - DNA, 25 bp, Mus musculus
aagcctctgattagccgaaactaca

SEQ ID NO: 14716 - DNA, 25 bp, Mus musculus
cgagtgcacttcctgtggatcaaac

SEQ ID NO: 14717 - DNA, 25 bp, Mus musculus
cacttcctgtggatcaaacacagca

SEQ ID NO: 14718 - DNA, 25 bp, Mus musculus
ttggtggccaccacgctgaagaacg

SEQ ID NO: 14719 - DNA, 25 bp, Mus musculus
gtggccaccacgctgaagaacgcta

SEQ ID NO: 14720 - DNA, 25 bp, Mus musculus
gccaccacgctgaagaacgctaatg

SEQ ID NO: 14721 - DNA, 25 bp, Mus musculus
aacgctaatgcctctctggtgtact

SEQ ID NO: 14722 - DNA, 25 bp, Mus musculus
ctggtgtactcctttctgtacaaga

SEQ ID NO: 14723 - DNA, 25 bp, Mus musculus
gtgtactcctttctgtacaagactg

SEQ ID NO: 14724 - DNA, 25 bp, Mus musculus
tactcctttctgtacaagactgtgg

SEQ ID NO: 14725 - DNA, 25 bp, Mus musculus
tcctttctgtacaagactgtggagg

SEQ ID NO: 14726 - DNA, 25 bp, Mus musculus
cctctgattagccgaaactacaaag

SEQ ID NO: 14727 - DNA, 25 bp, Mus musculus
ctgattagccgaaactacaaaggtg

SEQ ID NO: 14728 - DNA, 25 bp, Mus musculus
attagccgaaactacaaaggtgatg

SEQ ID NO: 14729 - DNA, 25 bp, Mus musculus
gagattgaccacttcatgccgctgc

SEQ ID NO: 14730 - DNA, 25 bp, Mus musculus
attgaccacttcatgccgctgctta

SEQ ID NO: 14731 - DNA, 25 bp, Mus musculus
gaccacttcatgccgctgcttatgc

SEQ ID NO: 14732 - DNA, 25 bp, Mus musculus
cacttcatgccgctgcttatgcacg

SEQ ID NO: 14733 - DNA, 25 bp, Mus musculus
ttcatgccgctgcttatgcacgtcg

SEQ ID NO: 14734 - DNA, 25 bp, Mus musculus
gaaacccgctgttgcccctcgacat

SEQ ID NO: 14735 - DNA, 25 bp, Mus musculus
cgctgttgcccctcgacatggcctg

SEQ ID NO: 14736 - DNA, 25 bp, Mus musculus
ggcaatgaccccaatgtctcactag

SEQ ID NO: 14737 - DNA, 25 bp, Mus musculus
aatgaccccaatgtctcactagtgc

SEQ ID NO: 14738 - DNA, 25 bp, Mus musculus
gaccccaatgtctcactagtgccga

SEQ ID NO: 14739 - DNA, 25 bp, Mus musculus
aatgtctcactagtgccgaaagacg

SEQ ID NO: 14740 - DNA, 25 bp, Mus musculus
gtctcactagtgccgaaagacggaa

SEQ ID NO: 14741 - DNA, 25 bp, Mus musculus
tcactagtgccgaaagacggaacag

SEQ ID NO: 14742 - DNA, 25 bp, Mus musculus
agttccgatgcctcaaccgctcagc

SEQ ID NO: 14743 - DNA, 25 bp, Mus musculus
ccggaatcgcagccactgccggctt

SEQ ID NO: 14744 - DNA, 25 bp, Mus musculus
gaatcgcagccactgccggcttcac

SEQ ID NO: 14745 - DNA, 25 bp, Mus musculus
tcgcagccactgccggcttcacaga

SEQ ID NO: 14746 - DNA, 25 bp, Mus musculus
tgttgcccctcgacatggcctgcag

SEQ ID NO: 14747 - DNA, 25 bp, Mus musculus
ccctcgacatggcctgcagagtctc

SEQ ID NO: 14748 - DNA, 25 bp, Mus musculus
tcgacatggcctgcagagtctcgga

SEQ ID NO: 14749 - DNA, 25 bp, Mus musculus
acatggcctgcagagtctcggaaaa

SEQ ID NO: 14750 - DNA, 25 bp, Mus musculus
tggcctgcagagtctcggaaaagtt

SEQ ID NO: 14751 - DNA, 25 bp, Mus musculus
gccaaccttccaagcctgaaagccg

SEQ ID NO: 14752 - DNA, 25 bp, Mus musculus
cttccaagcctgaaagccgagaaca

SEQ ID NO: 14753 - DNA, 25 bp, Mus musculus
aaaggcaatgaccccaatgtctcac

SEQ ID NO: 14754 - DNA, 25 bp, Mus musculus
acaatggtcagatccaactatggca

SEQ ID NO: 14755 - DNA, 25 bp, Mus musculus
gtcagatccaactatggcagttttt

SEQ ID NO: 14756 - DNA, 25 bp, Mus musculus
agcctgagttggttgcgcaaaaatg

SEQ ID NO: 14757 - DNA, 25 bp, Mus musculus
agcctaccatgaactatgagaaact

SEQ ID NO: 14758 - DNA, 25 bp, Mus musculus
ttagccgtgcattacggtattatta

SEQ ID NO: 14759 - DNA, 25 bp, Mus musculus
cagaactgaaccgtctggtcataga

SEQ ID NO: 14760 - DNA, 25 bp, Mus musculus
tgaaccgtctggtcatagagtgtga

SEQ ID NO: 14761 - DNA, 25 bp, Mus musculus
ggatgcagctgcatgggattgccca

SEQ ID NO: 14762 - DNA, 25 bp, Mus musculus
atgggattgcccagccagtcacggc

SEQ ID NO: 14763 - DNA, 25 bp, Mus musculus
tcacggcagtagcactggcagccac

SEQ ID NO: 14764 - DNA, 25 bp, Mus musculus
cagtagcactggcagccacctctct

SEQ ID NO: 14765 - DNA, 25 bp, Mus musculus
ttgctctaacctttattactgaatt

SEQ ID NO: 14766 - DNA, 25 bp, Mus musculus
tccaactatggcagtttttgctaga

SEQ ID NO: 14767 - DNA, 25 bp, Mus musculus
tgctagaacttcttactgacaagga

SEQ ID NO: 14768 - DNA, 25 bp, Mus musculus
aacttcttactgacaaggatgctcg

SEQ ID NO: 14769 - DNA, 25 bp, Mus musculus
ttactgacaaggatgctcgagactg

SEQ ID NO: 14770 - DNA, 25 bp, Mus musculus
atgctcgagactgtatttcttgggt

SEQ ID NO: 14771 - DNA, 25 bp, Mus musculus
gtatttcttgggttggtgatgaagg

SEQ ID NO: 14772 - DNA, 25 bp, Mus musculus
ttaagctaaatcagcctgagttggt

SEQ ID NO: 14773 - DNA, 25 bp, Mus musculus
taaatcagcctgagttggttgcgca

SEQ ID NO: 14774 - DNA, 25 bp, Mus musculus
actggcgaccatgacaatgttcttg

SEQ ID NO: 14775 - DNA, 25 bp, Mus musculus
tttctgacaattgtattgtgaggat

SEQ ID NO: 14776 - DNA, 25 bp, Mus musculus
agcaggaccttttgtactcagtgag

SEQ ID NO: 14777 - DNA, 25 bp, Mus musculus
accttttgtactcagtgaggctatg

SEQ ID NO: 14778 - DNA, 25 bp, Mus musculus
cctgtgctgcgactctctcacaata

SEQ ID NO: 14779 - DNA, 25 bp, Mus musculus
ctctctcacaatattgtcaattctg

SEQ ID NO: 14780 - DNA, 25 bp, Mus musculus
catttgacagactattccattctct

SEQ ID NO: 14781 - DNA, 25 bp, Mus musculus
acagactattccattctcttttgta

SEQ ID NO: 14782 - DNA, 25 bp, Mus musculus
gctcctctagcttatctgtataaag

SEQ ID NO: 14783 - DNA, 25 bp, Mus musculus
gttacctgcgagactgtactctggc

SEQ ID NO: 14784 - DNA, 25 bp, Mus musculus
actgtactctggcctcattttctat

SEQ ID NO: 14785 - DNA, 25 bp, Mus musculus
ctctggcctcattttctattttaca

SEQ ID NO: 14786 - DNA, 25 bp, Mus musculus
tgtgagactgctctgtgccttcctt

SEQ ID NO: 14787 - DNA, 25 bp, Mus musculus
ctgtgccttccttccatcatgactt

SEQ ID NO: 14788 - DNA, 25 bp, Mus musculus
cgagcactttgaggcgctggatttt

SEQ ID NO: 14789 - DNA, 25 bp, Mus musculus
ctttgaggcgctggattttaagata

SEQ ID NO: 14790 - DNA, 25 bp, Mus musculus
tttggcaaactcagtgcatttgggt

SEQ ID NO: 14791 - DNA, 25 bp, Mus musculus
aaactcagtgcatttgggtttctga

SEQ ID NO: 14792 - DNA, 25 bp, Mus musculus
aattgcttttgtatgcagagcagga

SEQ ID NO: 14793 - DNA, 25 bp, Mus musculus
atgcagagcaggaccttttgtactc

SEQ ID NO: 14794 - DNA, 25 bp, Mus musculus
ggcgctcaccaaaacatcatcccat

SEQ ID NO: 14795 - DNA, 25 bp, Mus musculus
atcccatcgtccactggggctgcca

SEQ ID NO: 14796 - DNA, 25 bp, Mus musculus
atccttgcttacacagaggaccagg

SEQ ID NO: 14797 - DNA, 25 bp, Mus musculus
aacggcaatccccattcttccatct

SEQ ID NO: 14798 - DNA, 25 bp, Mus musculus
aatccccattcttccatctttgatg

SEQ ID NO: 14799 - DNA, 25 bp, Mus musculus
tccatctttgatgctaaggctggaa

SEQ ID NO: 14800 - DNA, 25 bp, Mus musculus
ctcaatgacaacttcgtgaagcttg

SEQ ID NO: 14801 - DNA, 25 bp, Mus musculus
ttcgtgaagcttgttgcctggtacg

SEQ ID NO: 14802 - DNA, 25 bp, Mus musculus
aagcttgttgcctggtacgacaacg

SEQ ID NO: 14803 - DNA, 25 bp, Mus musculus
gttgcctggtacgacaacgaatatg

SEQ ID NO: 14804 - DNA, 25 bp, Mus musculus
cgctacatgtttagccgagagaagt

SEQ ID NO: 14805 - DNA, 25 bp, Mus musculus
tcctgacttcggcttccactcaaag

SEQ ID NO: 14806 - DNA, 25 bp, Mus musculus
gtggacctgacctgccgcctggcca

SEQ ID NO: 14807 - DNA, 25 bp, Mus musculus
aagcctgcttcttactcggctatca

SEQ ID NO: 14808 - DNA, 25 bp, Mus musculus
gcttcttactcggctatcacggagg

SEQ ID NO: 14809 - DNA, 25 bp, Mus musculus
gctatcacggaggctgtgaaagctg

SEQ ID NO: 14810 - DNA, 25 bp, Mus musculus
aaagctgcagccaagggacctttgg

SEQ ID NO: 14811 - DNA, 25 bp, Mus musculus
aagggacctttggctggcatccttg

SEQ ID NO: 14812 - DNA, 25 bp, Mus musculus
cctttggctggcatccttgcttaca

SEQ ID NO: 14813 - DNA, 25 bp, Mus musculus
gctggcatccttgcttacacagagg

SEQ ID NO: 14814 - DNA, 25 bp, Mus musculus
agcagactcttgttagaccggacca

SEQ ID NO: 14815 - DNA, 25 bp, Mus musculus
cagactcttgttagaccggaccatg

SEQ ID NO: 14816 - DNA, 25 bp, Mus musculus
ctggtcaggggccatgcaaagatcc

SEQ ID NO: 14817 - DNA, 25 bp, Mus musculus
gatccatggtcatcttccaccagga

SEQ ID NO: 14818 - DNA, 25 bp, Mus musculus
acctcttgcagatggatagaggagg

SEQ ID NO: 14819 - DNA, 25 bp, Mus musculus
ctcttgcagatggatagaggaggcc

SEQ ID NO: 14820 - DNA, 25 bp, Mus musculus
aggccttcttaagtgtttcattcat

SEQ ID NO: 14821 - DNA, 25 bp, Mus musculus
gccttcttaagtgtttcattcatct

SEQ ID NO: 14822 - DNA, 25 bp, Mus musculus
gtgttcacagtgcacttgggaccga

SEQ ID NO: 14823 - DNA, 25 bp, Mus musculus
gttcacagtgcacttgggaccgagg

SEQ ID NO: 14824 - DNA, 25 bp, Mus musculus
tcacagtgcacttgggaccgaggcc

SEQ ID NO: 14825 - DNA, 25 bp, Mus musculus
acagtgcacttgggaccgaggcccg

SEQ ID NO: 14826 - DNA, 25 bp, Mus musculus
cttgttagaccggaccatggatcct

SEQ ID NO: 14827 - DNA, 25 bp, Mus musculus
tgttagaccggaccatggatcctag

SEQ ID NO: 14828 - DNA, 25 bp, Mus musculus
ttagaccggaccatggatcctagtg

SEQ ID NO: 14829 - DNA, 25 bp, Mus musculus
tagtgtcctgctcctccttgctgtc

SEQ ID NO: 14830 - DNA, 25 bp, Mus musculus
tgctgtccttctgagcttatttcta

SEQ ID NO: 14831 - DNA, 25 bp, Mus musculus
ctgagcttatttctactcctggtca

SEQ ID NO: 14832 - DNA, 25 bp, Mus musculus
atttctactcctggtcaggggccat

SEQ ID NO: 14833 - DNA, 25 bp, Mus musculus
ttctactcctggtcaggggccatgc

SEQ ID NO: 14834 - DNA, 25 bp, Mus musculus
ttggagcagcaaccgactgaagaat

SEQ ID NO: 14835 - DNA, 25 bp, Mus musculus
cagatactccagggtaactgtccag

SEQ ID NO: 14836 - DNA, 25 bp, Mus musculus
aaattactgtcatggagagtgcccc

SEQ ID NO: 14837 - DNA, 25 bp, Mus musculus
caattatgctttcatgcaggctctg

SEQ ID NO: 14838 - DNA, 25 bp, Mus musculus
tgctttcatgcaggctctgatgcat

SEQ ID NO: 14839 - DNA, 25 bp, Mus musculus
catgcaggctctgatgcatatggct

SEQ ID NO: 14840 - DNA, 25 bp, Mus musculus
ggctctgatgcatatggctgacccc

SEQ ID NO: 14841 - DNA, 25 bp, Mus musculus
tatggctgaccccaaggtccccaag

SEQ ID NO: 14842 - DNA, 25 bp, Mus musculus
catgctctatcaggatagtgataag

SEQ ID NO: 14843 - DNA, 25 bp, Mus musculus
gaacgtcattctccgacattatgaa

SEQ ID NO: 14844 - DNA, 25 bp, Mus musculus
cattctccgacattatgaagacatg

SEQ ID NO: 14845 - DNA, 25 bp, Mus musculus
gtagtctcgggactaggctaggagt

SEQ ID NO: 14846 - DNA, 25 bp, Mus musculus
tcctaaacactgtcatccttcttcc

SEQ ID NO: 14847 - DNA, 25 bp, Mus musculus
acactgtcatccttcttccagaaaa

SEQ ID NO: 14848 - DNA, 25 bp, Mus musculus
ggcggccatctctgtccccaagggt

SEQ ID NO: 14849 - DNA, 25 bp, Mus musculus
taggaacttctgccaccgtcatcag

SEQ ID NO: 14850 - DNA, 25 bp, Mus musculus
cttctgccaccgtcatcagctgttc

SEQ ID NO: 14851 - DNA, 25 bp, Mus musculus
ccaccgtcatcagctgttcatcaac

SEQ ID NO: 14852 - DNA, 25 bp, Mus musculus
gctgttcatcaacttccaggacctg

SEQ ID NO: 14853 - DNA, 25 bp, Mus musculus
catcgcccctaaggggttcatggca

SEQ ID NO: 14854 - DNA, 25 bp, Mus musculus
gcacaccatggtccagaatataatc

SEQ ID NO: 14855 - DNA, 25 bp, Mus musculus
ggacccttcagtgccaaggccttcg

SEQ ID NO: 14856 - DNA, 25 bp, Mus musculus
caacaagcctgcctggcagagcaat

SEQ ID NO: 14857 - DNA, 25 bp, Mus musculus
gcctgcctggcagagcaatgctgtg

SEQ ID NO: 14858 - DNA, 25 bp, Mus musculus
tagagtgcctgggcagagagcttcc

SEQ ID NO: 14859 - DNA, 25 bp, Mus musculus
ctgtgaccagtctctccgtgctgct

SEQ ID NO: 14860 - DNA, 25 bp, Mus musculus
tctccgtgctgctcagtgcacactg

SEQ ID NO: 14861 - DNA, 25 bp, Mus musculus
tgagcacatcgagtgcagtgtccgt

SEQ ID NO: 14862 - DNA, 25 bp, Mus musculus
catcgagtgcagtgtccgtaggtgt

SEQ ID NO: 14863 - DNA, 25 bp, Mus musculus
taaagggcacactcactggtcgttg

SEQ ID NO: 14864 - DNA, 25 bp, Mus musculus
gcacactcactggtcgttgccataa

SEQ ID NO: 14865 - DNA, 25 bp, Mus musculus
gtcgttgccataaaccaagtgaaat

SEQ ID NO: 14866 - DNA, 25 bp, Mus musculus
gccaaggccttcgtgtgtgccgggc

SEQ ID NO: 14867 - DNA, 25 bp, Mus musculus
tgaacccgacggctccatcgcttac

SEQ ID NO: 14868 - DNA, 25 bp, Mus musculus
cgacggctccatcgcttacaaagag

SEQ ID NO: 14869 - DNA, 25 bp, Mus musculus
tacgaggtgcacctgtcgttagcat

SEQ ID NO: 14870 - DNA, 25 bp, Mus musculus
gtgcacctgtcgttagcatgggggc

SEQ ID NO: 14871 - DNA, 25 bp, Mus musculus
ctgtcgttagcatgggggccacttc

SEQ ID NO: 14872 - DNA, 25 bp, Mus musculus
ttagcatgggggccacttcaacaag

SEQ ID NO: 14873 - DNA, 25 bp, Mus musculus
ccacttcaacaagcctgcctggcag

SEQ ID NO: 14874 - DNA, 25 bp, Mus musculus
tgctgtccacagaaaccaccttgct

SEQ ID NO: 14875 - DNA, 25 bp, Mus musculus
gccacctgtccttgtccgctgaaac

SEQ ID NO: 14876 - DNA, 25 bp, Mus musculus
attactacaggtcaggctaagacta

SEQ ID NO: 14877 - DNA, 25 bp, Mus musculus
tgctgttttcacaataaccaacaag

SEQ ID NO: 14878 - DNA, 25 bp, Mus musculus
caacaagtccactcaaccataagct

SEQ ID NO: 14879 - DNA, 25 bp, Mus musculus
gtccactcaaccataagctaccatt

SEQ ID NO: 14880 - DNA, 25 bp, Mus musculus
tcaaccataagctaccatttcgacc

SEQ ID NO: 14881 - DNA, 25 bp, Mus musculus
taccatttcgacctaactgtaggct

SEQ ID NO: 14882 - DNA, 25 bp, Mus musculus
ttcgacctaactgtaggctactatt

SEQ ID NO: 14883 - DNA, 25 bp, Mus musculus
ctaactgtaggctactattgcaact

SEQ ID NO: 14884 - DNA, 25 bp, Mus musculus
gtaggctactattgcaactggaaat

SEQ ID NO: 14885 - DNA, 25 bp, Mus musculus
atcttgtctagtgatcctgacattt

SEQ ID NO: 14886 - DNA, 25 bp, Mus musculus
tgtccttgtccgctgaaaccaccat

SEQ ID NO: 14887 - DNA, 25 bp, Mus musculus
tgtccgctgaaaccaccatgctgcc

SEQ ID NO: 14888 - DNA, 25 bp, Mus musculus
tcgtgctgccccaaaaagtgcacct

SEQ ID NO: 14889 - DNA, 25 bp, Mus musculus
tgcgctcaacctacctgctgctctt

SEQ ID NO: 14890 - DNA, 25 bp, Mus musculus
caacctacctgctgctcttcagaga

SEQ ID NO: 14891 - DNA, 25 bp, Mus musculus
acctgctgctcttcagagaacaaga

SEQ ID NO: 14892 - DNA, 25 bp, Mus musculus
tcagattctgatacatctggccaaa

SEQ ID NO: 14893 - DNA, 25 bp, Mus musculus
gtccctgacaccatgccctttttca

SEQ ID NO: 14894 - DNA, 25 bp, Mus musculus
atcgctgcaacctttagactaatga

SEQ ID NO: 14895 - DNA, 25 bp, Mus musculus
agactaatgactgtccgaaacatcg

SEQ ID NO: 14896 - DNA, 25 bp, Mus musculus
gagcagtttccgatcaatgaacact

SEQ ID NO: 14897 - DNA, 25 bp, Mus musculus
cagtttccgatcaatgaacactact

SEQ ID NO: 14898 - DNA, 25 bp, Mus musculus
ccgatcaatgaacactacttcggat

SEQ ID NO: 14899 - DNA, 25 bp, Mus musculus
atcaatgaacactacttcggattgg

SEQ ID NO: 14900 - DNA, 25 bp, Mus musculus
ggaaacacatgctactgtaactccg

SEQ ID NO: 14901 - DNA, 25 bp, Mus musculus
aacacatgctactgtaactccgtgc

SEQ ID NO: 14902 - DNA, 25 bp, Mus musculus
acatgctactgtaactccgtgcttc

SEQ ID NO: 14903 - DNA, 25 bp, Mus musculus
tactgtaactccgtgcttcaagcgc

SEQ ID NO: 14904 - DNA, 25 bp, Mus musculus
tgtaactccgtgcttcaagcgctgt

SEQ ID NO: 14905 - DNA, 25 bp, Mus musculus
aactccgtgcttcaagcgctgtact

SEQ ID NO: 14906 - DNA, 25 bp, Mus musculus
atgactgtccgaaacatcgcctcca

SEQ ID NO: 14907 - DNA, 25 bp, Mus musculus
gtgcttcaagcgctgtacttctgcc

SEQ ID NO: 14908 - DNA, 25 bp, Mus musculus
actgtccgaaacatcgcctccatct

SEQ ID NO: 14909 - DNA, 25 bp, Mus musculus
gtccgaaacatcgcctccatctgta

SEQ ID NO: 14910 - DNA, 25 bp, Mus musculus
atcgcctccatctgtaatatgggca

SEQ ID NO: 14911 - DNA, 25 bp, Mus musculus
gcctccatctgtaatatgggcacca

SEQ ID NO: 14912 - DNA, 25 bp, Mus musculus
aatatgggcaccaatgcctctgctc

SEQ ID NO: 14913 - DNA, 25 bp, Mus musculus
accaatgcctctgctctggaaaaag

SEQ ID NO: 14914 - DNA, 25 bp, Mus musculus
aatgcctctgctctggaaaaagaca

SEQ ID NO: 14915 - DNA, 25 bp, Mus musculus
ttcctggactcagggtagatggaat

SEQ ID NO: 14916 - DNA, 25 bp, Mus musculus
tggatatcttgtgcgtccgagaggc

SEQ ID NO: 14917 - DNA, 25 bp, Mus musculus
agtttgccacggctgatcctgagcc

SEQ ID NO: 14918 - DNA, 25 bp, Mus musculus
acatctacagcagtgatcctccctt

SEQ ID NO: 14919 - DNA, 25 bp, Mus musculus
acagcagtgatcctccctttgaagt

SEQ ID NO: 14920 - DNA, 25 bp, Mus musculus
gtgatcctccctttgaagtgcgtgg

SEQ ID NO: 14921 - DNA, 25 bp, Mus musculus
ctccctttgaagtgcgtggtgccaa

SEQ ID NO: 14922 - DNA, 25 bp, Mus musculus
tgcgtggtgccaaccagtggatcaa

SEQ ID NO: 14923 - DNA, 25 bp, Mus musculus
gtgccaaccagtggatcaagtttaa

SEQ ID NO: 14924 - DNA, 25 bp, Mus musculus
gttcctcatccagcgtaaggaactc

SEQ ID NO: 14925 - DNA, 25 bp, Mus musculus
ggaactctgtgctctcaacttggac

SEQ ID NO: 14926 - DNA, 25 bp, Mus musculus
ctgtgctctcaacttggacaggaaa

SEQ ID NO: 14927 - DNA, 25 bp, Mus musculus
agtttgcggctgcctattgcaggtc

SEQ ID NO: 14928 - DNA, 25 bp, Mus musculus
agctccagacttaccgctaccatgg

SEQ ID NO: 14929 - DNA, 25 bp, Mus musculus
gcatgagtgaccctggagtaagcta

SEQ ID NO: 14930 - DNA, 25 bp, Mus musculus
taagctaccgcactcgagaagaaat

SEQ ID NO: 14931 - DNA, 25 bp, Mus musculus
agagtgaccctattatgcttctcaa

SEQ ID NO: 14932 - DNA, 25 bp, Mus musculus
accctattatgcttctcaaggatag

SEQ ID NO: 14933 - DNA, 25 bp, Mus musculus
aaatcgaggatgctgcccagtttgc

SEQ ID NO: 14934 - DNA, 25 bp, Mus musculus
ctgcccagtttgccacggctgatcc

SEQ ID NO: 14935 - DNA, 25 bp, Mus musculus
ccccaggagctgtcggaagaagtga

SEQ ID NO: 14936 - DNA, 25 bp, Mus musculus
aggttgcagatcactccggactcca

SEQ ID NO: 14937 - DNA, 25 bp, Mus musculus
ctcgtcaaggcttcggtcctgcagt

SEQ ID NO: 14938 - DNA, 25 bp, Mus musculus
cgtcaaggcttcggtcctgcagtgt

SEQ ID NO: 14939 - DNA, 25 bp, Mus musculus
tcggtcctgcagtgttaccgacacg

SEQ ID NO: 14940 - DNA, 25 bp, Mus musculus
ggtcctgcagtgttaccgacacggt

SEQ ID NO: 14941 - DNA, 25 bp, Mus musculus
gcagtgttaccgacacggttgctga

SEQ ID NO: 14942 - DNA, 25 bp, Mus musculus
agtgttaccgacacggttgctgagc

SEQ ID NO: 14943 - DNA, 25 bp, Mus musculus
tgttaccgacacggttgctgagcaa

SEQ ID NO: 14944 - DNA, 25 bp, Mus musculus
accgacacggttgctgagcaagctc

SEQ ID NO: 14945 - DNA, 25 bp, Mus musculus
cgacacggttgctgagcaagctcac

SEQ ID NO: 14946 - DNA, 25 bp, Mus musculus
ttgctgagcaagctcaccttccacc

SEQ ID NO: 14947 - DNA, 25 bp, Mus musculus
tgcagatcactccggactccaacgg

SEQ ID NO: 14948 - DNA, 25 bp, Mus musculus
cagatcactccggactccaacgggg

SEQ ID NO: 14949 - DNA, 25 bp, Mus musculus
gaacagttcagttctctgattcaga

SEQ ID NO: 14950 - DNA, 25 bp, Mus musculus
acagttcagttctctgattcagaga

SEQ ID NO: 14951 - DNA, 25 bp, Mus musculus
agttcagttctctgattcagagaga

SEQ ID NO: 14952 - DNA, 25 bp, Mus musculus
tcagagagagccctcgtcaaggctt

SEQ ID NO: 14953 - DNA, 25 bp, Mus musculus
agagagccctcgtcaaggcttcggt

SEQ ID NO: 14954 - DNA, 25 bp, Mus musculus
ccctcgtcaaggcttcggtcctgca

SEQ ID NO: 14955 - DNA, 25 bp, Mus musculus
ctcaagtataagtcccacagttaga

SEQ ID NO: 14956 - DNA, 25 bp, Mus musculus
caagtataagtcccacagttagata

SEQ ID NO: 14957 - DNA, 25 bp, Mus musculus
gttgcatactactatgaatatcttt

SEQ ID NO: 14958 - DNA, 25 bp, Mus musculus
catactactatgaatatcttttaga

SEQ ID NO: 14959 - DNA, 25 bp, Mus musculus
tactactatgaatatcttttagact

SEQ ID NO: 14960 - DNA, 25 bp, Mus musculus
tccccaatttggcatagtagtttca

SEQ ID NO: 14961 - DNA, 25 bp, Mus musculus
cttcttctttgatgagtttgtcaaa

SEQ ID NO: 14962 - DNA, 25 bp, Mus musculus
cctcaccaaatacctgattatgttc

SEQ ID NO: 14963 - DNA, 25 bp, Mus musculus
tcaccaaatacctgattatgttccc

SEQ ID NO: 14964 - DNA, 25 bp, Mus musculus
tccatgtccaatctctgacccaggt

SEQ ID NO: 14965 - DNA, 25 bp, Mus musculus
atgtccaatctctgacccaggttcc

SEQ ID NO: 14966 - DNA, 25 bp, Mus musculus
tgtccaatctctgacccaggttcct

SEQ ID NO: 14967 - DNA, 25 bp, Mus musculus
aagtataagtcccacagttagatag

SEQ ID NO: 14968 - DNA, 25 bp, Mus musculus
gtataagtcccacagttagatagat

SEQ ID NO: 14969 - DNA, 25 bp, Mus musculus
tataagtcccacagttagatagatg

SEQ ID NO: 14970 - DNA, 25 bp, Mus musculus
taagtcccacagttagatagatgtt

SEQ ID NO: 14971 - DNA, 25 bp, Mus musculus
aagtcccacagttagatagatgtta

SEQ ID NO: 14972 - DNA, 25 bp, Mus musculus
gatgttacctatacatttgttaaat

SEQ ID NO: 14973 - DNA, 25 bp, Mus musculus
ttttttcagtgggacatttatggtg

SEQ ID NO: 14974 - DNA, 25 bp, Mus musculus
agattcctgagttattaaggagatt

SEQ ID NO: 14975 - DNA, 25 bp, Mus musculus
atgcgaagtgccgggatgaaaagtg

SEQ ID NO: 14976 - DNA, 25 bp, Mus musculus
gagtgtactctgtgggtagaccgat

SEQ ID NO: 14977 - DNA, 25 bp, Mus musculus
tcgtgctacaccggtttacggcgca

SEQ ID NO: 14978 - DNA, 25 bp, Mus musculus
gtgctacaccggtttacggcgcaag

SEQ ID NO: 14979 - DNA, 25 bp, Mus musculus
atcatcgataatcgaatctgttccc

SEQ ID NO: 14980 - DNA, 25 bp, Mus musculus
gataatcgaatctgttcccgactca

SEQ ID NO: 14981 - DNA, 25 bp, Mus musculus
taatcgaatctgttcccgactcatg

SEQ ID NO: 14982 - DNA, 25 bp, Mus musculus
aatcgaatctgttcccgactcatgt

SEQ ID NO: 14983 - DNA, 25 bp, Mus musculus
atcgaatctgttcccgactcatgtg

SEQ ID NO: 14984 - DNA, 25 bp, Mus musculus
cgaatctgttcccgactcatgtgta

SEQ ID NO: 14985 - DNA, 25 bp, Mus musculus
tgttcccgactcatgtgtacagagc

SEQ ID NO: 14986 - DNA, 25 bp, Mus musculus
tcccgactcatgtgtacagagcatg

SEQ ID NO: 14987 - DNA, 25 bp, Mus musculus
gtgtactctgtgggtagaccgatga

SEQ ID NO: 14988 - DNA, 25 bp, Mus musculus
tgtactctgtgggtagaccgatgag

SEQ ID NO: 14989 - DNA, 25 bp, Mus musculus
gtactctgtgggtagaccgatgagg

SEQ ID NO: 14990 - DNA, 25 bp, Mus musculus
actctgtgggtagaccgatgaggca

SEQ ID NO: 14991 - DNA, 25 bp, Mus musculus
tagaccgatgaggcagtgtgtgcaa

SEQ ID NO: 14992 - DNA, 25 bp, Mus musculus
tgtgtgcaacagtcgtgctacaccg

SEQ ID NO: 14993 - DNA, 25 bp, Mus musculus
tgtgcaacagtcgtgctacaccggt

SEQ ID NO: 14994 - DNA, 25 bp, Mus musculus
tgcaacagtcgtgctacaccggttt

SEQ ID NO: 14995 - DNA, 25 bp, Mus musculus
aattaatgccaaccttgaagccagt

SEQ ID NO: 14996 - DNA, 25 bp, Mus musculus
ttaatgccaaccttgaagccagtgg

SEQ ID NO: 14997 - DNA, 25 bp, Mus musculus
gggcaccagtccacaaactggcttc

SEQ ID NO: 14998 - DNA, 25 bp, Mus musculus
ggcaccagtccacaaactggcttca

SEQ ID NO: 14999 - DNA, 25 bp, Mus musculus
caccagtccacaaactggcttcaag

SEQ ID NO: 15000 - DNA, 25 bp, Mus musculus
accagtccacaaactggcttcaagg

SEQ ID NO: 15001 - DNA, 25 bp, Mus musculus
cagtccacaaactggcttcaaggtt

SEQ ID NO: 15002 - DNA, 25 bp, Mus musculus
agtccacaaactggcttcaaggttg

SEQ ID NO: 15003 - DNA, 25 bp, Mus musculus
tccacaaactggcttcaaggttggc

SEQ ID NO: 15004 - DNA, 25 bp, Mus musculus
ccacaaactggcttcaaggttggca

SEQ ID NO: 15005 - DNA, 25 bp, Mus musculus
tagtggtacctaggtggcgacctgg

SEQ ID NO: 15006 - DNA, 25 bp, Mus musculus
tacctaggtggcgacctggccaagg

SEQ ID NO: 15007 - DNA, 25 bp, Mus musculus
taatgccaaccttgaagccagtggg

SEQ ID NO: 15008 - DNA, 25 bp, Mus musculus
caaccttgaagccagtggggcacca

SEQ ID NO: 15009 - DNA, 25 bp, Mus musculus
accttgaagccagtggggcaccagt

SEQ ID NO: 15010 - DNA, 25 bp, Mus musculus
ccttgaagccagtggggcaccagtc

SEQ ID NO: 15011 - DNA, 25 bp, Mus musculus
ttgaagccagtggggcaccagtcca

SEQ ID NO: 15012 - DNA, 25 bp, Mus musculus
tgaagccagtggggcaccagtccac

SEQ ID NO: 15013 - DNA, 25 bp, Mus musculus
aagccagtggggcaccagtccacaa

SEQ ID NO: 15014 - DNA, 25 bp, Mus musculus
tggggcaccagtccacaaactggct

SEQ ID NO: 15015 - DNA, 25 bp, Mus musculus
agcatgagtccagacactgaagtta

SEQ ID NO: 15016 - DNA, 25 bp, Mus musculus
agtccagacactgaagttaggagac

SEQ ID NO: 15017 - DNA, 25 bp, Mus musculus
cactgcccagcttaggatgcggtct

SEQ ID NO: 15018 - DNA, 25 bp, Mus musculus
taggatgcggtctgcggcgtctgac

SEQ ID NO: 15019 - DNA, 25 bp, Mus musculus
gtctgacctggtgtagagggaacaa

SEQ ID NO: 15020 - DNA, 25 bp, Mus musculus
acaactcgcaagcctgctctggaac

SEQ ID NO: 15021 - DNA, 25 bp, Mus musculus
cctgctctggaactggaagggcctg

SEQ ID NO: 15022 - DNA, 25 bp, Mus musculus
tattagtgcactgggctttgaagga

SEQ ID NO: 15023 - DNA, 25 bp, Mus musculus
tggtcccacgaacagagtctaatct

SEQ ID NO: 15024 - DNA, 25 bp, Mus musculus
tcagggccttaacctgttcaggaga

SEQ ID NO: 15025 - DNA, 25 bp, Mus musculus
tgccaaatactcttcttgctctcac

SEQ ID NO: 15026 - DNA, 25 bp, Mus musculus
atactcttcttgctctcacctcact

SEQ ID NO: 15027 - DNA, 25 bp, Mus musculus
cttcaaagtgctcaggcgtctgtcc

SEQ ID NO: 15028 - DNA, 25 bp, Mus musculus
tcctccactgaggaggaacacaagg

SEQ ID NO: 15029 - DNA, 25 bp, Mus musculus
cacaaggcacattggccaagtcact

SEQ ID NO: 15030 - DNA, 25 bp, Mus musculus
gcacattggccaagtcactggaagc

SEQ ID NO: 15031 - DNA, 25 bp, Mus musculus
agtcactggaagcccttcctggtca

SEQ ID NO: 15032 - DNA, 25 bp, Mus musculus
aatgtgtgcatggccacgctcctgg

SEQ ID NO: 15033 - DNA, 25 bp, Mus musculus
ctcctggccaccggcgcgtacttgt

SEQ ID NO: 15034 - DNA, 25 bp, Mus musculus
cactgacagactgggaggcactgcc

SEQ ID NO: 15035 - DNA, 25 bp, Mus musculus
ggcgcctatgatgctgcccgtagcc

SEQ ID NO: 15036 - DNA, 25 bp, Mus musculus
cgcctatgatgctgcccgtagcctc

SEQ ID NO: 15037 - DNA, 25 bp, Mus musculus
atctaaggcctcctgaggatgtagc

SEQ ID NO: 15038 - DNA, 25 bp, Mus musculus
aaggcctcctgaggatgtagccatc

SEQ ID NO: 15039 - DNA, 25 bp, Mus musculus
ggcctcctgaggatgtagccatcta

SEQ ID NO: 15040 - DNA, 25 bp, Mus musculus
ggatgtagccatctacattatagac

SEQ ID NO: 15041 - DNA, 25 bp, Mus musculus
gtagccatctacattatagacgaca

SEQ ID NO: 15042 - DNA, 25 bp, Mus musculus
taaagtggaaccaccacagagaatc

SEQ ID NO: 15043 - DNA, 25 bp, Mus musculus
aagtggaaccaccacagagaatcaa

SEQ ID NO: 15044 - DNA, 25 bp, Mus musculus
ccaccacagagaatcaatgggcaac

SEQ ID NO: 15045 - DNA, 25 bp, Mus musculus
actttttcagcagaatatcaaaaag

SEQ ID NO: 15046 - DNA, 25 bp, Mus musculus
gcccaaatgtcaacatattacaagg

SEQ ID NO: 15047 - DNA, 25 bp, Mus musculus
cctatgatgctgcccgtagcctcag

SEQ ID NO: 15048 - DNA, 25 bp, Mus musculus
tgatgctgcccgtagcctcaggtga

SEQ ID NO: 15049 - DNA, 25 bp, Mus musculus
atgctgcccgtagcctcaggtgaag

SEQ ID NO: 15050 - DNA, 25 bp, Mus musculus
gctgcccgtagcctcaggtgaagac

SEQ ID NO: 15051 - DNA, 25 bp, Mus musculus
tgcccgtagcctcaggtgaagacaa

SEQ ID NO: 15052 - DNA, 25 bp, Mus musculus
cgtagcctcaggtgaagacaatcta

SEQ ID NO: 15053 - DNA, 25 bp, Mus musculus
aagacaatctaaggcctcctgagga

SEQ ID NO: 15054 - DNA, 25 bp, Mus musculus
gacaatctaaggcctcctgaggatg

SEQ ID NO: 15055 - DNA, 25 bp, Mus musculus
tggttcctgtggagcaatgctttcg

SEQ ID NO: 15056 - DNA, 25 bp, Mus musculus
ggttcctgtggagcaatgctttcgc

SEQ ID NO: 15057 - DNA, 25 bp, Mus musculus
gtccgcagatggactccggctgcag

SEQ ID NO: 15058 - DNA, 25 bp, Mus musculus
ggtatccagggacccaaatgcttat

SEQ ID NO: 15059 - DNA, 25 bp, Mus musculus
atccagggacccaaatgcttatcct

SEQ ID NO: 15060 - DNA, 25 bp, Mus musculus
gacccaaatgcttatcctcaagaac

SEQ ID NO: 15061 - DNA, 25 bp, Mus musculus
cccaaatgcttatcctcaagaacat

SEQ ID NO: 15062 - DNA, 25 bp, Mus musculus
ccaaatgcttatcctcaagaacatc

SEQ ID NO: 15063 - DNA, 25 bp, Mus musculus
aatgcttatcctcaagaacatctgt

SEQ ID NO: 15064 - DNA, 25 bp, Mus musculus
tgcttatcctcaagaacatctgtat

SEQ ID NO: 15065 - DNA, 25 bp, Mus musculus
ttatcctcaagaacatctgtatgtc

SEQ ID NO: 15066 - DNA, 25 bp, Mus musculus
tatcctcaagaacatctgtatgtca

SEQ ID NO: 15067 - DNA, 25 bp, Mus musculus
ttcctgtggagcaatgctttcgccc

SEQ ID NO: 15068 - DNA, 25 bp, Mus musculus
gctttcgcccgcaatgagcttcctc

SEQ ID NO: 15069 - DNA, 25 bp, Mus musculus
ttcgcccgcaatgagcttcctcaaa

SEQ ID NO: 15070 - DNA, 25 bp, Mus musculus
tcgcccgcaatgagcttcctcaaaa

SEQ ID NO: 15071 - DNA, 25 bp, Mus musculus
cccgcaatgagcttcctcaaaagct

SEQ ID NO: 15072 - DNA, 25 bp, Mus musculus
cgcaatgagcttcctcaaaagcttc

SEQ ID NO: 15073 - DNA, 25 bp, Mus musculus
gcaatgagcttcctcaaaagcttcc

SEQ ID NO: 15074 - DNA, 25 bp, Mus musculus
aatgagcttcctcaaaagcttcccg

SEQ ID NO: 15075 - DNA, 25 bp, Mus musculus
tgggtgccctacaccatgacccaga

SEQ ID NO: 15076 - DNA, 25 bp, Mus musculus
acccagagcactggccgaatcctga

SEQ ID NO: 15077 - DNA, 25 bp, Mus musculus
aagccagccctgagactcaggttcc

SEQ ID NO: 15078 - DNA, 25 bp, Mus musculus
cacttcagctagaatccaaatctgc

SEQ ID NO: 15079 - DNA, 25 bp, Mus musculus
agctagaatccaaatctgccctagg

SEQ ID NO: 15080 - DNA, 25 bp, Mus musculus
gagtctacatcaagattgtgtcacg

SEQ ID NO: 15081 - DNA, 25 bp, Mus musculus
tgtcacgctgatatagaaggcacgt

SEQ ID NO: 15082 - DNA, 25 bp, Mus musculus
tggtaacatctgcacatcgctgcag

SEQ ID NO: 15083 - DNA, 25 bp, Mus musculus
cacatcgctgcaggagggcacccgg

SEQ ID NO: 15084 - DNA, 25 bp, Mus musculus
cacccggattcagatgaaagcctcg

SEQ ID NO: 15085 - DNA, 25 bp, Mus musculus
atgtgagcctactttgtcacaattc

SEQ ID NO: 15086 - DNA, 25 bp, Mus musculus
gcctactttgtcacaattcctaaat

SEQ ID NO: 15087 - DNA, 25 bp, Mus musculus
atcctgagacctttgaccctgaaag

SEQ ID NO: 15088 - DNA, 25 bp, Mus musculus
ttgtcacaattcctaaatgtttaat

SEQ ID NO: 15089 - DNA, 25 bp, Mus musculus
ggttcacagcagaggcccggcttca

SEQ ID NO: 15090 - DNA, 25 bp, Mus musculus
ggcttcagcggaggccgttcacata

SEQ ID NO: 15091 - DNA, 25 bp, Mus musculus
tcacatacctgccctttggagctgg

SEQ ID NO: 15092 - DNA, 25 bp, Mus musculus
gcctgctggtggtcaagctgacaat

SEQ ID NO: 15093 - DNA, 25 bp, Mus musculus
tgacaatactccaggtcctacacaa

SEQ ID NO: 15094 - DNA, 25 bp, Mus musculus
tacacaagttccgctttgaagccag

SEQ ID NO: 15095 - DNA, 25 bp, Mus musculus
gctttgaagccagccctgagactca

SEQ ID NO: 15096 - DNA, 25 bp, Mus musculus
tggcccagaggcaacggagcccgat

SEQ ID NO: 15097 - DNA, 25 bp, Mus musculus
aggcaacggagcccgatgatgtcat

SEQ ID NO: 15098 - DNA, 25 bp, Mus musculus
tatattcccatggattaaaggatat

SEQ ID NO: 15099 - DNA, 25 bp, Mus musculus
tattcccatggattaaaggatatgg

SEQ ID NO: 15100 - DNA, 25 bp, Mus musculus
gtggtcaagctcagtcagggactgt

SEQ ID NO: 15101 - DNA, 25 bp, Mus musculus
ggtcaagctcagtcagggactgtcg

SEQ ID NO: 15102 - DNA, 25 bp, Mus musculus
aagctcagtcagggactgtcgagtc

SEQ ID NO: 15103 - DNA, 25 bp, Mus musculus
gctcagtcagggactgtcgagtcag

SEQ ID NO: 15104 - DNA, 25 bp, Mus musculus
tcagtcagggactgtcgagtcagcc

SEQ ID NO: 15105 - DNA, 25 bp, Mus musculus
actgtcgagtcagccagatttgcta

SEQ ID NO: 15106 - DNA, 25 bp, Mus musculus
tgtcgagtcagccagatttgctatg

SEQ ID NO: 15107 - DNA, 25 bp, Mus musculus
gagtcagccagatttgctatgtcca

SEQ ID NO: 15108 - DNA, 25 bp, Mus musculus
gcaacggagcccgatgatgtcatcg

SEQ ID NO: 15109 - DNA, 25 bp, Mus musculus
cagatttgctatgtccatctgcatg

SEQ ID NO: 15110 - DNA, 25 bp, Mus musculus
gcttcttcgaggcagctatgcgtag

SEQ ID NO: 15111 - DNA, 25 bp, Mus musculus
tttgagaagccttcagcgaggcagg

SEQ ID NO: 15112 - DNA, 25 bp, Mus musculus
tgagaagccttcagcgaggcaggag

SEQ ID NO: 15113 - DNA, 25 bp, Mus musculus
agaagccttcagcgaggcaggagag

SEQ ID NO: 15114 - DNA, 25 bp, Mus musculus
aagccttcagcgaggcaggagagtg

SEQ ID NO: 15115 - DNA, 25 bp, Mus musculus
cttcagcgaggcaggagagtgttat

SEQ ID NO: 15116 - DNA, 25 bp, Mus musculus
gttatattcccatggattaaaggat

SEQ ID NO: 15117 - DNA, 25 bp, Mus musculus
agcccacatcaattgccagagcccg

SEQ ID NO: 15118 - DNA, 25 bp, Mus musculus
ctgagccactaataactgggaccct

SEQ ID NO: 15119 - DNA, 25 bp, Mus musculus
agctctgggcatttgatgcagcaca

SEQ ID NO: 15120 - DNA, 25 bp, Mus musculus
agtgcatccaattccactacggggg

SEQ ID NO: 15121 - DNA, 25 bp, Mus musculus
actgtggagtccctggtgatgggta

SEQ ID NO: 15122 - DNA, 25 bp, Mus musculus
tccctggtgatgggtacgaggaact

SEQ ID NO: 15123 - DNA, 25 bp, Mus musculus
ggtgccagtctgcaagccagagggt

SEQ ID NO: 15124 - DNA, 25 bp, Mus musculus
ccactgtttgtcacagcgcagtcca

SEQ ID NO: 15125 - DNA, 25 bp, Mus musculus
tttgtcacagcgcagtccagcttag

SEQ ID NO: 15126 - DNA, 25 bp, Mus musculus
gtcacagcgcagtccagcttagatg

SEQ ID NO: 15127 - DNA, 25 bp, Mus musculus
acagcgcagtccagcttagatgatc

SEQ ID NO: 15128 - DNA, 25 bp, Mus musculus
cagtccagcttagatgatctggacc

SEQ ID NO: 15129 - DNA, 25 bp, Mus musculus
attactacaacggcgcttccatggc

SEQ ID NO: 15130 - DNA, 25 bp, Mus musculus
actacaacggcgcttccatggcctg

SEQ ID NO: 15131 - DNA, 25 bp, Mus musculus
acaacttcatctctgagaaggactg

SEQ ID NO: 15132 - DNA, 25 bp, Mus musculus
tcatctctgagaaggactgtctgca

SEQ ID NO: 15133 - DNA, 25 bp, Mus musculus
actgtctgcagacatgtcggaccat

SEQ ID NO: 15134 - DNA, 25 bp, Mus musculus
agacatgtcggaccatagcggcctg

SEQ ID NO: 15135 - DNA, 25 bp, Mus musculus
tagcggcctgcaatctccccatagt

SEQ ID NO: 15136 - DNA, 25 bp, Mus musculus
gagccttcataaagctctgggcatt

SEQ ID NO: 15137 - DNA, 25 bp, Mus musculus
agacgaacccaggagctccgcacgg

SEQ ID NO: 15138 - DNA, 25 bp, Mus musculus
gacgaacccaggagctccgcacggc

SEQ ID NO: 15139 - DNA, 25 bp, Mus musculus
gtcactgtggaccgagaccgcttca

SEQ ID NO: 15140 - DNA, 25 bp, Mus musculus
tcactgtggaccgagaccgcttcat

SEQ ID NO: 15141 - DNA, 25 bp, Mus musculus
actgtggaccgagaccgcttcatgg

SEQ ID NO: 15142 - DNA, 25 bp, Mus musculus
ctgtggaccgagaccgcttcatgga

SEQ ID NO: 15143 - DNA, 25 bp, Mus musculus
tggaccgagaccgcttcatggatga

SEQ ID NO: 15144 - DNA, 25 bp, Mus musculus
ggaaacacagcgccatcctggcctc

SEQ ID NO: 15145 - DNA, 25 bp, Mus musculus
gagctcatgtcggacattaagaaga

SEQ ID NO: 15146 - DNA, 25 bp, Mus musculus
gcaaacaaagttcgctccaagctaa

SEQ ID NO: 15147 - DNA, 25 bp, Mus musculus
aagttcgctccaagctaaagagcat

SEQ ID NO: 15148 - DNA, 25 bp, Mus musculus
gttcgctccaagctaaagagcatcg

SEQ ID NO: 15149 - DNA, 25 bp, Mus musculus
gaacccaggagctccgcacggccaa

SEQ ID NO: 15150 - DNA, 25 bp, Mus musculus
gagctccgcacggccaaggacagcg

SEQ ID NO: 15151 - DNA, 25 bp, Mus musculus
agctccgcacggccaaggacagcga

SEQ ID NO: 15152 - DNA, 25 bp, Mus musculus
gatgatgtcactgtcactgtggacc

SEQ ID NO: 15153 - DNA, 25 bp, Mus musculus
atgatgtcactgtcactgtggaccg

SEQ ID NO: 15154 - DNA, 25 bp, Mus musculus
gatgtcactgtcactgtggaccgag

SEQ ID NO: 15155 - DNA, 25 bp, Mus musculus
atgtcactgtcactgtggaccgaga

SEQ ID NO: 15156 - DNA, 25 bp, Mus musculus
actgtcactgtggaccgagaccgct

SEQ ID NO: 15157 - DNA, 25 bp, Mus musculus
ttcactgacttcatgtgcatggcgc

SEQ ID NO: 15158 - DNA, 25 bp, Mus musculus
tccttctatgcgctgtcggcactta

SEQ ID NO: 15159 - DNA, 25 bp, Mus musculus
cccaacaatagcactggtattcaga

SEQ ID NO: 15160 - DNA, 25 bp, Mus musculus
aggcagagtctccccaacatgcaag

SEQ ID NO: 15161 - DNA, 25 bp, Mus musculus
agtctccccaacatgcaagatacct

SEQ ID NO: 15162 - DNA, 25 bp, Mus musculus
cccaacatgcaagatacctatgaac

SEQ ID NO: 15163 - DNA, 25 bp, Mus musculus
gatacctatgaactgcttggaaact

SEQ ID NO: 15164 - DNA, 25 bp, Mus musculus
ctgcttggaaactcccagctagctc

SEQ ID NO: 15165 - DNA, 25 bp, Mus musculus
aaaggctacgctagtcacagtgaga

SEQ ID NO: 15166 - DNA, 25 bp, Mus musculus
tacgctagtcacagtgagacttaca

SEQ ID NO: 15167 - DNA, 25 bp, Mus musculus
tcttgaacatgcgttccagtcccgt

SEQ ID NO: 15168 - DNA, 25 bp, Mus musculus
acataggttcatgcaggtgatgatt

SEQ ID NO: 15169 - DNA, 25 bp, Mus musculus
atgaacaagcctctaatcactgtta

SEQ ID NO: 15170 - DNA, 25 bp, Mus musculus
ctcaactcctgtgccaatccgtttc

SEQ ID NO: 15171 - DNA, 25 bp, Mus musculus
ctctatgctattttcaccaaggcct

SEQ ID NO: 15172 - DNA, 25 bp, Mus musculus
ctcagcaagtttggcatctgcaaac

SEQ ID NO: 15173 - DNA, 25 bp, Mus musculus
ggcatctgcaaacgccaggcccagg

SEQ ID NO: 15174 - DNA, 25 bp, Mus musculus
cgccaggcccaggcctatcagggtc

SEQ ID NO: 15175 - DNA, 25 bp, Mus musculus
cagagagtctgtcccaacaatagca

SEQ ID NO: 15176 - DNA, 25 bp, Mus musculus
gtctgtcccaacaatagcactggta

SEQ ID NO: 15177 - DNA, 25 bp, Mus musculus
ttgtattcgcatcatcacaccgcct

SEQ ID NO: 15178 - DNA, 25 bp, Mus musculus
gcaactgactacactcatttgaaca

SEQ ID NO: 15179 - DNA, 25 bp, Mus musculus
tgcttatcctcaaacagatagtgtt

SEQ ID NO: 15180 - DNA, 25 bp, Mus musculus
ttatcctcaaacagatagtgttaat

SEQ ID NO: 15181 - DNA, 25 bp, Mus musculus
tagtgttaatccacacacctagaga

SEQ ID NO: 15182 - DNA, 25 bp, Mus musculus
tgttaatccacacacctagagagcg

SEQ ID NO: 15183 - DNA, 25 bp, Mus musculus
taatccacacacctagagagcgacc

SEQ ID NO: 15184 - DNA, 25 bp, Mus musculus
tccacacacctagagagcgaccctg

SEQ ID NO: 15185 - DNA, 25 bp, Mus musculus
cacctagagagcgaccctgagtcct

SEQ ID NO: 15186 - DNA, 25 bp, Mus musculus
gagagcgaccctgagtcctaataat

SEQ ID NO: 15187 - DNA, 25 bp, Mus musculus
agcgaccctgagtcctaataatcgt

SEQ ID NO: 15188 - DNA, 25 bp, Mus musculus
gaccctgagtcctaataatcgtatc

SEQ ID NO: 15189 - DNA, 25 bp, Mus musculus
actgactacactcatttgaacactg

SEQ ID NO: 15190 - DNA, 25 bp, Mus musculus
gactacactcatttgaacactgcct

SEQ ID NO: 15191 - DNA, 25 bp, Mus musculus
tacactcatttgaacactgcctaag

SEQ ID NO: 15192 - DNA, 25 bp, Mus musculus
ttgaacactgcctaagcatgcttat

SEQ ID NO: 15193 - DNA, 25 bp, Mus musculus
aacactgcctaagcatgcttatcct

SEQ ID NO: 15194 - DNA, 25 bp, Mus musculus
actgcctaagcatgcttatcctcaa

SEQ ID NO: 15195 - DNA, 25 bp, Mus musculus
taagcatgcttatcctcaaacagat

SEQ ID NO: 15196 - DNA, 25 bp, Mus musculus
gcatgcttatcctcaaacagatagt

SEQ ID NO: 15197 - DNA, 25 bp, Mus musculus
tgaaactcctggccctgaagttatt

SEQ ID NO: 15198 - DNA, 25 bp, Mus musculus
tcctggccctgaagttattgtcaac

SEQ ID NO: 15199 - DNA, 25 bp, Mus musculus
agtttcagctaaggctgcagagaag

SEQ ID NO: 15200 - DNA, 25 bp, Mus musculus
aggagatcttcttcaggaggtcatg

SEQ ID NO: 15201 - DNA, 25 bp, Mus musculus
tgccaaagaacgacaactggatgaa

SEQ ID NO: 15202 - DNA, 25 bp, Mus musculus
acaactggatgaagccgtgggcaac

SEQ ID NO: 15203 - DNA, 25 bp, Mus musculus
gctagactggcttctcgctaacctg

SEQ ID NO: 15204 - DNA, 25 bp, Mus musculus
ctggcttctcgctaacctgtaagct

SEQ ID NO: 15205 - DNA, 25 bp, Mus musculus
atttaccaatacatctgagcagttg

SEQ ID NO: 15206 - DNA, 25 bp, Mus musculus
caatacatctgagcagttgcactgt

SEQ ID NO: 15207 - DNA, 25 bp, Mus musculus
atctgagcagttgcactgtgaaaat

SEQ ID NO: 15208 - DNA, 25 bp, Mus musculus
gtgccctcctgggcaacatgaataa

SEQ ID NO: 15209 - DNA, 25 bp, Mus musculus
taacttgcagaagcagctgcaggct

SEQ ID NO: 15210 - DNA, 25 bp, Mus musculus
tgtcctgcaatggattgcagcctct

SEQ ID NO: 15211 - DNA, 25 bp, Mus musculus
agcctctcaattcaatgtgcccatg

SEQ ID NO: 15212 - DNA, 25 bp, Mus musculus
tcaattcaatgtgcccatgctctac

SEQ ID NO: 15213 - DNA, 25 bp, Mus musculus
caatgtgcccatgctctacttcatg

SEQ ID NO: 15214 - DNA, 25 bp, Mus musculus
gcccatgctctacttcatgggagac

SEQ ID NO: 15215 - DNA, 25 bp, Mus musculus
gaagctccctgaagtttcagctaag

SEQ ID NO: 15216 - DNA, 25 bp, Mus musculus
ccctgaagtttcagctaaggctgca

SEQ ID NO: 15217 - DNA, 25 bp, Mus musculus
tacctgcgagcccgacagaaggagc

SEQ ID NO: 15218 - DNA, 25 bp, Mus musculus
ctgcgagcccgacagaaggagcaga

SEQ ID NO: 15219 - DNA, 25 bp, Mus musculus
ttgagcactaacagaacatgtcgcc

SEQ ID NO: 15220 - DNA, 25 bp, Mus musculus
ctaacagaacatgtcgccgtggtgc

SEQ ID NO: 15221 - DNA, 25 bp, Mus musculus
taacagaacatgtcgccgtggtgca

SEQ ID NO: 15222 - DNA, 25 bp, Mus musculus
acagaacatgtcgccgtggtgcact

SEQ ID NO: 15223 - DNA, 25 bp, Mus musculus
cagaacatgtcgccgtggtgcactc

SEQ ID NO: 15224 - DNA, 25 bp, Mus musculus
agaacatgtcgccgtggtgcactct

SEQ ID NO: 15225 - DNA, 25 bp, Mus musculus
aacatgtcgccgtggtgcactctga

SEQ ID NO: 15226 - DNA, 25 bp, Mus musculus
acatgtcgccgtggtgcactctgag

SEQ ID NO: 15227 - DNA, 25 bp, Mus musculus
catgtcgccgtggtgcactctgaga

SEQ ID NO: 15228 - DNA, 25 bp, Mus musculus
gtgcactctgagacccacagatgag

SEQ ID NO: 15229 - DNA, 25 bp, Mus musculus
tgcgagcccgacagaaggagcagag

SEQ ID NO: 15230 - DNA, 25 bp, Mus musculus
gcactctgagacccacagatgagct

SEQ ID NO: 15231 - DNA, 25 bp, Mus musculus
aggagcagagcacacccttgagcac

SEQ ID NO: 15232 - DNA, 25 bp, Mus musculus
ggagcagagcacacccttgagcact

SEQ ID NO: 15233 - DNA, 25 bp, Mus musculus
agcagagcacacccttgagcactaa

SEQ ID NO: 15234 - DNA, 25 bp, Mus musculus
acacccttgagcactaacagaacat

SEQ ID NO: 15235 - DNA, 25 bp, Mus musculus
cacccttgagcactaacagaacatg

SEQ ID NO: 15236 - DNA, 25 bp, Mus musculus
acccttgagcactaacagaacatgt

SEQ ID NO: 15237 - DNA, 25 bp, Mus musculus
ccttgagcactaacagaacatgtcg

SEQ ID NO: 15238 - DNA, 25 bp, Mus musculus
tccagcacaccagatctacttctta

SEQ ID NO: 15239 - DNA, 25 bp, Mus musculus
acaccagatctacttcttagcccgc

SEQ ID NO: 15240 - DNA, 25 bp, Mus musculus
acaactcatgctgagtcacttccct

SEQ ID NO: 15241 - DNA, 25 bp, Mus musculus
catgctgagtcacttccctcttcct

SEQ ID NO: 15242 - DNA, 25 bp, Mus musculus
tcccaacagtccaagtctccactta

SEQ ID NO: 15243 - DNA, 25 bp, Mus musculus
cagtccaagtctccacttatcagct

SEQ ID NO: 15244 - DNA, 25 bp, Mus musculus
aagtctccacttatcagctctccat

SEQ ID NO: 15245 - DNA, 25 bp, Mus musculus
ccacttatcagctctccatgatctg

SEQ ID NO: 15246 - DNA, 25 bp, Mus musculus
tctccatgatctgtgatctgtgcta

SEQ ID NO: 15247 - DNA, 25 bp, Mus musculus
gtgatctgtgctagtggactctata

SEQ ID NO: 15248 - DNA, 25 bp, Mus musculus
tctgatttctatgtctacagacttg

SEQ ID NO: 15249 - DNA, 25 bp, Mus musculus
agacttgcctagtatgtatggctca

SEQ ID NO: 15250 - DNA, 25 bp, Mus musculus
ccaggtgtcaccacttatgttgaga

SEQ ID NO: 15251 - DNA, 25 bp, Mus musculus
ctgctggaaaccaggccattggtag

SEQ ID NO: 15252 - DNA, 25 bp, Mus musculus
gaaaccaggccattggtagctgctc

SEQ ID NO: 15253 - DNA, 25 bp, Mus musculus
ttggtagctgctcacacccttcctt

SEQ ID NO: 15254 - DNA, 25 bp, Mus musculus
gttgttctccaaagctccaaggcat

SEQ ID NO: 15255 - DNA, 25 bp, Mus musculus
ctccaaagctccaaggcatgttctt

SEQ ID NO: 15256 - DNA, 25 bp, Mus musculus
agctccaaggcatgttcttcttccc

SEQ ID NO: 15257 - DNA, 25 bp, Mus musculus
atcaactgtctgttttgatttctgg

SEQ ID NO: 15258 - DNA, 25 bp, Mus musculus
cgcacccgcactatgaagatcgtta

SEQ ID NO: 15259 - DNA, 25 bp, Mus musculus
ttgactaccagccggccaagcaagg

SEQ ID NO: 15260 - DNA, 25 bp, Mus musculus
gtcatcttcctgctcatcatcatct

SEQ ID NO: 15261 - DNA, 25 bp, Mus musculus
ttcctgctcatcatcatcttcttga

SEQ ID NO: 15262 - DNA, 25 bp, Mus musculus
atcatcttcttgacagtcctactac

SEQ ID NO: 15263 - DNA, 25 bp, Mus musculus
ttcttgacagtcctactactcaagc

SEQ ID NO: 15264 - DNA, 25 bp, Mus musculus
ctccgcaagcgccatcgcaagcata

SEQ ID NO: 15265 - DNA, 25 bp, Mus musculus
aagcgccatcgcaagcatacacagc

SEQ ID NO: 15266 - DNA, 25 bp, Mus musculus
catcgcaagcatacacagcagcggg

SEQ ID NO: 15267 - DNA, 25 bp, Mus musculus
gactacgggcatcctgtctacatcg

SEQ ID NO: 15268 - DNA, 25 bp, Mus musculus
gggcatcctgtctacatcgtccagg

SEQ ID NO: 15269 - DNA, 25 bp, Mus musculus
cagagcccggcgaacatctactaca

SEQ ID NO: 15270 - DNA, 25 bp, Mus musculus
accagccggccaagcaaggagtcag

SEQ ID NO: 15271 - DNA, 25 bp, Mus musculus
gagtcagacaacactgtcaagacag

SEQ ID NO: 15272 - DNA, 25 bp, Mus musculus
gacaacactgtcaagacagccacac

SEQ ID NO: 15273 - DNA, 25 bp, Mus musculus
aagacagccacacaggctcctggtc

SEQ ID NO: 15274 - DNA, 25 bp, Mus musculus
gactctgacagcttcttcaactcca

SEQ ID NO: 15275 - DNA, 25 bp, Mus musculus
gacagcttcttcaactccaaggtag

SEQ ID NO: 15276 - DNA, 25 bp, Mus musculus
aactccaaggtagcattgttcgcag

SEQ ID NO: 15277 - DNA, 25 bp, Mus musculus
ggctgtgtcatcttcctgctcatca

SEQ ID NO: 15278 - DNA, 25 bp, Mus musculus
gcccgtgagctgcaggagagcaaga

SEQ ID NO: 15279 - DNA, 25 bp, Mus musculus
aatgagctggcccttatgagccagg

SEQ ID NO: 15280 - DNA, 25 bp, Mus musculus
gacgccaggacaagccttccactct

SEQ ID NO: 15281 - DNA, 25 bp, Mus musculus
gccaggacaagccttccactcttag

SEQ ID NO: 15282 - DNA, 25 bp, Mus musculus
agccttccactcttaggacagagtt

SEQ ID NO: 15283 - DNA, 25 bp, Mus musculus
ccactcttaggacagagttgaacgt

SEQ ID NO: 15284 - DNA, 25 bp, Mus musculus
tgaacgtggctctgtggacctagag

SEQ ID NO: 15285 - DNA, 25 bp, Mus musculus
acgtggctctgtggacctagaggaa

SEQ ID NO: 15286 - DNA, 25 bp, Mus musculus
ggagatcccttcctgttgactacag

SEQ ID NO: 15287 - DNA, 25 bp, Mus musculus
gatcccttcctgttgactacagggc

SEQ ID NO: 15288 - DNA, 25 bp, Mus musculus
ctgttgactacagggcccaggactg

SEQ ID NO: 15289 - DNA, 25 bp, Mus musculus
ttgactacagggcccaggactggga

SEQ ID NO: 15290 - DNA, 25 bp, Mus musculus
tttggcagccacctggatctggagc

SEQ ID NO: 15291 - DNA, 25 bp, Mus musculus
agccacctggatctggagcgcatgc

SEQ ID NO: 15292 - DNA, 25 bp, Mus musculus
cacctggatctggagcgcatgcaag

SEQ ID NO: 15293 - DNA, 25 bp, Mus musculus
ctggacaatatttcctatcgcaggg

SEQ ID NO: 15294 - DNA, 25 bp, Mus musculus
aatatttcctatcgcagggaatctg

SEQ ID NO: 15295 - DNA, 25 bp, Mus musculus
tcctatcgcagggaatctgccatct

SEQ ID NO: 15296 - DNA, 25 bp, Mus musculus
agggaatctgccatctgacctccag

SEQ ID NO: 15297 - DNA, 25 bp, Mus musculus
tattcccgcaagagcctctgccagg

SEQ ID NO: 15298 - DNA, 25 bp, Mus musculus
gactcccaatgtacagtaggcgttt

SEQ ID NO: 15299 - DNA, 25 bp, Mus musculus
atttttgatccccttgactgctggc

SEQ ID NO: 15300 - DNA, 25 bp, Mus musculus
tgacacatttacgacacgggtgtca

SEQ ID NO: 15301 - DNA, 25 bp, Mus musculus
ctctgagcacccttgagaggctcta

SEQ ID NO: 15302 - DNA, 25 bp, Mus musculus
gcacccttgagaggctctaccaggg

SEQ ID NO: 15303 - DNA, 25 bp, Mus musculus
actctagcacagccccagatgacat

SEQ ID NO: 15304 - DNA, 25 bp, Mus musculus
gcacagccccagatgacatttccag

SEQ ID NO: 15305 - DNA, 25 bp, Mus musculus
agactgcagaatgtccatggagctg

SEQ ID NO: 15306 - DNA, 25 bp, Mus musculus
gtccatggagctgtctagtcgacag

SEQ ID NO: 15307 - DNA, 25 bp, Mus musculus
aggactacattgccagcttcctgct

SEQ ID NO: 15308 - DNA, 25 bp, Mus musculus
tctctcacttcatctagcaagtctg

SEQ ID NO: 15309 - DNA, 25 bp, Mus musculus
acttcatctagcaagtctgcccctc

SEQ ID NO: 15310 - DNA, 25 bp, Mus musculus
tgctggccctctaaatgcatggcct

SEQ ID NO: 15311 - DNA, 25 bp, Mus musculus
ccctctaaatgcatggcctttgttc

SEQ ID NO: 15312 - DNA, 25 bp, Mus musculus
aaatgcatggcctttgttccaggtc

SEQ ID NO: 15313 - DNA, 25 bp, Mus musculus
cccttgtcatccttaagttgaatct

SEQ ID NO: 15314 - DNA, 25 bp, Mus musculus
tcatccttaagttgaatctaataag

SEQ ID NO: 15315 - DNA, 25 bp, Mus musculus
taataagccataggtctggggacag

SEQ ID NO: 15316 - DNA, 25 bp, Mus musculus
atgtccaccatccaaaatgctgata

SEQ ID NO: 15317 - DNA, 25 bp, Mus musculus
aaaccatgacacatttacgacacgg

SEQ ID NO: 15318 - DNA, 25 bp, Mus musculus
gctattggaccatgaacccagtcat

SEQ ID NO: 15319 - DNA, 25 bp, Mus musculus
tattggaccatgaacccagtcatca

SEQ ID NO: 15320 - DNA, 25 bp, Mus musculus
tggactgccgtcatgaatacaccaa

SEQ ID NO: 15321 - DNA, 25 bp, Mus musculus
gactgccgtcatgaatacaccaact

SEQ ID NO: 15322 - DNA, 25 bp, Mus musculus
ctgccgtcatgaatacaccaacttg

SEQ ID NO: 15323 - DNA, 25 bp, Mus musculus
cgtcatgaatacaccaacttgccca

SEQ ID NO: 15324 - DNA, 25 bp, Mus musculus
tcatgaatacaccaacttgcccatc

SEQ ID NO: 15325 - DNA, 25 bp, Mus musculus
atgaatacaccaacttgcccatcca

SEQ ID NO: 15326 - DNA, 25 bp, Mus musculus
cagtgtgtcagacctgggttccaca

SEQ ID NO: 15327 - DNA, 25 bp, Mus musculus
gtgtcagacctgggttccacaatta

SEQ ID NO: 15328 - DNA, 25 bp, Mus musculus
gtcagacctgggttccacaattacg

SEQ ID NO: 15329 - DNA, 25 bp, Mus musculus
acttttatgacgttatcagtctatt

SEQ ID NO: 15330 - DNA, 25 bp, Mus musculus
tcagcatcactctcctgcttcagtc

SEQ ID NO: 15331 - DNA, 25 bp, Mus musculus
catcactctcctgcttcagtcttgc

SEQ ID NO: 15332 - DNA, 25 bp, Mus musculus
tcactctcctgcttcagtcttgcag

SEQ ID NO: 15333 - DNA, 25 bp, Mus musculus
actctcctgcttcagtcttgcagat

SEQ ID NO: 15334 - DNA, 25 bp, Mus musculus
tctcctgcttcagtcttgcagatgt

SEQ ID NO: 15335 - DNA, 25 bp, Mus musculus
tcctgcttcagtcttgcagatgtcc

SEQ ID NO: 15336 - DNA, 25 bp, Mus musculus
ctgcttcagtcttgcagatgtcccg

SEQ ID NO: 15337 - DNA, 25 bp, Mus musculus
actggactgccgtcatgaatacacc

SEQ ID NO: 15338 - DNA, 25 bp, Mus musculus
gtttgaccttcacatcggttcatgg

SEQ ID NO: 15339 - DNA, 25 bp, Mus musculus
tgaccttcacatcggttcatgggtg

SEQ ID NO: 15340 - DNA, 25 bp, Mus musculus
ctcaaaccagggagcgtggcttagg

SEQ ID NO: 15341 - DNA, 25 bp, Mus musculus
ccctgatgtgtgacacgcctgccta

SEQ ID NO: 15342 - DNA, 25 bp, Mus musculus
tgtgtgacacgcctgcctaactaga

SEQ ID NO: 15343 - DNA, 25 bp, Mus musculus
atcactgtcccatggcgagaggtca

SEQ ID NO: 15344 - DNA, 25 bp, Mus musculus
actgtcccatggcgagaggtcagaa

SEQ ID NO: 15345 - DNA, 25 bp, Mus musculus
ccctgaagcaggacctggggacagc

SEQ ID NO: 15346 - DNA, 25 bp, Mus musculus
aatgaaaccttgcaggtcctgccac

SEQ ID NO: 15347 - DNA, 25 bp, Mus musculus
gaaaccttgcaggtcctgccacaga

SEQ ID NO: 15348 - DNA, 25 bp, Mus musculus
ttgcaggtcctgccacagaagcaag

SEQ ID NO: 15349 - DNA, 25 bp, Mus musculus
gtcctgccacagaagcaagaagcag

SEQ ID NO: 15350 - DNA, 25 bp, Mus musculus
aatggataatcgctcaggtggtaag

SEQ ID NO: 15351 - DNA, 25 bp, Mus musculus
taatcgctcaggtggtaagtggctt

SEQ ID NO: 15352 - DNA, 25 bp, Mus musculus
tcgatgatcgtcacctgcagcacac

SEQ ID NO: 15353 - DNA, 25 bp, Mus musculus
acctgcagcacacctttgtgagaaa

SEQ ID NO: 15354 - DNA, 25 bp, Mus musculus
catgggcatccttttcttccagata

SEQ ID NO: 15355 - DNA, 25 bp, Mus musculus
gggcatccttttcttccagatatag

SEQ ID NO: 15356 - DNA, 25 bp, Mus musculus
tttcttccagatataggtagcctca

SEQ ID NO: 15357 - DNA, 25 bp, Mus musculus
ggtagcctcaaaccagggagcgtgg

SEQ ID NO: 15358 - DNA, 25 bp, Mus musculus
cttgatcacagggatcccttggagc

SEQ ID NO: 15359 - DNA, 25 bp, Mus musculus
cacagggatcccttggagcaagtag

SEQ ID NO: 15360 - DNA, 25 bp, Mus musculus
accccagagaacttcagctgatttc

SEQ ID NO: 15361 - DNA, 25 bp, Mus musculus
gagaacttcagctgatttcatctgt

SEQ ID NO: 15362 - DNA, 25 bp, Mus musculus
ttcagctgatttcatctgtaacccg

SEQ ID NO: 15363 - DNA, 25 bp, Mus musculus
atggaggtctcagctggaagtctga

SEQ ID NO: 15364 - DNA, 25 bp, Mus musculus
gtctcagctggaagtctgagctctt

SEQ ID NO: 15365 - DNA, 25 bp, Mus musculus
tgacacctatactccaaacttgctg

SEQ ID NO: 15366 - DNA, 25 bp, Mus musculus
tccaaacttgctgccggctgaaggc

SEQ ID NO: 15367 - DNA, 25 bp, Mus musculus
ctgatgtcctgaggtggaagtccac

SEQ ID NO: 15368 - DNA, 25 bp, Mus musculus
gcaaaagttctctgcatgtgtgtac

SEQ ID NO: 15369 - DNA, 25 bp, Mus musculus
gttctctgcatgtgtgtacagatga

SEQ ID NO: 15370 - DNA, 25 bp, Mus musculus
gctgtgttagcatctctgggaatct

SEQ ID NO: 15371 - DNA, 25 bp, Mus musculus
ttagcatctctgggaatcttctctt

SEQ ID NO: 15372 - DNA, 25 bp, Mus musculus
ggaatcttctcttgccttggcctgg

SEQ ID NO: 15373 - DNA, 25 bp, Mus musculus
aaacctgggctcttggcacccatga

SEQ ID NO: 15374 - DNA, 25 bp, Mus musculus
ttggcacccatgatcccggtggaaa

SEQ ID NO: 15375 - DNA, 25 bp, Mus musculus
ccaggaattccaaacctgcagagga

SEQ ID NO: 15376 - DNA, 25 bp, Mus musculus
attccaaacctgcagaggaccccag

SEQ ID NO: 15377 - DNA, 25 bp, Mus musculus
cagaggaccccagagaacttcagct

SEQ ID NO: 15378 - DNA, 25 bp, Mus musculus
acccctcagggagcagcaggatgtg

SEQ ID NO: 15379 - DNA, 25 bp, Mus musculus
tgctttgaatcttccagggaagcct

SEQ ID NO: 15380 - DNA, 25 bp, Mus musculus
acctcaggctcctgcgagcagtgct

SEQ ID NO: 15381 - DNA, 25 bp, Mus musculus
ggctcctgcgagcagtgctcctgca

SEQ ID NO: 15382 - DNA, 25 bp, Mus musculus
cccagcctgttctgtactggggaca

SEQ ID NO: 15383 - DNA, 25 bp, Mus musculus
ctgttctgtactggggacagcagtc

SEQ ID NO: 15384 - DNA, 25 bp, Mus musculus
ccacagtgacactgggacagccctg

SEQ ID NO: 15385 - DNA, 25 bp, Mus musculus
gcactccacagtgtccctgtggtaa

SEQ ID NO: 15386 - DNA, 25 bp, Mus musculus
cacagtgtccctgtggtaactgttc

SEQ ID NO: 15387 - DNA, 25 bp, Mus musculus
tgtactgtctccttaactgatgtca

SEQ ID NO: 15388 - DNA, 25 bp, Mus musculus
gtctccttaactgatgtcacccagt

SEQ ID NO: 15389 - DNA, 25 bp, Mus musculus
ttaactgatgtcacccagttttaat

SEQ ID NO: 15390 - DNA, 25 bp, Mus musculus
gaagcctccgattcttccaggtttg

SEQ ID NO: 15391 - DNA, 25 bp, Mus musculus
aggtttgtcacccggagttagcatg

SEQ ID NO: 15392 - DNA, 25 bp, Mus musculus
gtcacccggagttagcatgtcccag

SEQ ID NO: 15393 - DNA, 25 bp, Mus musculus
gtcccaggctcgcagacaacactgc

SEQ ID NO: 15394 - DNA, 25 bp, Mus musculus
ggctcgcagacaacactgcagggtg

SEQ ID NO: 15395 - DNA, 25 bp, Mus musculus
ttctgttgagcatgggctctgaacc

SEQ ID NO: 15396 - DNA, 25 bp, Mus musculus
tgggctctgaacccacagaactgac

SEQ ID NO: 15397 - DNA, 25 bp, Mus musculus
ctgaacccacagaactgacaaagcc

SEQ ID NO: 15398 - DNA, 25 bp, Mus musculus
ttgggctgtcactgatgctgtctgg

SEQ ID NO: 15399 - DNA, 25 bp, Mus musculus
ggctgtcactgatgctgtctgggct

SEQ ID NO: 15400 - DNA, 25 bp, Mus musculus
cttgtgtgctgctcaaaccagccag

SEQ ID NO: 15401 - DNA, 25 bp, Mus musculus
gtgtgctgctcaaaccagccagacc

SEQ ID NO: 15402 - DNA, 25 bp, Mus musculus
tgtgctgctcaaaccagccagacca

SEQ ID NO: 15403 - DNA, 25 bp, Mus musculus
gtgctgctcaaaccagccagaccac

SEQ ID NO: 15404 - DNA, 25 bp, Mus musculus
tgctgctcaaaccagccagaccact

SEQ ID NO: 15405 - DNA, 25 bp, Mus musculus
gctgctcaaaccagccagaccactg

SEQ ID NO: 15406 - DNA, 25 bp, Mus musculus
tgctcaaaccagccagaccactgat

SEQ ID NO: 15407 - DNA, 25 bp, Mus musculus
gctcaaaccagccagaccactgatg

SEQ ID NO: 15408 - DNA, 25 bp, Mus musculus
ctcaaaccagccagaccactgatga

SEQ ID NO: 15409 - DNA, 25 bp, Mus musculus
tcaaaccagccagaccactgatgag

SEQ ID NO: 15410 - DNA, 25 bp, Mus musculus
gtctgggctccgcttgtgtgctgct

SEQ ID NO: 15411 - DNA, 25 bp, Mus musculus
aaaccagccagaccactgatgaggt

SEQ ID NO: 15412 - DNA, 25 bp, Mus musculus
ctgggctccgcttgtgtgctgctca

SEQ ID NO: 15413 - DNA, 25 bp, Mus musculus
tgggctccgcttgtgtgctgctcaa

SEQ ID NO: 15414 - DNA, 25 bp, Mus musculus
ggctccgcttgtgtgctgctcaaac

SEQ ID NO: 15415 - DNA, 25 bp, Mus musculus
ctccgcttgtgtgctgctcaaacca

SEQ ID NO: 15416 - DNA, 25 bp, Mus musculus
tccgcttgtgtgctgctcaaaccag

SEQ ID NO: 15417 - DNA, 25 bp, Mus musculus
ccgcttgtgtgctgctcaaaccagc

SEQ ID NO: 15418 - DNA, 25 bp, Mus musculus
cgcttgtgtgctgctcaaaccagcc

SEQ ID NO: 15419 - DNA, 25 bp, Mus musculus
tgtgcagactacacactgtgtatct

SEQ ID NO: 15420 - DNA, 25 bp, Mus musculus
cagactacacactgtgtatctcctc

SEQ ID NO: 15421 - DNA, 25 bp, Mus musculus
atctcctcgagagactttccacaca

SEQ ID NO: 15422 - DNA, 25 bp, Mus musculus
tctcctcgagagactttccacacag

SEQ ID NO: 15423 - DNA, 25 bp, Mus musculus
cctcgagagactttccacacaggaa

SEQ ID NO: 15424 - DNA, 25 bp, Mus musculus
tcgagagactttccacacaggaact

SEQ ID NO: 15425 - DNA, 25 bp, Mus musculus
cgagagactttccacacaggaactt

SEQ ID NO: 15426 - DNA, 25 bp, Mus musculus
ttctcaaaaatacactctccttcca

SEQ ID NO: 15427 - DNA, 25 bp, Mus musculus
tctcaaaaatacactctccttccat

SEQ ID NO: 15428 - DNA, 25 bp, Mus musculus
ccttccatctccggtcattgctgtc

SEQ ID NO: 15429 - DNA, 25 bp, Mus musculus
cttccatctccggtcattgctgtca

SEQ ID NO: 15430 - DNA, 25 bp, Mus musculus
cacttccaatactgagaaaagacaa

SEQ ID NO: 15431 - DNA, 25 bp, Mus musculus
gactacacactgtgtatctcctcga

SEQ ID NO: 15432 - DNA, 25 bp, Mus musculus
actacacactgtgtatctcctcgag

SEQ ID NO: 15433 - DNA, 25 bp, Mus musculus
tacacactgtgtatctcctcgagag

SEQ ID NO: 15434 - DNA, 25 bp, Mus musculus
cactgtgtatctcctcgagagactt

SEQ ID NO: 15435 - DNA, 25 bp, Mus musculus
ctgtgtatctcctcgagagactttc

SEQ ID NO: 15436 - DNA, 25 bp, Mus musculus
tgtgtatctcctcgagagactttcc

SEQ ID NO: 15437 - DNA, 25 bp, Mus musculus
tgtatctcctcgagagactttccac

SEQ ID NO: 15438 - DNA, 25 bp, Mus musculus
gtatctcctcgagagactttccaca

SEQ ID NO: 15439 - DNA, 25 bp, Mus musculus
attatatgtaactccacaatgtctt

SEQ ID NO: 15440 - DNA, 25 bp, Mus musculus
tgtaactccacaatgtcttctgttt

SEQ ID NO: 15441 - DNA, 25 bp, Mus musculus
atttcactgcgccaacactttctct

SEQ ID NO: 15442 - DNA, 25 bp, Mus musculus
ctgcgccaacactttctctttgtac

SEQ ID NO: 15443 - DNA, 25 bp, Mus musculus
caacactttctctttgtacatattc

SEQ ID NO: 15444 - DNA, 25 bp, Mus musculus
tttctctttgtacatattcgtgcca

SEQ ID NO: 15445 - DNA, 25 bp, Mus musculus
tttgtacatattcgtgccaaccttc

SEQ ID NO: 15446 - DNA, 25 bp, Mus musculus
catattcgtgccaaccttctgaaaa

SEQ ID NO: 15447 - DNA, 25 bp, Mus musculus
ctgtgaataaccatctgctgcttgg

SEQ ID NO: 15448 - DNA, 25 bp, Mus musculus
ggtgaacacatgccttttagcagga

SEQ ID NO: 15449 - DNA, 25 bp, Mus musculus
tgaatgttccctacttaaaactgtg

SEQ ID NO: 15450 - DNA, 25 bp, Mus musculus
cattccaatctgtgaatttttgtgt

SEQ ID NO: 15451 - DNA, 25 bp, Mus musculus
tccacaatgtcttctgtttagtgta

SEQ ID NO: 15452 - DNA, 25 bp, Mus musculus
atgtcttctgtttagtgtatggaaa

SEQ ID NO: 15453 - DNA, 25 bp, Mus musculus
ctgggccagcacagtggccagcgtg

SEQ ID NO: 15454 - DNA, 25 bp, Mus musculus
agtggccagcgtgttctcaggctgc

SEQ ID NO: 15455 - DNA, 25 bp, Mus musculus
cagcgtgttctcaggctgcctgctg

SEQ ID NO: 15456 - DNA, 25 bp, Mus musculus
aggctgcctgctgaggaccgatggt

SEQ ID NO: 15457 - DNA, 25 bp, Mus musculus
cctgctgaggaccgatggtggattt

SEQ ID NO: 15458 - DNA, 25 bp, Mus musculus
ctctttatttcactgcgccaacact

SEQ ID NO: 15459 - DNA, 25 bp, Mus musculus
gcagacttgttgcccactgcttctc

SEQ ID NO: 15460 - DNA, 25 bp, Mus musculus
gcttctccctctgttttgaccaatc

SEQ ID NO: 15461 - DNA, 25 bp, Mus musculus
gaggtgtctttcctcctgtacatct

SEQ ID NO: 15462 - DNA, 25 bp, Mus musculus
tctttcctcctgtacatctagtctg

SEQ ID NO: 15463 - DNA, 25 bp, Mus musculus
tacatctagtctgtgcctggctcca

SEQ ID NO: 15464 - DNA, 25 bp, Mus musculus
tagtctgtgcctggctccattgttt

SEQ ID NO: 15465 - DNA, 25 bp, Mus musculus
ggctccattgtttgttccaatccat

SEQ ID NO: 15466 - DNA, 25 bp, Mus musculus
attgtttgttccaatccatgggact

SEQ ID NO: 15467 - DNA, 25 bp, Mus musculus
tgttccaatccatgggacttcatgc

SEQ ID NO: 15468 - DNA, 25 bp, Mus musculus
tgggacttcatgccacgtaacaact

SEQ ID NO: 15469 - DNA, 25 bp, Mus musculus
ttatgaccaagcaaaaactctgaat

SEQ ID NO: 15470 - DNA, 25 bp, Mus musculus
ttctgcttactagactaatatatgt

SEQ ID NO: 15471 - DNA, 25 bp, Mus musculus
accaatcctcaaccttgaataaatg

SEQ ID NO: 15472 - DNA, 25 bp, Mus musculus
cctcaaccttgaataaatgagagga

SEQ ID NO: 15473 - DNA, 25 bp, Mus musculus
attgctatagctcacctgcctctca

SEQ ID NO: 15474 - DNA, 25 bp, Mus musculus
cctctcatagaaccagtagagacac

SEQ ID NO: 15475 - DNA, 25 bp, Mus musculus
atgtctttattcttcagattggcag

SEQ ID NO: 15476 - DNA, 25 bp, Mus musculus
gtcagcaaatctcagactcgagggt

SEQ ID NO: 15477 - DNA, 25 bp, Mus musculus
aaatctcagactcgagggtcataga

SEQ ID NO: 15478 - DNA, 25 bp, Mus musculus
tcatagacaatcccattgaagatgg

SEQ ID NO: 15479 - DNA, 25 bp, Mus musculus
cagccgtgcaagcagcagtcgaagt

SEQ ID NO: 15480 - DNA, 25 bp, Mus musculus
tggccatggcggcagtcgaggattt

SEQ ID NO: 15481 - DNA, 25 bp, Mus musculus
cttagccagactataccttgtgtag

SEQ ID NO: 15482 - DNA, 25 bp, Mus musculus
actataccttgtgtagcttcaagaa

SEQ ID NO: 15483 - DNA, 25 bp, Mus musculus
ataccttgtgtagcttcaagaactc

SEQ ID NO: 15484 - DNA, 25 bp, Mus musculus
gtagcttcaagaactcgcagtacat

SEQ ID NO: 15485 - DNA, 25 bp, Mus musculus
gcttcaagaactcgcagtacattac

SEQ ID NO: 15486 - DNA, 25 bp, Mus musculus
tcaagaactcgcagtacattaccag

SEQ ID NO: 15487 - DNA, 25 bp, Mus musculus
cgcagtacattaccagctgtgattc

SEQ ID NO: 15488 - DNA, 25 bp, Mus musculus
agtacattaccagctgtgattctcc

SEQ ID NO: 15489 - DNA, 25 bp, Mus musculus
ttaccagctgtgattctccactgaa

SEQ ID NO: 15490 - DNA, 25 bp, Mus musculus
gctgtgattctccactgaaattttt

SEQ ID NO: 15491 - DNA, 25 bp, Mus musculus
ccatggcggcagtcgaggatttggt

SEQ ID NO: 15492 - DNA, 25 bp, Mus musculus
taactgagcctgctctgtagtaggt

SEQ ID NO: 15493 - DNA, 25 bp, Mus musculus
ctgagcctgctctgtagtaggtcac

SEQ ID NO: 15494 - DNA, 25 bp, Mus musculus
ctctgtagtaggtcaccctgccaaa

SEQ ID NO: 15495 - DNA, 25 bp, Mus musculus
tcaccctgccaaacaagctaatatg

SEQ ID NO: 15496 - DNA, 25 bp, Mus musculus
ccctgccaaacaagctaatatggaa

SEQ ID NO: 15497 - DNA, 25 bp, Mus musculus
tgccaaacaagctaatatggaaacc

SEQ ID NO: 15498 - DNA, 25 bp, Mus musculus
taacttagccagactataccttgtg

SEQ ID NO: 15499 - DNA, 25 bp, Mus musculus
gaaactattattgtcacctagatcc

SEQ ID NO: 15500 - DNA, 25 bp, Mus musculus
attattgtcacctagatccttctta

SEQ ID NO: 15501 - DNA, 25 bp, Mus musculus
caaggtcctcatgtccagtgcgaat

SEQ ID NO: 15502 - DNA, 25 bp, Mus musculus
ggtcctcatgtccagtgcgaatgaa

SEQ ID NO: 15503 - DNA, 25 bp, Mus musculus
tgatttgatcctgacttctacagcc

SEQ ID NO: 15504 - DNA, 25 bp, Mus musculus
gatcctgacttctacagcccctgaa

SEQ ID NO: 15505 - DNA, 25 bp, Mus musculus
ccttccagaggttcagtgctttgtg

SEQ ID NO: 15506 - DNA, 25 bp, Mus musculus
tcagtgctttgtgttcaacatagag

SEQ ID NO: 15507 - DNA, 25 bp, Mus musculus
cagttctgagcctcaggcaaccaac

SEQ ID NO: 15508 - DNA, 25 bp, Mus musculus
ttctgagcctcaggcaaccaacctc

SEQ ID NO: 15509 - DNA, 25 bp, Mus musculus
tgagcctcaggcaaccaacctcacg

SEQ ID NO: 15510 - DNA, 25 bp, Mus musculus
caacctcacgctgcactataggtac

SEQ ID NO: 15511 - DNA, 25 bp, Mus musculus
attgtcacctagatccttcttagtc

SEQ ID NO: 15512 - DNA, 25 bp, Mus musculus
cctcacgctgcactataggtacaag

SEQ ID NO: 15513 - DNA, 25 bp, Mus musculus
gtcacctagatccttcttagtcctt

SEQ ID NO: 15514 - DNA, 25 bp, Mus musculus
tagatccttcttagtccttcagctg

SEQ ID NO: 15515 - DNA, 25 bp, Mus musculus
atccttcttagtccttcagctgctc

SEQ ID NO: 15516 - DNA, 25 bp, Mus musculus
cttcttagtccttcagctgctcctg

SEQ ID NO: 15517 - DNA, 25 bp, Mus musculus
agtccttcagctgctcctgctgagg

SEQ ID NO: 15518 - DNA, 25 bp, Mus musculus
ccttcagctgctcctgctgagggca

SEQ ID NO: 15519 - DNA, 25 bp, Mus musculus
ctccaaggtcctcatgtccagtgcg

SEQ ID NO: 15520 - DNA, 25 bp, Mus musculus
tccttcctggaataccggagatcca

SEQ ID NO: 15521 - DNA, 25 bp, Mus musculus
cttcctggaataccggagatccagg

SEQ ID NO: 15522 - DNA, 25 bp, Mus musculus
gccaggcaagcctgagccagaaagg

SEQ ID NO: 15523 - DNA, 25 bp, Mus musculus
ggcaagcctgagccagaaagggcgc

SEQ ID NO: 15524 - DNA, 25 bp, Mus musculus
caagcctgagccagaaagggcgcac

SEQ ID NO: 15525 - DNA, 25 bp, Mus musculus
ccacatcatctcagaaacccttcag

SEQ ID NO: 15526 - DNA, 25 bp, Mus musculus
atcatctcagaaacccttcagccct

SEQ ID NO: 15527 - DNA, 25 bp, Mus musculus
aaaccagcaagtgtatactgtgatt

SEQ ID NO: 15528 - DNA, 25 bp, Mus musculus
agaagcaacactttgcaataaactc

SEQ ID NO: 15529 - DNA, 25 bp, Mus musculus
aagcaacactttgcaataaactcat

SEQ ID NO: 15530 - DNA, 25 bp, Mus musculus
tcccccttgatcatgtgacctagta

SEQ ID NO: 15531 - DNA, 25 bp, Mus musculus
ccttgatcatgtgacctagtaatgt

SEQ ID NO: 15532 - DNA, 25 bp, Mus musculus
taccggagatccaggggcctccagc

SEQ ID NO: 15533 - DNA, 25 bp, Mus musculus
agatccaggggcctccagctgctcc

SEQ ID NO: 15534 - DNA, 25 bp, Mus musculus
tctgtgtcctgttatttgggtccca

SEQ ID NO: 15535 - DNA, 25 bp, Mus musculus
tgtgtcctgttatttgggtcccaga

SEQ ID NO: 15536 - DNA, 25 bp, Mus musculus
tcctgttatttgggtcccagatgga

SEQ ID NO: 15537 - DNA, 25 bp, Mus musculus
ctgttatttgggtcccagatggagc

SEQ ID NO: 15538 - DNA, 25 bp, Mus musculus
tatttgggtcccagatggagcccac

SEQ ID NO: 15539 - DNA, 25 bp, Mus musculus
tgcattcctcaggccaggcaagcct

SEQ ID NO: 15540 - DNA, 25 bp, Mus musculus
gattacgacctttcaaagatgaggg

SEQ ID NO: 15541 - DNA, 25 bp, Mus musculus
gactttatcaaccaacaagctgacg

SEQ ID NO: 15542 - DNA, 25 bp, Mus musculus
tagagctctcttgccataaatacct

SEQ ID NO: 15543 - DNA, 25 bp, Mus musculus
tctcttgccataaataccttatgaa

SEQ ID NO: 15544 - DNA, 25 bp, Mus musculus
gctctgagaggccctgtctcggcat

SEQ ID NO: 15545 - DNA, 25 bp, Mus musculus
cctgtctcggcatgctagacacctg

SEQ ID NO: 15546 - DNA, 25 bp, Mus musculus
tcggcatgctagacacctgagcacc

SEQ ID NO: 15547 - DNA, 25 bp, Mus musculus
tgctagacacctgagcacctcactg

SEQ ID NO: 15548 - DNA, 25 bp, Mus musculus
ctcactggatgtttgtcataggatg

SEQ ID NO: 15549 - DNA, 25 bp, Mus musculus
taggatgtcgtttccactagtcgat

SEQ ID NO: 15550 - DNA, 25 bp, Mus musculus
tccactagtcgatctctgttgggca

SEQ ID NO: 15551 - DNA, 25 bp, Mus musculus
agtcgatctctgttgggcacggaaa

SEQ ID NO: 15552 - DNA, 25 bp, Mus musculus
atcaaccaacaagctgacgcttatg

SEQ ID NO: 15553 - DNA, 25 bp, Mus musculus
aagggcatcctcgacaaggaagaag

SEQ ID NO: 15554 - DNA, 25 bp, Mus musculus
gaagaagccaacgccatcaaacgca

SEQ ID NO: 15555 - DNA, 25 bp, Mus musculus
gccaacgccatcaaacgcatctaca

SEQ ID NO: 15556 - DNA, 25 bp, Mus musculus
gccatcaaacgcatctacagcagcc

SEQ ID NO: 15557 - DNA, 25 bp, Mus musculus
atctacagcagcctgtgaaaatggc

SEQ ID NO: 15558 - DNA, 25 bp, Mus musculus
aaatggcgggcagcttgagccttcc

SEQ ID NO: 15559 - DNA, 25 bp, Mus musculus
ttaccagcccagaagtattaggatg

SEQ ID NO: 15560 - DNA, 25 bp, Mus musculus
gcgttgtctcagtttagagagggca

SEQ ID NO: 15561 - DNA, 25 bp, Mus musculus
cgttgtctcagtttagagagggcaa

SEQ ID NO: 15562 - DNA, 25 bp, Mus musculus
caaggtcaaaaccatctaccgcaat

SEQ ID NO: 15563 - DNA, 25 bp, Mus musculus
aaggtcaaaaccatctaccgcaatg

SEQ ID NO: 15564 - DNA, 25 bp, Mus musculus
aggtcaaaaccatctaccgcaatga

SEQ ID NO: 15565 - DNA, 25 bp, Mus musculus
gtcaaaaccatctaccgcaatgaca

SEQ ID NO: 15566 - DNA, 25 bp, Mus musculus
tcaaaaccatctaccgcaatgacaa

SEQ ID NO: 15567 - DNA, 25 bp, Mus musculus
aaaccatctaccgcaatgacaagag

SEQ ID NO: 15568 - DNA, 25 bp, Mus musculus
aaccatctaccgcaatgacaagagg

SEQ ID NO: 15569 - DNA, 25 bp, Mus musculus
accatctaccgcaatgacaagagga

SEQ ID NO: 15570 - DNA, 25 bp, Mus musculus
ccatctaccgcaatgacaagaggat

SEQ ID NO: 15571 - DNA, 25 bp, Mus musculus
catctaccgcaatgacaagaggatc

SEQ ID NO: 15572 - DNA, 25 bp, Mus musculus
caagatggcctcagccacagactct

SEQ ID NO: 15573 - DNA, 25 bp, Mus musculus
gactcttttactccagcctttgtca

SEQ ID NO: 15574 - DNA, 25 bp, Mus musculus
actcttttactccagcctttgtcag

SEQ ID NO: 15575 - DNA, 25 bp, Mus musculus
ctcttttactccagcctttgtcagc

SEQ ID NO: 15576 - DNA, 25 bp, Mus musculus
tcttttactccagcctttgtcagca

SEQ ID NO: 15577 - DNA, 25 bp, Mus musculus
cttttactccagcctttgtcagcac

SEQ ID NO: 15578 - DNA, 25 bp, Mus musculus
ttcaaggtcaaaaccatctaccgca

SEQ ID NO: 15579 - DNA, 25 bp, Mus musculus
tcaaggtcaaaaccatctaccgcaa

SEQ ID NO: 15580 - DNA, 25 bp, Mus musculus
cctaggcagctgcatgtcgtcctgt

SEQ ID NO: 15581 - DNA, 25 bp, Mus musculus
cagctgcatgtcgtcctgtacaaat

SEQ ID NO: 15582 - DNA, 25 bp, Mus musculus
gttcacttgtgctgtctgcataagc

SEQ ID NO: 15583 - DNA, 25 bp, Mus musculus
ttgtgctgtctgcataagctgcgtc

SEQ ID NO: 15584 - DNA, 25 bp, Mus musculus
tgctgtctgcataagctgcgtctgt

SEQ ID NO: 15585 - DNA, 25 bp, Mus musculus
tgtctgcataagctgcgtctgtgag

SEQ ID NO: 15586 - DNA, 25 bp, Mus musculus
ctgcataagctgcgtctgtgagtgc

SEQ ID NO: 15587 - DNA, 25 bp, Mus musculus
aagctgcgtctgtgagtgcacggtg

SEQ ID NO: 15588 - DNA, 25 bp, Mus musculus
tgctccggtaggtgtgtatgatgcg

SEQ ID NO: 15589 - DNA, 25 bp, Mus musculus
tgatgcgttgacacgctacgctgtc

SEQ ID NO: 15590 - DNA, 25 bp, Mus musculus
acgctacgctgtctccctcatgtgc

SEQ ID NO: 15591 - DNA, 25 bp, Mus musculus
ctacgctgtctccctcatgtgcaca

SEQ ID NO: 15592 - DNA, 25 bp, Mus musculus
ctgcatgtcgtcctgtacaaatgtg

SEQ ID NO: 15593 - DNA, 25 bp, Mus musculus
catgtcgtcctgtacaaatgtgctc

SEQ ID NO: 15594 - DNA, 25 bp, Mus musculus
gtcgtcctgtacaaatgtgctcgtt

SEQ ID NO: 15595 - DNA, 25 bp, Mus musculus
tacaaatgtgctcgtttctgagtgc

SEQ ID NO: 15596 - DNA, 25 bp, Mus musculus
aaatgtgctcgtttctgagtgcttt

SEQ ID NO: 15597 - DNA, 25 bp, Mus musculus
tgagtgctttgtgcggccgttcact

SEQ ID NO: 15598 - DNA, 25 bp, Mus musculus
gtgctttgtgcggccgttcacttgt

SEQ ID NO: 15599 - DNA, 25 bp, Mus musculus
gccgttcacttgtgctgtctgcata

SEQ ID NO: 15600 - DNA, 25 bp, Mus musculus
gcagttgcgccgtgattgcgatgcg

SEQ ID NO: 15601 - DNA, 25 bp, Mus musculus
gttgcgccgtgattgcgatgcgctc

SEQ ID NO: 15602 - DNA, 25 bp, Mus musculus
gacagatttctatcactccaagcgc

SEQ ID NO: 15603 - DNA, 25 bp, Mus musculus
agatttctatcactccaagcgcaga

SEQ ID NO: 15604 - DNA, 25 bp, Mus musculus
tttctatcactccaagcgcagattg

SEQ ID NO: 15605 - DNA, 25 bp, Mus musculus
tcactccaagcgcagattggtcttc

SEQ ID NO: 15606 - DNA, 25 bp, Mus musculus
ctccaagcgcagattggtcttctgc

SEQ ID NO: 15607 - DNA, 25 bp, Mus musculus
cttcggccttagccctcactctgtg

SEQ ID NO: 15608 - DNA, 25 bp, Mus musculus
tagccctcactctgtgtgtcttaat

SEQ ID NO: 15609 - DNA, 25 bp, Mus musculus
ccctcactctgtgtgtcttaattat

SEQ ID NO: 15610 - DNA, 25 bp, Mus musculus
tttaaacgtctcctgatatacgctg

SEQ ID NO: 15611 - DNA, 25 bp, Mus musculus
cgtctcctgatatacgctgcctgcc

SEQ ID NO: 15612 - DNA, 25 bp, Mus musculus
tgattgcgatgcgctcatggcgggc

SEQ ID NO: 15613 - DNA, 25 bp, Mus musculus
gaactttgacttcgtcacggagacg

SEQ ID NO: 15614 - DNA, 25 bp, Mus musculus
cttcgtcacggagacgccgctggag

SEQ ID NO: 15615 - DNA, 25 bp, Mus musculus
gggcaacttcgtctgggagcgcgtt

SEQ ID NO: 15616 - DNA, 25 bp, Mus musculus
gctgcccaaggtctacctgagccct

SEQ ID NO: 15617 - DNA, 25 bp, Mus musculus
gaggcccagtacttcctctgccctg

SEQ ID NO: 15618 - DNA, 25 bp, Mus musculus
agctccggaggaccacgtggccttg

SEQ ID NO: 15619 - DNA, 25 bp, Mus musculus
gtcgctgtcttgcactctggtgtct

SEQ ID NO: 15620 - DNA, 25 bp, Mus musculus
tcccaaccaaggcaagacgctttat

SEQ ID NO: 15621 - DNA, 25 bp, Mus musculus
caaccaaggcaagacgctttatttg

SEQ ID NO: 15622 - DNA, 25 bp, Mus musculus
tcttccaaccagatcatatagacag

SEQ ID NO: 15623 - DNA, 25 bp, Mus musculus
ttccaaccagatcatatagacagat

SEQ ID NO: 15624 - DNA, 25 bp, Mus musculus
ccaaccagatcatatagacagatac

SEQ ID NO: 15625 - DNA, 25 bp, Mus musculus
gatacagttgctaatcagggcccct

SEQ ID NO: 15626 - DNA, 25 bp, Mus musculus
gttgctaatcagggcccctggaagc

SEQ ID NO: 15627 - DNA, 25 bp, Mus musculus
ttgctaatcagggcccctggaagcg

SEQ ID NO: 15628 - DNA, 25 bp, Mus musculus
tgctaatcagggcccctggaagcgg

SEQ ID NO: 15629 - DNA, 25 bp, Mus musculus
taatcagggcccctggaagcgggca

SEQ ID NO: 15630 - DNA, 25 bp, Mus musculus
catccggcagcgagggaagcccggc

SEQ ID NO: 15631 - DNA, 25 bp, Mus musculus
tcagctacgcggcgccctggtgggt

SEQ ID NO: 15632 - DNA, 25 bp, Mus musculus
gacgctttatttgtcttccaaccag

SEQ ID NO: 15633 - DNA, 25 bp, Mus musculus
gctttatttgtcttccaaccagatc

SEQ ID NO: 15634 - DNA, 25 bp, Mus musculus
ctttatttgtcttccaaccagatca

SEQ ID NO: 15635 - DNA, 25 bp, Mus musculus
tttatttgtcttccaaccagatcat

SEQ ID NO: 15636 - DNA, 25 bp, Mus musculus
tatttgtcttccaaccagatcatat

SEQ ID NO: 15637 - DNA, 25 bp, Mus musculus
atttgtcttccaaccagatcatata

SEQ ID NO: 15638 - DNA, 25 bp, Mus musculus
tttgtcttccaaccagatcatatag

SEQ ID NO: 15639 - DNA, 25 bp, Mus musculus
gtcttccaaccagatcatatagaca

SEQ ID NO: 15640 - DNA, 25 bp, Mus musculus
ctatgacctcaccttcagcactgag

SEQ ID NO: 15641 - DNA, 25 bp, Mus musculus
cctcaccttcagcactgaggttcaa

SEQ ID NO: 15642 - DNA, 25 bp, Mus musculus
agccatccgcaaacagctggcagcc

SEQ ID NO: 15643 - DNA, 25 bp, Mus musculus
ccgcaaacagctggcagccttcttg

SEQ ID NO: 15644 - DNA, 25 bp, Mus musculus
acagctggcagccttcttggagggc

SEQ ID NO: 15645 - DNA, 25 bp, Mus musculus
ggcagccttcttggagggcttctat

SEQ ID NO: 15646 - DNA, 25 bp, Mus musculus
cttcttggagggcttctatgaaatc

SEQ ID NO: 15647 - DNA, 25 bp, Mus musculus
cattccaaagcgcctcatatccatc

SEQ ID NO: 15648 - DNA, 25 bp, Mus musculus
aaagcgcctcatatccatctttact

SEQ ID NO: 15649 - DNA, 25 bp, Mus musculus
cctcatatccatctttactgagcag

SEQ ID NO: 15650 - DNA, 25 bp, Mus musculus
atccatctttactgagcaggaatta

SEQ ID NO: 15651 - DNA, 25 bp, Mus musculus
agagctgctcatatcagggctgcct

SEQ ID NO: 15652 - DNA, 25 bp, Mus musculus
cttcagcactgaggttcaagaattt

SEQ ID NO: 15653 - DNA, 25 bp, Mus musculus
gctcatatcagggctgcctaccatc

SEQ ID NO: 15654 - DNA, 25 bp, Mus musculus
tgacctcaaacccaatggagccaac

SEQ ID NO: 15655 - DNA, 25 bp, Mus musculus
caaacccaatggagccaacatcttg

SEQ ID NO: 15656 - DNA, 25 bp, Mus musculus
caatggagccaacatcttggtaaca

SEQ ID NO: 15657 - DNA, 25 bp, Mus musculus
agccaacatcttggtaacagaggag

SEQ ID NO: 15658 - DNA, 25 bp, Mus musculus
atatgtacacctggtttgccagatg

SEQ ID NO: 15659 - DNA, 25 bp, Mus musculus
acacctggtttgccagatgagaatg

SEQ ID NO: 15660 - DNA, 25 bp, Mus musculus
gacaggagccatccgcaaacagctg

SEQ ID NO: 15661 - DNA, 25 bp, Mus musculus
tccttcagtgctatgtctcttccgg

SEQ ID NO: 15662 - DNA, 25 bp, Mus musculus
agtgctatgtctcttccgggtgctc

SEQ ID NO: 15663 - DNA, 25 bp, Mus musculus
cagacacaagcacaagcacctagcc

SEQ ID NO: 15664 - DNA, 25 bp, Mus musculus
caagcacaagcacctagccagcctg

SEQ ID NO: 15665 - DNA, 25 bp, Mus musculus
caagcacctagccagcctgaggtct

SEQ ID NO: 15666 - DNA, 25 bp, Mus musculus
cctagccagcctgaggtctttcaag

SEQ ID NO: 15667 - DNA, 25 bp, Mus musculus
cagcctgaggtctttcaagaaatgc

SEQ ID NO: 15668 - DNA, 25 bp, Mus musculus
gaaatgctgtccatgctgggagacc

SEQ ID NO: 15669 - DNA, 25 bp, Mus musculus
ctgtccatgctgggagaccaaagca

SEQ ID NO: 15670 - DNA, 25 bp, Mus musculus
ggagaccaaagcaacacctacaaca

SEQ ID NO: 15671 - DNA, 25 bp, Mus musculus
ttttaggatcctctgaaattttgag

SEQ ID NO: 15672 - DNA, 25 bp, Mus musculus
gatcctctgaaattttgaggatagg

SEQ ID NO: 15673 - DNA, 25 bp, Mus musculus
cccactgcctcatctggtactgctg

SEQ ID NO: 15674 - DNA, 25 bp, Mus musculus
aactttcctcctgagactggacaga

SEQ ID NO: 15675 - DNA, 25 bp, Mus musculus
cctcctgagactggacagaccacag

SEQ ID NO: 15676 - DNA, 25 bp, Mus musculus
cagccccatcatcggtctagttcca

SEQ ID NO: 15677 - DNA, 25 bp, Mus musculus
catcatcggtctagttccagtgagc

SEQ ID NO: 15678 - DNA, 25 bp, Mus musculus
cggtctagttccagtgagcagcatg

SEQ ID NO: 15679 - DNA, 25 bp, Mus musculus
agttccagtgagcagcatgttcagc

SEQ ID NO: 15680 - DNA, 25 bp, Mus musculus
gttcagcagacacaagcacaagcac

SEQ ID NO: 15681 - DNA, 25 bp, Mus musculus
tctcgccaagctcctgaccaggatg

SEQ ID NO: 15682 - DNA, 25 bp, Mus musculus
ggttgaaattcctccgaccagagca

SEQ ID NO: 15683 - DNA, 25 bp, Mus musculus
gtacaccatagctaatcaatttcct

SEQ ID NO: 15684 - DNA, 25 bp, Mus musculus
catagctaatcaatttcctctcaac

SEQ ID NO: 15685 - DNA, 25 bp, Mus musculus
agctaatcaatttcctctcaacaag

SEQ ID NO: 15686 - DNA, 25 bp, Mus musculus
taatcaatttcctctcaacaagctc

SEQ ID NO: 15687 - DNA, 25 bp, Mus musculus
caagctcaccgagctcctcagactt

SEQ ID NO: 15688 - DNA, 25 bp, Mus musculus
caccgagctcctcagacttgacatg

SEQ ID NO: 15689 - DNA, 25 bp, Mus musculus
gctcctcagacttgacatggctgcg

SEQ ID NO: 15690 - DNA, 25 bp, Mus musculus
cctcagacttgacatggctgcggct

SEQ ID NO: 15691 - DNA, 25 bp, Mus musculus
tggcttcaccgaagcactgactttt

SEQ ID NO: 15692 - DNA, 25 bp, Mus musculus
cttcaccgaagcactgacttttgct

SEQ ID NO: 15693 - DNA, 25 bp, Mus musculus
tcctccgaccagagcagatgtcatc

SEQ ID NO: 15694 - DNA, 25 bp, Mus musculus
cgaagcactgacttttgctctgtgc

SEQ ID NO: 15695 - DNA, 25 bp, Mus musculus
tccgaccagagcagatgtcatccat

SEQ ID NO: 15696 - DNA, 25 bp, Mus musculus
ggacgcagctattgcttatggctat

SEQ ID NO: 15697 - DNA, 25 bp, Mus musculus
cgcagctattgcttatggctataac

SEQ ID NO: 15698 - DNA, 25 bp, Mus musculus
cattcagatgactctgccgaaaacg

SEQ ID NO: 15699 - DNA, 25 bp, Mus musculus
gatgactctgccgaaaacgtacacc

SEQ ID NO: 15700 - DNA, 25 bp, Mus musculus
gactctgccgaaaacgtacaccata

SEQ ID NO: 15701 - DNA, 25 bp, Mus musculus
aacgtacaccatagctaatcaattt

SEQ ID NO: 15702 - DNA, 25 bp, Mus musculus
aacttacaaacccagcggctgccag

SEQ ID NO: 15703 - DNA, 25 bp, Mus musculus
caaacccagcggctgccagttcaaa

SEQ ID NO: 15704 - DNA, 25 bp, Mus musculus
gggtaacagcctccaggacaatgtt

SEQ ID NO: 15705 - DNA, 25 bp, Mus musculus
caatgtttcctcactcgttaagcag

SEQ ID NO: 15706 - DNA, 25 bp, Mus musculus
ttcctcactcgttaagcagctcatc

SEQ ID NO: 15707 - DNA, 25 bp, Mus musculus
actcgttaagcagctcatctcagtt

SEQ ID NO: 15708 - DNA, 25 bp, Mus musculus
taagcagctcatctcagttcccaaa

SEQ ID NO: 15709 - DNA, 25 bp, Mus musculus
gctcatctcagttcccaaacccatt

SEQ ID NO: 15710 - DNA, 25 bp, Mus musculus
ctcagttcccaaacccattgcacaa

SEQ ID NO: 15711 - DNA, 25 bp, Mus musculus
tcccaaacccattgcacaaatactt

SEQ ID NO: 15712 - DNA, 25 bp, Mus musculus
taacgacattcacattcatttcaaa

SEQ ID NO: 15713 - DNA, 25 bp, Mus musculus
cattcacattcatttcaaatgttat

SEQ ID NO: 15714 - DNA, 25 bp, Mus musculus
cagcggctgccagttcaaaaaatca

SEQ ID NO: 15715 - DNA, 25 bp, Mus musculus
gctgatccagaagccaaatgggtga

SEQ ID NO: 15716 - DNA, 25 bp, Mus musculus
gaaactgttcccacaggagcccaga

SEQ ID NO: 15717 - DNA, 25 bp, Mus musculus
gttcccacaggagcccagaggtcca

SEQ ID NO: 15718 - DNA, 25 bp, Mus musculus
acaggagcccagaggtccaccagca

SEQ ID NO: 15719 - DNA, 25 bp, Mus musculus
gcccagaggtccaccagcacagcga

SEQ ID NO: 15720 - DNA, 25 bp, Mus musculus
aggtccaccagcacagcgataaccc

SEQ ID NO: 15721 - DNA, 25 bp, Mus musculus
accagcacagcgataaccctgactg

SEQ ID NO: 15722 - DNA, 25 bp, Mus musculus
aaagcctatcgctgctccatctgtg

SEQ ID NO: 15723 - DNA, 25 bp, Mus musculus
aagcctatcgctgctccatctgtgg

SEQ ID NO: 15724 - DNA, 25 bp, Mus musculus
aaactctaaacacacagacgcagtc

SEQ ID NO: 15725 - DNA, 25 bp, Mus musculus
aactctaaacacacagacgcagtca

SEQ ID NO: 15726 - DNA, 25 bp, Mus musculus
ctctaaacacacagacgcagtcatt

SEQ ID NO: 15727 - DNA, 25 bp, Mus musculus
tctaaacacacagacgcagtcattc

SEQ ID NO: 15728 - DNA, 25 bp, Mus musculus
taaacacacagacgcagtcattccg

SEQ ID NO: 15729 - DNA, 25 bp, Mus musculus
acacacagacgcagtcattccgggg

SEQ ID NO: 15730 - DNA, 25 bp, Mus musculus
cacacagacgcagtcattccgggga

SEQ ID NO: 15731 - DNA, 25 bp, Mus musculus
cacagacgcagtcattccggggaga

SEQ ID NO: 15732 - DNA, 25 bp, Mus musculus
acagacgcagtcattccggggagaa

SEQ ID NO: 15733 - DNA, 25 bp, Mus musculus
agtgtgagacctgcggctcgcgttt

SEQ ID NO: 15734 - DNA, 25 bp, Mus musculus
cctatcgctgctccatctgtggaga

SEQ ID NO: 15735 - DNA, 25 bp, Mus musculus
tatcgctgctccatctgtggagaca

SEQ ID NO: 15736 - DNA, 25 bp, Mus musculus
atcgctgctccatctgtggagacag

SEQ ID NO: 15737 - DNA, 25 bp, Mus musculus
cgctgctccatctgtggagacagtt

SEQ ID NO: 15738 - DNA, 25 bp, Mus musculus
tgctccatctgtggagacagtttta

SEQ ID NO: 15739 - DNA, 25 bp, Mus musculus
gctccatctgtggagacagttttaa

SEQ ID NO: 15740 - DNA, 25 bp, Mus musculus
tccatctgtggagacagttttaacc

SEQ ID NO: 15741 - DNA, 25 bp, Mus musculus
gtaaactctaaacacacagacgcag

SEQ ID NO: 15742 - DNA, 25 bp, Mus musculus
ttggaacttgcctgggatatgctgg

SEQ ID NO: 15743 - DNA, 25 bp, Mus musculus
gaacttgcctgggatatgctggatt

SEQ ID NO: 15744 - DNA, 25 bp, Mus musculus
tatatccaagctgtggaggagtttc

SEQ ID NO: 15745 - DNA, 25 bp, Mus musculus
caggcttgcctaagcctgcaagaac

SEQ ID NO: 15746 - DNA, 25 bp, Mus musculus
gcttgcctaagcctgcaagaacaat

SEQ ID NO: 15747 - DNA, 25 bp, Mus musculus
tgcctaagcctgcaagaacaatatt

SEQ ID NO: 15748 - DNA, 25 bp, Mus musculus
gaagctcacgatcgtctccttgcag

SEQ ID NO: 15749 - DNA, 25 bp, Mus musculus
gctcacgatcgtctccttgcagaga

SEQ ID NO: 15750 - DNA, 25 bp, Mus musculus
gatcgtctccttgcagagactcact

SEQ ID NO: 15751 - DNA, 25 bp, Mus musculus
cgtctccttgcagagactcactacc

SEQ ID NO: 15752 - DNA, 25 bp, Mus musculus
ctccttgcagagactcactaccaat

SEQ ID NO: 15753 - DNA, 25 bp, Mus musculus
cttgcagagactcactaccaattag

SEQ ID NO: 15754 - DNA, 25 bp, Mus musculus
cttgcctgggatatgctggatttag

SEQ ID NO: 15755 - DNA, 25 bp, Mus musculus
gcagagactcactaccaattaggtt

SEQ ID NO: 15756 - DNA, 25 bp, Mus musculus
gaagcccagctttatgctgcacaag

SEQ ID NO: 15757 - DNA, 25 bp, Mus musculus
gcccagctttatgctgcacaagccc

SEQ ID NO: 15758 - DNA, 25 bp, Mus musculus
cagctttatgctgcacaagcccatc

SEQ ID NO: 15759 - DNA, 25 bp, Mus musculus
tatgctgcacaagcccatcttaaac

SEQ ID NO: 15760 - DNA, 25 bp, Mus musculus
gctgcacaagcccatcttaaacttg

SEQ ID NO: 15761 - DNA, 25 bp, Mus musculus
gcacaagcccatcttaaacttggag

SEQ ID NO: 15762 - DNA, 25 bp, Mus musculus
aattatatccaagctgtggaggagt

SEQ ID NO: 15763 - DNA, 25 bp, Mus musculus
tcccaggcagcatctgtcagtatgt

SEQ ID NO: 15764 - DNA, 25 bp, Mus musculus
gcagcatctgtcagtatgtcagagt

SEQ ID NO: 15765 - DNA, 25 bp, Mus musculus
ctaccttcccaggtatattggcagg

SEQ ID NO: 15766 - DNA, 25 bp, Mus musculus
gatctcagaacacacaggtaatgtg

SEQ ID NO: 15767 - DNA, 25 bp, Mus musculus
acctatgacaactggtaatggtgga

SEQ ID NO: 15768 - DNA, 25 bp, Mus musculus
ttacattgtttacacttctatgacc

SEQ ID NO: 15769 - DNA, 25 bp, Mus musculus
tgtttacacttctatgaccaggcct

SEQ ID NO: 15770 - DNA, 25 bp, Mus musculus
cacttctatgaccaggccttagggg

SEQ ID NO: 15771 - DNA, 25 bp, Mus musculus
ccatccatgccacactgtcttctgt

SEQ ID NO: 15772 - DNA, 25 bp, Mus musculus
atgccacactgtcttctgtaccagg

SEQ ID NO: 15773 - DNA, 25 bp, Mus musculus
cactgtcttctgtaccaggtagccc

SEQ ID NO: 15774 - DNA, 25 bp, Mus musculus
cttctgtaccaggtagcccaataga

SEQ ID NO: 15775 - DNA, 25 bp, Mus musculus
tgctagtgcttccttctaaacagga

SEQ ID NO: 15776 - DNA, 25 bp, Mus musculus
tgcttccttctaaacaggatgacca

SEQ ID NO: 15777 - DNA, 25 bp, Mus musculus
atgaccaagtcattccagttcatct

SEQ ID NO: 15778 - DNA, 25 bp, Mus musculus
aagtcattccagttcatcttttcca

SEQ ID NO: 15779 - DNA, 25 bp, Mus musculus
ttccagttcatcttttccatcatcc

SEQ ID NO: 15780 - DNA, 25 bp, Mus musculus
ttttccatcatcctacctgcctaga

SEQ ID NO: 15781 - DNA, 25 bp, Mus musculus
atcatcctacctgcctagaactcat

SEQ ID NO: 15782 - DNA, 25 bp, Mus musculus
ctacctgcctagaactcatgtgtaa

SEQ ID NO: 15783 - DNA, 25 bp, Mus musculus
atcagagctgaccctacaaacacct

SEQ ID NO: 15784 - DNA, 25 bp, Mus musculus
tcagagctgaccctacaaacacctg

SEQ ID NO: 15785 - DNA, 25 bp, Mus musculus
tgttgaagtcccctggacaattgag

SEQ ID NO: 15786 - DNA, 25 bp, Mus musculus
gttgaagtcccctggacaattgagc

SEQ ID NO: 15787 - DNA, 25 bp, Mus musculus
ttgaagtcccctggacaattgagca

SEQ ID NO: 15788 - DNA, 25 bp, Mus musculus
tgaagtcccctggacaattgagcag

SEQ ID NO: 15789 - DNA, 25 bp, Mus musculus
gaagtcccctggacaattgagcagg

SEQ ID NO: 15790 - DNA, 25 bp, Mus musculus
aagtcccctggacaattgagcaggt

SEQ ID NO: 15791 - DNA, 25 bp, Mus musculus
agtcccctggacaattgagcaggtg

SEQ ID NO: 15792 - DNA, 25 bp, Mus musculus
gtcccctggacaattgagcaggtgg

SEQ ID NO: 15793 - DNA, 25 bp, Mus musculus
tcccctggacaattgagcaggtggt

SEQ ID NO: 15794 - DNA, 25 bp, Mus musculus
cagagctgaccctacaaacacctgt

SEQ ID NO: 15795 - DNA, 25 bp, Mus musculus
agagctgaccctacaaacacctgtc

SEQ ID NO: 15796 - DNA, 25 bp, Mus musculus
gagctgaccctacaaacacctgtcc

SEQ ID NO: 15797 - DNA, 25 bp, Mus musculus
ctgtcccctgagtttgtgttgaagt

SEQ ID NO: 15798 - DNA, 25 bp, Mus musculus
tgtcccctgagtttgtgttgaagtc

SEQ ID NO: 15799 - DNA, 25 bp, Mus musculus
tttgtgttgaagtcccctggacaat

SEQ ID NO: 15800 - DNA, 25 bp, Mus musculus
ttgtgttgaagtcccctggacaatt

SEQ ID NO: 15801 - DNA, 25 bp, Mus musculus
gtgttgaagtcccctggacaattga

SEQ ID NO: 15802 - DNA, 25 bp, Mus musculus
gttccttctcctacaatgaagaggt

SEQ ID NO: 15803 - DNA, 25 bp, Mus musculus
ccttctcctacaatgaagaggtgat

SEQ ID NO: 15804 - DNA, 25 bp, Mus musculus
tagccatgtatgctgctaaagaaat

SEQ ID NO: 15805 - DNA, 25 bp, Mus musculus
ttttcctttcacctcttccagcatg

SEQ ID NO: 15806 - DNA, 25 bp, Mus musculus
tttcacctcttccagcatggaagat

SEQ ID NO: 15807 - DNA, 25 bp, Mus musculus
ctcttccagcatggaagatggagat

SEQ ID NO: 15808 - DNA, 25 bp, Mus musculus
ccttctcagcaaggttatttagcta

SEQ ID NO: 15809 - DNA, 25 bp, Mus musculus
tatttagctagcttagtgtctaact

SEQ ID NO: 15810 - DNA, 25 bp, Mus musculus
caaggccaaggtctgttgctgtttt

SEQ ID NO: 15811 - DNA, 25 bp, Mus musculus
caaggtctgttgctgttttgagatt

SEQ ID NO: 15812 - DNA, 25 bp, Mus musculus
ggtctgttgctgttttgagattctg

SEQ ID NO: 15813 - DNA, 25 bp, Mus musculus
tttcttgtgacagttatgcaaatta

SEQ ID NO: 15814 - DNA, 25 bp, Mus musculus
tgatccctctgggtcatgtctaaag

SEQ ID NO: 15815 - DNA, 25 bp, Mus musculus
tccctctgggtcatgtctaaagggt

SEQ ID NO: 15816 - DNA, 25 bp, Mus musculus
ctctgggtcatgtctaaagggtttg

SEQ ID NO: 15817 - DNA, 25 bp, Mus musculus
tactgtaaccctgaagttgtctttg

SEQ ID NO: 15818 - DNA, 25 bp, Mus musculus
ttgatgttagcccaggtagttttag

SEQ ID NO: 15819 - DNA, 25 bp, Mus musculus
gggcactctagttaaggtggttgat

SEQ ID NO: 15820 - DNA, 25 bp, Mus musculus
cactctagttaaggtggttgatgga

SEQ ID NO: 15821 - DNA, 25 bp, Mus musculus
tggacttagccatgtatgctgctaa

SEQ ID NO: 15822 - DNA, 25 bp, Mus musculus
gcttctccgagtgcaagcagtaggt

SEQ ID NO: 15823 - DNA, 25 bp, Mus musculus
gaaccaaattgccaagtactcagtt

SEQ ID NO: 15824 - DNA, 25 bp, Mus musculus
ttctctgagactggcccacttgtgc

SEQ ID NO: 15825 - DNA, 25 bp, Mus musculus
gagactggcccacttgtgcactagt

SEQ ID NO: 15826 - DNA, 25 bp, Mus musculus
ggcccacttgtgcactagttgggag

SEQ ID NO: 15827 - DNA, 25 bp, Mus musculus
cttgtgcactagttgggaggaacaa

SEQ ID NO: 15828 - DNA, 25 bp, Mus musculus
atcctccatcacacagcatgtgcaa

SEQ ID NO: 15829 - DNA, 25 bp, Mus musculus
catcacacagcatgtgcaatacgcc

SEQ ID NO: 15830 - DNA, 25 bp, Mus musculus
acagcatgtgcaatacgccaaaatc

SEQ ID NO: 15831 - DNA, 25 bp, Mus musculus
tgtgcaatacgccaaaatcactctc

SEQ ID NO: 15832 - DNA, 25 bp, Mus musculus
atacgccaaaatcactctcagtcat

SEQ ID NO: 15833 - DNA, 25 bp, Mus musculus
cactctcagtcattcctgtcaacaa

SEQ ID NO: 15834 - DNA, 25 bp, Mus musculus
aattgccaagtactcagttcaaata

SEQ ID NO: 15835 - DNA, 25 bp, Mus musculus
ctcagttcaaatacttcatttcaat

SEQ ID NO: 15836 - DNA, 25 bp, Mus musculus
tcaaatacttcatttcaatcaacca

SEQ ID NO: 15837 - DNA, 25 bp, Mus musculus
tttcaatcaaccaaagttagttcag

SEQ ID NO: 15838 - DNA, 25 bp, Mus musculus
gtagcttatctcacttatgagtatg

SEQ ID NO: 15839 - DNA, 25 bp, Mus musculus
tatctcacttatgagtatggtgcag

SEQ ID NO: 15840 - DNA, 25 bp, Mus musculus
tgttaaacatctacaccaaatggta

SEQ ID NO: 15841 - DNA, 25 bp, Mus musculus
agtggattctctgagactggcccac

SEQ ID NO: 15842 - DNA, 25 bp, Mus musculus
ttggagatcctaccgtggagtttgt

SEQ ID NO: 15843 - DNA, 25 bp, Mus musculus
gagatcctaccgtggagtttgtggc

SEQ ID NO: 15844 - DNA, 25 bp, Mus musculus
gagctctgcgtcagaagtctagttt

SEQ ID NO: 15845 - DNA, 25 bp, Mus musculus
ctctgcgtcagaagtctagttttat

SEQ ID NO: 15846 - DNA, 25 bp, Mus musculus
ttatagtcaactgtcctgtgatgtc

SEQ ID NO: 15847 - DNA, 25 bp, Mus musculus
tagtcaactgtcctgtgatgtcagc

SEQ ID NO: 15848 - DNA, 25 bp, Mus musculus
tcaactgtcctgtgatgtcagcagt

SEQ ID NO: 15849 - DNA, 25 bp, Mus musculus
ttgagcgcgtgtgcgatctgagata

SEQ ID NO: 15850 - DNA, 25 bp, Mus musculus
agcgcgtgtgcgatctgagatagct

SEQ ID NO: 15851 - DNA, 25 bp, Mus musculus
gatgcgtgactccatatgggatgct

SEQ ID NO: 15852 - DNA, 25 bp, Mus musculus
gcgtgactccatatgggatgctgaa

SEQ ID NO: 15853 - DNA, 25 bp, Mus musculus
tgactccatatgggatgctgaagga

SEQ ID NO: 15854 - DNA, 25 bp, Mus musculus
ctaccgtggagtttgtggccatgcc

SEQ ID NO: 15855 - DNA, 25 bp, Mus musculus
ctccatatgggatgctgaaggagat

SEQ ID NO: 15856 - DNA, 25 bp, Mus musculus
cgccacctgacgtggtcatagagcc

SEQ ID NO: 15857 - DNA, 25 bp, Mus musculus
tcatagagccagctttggcagcaca

SEQ ID NO: 15858 - DNA, 25 bp, Mus musculus
agccagctttggcagcacagtacga

SEQ ID NO: 15859 - DNA, 25 bp, Mus musculus
ctttggcagcacagtacgagcatga

SEQ ID NO: 15860 - DNA, 25 bp, Mus musculus
cgactgctctcccagatgaggatga

SEQ ID NO: 15861 - DNA, 25 bp, Mus musculus
ctctcccagatgaggatgatgagct

SEQ ID NO: 15862 - DNA, 25 bp, Mus musculus
aagctggagctctgcgtcagaagtc

SEQ ID NO: 15863 - DNA, 25 bp, Mus musculus
ttccttcattggcatggagtcagct

SEQ ID NO: 15864 - DNA, 25 bp, Mus musculus
acagccttggctcccagcaccatat

SEQ ID NO: 15865 - DNA, 25 bp, Mus musculus
tctctggggatccccacaagactgc

SEQ ID NO: 15866 - DNA, 25 bp, Mus musculus
gatccccacaagactgctgtcacca

SEQ ID NO: 15867 - DNA, 25 bp, Mus musculus
cacaagactgctgtcaccagccaca

SEQ ID NO: 15868 - DNA, 25 bp, Mus musculus
agactgctgtcaccagccacagatc

SEQ ID NO: 15869 - DNA, 25 bp, Mus musculus
actgctgtcaccagccacagatcat

SEQ ID NO: 15870 - DNA, 25 bp, Mus musculus
tgctgtcaccagccacagatcatta

SEQ ID NO: 15871 - DNA, 25 bp, Mus musculus
ctgtcaccagccacagatcattaaa

SEQ ID NO: 15872 - DNA, 25 bp, Mus musculus
caccagccacagatcattaaaacct

SEQ ID NO: 15873 - DNA, 25 bp, Mus musculus
ccagccacagatcattaaaaccttc

SEQ ID NO: 15874 - DNA, 25 bp, Mus musculus
acagatcattaaaaccttcaagcct

SEQ ID NO: 15875 - DNA, 25 bp, Mus musculus
ccttggctcccagcaccatattatc

SEQ ID NO: 15876 - DNA, 25 bp, Mus musculus
cagatcattaaaaccttcaagcctt

SEQ ID NO: 15877 - DNA, 25 bp, Mus musculus
ggctcccagcaccatattatcgctc

SEQ ID NO: 15878 - DNA, 25 bp, Mus musculus
cagcaccatattatcgctcctcctg

SEQ ID NO: 15879 - DNA, 25 bp, Mus musculus
accatattatcgctcctcctgagcg

SEQ ID NO: 15880 - DNA, 25 bp, Mus musculus
catattatcgctcctcctgagcgga

SEQ ID NO: 15881 - DNA, 25 bp, Mus musculus
cagggccctccattgtccacaggaa

SEQ ID NO: 15882 - DNA, 25 bp, Mus musculus
ttgtccacaggaaatgcttctaaag

SEQ ID NO: 15883 - DNA, 25 bp, Mus musculus
cttctctggggatccccacaagact

SEQ ID NO: 15884 - DNA, 25 bp, Mus musculus
cacgcctacagaacccacaaagctg

SEQ ID NO: 15885 - DNA, 25 bp, Mus musculus
gcctacagaacccacaaagctgtgc

SEQ ID NO: 15886 - DNA, 25 bp, Mus musculus
aggtatcctgactctggtaccccat

SEQ ID NO: 15887 - DNA, 25 bp, Mus musculus
tatcctgactctggtaccccattga

SEQ ID NO: 15888 - DNA, 25 bp, Mus musculus
accccattgaacatcattatcacac

SEQ ID NO: 15889 - DNA, 25 bp, Mus musculus
ttgaacatcattatcacactgggat

SEQ ID NO: 15890 - DNA, 25 bp, Mus musculus
aacatcattatcacactgggatgac

SEQ ID NO: 15891 - DNA, 25 bp, Mus musculus
atcattatcacactgggatgacatg

SEQ ID NO: 15892 - DNA, 25 bp, Mus musculus
attatcacactgggatgacatggaa

SEQ ID NO: 15893 - DNA, 25 bp, Mus musculus
atcacactgggatgacatggaaaga

SEQ ID NO: 15894 - DNA, 25 bp, Mus musculus
aagatctggcacatacattctaaat

SEQ ID NO: 15895 - DNA, 25 bp, Mus musculus
gatctggcacatacattctaaatga

SEQ ID NO: 15896 - DNA, 25 bp, Mus musculus
tacagaacccacaaagctgtgccag

SEQ ID NO: 15897 - DNA, 25 bp, Mus musculus
atctggcacatacattctaaatgac

SEQ ID NO: 15898 - DNA, 25 bp, Mus musculus
agaacccacaaagctgtgccaggat

SEQ ID NO: 15899 - DNA, 25 bp, Mus musculus
gtgacgagaaaccaccgctggtgtg

SEQ ID NO: 15900 - DNA, 25 bp, Mus musculus
acgagaaaccaccgctggtgtgtga

SEQ ID NO: 15901 - DNA, 25 bp, Mus musculus
aaccaccgctggtgtgtgacaatgg

SEQ ID NO: 15902 - DNA, 25 bp, Mus musculus
catcgtgggtcgccagtcaccaggg

SEQ ID NO: 15903 - DNA, 25 bp, Mus musculus
tcgccagtcaccagggtgtcatggt

SEQ ID NO: 15904 - DNA, 25 bp, Mus musculus
gtcaccagggtgtcatggtggtatg

SEQ ID NO: 15905 - DNA, 25 bp, Mus musculus
ctcctggggctgctggtcatgcgga

SEQ ID NO: 15906 - DNA, 25 bp, Mus musculus
ctgctggtcatgcggaacctactga

SEQ ID NO: 15907 - DNA, 25 bp, Mus musculus
ggcatccgcaccgttatggtgacag

SEQ ID NO: 15908 - DNA, 25 bp, Mus musculus
aacctgcagacagcagtcaccgtgg

SEQ ID NO: 15909 - DNA, 25 bp, Mus musculus
ctgcagacagcagtcaccgtggcca

SEQ ID NO: 15910 - DNA, 25 bp, Mus musculus
accgtggccagagcttgtggcatgg

SEQ ID NO: 15911 - DNA, 25 bp, Mus musculus
gagcacctggctgtcatccatgcca

SEQ ID NO: 15912 - DNA, 25 bp, Mus musculus
ctcgagttcctgccaacggagtcct

SEQ ID NO: 15913 - DNA, 25 bp, Mus musculus
ttcctgccaacggagtcctctgcag

SEQ ID NO: 15914 - DNA, 25 bp, Mus musculus
ccaacggagtcctctgcagtcatga

SEQ ID NO: 15915 - DNA, 25 bp, Mus musculus
acggagtcctctgcagtcatgaacg

SEQ ID NO: 15916 - DNA, 25 bp, Mus musculus
tctgcagtcatgaacggggcgaagg

SEQ ID NO: 15917 - DNA, 25 bp, Mus musculus
ctggtcatgcggaacctactgaagc

SEQ ID NO: 15918 - DNA, 25 bp, Mus musculus
gcacaggctatcccacggtgccgga

SEQ ID NO: 15919 - DNA, 25 bp, Mus musculus
gtcatgcggaacctactgaagccac

SEQ ID NO: 15920 - DNA, 25 bp, Mus musculus
ctactgaagccacagacggccccag

SEQ ID NO: 15921 - DNA, 25 bp, Mus musculus
cagacggccccagttatccagactc

SEQ ID NO: 15922 - DNA, 25 bp, Mus musculus
gccccagttatccagactctgagga

SEQ ID NO: 15923 - DNA, 25 bp, Mus musculus
ccagttatccagactctgaggaaga

SEQ ID NO: 15924 - DNA, 25 bp, Mus musculus
aagacgggcatccgcaccgttatgg

SEQ ID NO: 15925 - DNA, 25 bp, Mus musculus
acgggcatccgcaccgttatggtga

SEQ ID NO: 15926 - DNA, 25 bp, Mus musculus
catcagcttgggttatgatattggc

SEQ ID NO: 15927 - DNA, 25 bp, Mus musculus
agtgacgttccaggccttcatcgac

SEQ ID NO: 15928 - DNA, 25 bp, Mus musculus
agatcaggtcatggcttccttcaag

SEQ ID NO: 15929 - DNA, 25 bp, Mus musculus
tcaggtcatggcttccttcaagatc

SEQ ID NO: 15930 - DNA, 25 bp, Mus musculus
ggtcatggcttccttcaagatcctg

SEQ ID NO: 15931 - DNA, 25 bp, Mus musculus
ggcttccttcaagatcctggctgga

SEQ ID NO: 15932 - DNA, 25 bp, Mus musculus
ttccttcaagatcctggctggagat

SEQ ID NO: 15933 - DNA, 25 bp, Mus musculus
gatcctggctggagataagaattac

SEQ ID NO: 15934 - DNA, 25 bp, Mus musculus
gaattacatcacagaggatgagctg

SEQ ID NO: 15935 - DNA, 25 bp, Mus musculus
tgaccaagccgagtactgcatcgaa

SEQ ID NO: 15936 - DNA, 25 bp, Mus musculus
ccaagccgagtactgcatcgaagaa

SEQ ID NO: 15937 - DNA, 25 bp, Mus musculus
agccgagtactgcatcgaagaatgg

SEQ ID NO: 15938 - DNA, 25 bp, Mus musculus
gacgttccaggccttcatcgacttt

SEQ ID NO: 15939 - DNA, 25 bp, Mus musculus
gttccaggccttcatcgactttatg

SEQ ID NO: 15940 - DNA, 25 bp, Mus musculus
ggccttcatcgactttatgtcccga

SEQ ID NO: 15941 - DNA, 25 bp, Mus musculus
catcgactttatgtcccgagagacg

SEQ ID NO: 15942 - DNA, 25 bp, Mus musculus
tatgtcccgagagacggcagatact

SEQ ID NO: 15943 - DNA, 25 bp, Mus musculus
gtcccgagagacggcagatactgat

SEQ ID NO: 15944 - DNA, 25 bp, Mus musculus
tgatactgcagatcaggtcatggct

SEQ ID NO: 15945 - DNA, 25 bp, Mus musculus
tactgcagatcaggtcatggcttcc

SEQ ID NO: 15946 - DNA, 25 bp, Mus musculus
ccgctgcccagatggaaggcttcct

SEQ ID NO: 15947 - DNA, 25 bp, Mus musculus
tggaaggcttcctcaatcggaagca

SEQ ID NO: 15948 - DNA, 25 bp, Mus musculus
tgaacacatggatccaggctatctc

SEQ ID NO: 15949 - DNA, 25 bp, Mus musculus
cctctgacaaacacgacacatctgc

SEQ ID NO: 15950 - DNA, 25 bp, Mus musculus
ctgacaaacacgacacatctgccag

SEQ ID NO: 15951 - DNA, 25 bp, Mus musculus
gcacccagagtacgccagcatccag

SEQ ID NO: 15952 - DNA, 25 bp, Mus musculus
cccagagtacgccagcatccagtcg

SEQ ID NO: 15953 - DNA, 25 bp, Mus musculus
tcgtcaccatcaccagcgagtccag

SEQ ID NO: 15954 - DNA, 25 bp, Mus musculus
ccatcaccagcgagtccagtcctgg

SEQ ID NO: 15955 - DNA, 25 bp, Mus musculus
tcaccagcgagtccagtcctggcaa

SEQ ID NO: 15956 - DNA, 25 bp, Mus musculus
ccagcgagtccagtcctggcaagag

SEQ ID NO: 15957 - DNA, 25 bp, Mus musculus
gtaagagtccagcatgcaagttccg

SEQ ID NO: 15958 - DNA, 25 bp, Mus musculus
aaggcttcctcaatcggaagcatga

SEQ ID NO: 15959 - DNA, 25 bp, Mus musculus
tcctcaatcggaagcatgagtggga

SEQ ID NO: 15960 - DNA, 25 bp, Mus musculus
cccacaataagaaagcctcgagcag

SEQ ID NO: 15961 - DNA, 25 bp, Mus musculus
cctcgagcaggtcctggcacaatgt

SEQ ID NO: 15962 - DNA, 25 bp, Mus musculus
gtgaggtccctgtgagtttgaaaga

SEQ ID NO: 15963 - DNA, 25 bp, Mus musculus
ccatctgcgaagtggcccttgatta

SEQ ID NO: 15964 - DNA, 25 bp, Mus musculus
tctgcgaagtggcccttgattacaa

SEQ ID NO: 15965 - DNA, 25 bp, Mus musculus
acctcttccaagccaaagatgatga

SEQ ID NO: 15966 - DNA, 25 bp, Mus musculus
taagactcggacaggacaggtgcta

SEQ ID NO: 15967 - DNA, 25 bp, Mus musculus
acatctattctctaactcactgtat

SEQ ID NO: 15968 - DNA, 25 bp, Mus musculus
gccaaactgcttacgaccgtgtata

SEQ ID NO: 15969 - DNA, 25 bp, Mus musculus
tgtgtagcgatctctatttgctgga

SEQ ID NO: 15970 - DNA, 25 bp, Mus musculus
gcgatctctatttgctggacatttt

SEQ ID NO: 15971 - DNA, 25 bp, Mus musculus
ttccttttctggagactccttgaga

SEQ ID NO: 15972 - DNA, 25 bp, Mus musculus
cttttctggagactccttgagaaat

SEQ ID NO: 15973 - DNA, 25 bp, Mus musculus
ttctggagactccttgagaaataca

SEQ ID NO: 15974 - DNA, 25 bp, Mus musculus
cttgagaaatacaaccccacagact

SEQ ID NO: 15975 - DNA, 25 bp, Mus musculus
actgaaccgccgctacaagccaaag

SEQ ID NO: 15976 - DNA, 25 bp, Mus musculus
gaaccgccgctacaagccaaagatt

SEQ ID NO: 15977 - DNA, 25 bp, Mus musculus
ttcagaaacctgtagtctgaaataa

SEQ ID NO: 15978 - DNA, 25 bp, Mus musculus
attctctaactcactgtataagatg

SEQ ID NO: 15979 - DNA, 25 bp, Mus musculus
tcagaaacctgtagtctgaaataaa

SEQ ID NO: 15980 - DNA, 25 bp, Mus musculus
ctctaactcactgtataagatgaaa

SEQ ID NO: 15981 - DNA, 25 bp, Mus musculus
gaaactgcgaattccttaaagctct

SEQ ID NO: 15982 - DNA, 25 bp, Mus musculus
actgcgaattccttaaagctctatc

SEQ ID NO: 15983 - DNA, 25 bp, Mus musculus
gcgaattccttaaagctctatcatg

SEQ ID NO: 15984 - DNA, 25 bp, Mus musculus
ttaaagctctatcatgccaaactgc

SEQ ID NO: 15985 - DNA, 25 bp, Mus musculus
aagctctatcatgccaaactgctta

SEQ ID NO: 15986 - DNA, 25 bp, Mus musculus
tatcatgccaaactgcttacgaccg

SEQ ID NO: 15987 - DNA, 25 bp, Mus musculus
ttcacacaaaggcgtatcctcataa

SEQ ID NO: 15988 - DNA, 25 bp, Mus musculus
acacaaaggcgtatcctcataaatg

SEQ ID NO: 15989 - DNA, 25 bp, Mus musculus
atgttccattcaagtgtaagagatg

SEQ ID NO: 15990 - DNA, 25 bp, Mus musculus
aatttcaacaacagtgtgagcttca

SEQ ID NO: 15991 - DNA, 25 bp, Mus musculus
ttcaacaacagtgtgagcttcaaac

SEQ ID NO: 15992 - DNA, 25 bp, Mus musculus
aagttggcctgctctaagtgtgtaa

SEQ ID NO: 15993 - DNA, 25 bp, Mus musculus
tgtgtaatcctaacatatggggaca

SEQ ID NO: 15994 - DNA, 25 bp, Mus musculus
gtaatcctaacatatggggacattg

SEQ ID NO: 15995 - DNA, 25 bp, Mus musculus
attggcattcaggcaggaaattcat

SEQ ID NO: 15996 - DNA, 25 bp, Mus musculus
aagtaggcatccttgttcacattca

SEQ ID NO: 15997 - DNA, 25 bp, Mus musculus
gcatccttgttcacattcaatgtca

SEQ ID NO: 15998 - DNA, 25 bp, Mus musculus
tccttgttcacattcaatgtcatga

SEQ ID NO: 15999 - DNA, 25 bp, Mus musculus
caaaggcgtatcctcataaatgtga

SEQ ID NO: 16000 - DNA, 25 bp, Mus musculus
actttaatagtccagatccatttct

SEQ ID NO: 16001 - DNA, 25 bp, Mus musculus
ttaatagtccagatccatttctgct

SEQ ID NO: 16002 - DNA, 25 bp, Mus musculus
cagatccatttctgcttagtcacca

SEQ ID NO: 16003 - DNA, 25 bp, Mus musculus
ttagtcaccatattctctcagctca

SEQ ID NO: 16004 - DNA, 25 bp, Mus musculus
accatattctctcagctcacacaaa

SEQ ID NO: 16005 - DNA, 25 bp, Mus musculus
cagctcacacaaagaatgttccatt

SEQ ID NO: 16006 - DNA, 25 bp, Mus musculus
ctcacacaaagaatgttccattcaa

SEQ ID NO: 16007 - DNA, 25 bp, Mus musculus
gagcatcagtacctctgaggtcagg

SEQ ID NO: 16008 - DNA, 25 bp, Mus musculus
ctctgaggtcaggccctatgcaaag

SEQ ID NO: 16009 - DNA, 25 bp, Mus musculus
gttctgagtccctacatcgagcacc

SEQ ID NO: 16010 - DNA, 25 bp, Mus musculus
tgagtccctacatcgagcacccagt

SEQ ID NO: 16011 - DNA, 25 bp, Mus musculus
agtccctacatcgagcacccagtca

SEQ ID NO: 16012 - DNA, 25 bp, Mus musculus
tccctacatcgagcacccagtcaaa

SEQ ID NO: 16013 - DNA, 25 bp, Mus musculus
cctacatcgagcacccagtcaaagt

SEQ ID NO: 16014 - DNA, 25 bp, Mus musculus
tacatcgagcacccagtcaaagtgg

SEQ ID NO: 16015 - DNA, 25 bp, Mus musculus
catcgagcacccagtcaaagtggga

SEQ ID NO: 16016 - DNA, 25 bp, Mus musculus
tcgagcacccagtcaaagtgggaag

SEQ ID NO: 16017 - DNA, 25 bp, Mus musculus
gagcacccagtcaaagtgggaagca

SEQ ID NO: 16018 - DNA, 25 bp, Mus musculus
gcacccagtcaaagtgggaagcata

SEQ ID NO: 16019 - DNA, 25 bp, Mus musculus
gaggtcaggccctatgcaaagattg

SEQ ID NO: 16020 - DNA, 25 bp, Mus musculus
gacgctatgccacagccctgtacta

SEQ ID NO: 16021 - DNA, 25 bp, Mus musculus
cacagccctgtactatgctgcatat

SEQ ID NO: 16022 - DNA, 25 bp, Mus musculus
cagccctgtactatgctgcatatac

SEQ ID NO: 16023 - DNA, 25 bp, Mus musculus
tgtactatgctgcatatacggagac

SEQ ID NO: 16024 - DNA, 25 bp, Mus musculus
ctatgctgcatatacggagacgcag

SEQ ID NO: 16025 - DNA, 25 bp, Mus musculus
atgctgcatatacggagacgcagat

SEQ ID NO: 16026 - DNA, 25 bp, Mus musculus
tgcatatacggagacgcagatggaa

SEQ ID NO: 16027 - DNA, 25 bp, Mus musculus
aaatgcacctgtgactcaaccttgg

SEQ ID NO: 16028 - DNA, 25 bp, Mus musculus
gactcaaccttggagaaggacaggg

SEQ ID NO: 16029 - DNA, 25 bp, Mus musculus
atgcttctttgtacttttccagtgg

SEQ ID NO: 16030 - DNA, 25 bp, Mus musculus
gcctgtggtcagtctacctgtattt

SEQ ID NO: 16031 - DNA, 25 bp, Mus musculus
ggtcagtctacctgtatttctaaca

SEQ ID NO: 16032 - DNA, 25 bp, Mus musculus
tctacctgtatttctaacagttgca

SEQ ID NO: 16033 - DNA, 25 bp, Mus musculus
tgtatttctaacagttgcatactcc

SEQ ID NO: 16034 - DNA, 25 bp, Mus musculus
agttgcatactccaaagcctgcagt

SEQ ID NO: 16035 - DNA, 25 bp, Mus musculus
gagtacctgtgtccatggtatgcaa

SEQ ID NO: 16036 - DNA, 25 bp, Mus musculus
ctgtgtccatggtatgcaatatttc

SEQ ID NO: 16037 - DNA, 25 bp, Mus musculus
atatttcaggctcagcttagataca

SEQ ID NO: 16038 - DNA, 25 bp, Mus musculus
caggctcagcttagatacagaggta

SEQ ID NO: 16039 - DNA, 25 bp, Mus musculus
gagcccgagtatgcggctcagctgg

SEQ ID NO: 16040 - DNA, 25 bp, Mus musculus
caaagactagaccatgctgaggccg

SEQ ID NO: 16041 - DNA, 25 bp, Mus musculus
catgctgaggccgacaggcaggaac

SEQ ID NO: 16042 - DNA, 25 bp, Mus musculus
acacggcttgtgtttgtcgcttgct

SEQ ID NO: 16043 - DNA, 25 bp, Mus musculus
tttgtcgcttgctttgaaaattgaa

SEQ ID NO: 16044 - DNA, 25 bp, Mus musculus
attctaacatcttattgcatgaagg

SEQ ID NO: 16045 - DNA, 25 bp, Mus musculus
acatcttattgcatgaaggtagcta

SEQ ID NO: 16046 - DNA, 25 bp, Mus musculus
aggcattctgttcatttgtatggca

SEQ ID NO: 16047 - DNA, 25 bp, Mus musculus
tctgcccaaggccataccaagctct

SEQ ID NO: 16048 - DNA, 25 bp, Mus musculus
caaggccataccaagctctgtagtc

SEQ ID NO: 16049 - DNA, 25 bp, Mus musculus
tctccatgtactcgtgccccatcag

SEQ ID NO: 16050 - DNA, 25 bp, Mus musculus
ccatcagtgtccaggccccaaggta

SEQ ID NO: 16051 - DNA, 25 bp, Mus musculus
gattcaactttagggctctctggaa

SEQ ID NO: 16052 - DNA, 25 bp, Mus musculus
aatacaaagctgctttctcatgctg

SEQ ID NO: 16053 - DNA, 25 bp, Mus musculus
aagctgctttctcatgctgggagcg

SEQ ID NO: 16054 - DNA, 25 bp, Mus musculus
aattacacagcatgtttctactcgg

SEQ ID NO: 16055 - DNA, 25 bp, Mus musculus
acagcatgtttctactcggtattta

SEQ ID NO: 16056 - DNA, 25 bp, Mus musculus
gtatttatcaatttcacagaggtta

SEQ ID NO: 16057 - DNA, 25 bp, Mus musculus
atcaatttcacagaggttatgcgcc

SEQ ID NO: 16058 - DNA, 25 bp, Mus musculus
atgcgccaggtaactcaattcagac

SEQ ID NO: 16059 - DNA, 25 bp, Mus musculus
cataccaagctctgtagtctctcgt

SEQ ID NO: 16060 - DNA, 25 bp, Mus musculus
aagctctgtagtctctcgtgttgac

SEQ ID NO: 16061 - DNA, 25 bp, Mus musculus
ctctcgtgttgacctcaatggcatg

SEQ ID NO: 16062 - DNA, 25 bp, Mus musculus
tgttgacctcaatggcatgtcggta

SEQ ID NO: 16063 - DNA, 25 bp, Mus musculus
cctcaatggcatgtcggtaagcctg

SEQ ID NO: 16064 - DNA, 25 bp, Mus musculus
tggcatgtcggtaagcctgaatagc

SEQ ID NO: 16065 - DNA, 25 bp, Mus musculus
ctgcagacgtgttcttcatctccat

SEQ ID NO: 16066 - DNA, 25 bp, Mus musculus
acgtgttcttcatctccatgtactc

SEQ ID NO: 16067 - DNA, 25 bp, Mus musculus
agctgcctgctcatcctaatccatc

SEQ ID NO: 16068 - DNA, 25 bp, Mus musculus
gcctgctcatcctaatccatccagg

SEQ ID NO: 16069 - DNA, 25 bp, Mus musculus
gccactgatgctggtgcctgatgac

SEQ ID NO: 16070 - DNA, 25 bp, Mus musculus
cactgatgctggtgcctgatgacca

SEQ ID NO: 16071 - DNA, 25 bp, Mus musculus
ctgatgctggtgcctgatgaccact

SEQ ID NO: 16072 - DNA, 25 bp, Mus musculus
ggtgcctgatgaccacttctcaata

SEQ ID NO: 16073 - DNA, 25 bp, Mus musculus
tgcctgatgaccacttctcaataaa

SEQ ID NO: 16074 - DNA, 25 bp, Mus musculus
cctgatgaccacttctcaataaatt

SEQ ID NO: 16075 - DNA, 25 bp, Mus musculus
atgaccacttctcaataaattgttc

SEQ ID NO: 16076 - DNA, 25 bp, Mus musculus
gaccacttctcaataaattgttcgc

SEQ ID NO: 16077 - DNA, 25 bp, Mus musculus
ccacttctcaataaattgttcgcaa

SEQ ID NO: 16078 - DNA, 25 bp, Mus musculus
acttctcaataaattgttcgcaata

SEQ ID NO: 16079 - DNA, 25 bp, Mus musculus
ctgctcatcctaatccatccaggtg

SEQ ID NO: 16080 - DNA, 25 bp, Mus musculus
tcatcctaatccatccaggtgactc

SEQ ID NO: 16081 - DNA, 25 bp, Mus musculus
cctaatccatccaggtgactcgcag

SEQ ID NO: 16082 - DNA, 25 bp, Mus musculus
taatccatccaggtgactcgcagcc

SEQ ID NO: 16083 - DNA, 25 bp, Mus musculus
gagtactgaggccactgatgctggt

SEQ ID NO: 16084 - DNA, 25 bp, Mus musculus
gtactgaggccactgatgctggtgc

SEQ ID NO: 16085 - DNA, 25 bp, Mus musculus
actgaggccactgatgctggtgcct

SEQ ID NO: 16086 - DNA, 25 bp, Mus musculus
tgaggccactgatgctggtgcctga

SEQ ID NO: 16087 - DNA, 25 bp, Mus musculus
acacattgggctcctgctcaccaat

SEQ ID NO: 16088 - DNA, 25 bp, Mus musculus
cacattgggctcctgctcaccaatc

SEQ ID NO: 16089 - DNA, 25 bp, Mus musculus
ttgtcctactgtcctttcaggtcca

SEQ ID NO: 16090 - DNA, 25 bp, Mus musculus
tgtcctactgtcctttcaggtccag

SEQ ID NO: 16091 - DNA, 25 bp, Mus musculus
gtcctactgtcctttcaggtccagg

SEQ ID NO: 16092 - DNA, 25 bp, Mus musculus
tcctactgtcctttcaggtccaggc

SEQ ID NO: 16093 - DNA, 25 bp, Mus musculus
cctactgtcctttcaggtccaggct

SEQ ID NO: 16094 - DNA, 25 bp, Mus musculus
attgggctcctgctcaccaatcctc

SEQ ID NO: 16095 - DNA, 25 bp, Mus musculus
ctttctgcccttgtcctactgtcct

SEQ ID NO: 16096 - DNA, 25 bp, Mus musculus
tttctgcccttgtcctactgtcctt

SEQ ID NO: 16097 - DNA, 25 bp, Mus musculus
ttctgcccttgtcctactgtccttt

SEQ ID NO: 16098 - DNA, 25 bp, Mus musculus
tctgcccttgtcctactgtcctttc

SEQ ID NO: 16099 - DNA, 25 bp, Mus musculus
ctgcccttgtcctactgtcctttca

SEQ ID NO: 16100 - DNA, 25 bp, Mus musculus
tgcccttgtcctactgtcctttcag

SEQ ID NO: 16101 - DNA, 25 bp, Mus musculus
gcccttgtcctactgtcctttcagg

SEQ ID NO: 16102 - DNA, 25 bp, Mus musculus
acacattgggctcctgctcaccaat

SEQ ID NO: 16103 - DNA, 25 bp, Mus musculus
cacattgggctcctgctcaccaatc

SEQ ID NO: 16104 - DNA, 25 bp, Mus musculus
gcccttgtcctactgtcctttcagg

SEQ ID NO: 16105 - DNA, 25 bp, Mus musculus
ttgtcctactgtcctttcaggtcca

SEQ ID NO: 16106 - DNA, 25 bp, Mus musculus
tgtcctactgtcctttcaggtccag

SEQ ID NO: 16107 - DNA, 25 bp, Mus musculus
gtcctactgtcctttcaggtccagg

SEQ ID NO: 16108 - DNA, 25 bp, Mus musculus
tcctactgtcctttcaggtccaggc

SEQ ID NO: 16109 - DNA, 25 bp, Mus musculus
cctactgtcctttcaggtccaggct

SEQ ID NO: 16110 - DNA, 25 bp, Mus musculus
attgggctcctgctcaccaatcctc

SEQ ID NO: 16111 - DNA, 25 bp, Mus musculus
ttgggctcctgctcaccaatcctcc

SEQ ID NO: 16112 - DNA, 25 bp, Mus musculus
ctttctgcccttgtcctactgtcct

SEQ ID NO: 16113 - DNA, 25 bp, Mus musculus
tttctgcccttgtcctactgtcctt

SEQ ID NO: 16114 - DNA, 25 bp, Mus musculus
ttctgcccttgtcctactgtccttt

SEQ ID NO: 16115 - DNA, 25 bp, Mus musculus
tctgcccttgtcctactgtcctttc

SEQ ID NO: 16116 - DNA, 25 bp, Mus musculus
ctgcccttgtcctactgtcctttca

SEQ ID NO: 16117 - DNA, 25 bp, Mus musculus
tgcccttgtcctactgtcctttcag

SEQ ID NO: 16118 - DNA, 25 bp, Mus musculus
cgccgctgctcagccattgtacttt

SEQ ID NO: 16119 - DNA, 25 bp, Mus musculus
cgctgctcagccattgtactttgga

SEQ ID NO: 16120 - DNA, 25 bp, Mus musculus
tgagacacaagtcacttgtttggaa

SEQ ID NO: 16121 - DNA, 25 bp, Mus musculus
gacacaagtcacttgtttggaaaat

SEQ ID NO: 16122 - DNA, 25 bp, Mus musculus
agcttctgaaaactctgggatctca

SEQ ID NO: 16123 - DNA, 25 bp, Mus musculus
tgaaaactctgggatctcaacatgc

SEQ ID NO: 16124 - DNA, 25 bp, Mus musculus
aaactctgggatctcaacatgcacc

SEQ ID NO: 16125 - DNA, 25 bp, Mus musculus
tgggatctcaacatgcaccgttggg

SEQ ID NO: 16126 - DNA, 25 bp, Mus musculus
gatctcaacatgcaccgttgggctg

SEQ ID NO: 16127 - DNA, 25 bp, Mus musculus
gatcgatgctggcagtcggtatgag

SEQ ID NO: 16128 - DNA, 25 bp, Mus musculus
cgatgctggcagtcggtatgagaat

SEQ ID NO: 16129 - DNA, 25 bp, Mus musculus
tgctggcagtcggtatgagaatgaa

SEQ ID NO: 16130 - DNA, 25 bp, Mus musculus
ccgactcagaagtacacaggctgct

SEQ ID NO: 16131 - DNA, 25 bp, Mus musculus
tacacaggctgctccacaagttgtt

SEQ ID NO: 16132 - DNA, 25 bp, Mus musculus
acaggctgctccacaagttgttctg

SEQ ID NO: 16133 - DNA, 25 bp, Mus musculus
ggctgctccacaagttgttctgaat

SEQ ID NO: 16134 - DNA, 25 bp, Mus musculus
tgctccacaagttgttctgaatgtt

SEQ ID NO: 16135 - DNA, 25 bp, Mus musculus
agttgttctgaatgttcctgagaca

SEQ ID NO: 16136 - DNA, 25 bp, Mus musculus
tgttcctgagacacaagtcacttgt

SEQ ID NO: 16137 - DNA, 25 bp, Mus musculus
tcctgagacacaagtcacttgtttg

SEQ ID NO: 16138 - DNA, 25 bp, Mus musculus
cacgcagttcgcatgatccagcgtg

SEQ ID NO: 16139 - DNA, 25 bp, Mus musculus
cagaaaagcatcatcattcacacct

SEQ ID NO: 16140 - DNA, 25 bp, Mus musculus
ctgagacatgctttccgcagcatgt

SEQ ID NO: 16141 - DNA, 25 bp, Mus musculus
ttccgcagcatgttcccttcatgtg

SEQ ID NO: 16142 - DNA, 25 bp, Mus musculus
agcatgttcccttcatgtgaaggca

SEQ ID NO: 16143 - DNA, 25 bp, Mus musculus
gaaggcactgcgcagcctctagata

SEQ ID NO: 16144 - DNA, 25 bp, Mus musculus
actgcgcagcctctagataacagca

SEQ ID NO: 16145 - DNA, 25 bp, Mus musculus
gactgcctgcacaagcacgccaata

SEQ ID NO: 16146 - DNA, 25 bp, Mus musculus
aagcacgccaataacacagccagca

SEQ ID NO: 16147 - DNA, 25 bp, Mus musculus
agctgcatcaagagcactgttaaga

SEQ ID NO: 16148 - DNA, 25 bp, Mus musculus
tccacagacacgtctgccgaggctc

SEQ ID NO: 16149 - DNA, 25 bp, Mus musculus
gctgctgcttttgtggctgcccaga

SEQ ID NO: 16150 - DNA, 25 bp, Mus musculus
atcattcacacctcagaagatggca

SEQ ID NO: 16151 - DNA, 25 bp, Mus musculus
atcctggtggtgttgatcatctgct

SEQ ID NO: 16152 - DNA, 25 bp, Mus musculus
atctgctggggccctctgcttgcga

SEQ ID NO: 16153 - DNA, 25 bp, Mus musculus
cttgcgatcatggtgtatgatgtct

SEQ ID NO: 16154 - DNA, 25 bp, Mus musculus
gtgtttgccttctgtagtatgctct

SEQ ID NO: 16155 - DNA, 25 bp, Mus musculus
gccttctgtagtatgctctgcctgc

SEQ ID NO: 16156 - DNA, 25 bp, Mus musculus
atgctctgcctgctgaactccaccg

SEQ ID NO: 16157 - DNA, 25 bp, Mus musculus
atctatgctctgaggagcaaggacc

SEQ ID NO: 16158 - DNA, 25 bp, Mus musculus
aaagtcacgctgtctactgataaaa

SEQ ID NO: 16159 - DNA, 25 bp, Mus musculus
agtcacgctgtctactgataaaaac

SEQ ID NO: 16160 - DNA, 25 bp, Mus musculus
tggaaggccacgaactgcatgagga

SEQ ID NO: 16161 - DNA, 25 bp, Mus musculus
gaaggccacgaactgcatgaggaag

SEQ ID NO: 16162 - DNA, 25 bp, Mus musculus
gccacgaactgcatgaggaagacat

SEQ ID NO: 16163 - DNA, 25 bp, Mus musculus
ggaagacattcgcctcatgtacacc

SEQ ID NO: 16164 - DNA, 25 bp, Mus musculus
gacattcgcctcatgtacacctttg

SEQ ID NO: 16165 - DNA, 25 bp, Mus musculus
cattcgcctcatgtacacctttgac

SEQ ID NO: 16166 - DNA, 25 bp, Mus musculus
ttcgcctcatgtacacctttgacca

SEQ ID NO: 16167 - DNA, 25 bp, Mus musculus
cgcctcatgtacacctttgaccagg

SEQ ID NO: 16168 - DNA, 25 bp, Mus musculus
tcatgtacacctttgaccaggccac

SEQ ID NO: 16169 - DNA, 25 bp, Mus musculus
atgtacacctttgaccaggccacgg

SEQ ID NO: 16170 - DNA, 25 bp, Mus musculus
gctgaaccagatcacatggtccttg

SEQ ID NO: 16171 - DNA, 25 bp, Mus musculus
tgaaccagatcacatggtccttggg

SEQ ID NO: 16172 - DNA, 25 bp, Mus musculus
atcacatggtccttgggaagcgcct

SEQ ID NO: 16173 - DNA, 25 bp, Mus musculus
gggccttcaaagcggtgatgatggc

SEQ ID NO: 16174 - DNA, 25 bp, Mus musculus
gccttcaaagcggtgatgatggcca

SEQ ID NO: 16175 - DNA, 25 bp, Mus musculus
cttcaaagcggtgatgatggccata

SEQ ID NO: 16176 - DNA, 25 bp, Mus musculus
atggccataaagcggctgagcaatg

SEQ ID NO: 16177 - DNA, 25 bp, Mus musculus
ccataaagcggctgagcaatgagga

SEQ ID NO: 16178 - DNA, 25 bp, Mus musculus
caagcaagttccaaagccagcctgg

SEQ ID NO: 16179 - DNA, 25 bp, Mus musculus
aaagccagcctggaacatcagagcc

SEQ ID NO: 16180 - DNA, 25 bp, Mus musculus
ttgggctcttagcttagtctgttgt

SEQ ID NO: 16181 - DNA, 25 bp, Mus musculus
cttagtctgttgtttcatgcaaaca

SEQ ID NO: 16182 - DNA, 25 bp, Mus musculus
tttcatgcaaacaccgttgtaacca

SEQ ID NO: 16183 - DNA, 25 bp, Mus musculus
gtaaccaaaagcttctgcactttgc

SEQ ID NO: 16184 - DNA, 25 bp, Mus musculus
cttctgttgttcctgtacaagaaat

SEQ ID NO: 16185 - DNA, 25 bp, Mus musculus
ttgttcctgtacaagaaatgcaacg

SEQ ID NO: 16186 - DNA, 25 bp, Mus musculus
tgcaacggccactgcattttaatga

SEQ ID NO: 16187 - DNA, 25 bp, Mus musculus
ggccactgcattttaatgattgtta

SEQ ID NO: 16188 - DNA, 25 bp, Mus musculus
gtaacagtctatatcactataccct

SEQ ID NO: 16189 - DNA, 25 bp, Mus musculus
gtctatatcactatacccttttagt

SEQ ID NO: 16190 - DNA, 25 bp, Mus musculus
gaacatcagagccacaagtttcaca

SEQ ID NO: 16191 - DNA, 25 bp, Mus musculus
cacaagtttcacagccacaaggaca

SEQ ID NO: 16192 - DNA, 25 bp, Mus musculus
tttcacagccacaaggacaagctag

SEQ ID NO: 16193 - DNA, 25 bp, Mus musculus
ttccgaatttctcatgaattagaga

SEQ ID NO: 16194 - DNA, 25 bp, Mus musculus
agttcatcttctgaggtcaactaaa

SEQ ID NO: 16195 - DNA, 25 bp, Mus musculus
tcttctgaggtcaactaaagaagag

SEQ ID NO: 16196 - DNA, 25 bp, Mus musculus
actaactgctcatttctcagttcag

SEQ ID NO: 16197 - DNA, 25 bp, Mus musculus
tgctcatttctcagttcagtggata

SEQ ID NO: 16198 - DNA, 25 bp, Mus musculus
gatatccttcccttgaagctgcttg

SEQ ID NO: 16199 - DNA, 25 bp, Mus musculus
cttcccttgaagctgcttgtgcccc

SEQ ID NO: 16200 - DNA, 25 bp, Mus musculus
gccatctgcaatcatgtgggcctgt

SEQ ID NO: 16201 - DNA, 25 bp, Mus musculus
atctgcaatcatgtgggcctgtgcc

SEQ ID NO: 16202 - DNA, 25 bp, Mus musculus
tgcaatcatgtgggcctgtgccacg

SEQ ID NO: 16203 - DNA, 25 bp, Mus musculus
tgccacgtgggcaggctaagccaga

SEQ ID NO: 16204 - DNA, 25 bp, Mus musculus
aacagaatccagggatgccggatgc

SEQ ID NO: 16205 - DNA, 25 bp, Mus musculus
agaatccagggatgccggatgccgt

SEQ ID NO: 16206 - DNA, 25 bp, Mus musculus
tgccggatgccgttccaaacctctg

SEQ ID NO: 16207 - DNA, 25 bp, Mus musculus
ttccaaacctctgctggacaagctg

SEQ ID NO: 16208 - DNA, 25 bp, Mus musculus
ggacaagctggtcctccctgtgctg

SEQ ID NO: 16209 - DNA, 25 bp, Mus musculus
tgtgctgccaggagccctcttggca

SEQ ID NO: 16210 - DNA, 25 bp, Mus musculus
ttgaagctgcttgtgccccggtgtc

SEQ ID NO: 16211 - DNA, 25 bp, Mus musculus
cggtgtcgccaagtgcttgatgtct

SEQ ID NO: 16212 - DNA, 25 bp, Mus musculus
tgtcgccaagtgcttgatgtctacc

SEQ ID NO: 16213 - DNA, 25 bp, Mus musculus
gttattgactacttccagagccaga

SEQ ID NO: 16214 - DNA, 25 bp, Mus musculus
gactacttccagagccagattaacc

SEQ ID NO: 16215 - DNA, 25 bp, Mus musculus
attaaccccaaagccatctgcaatc

SEQ ID NO: 16216 - DNA, 25 bp, Mus musculus
aaccccaaagccatctgcaatcatg

SEQ ID NO: 16217 - DNA, 25 bp, Mus musculus
cccaaagccatctgcaatcatgtgg

SEQ ID NO: 16218 - DNA, 25 bp, Mus musculus
ctccgagtactaccctagagctata

SEQ ID NO: 16219 - DNA, 25 bp, Mus musculus
cgagtactaccctagagctataaag

SEQ ID NO: 16220 - DNA, 25 bp, Mus musculus
ttgggccagacgactaacagcatgt

SEQ ID NO: 16221 - DNA, 25 bp, Mus musculus
acgactaacagcatgtgatggctca

SEQ ID NO: 16222 - DNA, 25 bp, Mus musculus
tgatggctcaggctgaagaactggg

SEQ ID NO: 16223 - DNA, 25 bp, Mus musculus
gctgttagtccccactgttatcttg

SEQ ID NO: 16224 - DNA, 25 bp, Mus musculus
ccccactgttatcttggtgcctggt

SEQ ID NO: 16225 - DNA, 25 bp, Mus musculus
tcatattgtaacccctgtgaacaac

SEQ ID NO: 16226 - DNA, 25 bp, Mus musculus
aatataaccactccatgcaggccca

SEQ ID NO: 16227 - DNA, 25 bp, Mus musculus
ccatgcaggcccaactgtcgagggt

SEQ ID NO: 16228 - DNA, 25 bp, Mus musculus
tgcaggcccaactgtcgagggtttt

SEQ ID NO: 16229 - DNA, 25 bp, Mus musculus
taatacatggtttcaacttggattt

SEQ ID NO: 16230 - DNA, 25 bp, Mus musculus
aggcttgtctctatactgtctatcc

SEQ ID NO: 16231 - DNA, 25 bp, Mus musculus
cttgtctctatactgtctatccctg

SEQ ID NO: 16232 - DNA, 25 bp, Mus musculus
tctatactgtctatccctgaacact

SEQ ID NO: 16233 - DNA, 25 bp, Mus musculus
actgtttacacattttgcacttggg

SEQ ID NO: 16234 - DNA, 25 bp, Mus musculus
gtcatccctctgaggtttctcaggt

SEQ ID NO: 16235 - DNA, 25 bp, Mus musculus
tttctcaggtggcaatgtaactcat

SEQ ID NO: 16236 - DNA, 25 bp, Mus musculus
caatgtaactcatttctttgttcct

SEQ ID NO: 16237 - DNA, 25 bp, Mus musculus
gctttgggccagacgactaacagca

SEQ ID NO: 16238 - DNA, 25 bp, Mus musculus
agggacgctgtcattgcaagaggtg

SEQ ID NO: 16239 - DNA, 25 bp, Mus musculus
gagccgcttcagcacgtactgatgg

SEQ ID NO: 16240 - DNA, 25 bp, Mus musculus
gcaaagtgcatacgcgcacgcagat

SEQ ID NO: 16241 - DNA, 25 bp, Mus musculus
aaagtgcatacgcgcacgcagatca

SEQ ID NO: 16242 - DNA, 25 bp, Mus musculus
agtgcatacgcgcacgcagatcatg

SEQ ID NO: 16243 - DNA, 25 bp, Mus musculus
gtgcatacgcgcacgcagatcatga

SEQ ID NO: 16244 - DNA, 25 bp, Mus musculus
gcatacgcgcacgcagatcatgaat

SEQ ID NO: 16245 - DNA, 25 bp, Mus musculus
catacgcgcacgcagatcatgaata

SEQ ID NO: 16246 - DNA, 25 bp, Mus musculus
atacgcgcacgcagatcatgaataa

SEQ ID NO: 16247 - DNA, 25 bp, Mus musculus
tacgcgcacgcagatcatgaataag

SEQ ID NO: 16248 - DNA, 25 bp, Mus musculus
cgcgcacgcagatcatgaataagat

SEQ ID NO: 16249 - DNA, 25 bp, Mus musculus
agatttcatgggattgccttgatgc

SEQ ID NO: 16250 - DNA, 25 bp, Mus musculus
agccgcttcagcacgtactgatggt

SEQ ID NO: 16251 - DNA, 25 bp, Mus musculus
gccgcttcagcacgtactgatggta

SEQ ID NO: 16252 - DNA, 25 bp, Mus musculus
ccgcttcagcacgtactgatggtag

SEQ ID NO: 16253 - DNA, 25 bp, Mus musculus
gcttcagcacgtactgatggtagag

SEQ ID NO: 16254 - DNA, 25 bp, Mus musculus
cttcagcacgtactgatggtagagt

SEQ ID NO: 16255 - DNA, 25 bp, Mus musculus
ttcagcacgtactgatggtagagta

SEQ ID NO: 16256 - DNA, 25 bp, Mus musculus
tcagcacgtactgatggtagagtac

SEQ ID NO: 16257 - DNA, 25 bp, Mus musculus
agcacgtactgatggtagagtacgg

SEQ ID NO: 16258 - DNA, 25 bp, Mus musculus
gcagacccgagatccacgtgacaca

SEQ ID NO: 16259 - DNA, 25 bp, Mus musculus
tccacgtgacacagacagtgacggg

SEQ ID NO: 16260 - DNA, 25 bp, Mus musculus
aacacaagctgccctggaccttcgt

SEQ ID NO: 16261 - DNA, 25 bp, Mus musculus
cacccttacatcagcttcttagact

SEQ ID NO: 16262 - DNA, 25 bp, Mus musculus
atcccagacaggcactgggcaaaca

SEQ ID NO: 16263 - DNA, 25 bp, Mus musculus
taagcactgaggtccgtggtccttt

SEQ ID NO: 16264 - DNA, 25 bp, Mus musculus
ctctccctaaacatgccactcttgt

SEQ ID NO: 16265 - DNA, 25 bp, Mus musculus
ctaaacatgccactcttgtgtcccg

SEQ ID NO: 16266 - DNA, 25 bp, Mus musculus
cggcaaaagccactggcagtggctc

SEQ ID NO: 16267 - DNA, 25 bp, Mus musculus
aagccactggcagtggctcccaacc

SEQ ID NO: 16268 - DNA, 25 bp, Mus musculus
gacttggcctgccctttggaactgt

SEQ ID NO: 16269 - DNA, 25 bp, Mus musculus
gcctgccctttggaactgtgccctt

SEQ ID NO: 16270 - DNA, 25 bp, Mus musculus
tcagggtcctgtgggctcaggcagc

SEQ ID NO: 16271 - DNA, 25 bp, Mus musculus
cctgcatgccttttctggtagtgct

SEQ ID NO: 16272 - DNA, 25 bp, Mus musculus
tgccttttctggtagtgctgcctgg

SEQ ID NO: 16273 - DNA, 25 bp, Mus musculus
ttctggtagtgctgcctgggatgac

SEQ ID NO: 16274 - DNA, 25 bp, Mus musculus
tagtgctgcctgggatgacagcgct

SEQ ID NO: 16275 - DNA, 25 bp, Mus musculus
ccgggtcactgcactataggagtca

SEQ ID NO: 16276 - DNA, 25 bp, Mus musculus
cactgcactataggagtcagcttgt

SEQ ID NO: 16277 - DNA, 25 bp, Mus musculus
cttttcccatgcatgttatggtgaa

SEQ ID NO: 16278 - DNA, 25 bp, Mus musculus
ggcccccaaagtgctactcctatct

SEQ ID NO: 16279 - DNA, 25 bp, Mus musculus
cccccaaagtgctactcctatctgg

SEQ ID NO: 16280 - DNA, 25 bp, Mus musculus
gcgacgacaccgaggctcgcaagcg

SEQ ID NO: 16281 - DNA, 25 bp, Mus musculus
cgacgacaccgaggctcgcaagcgg

SEQ ID NO: 16282 - DNA, 25 bp, Mus musculus
acgacaccgaggctcgcaagcggca

SEQ ID NO: 16283 - DNA, 25 bp, Mus musculus
gacaccgaggctcgcaagcggcacg

SEQ ID NO: 16284 - DNA, 25 bp, Mus musculus
acaccgaggctcgcaagcggcacgc

SEQ ID NO: 16285 - DNA, 25 bp, Mus musculus
gcacctgagcccggagagaaagcgc

SEQ ID NO: 16286 - DNA, 25 bp, Mus musculus
cacctgagcccggagagaaagcgct

SEQ ID NO: 16287 - DNA, 25 bp, Mus musculus
acctgagcccggagagaaagcgctg

SEQ ID NO: 16288 - DNA, 25 bp, Mus musculus
aagagaaccagaaactccagctaga

SEQ ID NO: 16289 - DNA, 25 bp, Mus musculus
agagaaccagaaactccagctagaa

SEQ ID NO: 16290 - DNA, 25 bp, Mus musculus
ccccaaagtgctactcctatctggt

SEQ ID NO: 16291 - DNA, 25 bp, Mus musculus
gagaaccagaaactccagctagaaa

SEQ ID NO: 16292 - DNA, 25 bp, Mus musculus
cccaaagtgctactcctatctggtc

SEQ ID NO: 16293 - DNA, 25 bp, Mus musculus
ccaaagtgctactcctatctggtca

SEQ ID NO: 16294 - DNA, 25 bp, Mus musculus
aaagtgctactcctatctggtcagc

SEQ ID NO: 16295 - DNA, 25 bp, Mus musculus
aagtgctactcctatctggtcagcc

SEQ ID NO: 16296 - DNA, 25 bp, Mus musculus
agtgctactcctatctggtcagccc

SEQ ID NO: 16297 - DNA, 25 bp, Mus musculus
gtgctactcctatctggtcagcccg

SEQ ID NO: 16298 - DNA, 25 bp, Mus musculus
aggcgacgacaccgaggctcgcaag

SEQ ID NO: 16299 - DNA, 25 bp, Mus musculus
catctttagagctggcctcatcaca

SEQ ID NO: 16300 - DNA, 25 bp, Mus musculus
ctttagagctggcctcatcacagtt

SEQ ID NO: 16301 - DNA, 25 bp, Mus musculus
gtcaaatcatcttctatgtcttgct

SEQ ID NO: 16302 - DNA, 25 bp, Mus musculus
aaatctcaactatattgataacctg

SEQ ID NO: 16303 - DNA, 25 bp, Mus musculus
tattgataacctgcagcgcaaaatt

SEQ ID NO: 16304 - DNA, 25 bp, Mus musculus
ccatcctttgggttgcttcttgtat

SEQ ID NO: 16305 - DNA, 25 bp, Mus musculus
tttgggttgcttcttgtatgccaca

SEQ ID NO: 16306 - DNA, 25 bp, Mus musculus
gggttgcttcttgtatgccacagct

SEQ ID NO: 16307 - DNA, 25 bp, Mus musculus
ttgcttcttgtatgccacagctgaa

SEQ ID NO: 16308 - DNA, 25 bp, Mus musculus
cttgtatgccacagctgaattatat

SEQ ID NO: 16309 - DNA, 25 bp, Mus musculus
tgagcatatttcttactgagaaaat

SEQ ID NO: 16310 - DNA, 25 bp, Mus musculus
tatttcttactgagaaaatgtctgt

SEQ ID NO: 16311 - DNA, 25 bp, Mus musculus
tagagctggcctcatcacagttgtg

SEQ ID NO: 16312 - DNA, 25 bp, Mus musculus
cctcatcacagttgtgactatttct

SEQ ID NO: 16313 - DNA, 25 bp, Mus musculus
tgtgactatttctgctccagtgaag

SEQ ID NO: 16314 - DNA, 25 bp, Mus musculus
gactatttctgctccagtgaagaga

SEQ ID NO: 16315 - DNA, 25 bp, Mus musculus
ttacttatgtgtcgtagaagtgttt

SEQ ID NO: 16316 - DNA, 25 bp, Mus musculus
aaattctacttagtcaaatcatctt

SEQ ID NO: 16317 - DNA, 25 bp, Mus musculus
tacttagtcaaatcatcttctatgt

SEQ ID NO: 16318 - DNA, 25 bp, Mus musculus
ttagtcaaatcatcttctatgtctt

SEQ ID NO: 16319 - DNA, 25 bp, Mus musculus
cgtattggccgaaccgcgcagcacc

SEQ ID NO: 16320 - DNA, 25 bp, Mus musculus
attggccgaaccgcgcagcaccaac

SEQ ID NO: 16321 - DNA, 25 bp, Mus musculus
taccccgggcaacctgaagcaggct

SEQ ID NO: 16322 - DNA, 25 bp, Mus musculus
caacctgaagcaggctagagagctg

SEQ ID NO: 16323 - DNA, 25 bp, Mus musculus
aaagttgatgcagcttgtggaccac

SEQ ID NO: 16324 - DNA, 25 bp, Mus musculus
ccggactacttcttcagccaacaat

SEQ ID NO: 16325 - DNA, 25 bp, Mus musculus
tacttcttcagccaacaatcccaac

SEQ ID NO: 16326 - DNA, 25 bp, Mus musculus
ttcttcagccaacaatcccaacctg

SEQ ID NO: 16327 - DNA, 25 bp, Mus musculus
ttcagccaacaatcccaacctgatg

SEQ ID NO: 16328 - DNA, 25 bp, Mus musculus
agccaacaatcccaacctgatgtat

SEQ ID NO: 16329 - DNA, 25 bp, Mus musculus
caacaatcccaacctgatgtatcag

SEQ ID NO: 16330 - DNA, 25 bp, Mus musculus
caatcccaacctgatgtatcaggat

SEQ ID NO: 16331 - DNA, 25 bp, Mus musculus
ggccgaaccgcgcagcaccaacaag

SEQ ID NO: 16332 - DNA, 25 bp, Mus musculus
cgaaccgcgcagcaccaacaagggc

SEQ ID NO: 16333 - DNA, 25 bp, Mus musculus
accgcgcagcaccaacaagggcact

SEQ ID NO: 16334 - DNA, 25 bp, Mus musculus
gcgcagcaccaacaagggcactgcc

SEQ ID NO: 16335 - DNA, 25 bp, Mus musculus
cagcaccaacaagggcactgcctat

SEQ ID NO: 16336 - DNA, 25 bp, Mus musculus
caccaacaagggcactgcctatact

SEQ ID NO: 16337 - DNA, 25 bp, Mus musculus
caacaagggcactgcctatactttc

SEQ ID NO: 16338 - DNA, 25 bp, Mus musculus
caagggcactgcctatactttcttt

SEQ ID NO: 16339 - DNA, 25 bp, Mus musculus
actacaattacaatggcttacgtga

SEQ ID NO: 16340 - DNA, 25 bp, Mus musculus
attacaatggcttacgtgacattga

SEQ ID NO: 16341 - DNA, 25 bp, Mus musculus
tggacttcactcagcctgcagacaa

SEQ ID NO: 16342 - DNA, 25 bp, Mus musculus
ctcagcctgcagacaagtgtgatgg

SEQ ID NO: 16343 - DNA, 25 bp, Mus musculus
ctgtgtcttctttcatccttcctca

SEQ ID NO: 16344 - DNA, 25 bp, Mus musculus
ttcctcaccgacctgacaatgatga

SEQ ID NO: 16345 - DNA, 25 bp, Mus musculus
accgacctgacaatgatgagagctg

SEQ ID NO: 16346 - DNA, 25 bp, Mus musculus
atagttccgaggatgagtcgaagtg

SEQ ID NO: 16347 - DNA, 25 bp, Mus musculus
tgaagatgcacacagctcgggtgat

SEQ ID NO: 16348 - DNA, 25 bp, Mus musculus
tgcacacagctcgggtgatggacat

SEQ ID NO: 16349 - DNA, 25 bp, Mus musculus
acacagctcgggtgatggacatcga

SEQ ID NO: 16350 - DNA, 25 bp, Mus musculus
tggacatcgagcatctcaccggttt

SEQ ID NO: 16351 - DNA, 25 bp, Mus musculus
atggcttacgtgacattgaggatga

SEQ ID NO: 16352 - DNA, 25 bp, Mus musculus
tcgagcatctcaccggtttggattt

SEQ ID NO: 16353 - DNA, 25 bp, Mus musculus
aaggcagctctattcctgtccctac

SEQ ID NO: 16354 - DNA, 25 bp, Mus musculus
actactacagcatcatcaccagctg

SEQ ID NO: 16355 - DNA, 25 bp, Mus musculus
actacagcatcatcaccagctgcct

SEQ ID NO: 16356 - DNA, 25 bp, Mus musculus
gcatcatcaccagctgcctggactt

SEQ ID NO: 16357 - DNA, 25 bp, Mus musculus
tcaccagctgcctggacttcactca

SEQ ID NO: 16358 - DNA, 25 bp, Mus musculus
gctgcctggacttcactcagcctgc

SEQ ID NO: 16359 - DNA, 25 bp, Mus musculus
gcctggacttcactcagcctgcaga

SEQ ID NO: 16360 - DNA, 25 bp, Mus musculus
agaatcggagtctaacctgggcatt

SEQ ID NO: 16361 - DNA, 25 bp, Mus musculus
gaatcggagtctaacctgggcattt

SEQ ID NO: 16362 - DNA, 25 bp, Mus musculus
aatctacagattcaacatgtcttac

SEQ ID NO: 16363 - DNA, 25 bp, Mus musculus
atctacagattcaacatgtcttaca

SEQ ID NO: 16364 - DNA, 25 bp, Mus musculus
tctacagattcaacatgtcttacat

SEQ ID NO: 16365 - DNA, 25 bp, Mus musculus
ctacagattcaacatgtcttacata

SEQ ID NO: 16366 - DNA, 25 bp, Mus musculus
tacagattcaacatgtcttacatag

SEQ ID NO: 16367 - DNA, 25 bp, Mus musculus
acagattcaacatgtcttacataga

SEQ ID NO: 16368 - DNA, 25 bp, Mus musculus
cagattcaacatgtcttacatagat

SEQ ID NO: 16369 - DNA, 25 bp, Mus musculus
agattcaacatgtcttacatagatt

SEQ ID NO: 16370 - DNA, 25 bp, Mus musculus
gattcaacatgtcttacatagattc

SEQ ID NO: 16371 - DNA, 25 bp, Mus musculus
attcaacatgtcttacatagattca

SEQ ID NO: 16372 - DNA, 25 bp, Mus musculus
gactgcgctatgttacttgatttat

SEQ ID NO: 16373 - DNA, 25 bp, Mus musculus
actgcgctatgttacttgatttata

SEQ ID NO: 16374 - DNA, 25 bp, Mus musculus
aatattatcctggaatatgttggat

SEQ ID NO: 16375 - DNA, 25 bp, Mus musculus
atattatcctggaatatgttggatg

SEQ ID NO: 16376 - DNA, 25 bp, Mus musculus
tattatcctggaatatgttggatgt

SEQ ID NO: 16377 - DNA, 25 bp, Mus musculus
attatcctggaatatgttggatgta

SEQ ID NO: 16378 - DNA, 25 bp, Mus musculus
tgattgtgtttgccacttttagggt

SEQ ID NO: 16379 - DNA, 25 bp, Mus musculus
aaatctacagattcaacatgtctta

SEQ ID NO: 16380 - DNA, 25 bp, Mus musculus
tcgccgcttcggattcttggaccag

SEQ ID NO: 16381 - DNA, 25 bp, Mus musculus
ccgcttcggattcttggaccagact

SEQ ID NO: 16382 - DNA, 25 bp, Mus musculus
tcgctctgtcttggcactaggaatt

SEQ ID NO: 16383 - DNA, 25 bp, Mus musculus
ttccttgacttttgacaaattgaga

SEQ ID NO: 16384 - DNA, 25 bp, Mus musculus
agagattcacaggtccagcgtttta

SEQ ID NO: 16385 - DNA, 25 bp, Mus musculus
ctccaagaaatgcctctacttgttc

SEQ ID NO: 16386 - DNA, 25 bp, Mus musculus
caagaaatgcctctacttgttcaca

SEQ ID NO: 16387 - DNA, 25 bp, Mus musculus
gaaatgcctctacttgttcacactt

SEQ ID NO: 16388 - DNA, 25 bp, Mus musculus
ctacttgttcacacttgtttggtag

SEQ ID NO: 16389 - DNA, 25 bp, Mus musculus
cttgttcacacttgtttggtagact

SEQ ID NO: 16390 - DNA, 25 bp, Mus musculus
gtacttactacgtattctttgcaag

SEQ ID NO: 16391 - DNA, 25 bp, Mus musculus
acgtattctttgcaaggagtattgt

SEQ ID NO: 16392 - DNA, 25 bp, Mus musculus
cttggaccagactgtgttgggcgac

SEQ ID NO: 16393 - DNA, 25 bp, Mus musculus
gtttagctcagagggtccatctatt

SEQ ID NO: 16394 - DNA, 25 bp, Mus musculus
tagctcagagggtccatctatttat

SEQ ID NO: 16395 - DNA, 25 bp, Mus musculus
gggtccatctatttatgcaaaatcg

SEQ ID NO: 16396 - DNA, 25 bp, Mus musculus
tccatctatttatgcaaaatcgccc

SEQ ID NO: 16397 - DNA, 25 bp, Mus musculus
tgcaaaatcgccctatgctgcaacc

SEQ ID NO: 16398 - DNA, 25 bp, Mus musculus
gccctatgctgcaaccctgacttgg

SEQ ID NO: 16399 - DNA, 25 bp, Mus musculus
gagtcgctctgtcttggcactagga

SEQ ID NO: 16400 - DNA, 25 bp, Mus musculus
tcatcaccatgaccacagtgggcta

SEQ ID NO: 16401 - DNA, 25 bp, Mus musculus
atggcgacatctaccccaagaccac

SEQ ID NO: 16402 - DNA, 25 bp, Mus musculus
tcattaacaactttgtcaggtacta

SEQ ID NO: 16403 - DNA, 25 bp, Mus musculus
tcaggtactacaacaaacaacgtgt

SEQ ID NO: 16404 - DNA, 25 bp, Mus musculus
aacgtgtcctggagacggcagccaa

SEQ ID NO: 16405 - DNA, 25 bp, Mus musculus
agacggcagccaagcatgagctgga

SEQ ID NO: 16406 - DNA, 25 bp, Mus musculus
cggcagccaagcatgagctggagct

SEQ ID NO: 16407 - DNA, 25 bp, Mus musculus
cagccaagcatgagctggagctgat

SEQ ID NO: 16408 - DNA, 25 bp, Mus musculus
tgatggagctcaactccagcagcgc

SEQ ID NO: 16409 - DNA, 25 bp, Mus musculus
tggagctcaactccagcagcgcaga

SEQ ID NO: 16410 - DNA, 25 bp, Mus musculus
tcaactccagcagcgcagaaagcaa

SEQ ID NO: 16411 - DNA, 25 bp, Mus musculus
actccagcagcgcagaaagcaagcc

SEQ ID NO: 16412 - DNA, 25 bp, Mus musculus
tctaccccaagaccactctgggcaa

SEQ ID NO: 16413 - DNA, 25 bp, Mus musculus
accccaagaccactctgggcaagct

SEQ ID NO: 16414 - DNA, 25 bp, Mus musculus
ccaagaccactctgggcaagctcaa

SEQ ID NO: 16415 - DNA, 25 bp, Mus musculus
ccactctgggcaagctcaacgcggc

SEQ ID NO: 16416 - DNA, 25 bp, Mus musculus
ctctgggcaagctcaacgcggccat

SEQ ID NO: 16417 - DNA, 25 bp, Mus musculus
tcaacgcggccatcagcttcttgtg

SEQ ID NO: 16418 - DNA, 25 bp, Mus musculus
acgcggccatcagcttcttgtgtgg

SEQ ID NO: 16419 - DNA, 25 bp, Mus musculus
ttcaccccatcattaacaactttgt

SEQ ID NO: 16420 - DNA, 25 bp, Mus musculus
aatagatgacacctcaagaaattct

SEQ ID NO: 16421 - DNA, 25 bp, Mus musculus
tgacacctcaagaaattctccaagg

SEQ ID NO: 16422 - DNA, 25 bp, Mus musculus
ttcacgtgcactgacacagcactta

SEQ ID NO: 16423 - DNA, 25 bp, Mus musculus
gacacagcacttacgttgatgtaga

SEQ ID NO: 16424 - DNA, 25 bp, Mus musculus
tcatgctcttacgtgcaaggatctt

SEQ ID NO: 16425 - DNA, 25 bp, Mus musculus
tcttacgtgcaaggatcttatgtca

SEQ ID NO: 16426 - DNA, 25 bp, Mus musculus
aatctcatgctgttacgtgcaggat

SEQ ID NO: 16427 - DNA, 25 bp, Mus musculus
atgctgttacgtgcaggattgtatc

SEQ ID NO: 16428 - DNA, 25 bp, Mus musculus
ctttctcagggcaggagctctgaac

SEQ ID NO: 16429 - DNA, 25 bp, Mus musculus
tctgaacctggcattatctagaagt

SEQ ID NO: 16430 - DNA, 25 bp, Mus musculus
agttgctaatgtgctgctatatggc

SEQ ID NO: 16431 - DNA, 25 bp, Mus musculus
taatgtgctgctatatggcagatca

SEQ ID NO: 16432 - DNA, 25 bp, Mus musculus
aaattctccaaggctgggtttgctg

SEQ ID NO: 16433 - DNA, 25 bp, Mus musculus
gctgggtttgctggaccggattgtc

SEQ ID NO: 16434 - DNA, 25 bp, Mus musculus
caactatagcagagcctccataaat

SEQ ID NO: 16435 - DNA, 25 bp, Mus musculus
tagcagagcctccataaattcactg

SEQ ID NO: 16436 - DNA, 25 bp, Mus musculus
tgacaagcgctccctgaacagcgtt

SEQ ID NO: 16437 - DNA, 25 bp, Mus musculus
gcgctccctgaacagcgttgttact

SEQ ID NO: 16438 - DNA, 25 bp, Mus musculus
tgatgacaccacactgtaaaaagcc

SEQ ID NO: 16439 - DNA, 25 bp, Mus musculus
ttaaagttcacgtgcactgacacag

SEQ ID NO: 16440 - DNA, 25 bp, Mus musculus
acttgtctgggtccttcaacaactg

SEQ ID NO: 16441 - DNA, 25 bp, Mus musculus
ggtccttcaacaactggagcaagct

SEQ ID NO: 16442 - DNA, 25 bp, Mus musculus
tcttcgtggatggacagtggaccca

SEQ ID NO: 16443 - DNA, 25 bp, Mus musculus
atgatccttctgagccaatagtaac

SEQ ID NO: 16444 - DNA, 25 bp, Mus musculus
atccttctgagccaatagtaaccag

SEQ ID NO: 16445 - DNA, 25 bp, Mus musculus
agccaatagtaaccagccagcttgg

SEQ ID NO: 16446 - DNA, 25 bp, Mus musculus
caatagtaaccagccagcttggcac

SEQ ID NO: 16447 - DNA, 25 bp, Mus musculus
taaccagccagcttggcacagttaa

SEQ ID NO: 16448 - DNA, 25 bp, Mus musculus
ccagccagcttggcacagttaacaa

SEQ ID NO: 16449 - DNA, 25 bp, Mus musculus
cagttaacaacatcattcaagtgaa

SEQ ID NO: 16450 - DNA, 25 bp, Mus musculus
tggattcccaaaagtgctccgatgt

SEQ ID NO: 16451 - DNA, 25 bp, Mus musculus
agtgctccgatgtgtctgagctgtc

SEQ ID NO: 16452 - DNA, 25 bp, Mus musculus
ccttcaacaactggagcaagcttcc

SEQ ID NO: 16453 - DNA, 25 bp, Mus musculus
ataactttgtagccatcctggacct

SEQ ID NO: 16454 - DNA, 25 bp, Mus musculus
actttgtagccatcctggacctgcc

SEQ ID NO: 16455 - DNA, 25 bp, Mus musculus
ttgtagccatcctggacctgcctga

SEQ ID NO: 16456 - DNA, 25 bp, Mus musculus
tcctggacctgcctgaaggagagca

SEQ ID NO: 16457 - DNA, 25 bp, Mus musculus
atcagtacaagttcttcgtggatgg

SEQ ID NO: 16458 - DNA, 25 bp, Mus musculus
agtacaagttcttcgtggatggaca

SEQ ID NO: 16459 - DNA, 25 bp, Mus musculus
agttcttcgtggatggacagtggac

SEQ ID NO: 16460 - DNA, 25 bp, Mus musculus
tgtccttttataggatcagattggc

SEQ ID NO: 16461 - DNA, 25 bp, Mus musculus
tttgcaatcaagcattttttgatgc

SEQ ID NO: 16462 - DNA, 25 bp, Mus musculus
agcacttgccttttctccagtcttc

SEQ ID NO: 16463 - DNA, 25 bp, Mus musculus
tgccttttctccagtcttctgagct

SEQ ID NO: 16464 - DNA, 25 bp, Mus musculus
ccacttgacaggaacatgtgttcag

SEQ ID NO: 16465 - DNA, 25 bp, Mus musculus
gtgaactgagcccctcaacaaatgc

SEQ ID NO: 16466 - DNA, 25 bp, Mus musculus
tgagcccctcaacaaatgccaaatt

SEQ ID NO: 16467 - DNA, 25 bp, Mus musculus
ccagcttcgtgagatgggtgtctta

SEQ ID NO: 16468 - DNA, 25 bp, Mus musculus
tgtcttactgtgcttagctccagag

SEQ ID NO: 16469 - DNA, 25 bp, Mus musculus
actgtgcttagctccagagcattcc

SEQ ID NO: 16470 - DNA, 25 bp, Mus musculus
cttagctccagagcattccgagaga

SEQ ID NO: 16471 - DNA, 25 bp, Mus musculus
tccagagcattccgagagagatgac

SEQ ID NO: 16472 - DNA, 25 bp, Mus musculus
ttgatgcaagtcttttgggacaagg

SEQ ID NO: 16473 - DNA, 25 bp, Mus musculus
ggtcagcctagcttggtctcaaact

SEQ ID NO: 16474 - DNA, 25 bp, Mus musculus
gtctccggagtgtttcaattacaga

SEQ ID NO: 16475 - DNA, 25 bp, Mus musculus
atgtgcacgactatctccagctgtt

SEQ ID NO: 16476 - DNA, 25 bp, Mus musculus
acgactatctccagctgtttctgtg

SEQ ID NO: 16477 - DNA, 25 bp, Mus musculus
atctccagctgtttctgtgggaaag

SEQ ID NO: 16478 - DNA, 25 bp, Mus musculus
ggacaactttgtagcacttgccttt

SEQ ID NO: 16479 - DNA, 25 bp, Mus musculus
ctttgtagcacttgccttttctcca

SEQ ID NO: 16480 - DNA, 25 bp, Mus musculus
accagcaactcaatgacctgaaaac

SEQ ID NO: 16481 - DNA, 25 bp, Mus musculus
cagcaactcaatgacctgaaaacct

SEQ ID NO: 16482 - DNA, 25 bp, Mus musculus
cccagattctaccatctcaaagata

SEQ ID NO: 16483 - DNA, 25 bp, Mus musculus
cagattctaccatctcaaagatacc

SEQ ID NO: 16484 - DNA, 25 bp, Mus musculus
attctaccatctcaaagataccagt

SEQ ID NO: 16485 - DNA, 25 bp, Mus musculus
ttctaccatctcaaagataccagtc

SEQ ID NO: 16486 - DNA, 25 bp, Mus musculus
taccatctcaaagataccagtcatt

SEQ ID NO: 16487 - DNA, 25 bp, Mus musculus
tctcaaagataccagtcattttgac

SEQ ID NO: 16488 - DNA, 25 bp, Mus musculus
ctcaaagataccagtcattttgaca

SEQ ID NO: 16489 - DNA, 25 bp, Mus musculus
caaagataccagtcattttgacatg

SEQ ID NO: 16490 - DNA, 25 bp, Mus musculus
agataccagtcattttgacatgaat

SEQ ID NO: 16491 - DNA, 25 bp, Mus musculus
gataccagtcattttgacatgaatt

SEQ ID NO: 16492 - DNA, 25 bp, Mus musculus
agcaactcaatgacctgaaaacctg

SEQ ID NO: 16493 - DNA, 25 bp, Mus musculus
acaagttgcctagatgcttctgcag

SEQ ID NO: 16494 - DNA, 25 bp, Mus musculus
caactcaatgacctgaaaacctgtc

SEQ ID NO: 16495 - DNA, 25 bp, Mus musculus
gagtctgagacccagtggagagaat

SEQ ID NO: 16496 - DNA, 25 bp, Mus musculus
tctgagacccagtggagagaatctc

SEQ ID NO: 16497 - DNA, 25 bp, Mus musculus
agagaatctcctggactaggacact

SEQ ID NO: 16498 - DNA, 25 bp, Mus musculus
aggacactgcacctctctgcccaga

SEQ ID NO: 16499 - DNA, 25 bp, Mus musculus
tctctgcccagattctaccatctca

SEQ ID NO: 16500 - DNA, 25 bp, Mus musculus
gcccagattctaccatctcaaagat

SEQ ID NO: 16501 - DNA, 25 bp, Mus musculus
gcagccaacagcgatggcacggtag

SEQ ID NO: 16502 - DNA, 25 bp, Mus musculus
gcctgcaacatgctcatgcccgagc

SEQ ID NO: 16503 - DNA, 25 bp, Mus musculus
accgtgagccagttgtctgtcatcc

SEQ ID NO: 16504 - DNA, 25 bp, Mus musculus
ttgtctgtcatcctgggctatgcca

SEQ ID NO: 16505 - DNA, 25 bp, Mus musculus
aacttcaagcgctctttccagcgca

SEQ ID NO: 16506 - DNA, 25 bp, Mus musculus
aagcgctctttccagcgcatcctgt

SEQ ID NO: 16507 - DNA, 25 bp, Mus musculus
tctttccagcgcatcctgtgcctca

SEQ ID NO: 16508 - DNA, 25 bp, Mus musculus
atcctgtgcctcagctggatggata

SEQ ID NO: 16509 - DNA, 25 bp, Mus musculus
gtcgactactatgccactgccctga

SEQ ID NO: 16510 - DNA, 25 bp, Mus musculus
tactatgccactgccctgaagagtc

SEQ ID NO: 16511 - DNA, 25 bp, Mus musculus
aatggcacctgcgcttccaggatca

SEQ ID NO: 16512 - DNA, 25 bp, Mus musculus
acctgcgcttccaggatcagcacgc

SEQ ID NO: 16513 - DNA, 25 bp, Mus musculus
ttcgtcttatacacatttctcatgg

SEQ ID NO: 16514 - DNA, 25 bp, Mus musculus
cttccaggatcagcacgctttgagg

SEQ ID NO: 16515 - DNA, 25 bp, Mus musculus
atttgcctgtgttatgtgctcatca

SEQ ID NO: 16516 - DNA, 25 bp, Mus musculus
tatgtgctcatcattgccaagatgc

SEQ ID NO: 16517 - DNA, 25 bp, Mus musculus
gtggccctcaaggctggctggcagc

SEQ ID NO: 16518 - DNA, 25 bp, Mus musculus
cagcgcaagcgctcagagcgcaaga

SEQ ID NO: 16519 - DNA, 25 bp, Mus musculus
cgcaagatcactctaatggtgatga

SEQ ID NO: 16520 - DNA, 25 bp, Mus musculus
atcactctaatggtgatgatggtgg

SEQ ID NO: 16521 - DNA, 25 bp, Mus musculus
gacgccaccgtgagccagttgtctg

SEQ ID NO: 16522 - DNA, 25 bp, Mus musculus
gacccgcatggtgtccatcgtagtg

SEQ ID NO: 16523 - DNA, 25 bp, Mus musculus
catggtgtccatcgtagtggctgtc

SEQ ID NO: 16524 - DNA, 25 bp, Mus musculus
agacaattcacaatccggagcggaa

SEQ ID NO: 16525 - DNA, 25 bp, Mus musculus
agacatcattgcctgggtgtgacct

SEQ ID NO: 16526 - DNA, 25 bp, Mus musculus
tgtgctaacacgttacgtaaatctt

SEQ ID NO: 16527 - DNA, 25 bp, Mus musculus
cccggtcacacaaacatgtcccgtg

SEQ ID NO: 16528 - DNA, 25 bp, Mus musculus
cacacaaacatgtcccgtgtttgta

SEQ ID NO: 16529 - DNA, 25 bp, Mus musculus
aagcccaagtagctagttcgtgtgc

SEQ ID NO: 16530 - DNA, 25 bp, Mus musculus
ctagttcgtgtgcgtctagtatagg

SEQ ID NO: 16531 - DNA, 25 bp, Mus musculus
agttaccacaacgctgaacctgaag

SEQ ID NO: 16532 - DNA, 25 bp, Mus musculus
cacaacgctgaacctgaagaaaagg

SEQ ID NO: 16533 - DNA, 25 bp, Mus musculus
gactcgccacgtcacagtcagtcca

SEQ ID NO: 16534 - DNA, 25 bp, Mus musculus
cgtagtggctgtcttcatcttctgc

SEQ ID NO: 16535 - DNA, 25 bp, Mus musculus
acagtcagtccaatctccggaattc

SEQ ID NO: 16536 - DNA, 25 bp, Mus musculus
ggctgtcttcatcttctgctggctc

SEQ ID NO: 16537 - DNA, 25 bp, Mus musculus
cttcatcttctgctggctccctttc

SEQ ID NO: 16538 - DNA, 25 bp, Mus musculus
cttctgctggctccctttctacatc

SEQ ID NO: 16539 - DNA, 25 bp, Mus musculus
aatgtttgactttgtggtgatcctc

SEQ ID NO: 16540 - DNA, 25 bp, Mus musculus
tgtggtgatcctcacctatgccaac

SEQ ID NO: 16541 - DNA, 25 bp, Mus musculus
cctgtacgccttcttgtctgacaac

SEQ ID NO: 16542 - DNA, 25 bp, Mus musculus
cttccagaatgttctttgcttggtc

SEQ ID NO: 16543 - DNA, 25 bp, Mus musculus
ggtgcatctccgacaccatgagcgg

SEQ ID NO: 16544 - DNA, 25 bp, Mus musculus
accatgagcggcttcacagcgagga

SEQ ID NO: 16545 - DNA, 25 bp, Mus musculus
gctggtccaacgccaaaatggagat

SEQ ID NO: 16546 - DNA, 25 bp, Mus musculus
tggtccaacgccaaaatggagattg

SEQ ID NO: 16547 - DNA, 25 bp, Mus musculus
cctttaaacccaatcaagcaagatg

SEQ ID NO: 16548 - DNA, 25 bp, Mus musculus
tttaaacccaatcaagcaagatgtg

SEQ ID NO: 16549 - DNA, 25 bp, Mus musculus
taaacccaatcaagcaagatgtgaa

SEQ ID NO: 16550 - DNA, 25 bp, Mus musculus
cccaatcaagcaagatgtgaaaaag

SEQ ID NO: 16551 - DNA, 25 bp, Mus musculus
ggaagctccgctatgtggcgaatct

SEQ ID NO: 16552 - DNA, 25 bp, Mus musculus
gctccgctatgtggcgaatctgttc

SEQ ID NO: 16553 - DNA, 25 bp, Mus musculus
tccgctatgtggcgaatctgttccc

SEQ ID NO: 16554 - DNA, 25 bp, Mus musculus
gtggcgaatctgttcccttataaag

SEQ ID NO: 16555 - DNA, 25 bp, Mus musculus
ccatttcatgatgttccaatttatg

SEQ ID NO: 16556 - DNA, 25 bp, Mus musculus
atttcatgatgttccaatttatgca

SEQ ID NO: 16557 - DNA, 25 bp, Mus musculus
atgtgttccacatggtggttgaggt

SEQ ID NO: 16558 - DNA, 25 bp, Mus musculus
gtgttccacatggtggttgaggttc

SEQ ID NO: 16559 - DNA, 25 bp, Mus musculus
tccacatggtggttgaggttccacg

SEQ ID NO: 16560 - DNA, 25 bp, Mus musculus
ttgaggttccacgctggtccaacgc

SEQ ID NO: 16561 - DNA, 25 bp, Mus musculus
gaggttccacgctggtccaacgcca

SEQ ID NO: 16562 - DNA, 25 bp, Mus musculus
acgctggtccaacgccaaaatggag

SEQ ID NO: 16563 - DNA, 25 bp, Mus musculus
ggcccacattaccccaattgaggca

SEQ ID NO: 16564 - DNA, 25 bp, Mus musculus
cccaattgaggcatccattctttct

SEQ ID NO: 16565 - DNA, 25 bp, Mus musculus
agggttgaacagccaggtgagactt

SEQ ID NO: 16566 - DNA, 25 bp, Mus musculus
gttgaacagccaggtgagacttgag

SEQ ID NO: 16567 - DNA, 25 bp, Mus musculus
cagccaggtgagacttgaggggact

SEQ ID NO: 16568 - DNA, 25 bp, Mus musculus
acttgaggggactcagagatctaga

SEQ ID NO: 16569 - DNA, 25 bp, Mus musculus
atctagaaaagctggcctaagagtg

SEQ ID NO: 16570 - DNA, 25 bp, Mus musculus
tggcctaagagtgtgttcagtccct

SEQ ID NO: 16571 - DNA, 25 bp, Mus musculus
agtgtgttcagtcccttggcagctc

SEQ ID NO: 16572 - DNA, 25 bp, Mus musculus
tgtttcagattcttcacgagacaca

SEQ ID NO: 16573 - DNA, 25 bp, Mus musculus
aacagaggtcatttttctatcctgt

SEQ ID NO: 16574 - DNA, 25 bp, Mus musculus
caaatctactcaggtgaatgggcat

SEQ ID NO: 16575 - DNA, 25 bp, Mus musculus
aattgaggcatccattctttctacc

SEQ ID NO: 16576 - DNA, 25 bp, Mus musculus
ggcatccattctttctaccggcatc

SEQ ID NO: 16577 - DNA, 25 bp, Mus musculus
cattctttctaccggcatcacttca

SEQ ID NO: 16578 - DNA, 25 bp, Mus musculus
tactctacgtattcccaagatgagt

SEQ ID NO: 16579 - DNA, 25 bp, Mus musculus
ggtcactttcccaactatgagattc

SEQ ID NO: 16580 - DNA, 25 bp, Mus musculus
cccaactatgagattccacaagtct

SEQ ID NO: 16581 - DNA, 25 bp, Mus musculus
ccacaagtcttcagggttgaacagc

SEQ ID NO: 16582 - DNA, 25 bp, Mus musculus
caagtcttcagggttgaacagccag

SEQ ID NO: 16583 - DNA, 25 bp, Mus musculus
ctacactgcctatagggcagcatgc

SEQ ID NO: 16584 - DNA, 25 bp, Mus musculus
tgcctatagggcagcatgctgcagg

SEQ ID NO: 16585 - DNA, 25 bp, Mus musculus
agagcacgaccacgcctggccagta

SEQ ID NO: 16586 - DNA, 25 bp, Mus musculus
cgaccacgcctggccagtatgtgct

SEQ ID NO: 16587 - DNA, 25 bp, Mus musculus
atgtgctcactggcctgcagagtgg

SEQ ID NO: 16588 - DNA, 25 bp, Mus musculus
caaaggatcaccgctttgagagtgt

SEQ ID NO: 16589 - DNA, 25 bp, Mus musculus
tcagtcacctgatcagctaccacat

SEQ ID NO: 16590 - DNA, 25 bp, Mus musculus
accacatggacaatcacttgcccat

SEQ ID NO: 16591 - DNA, 25 bp, Mus musculus
tggacaatcacttgcccatcatctc

SEQ ID NO: 16592 - DNA, 25 bp, Mus musculus
atcacttgcccatcatctctgcggg

SEQ ID NO: 16593 - DNA, 25 bp, Mus musculus
gcagcgaactgtgcctacagcaacc

SEQ ID NO: 16594 - DNA, 25 bp, Mus musculus
aactgtgcctacagcaacccgtgga

SEQ ID NO: 16595 - DNA, 25 bp, Mus musculus
agcatgctgcaggagaccatgaagt

SEQ ID NO: 16596 - DNA, 25 bp, Mus musculus
cgccttgcccaggcagagaactctt

SEQ ID NO: 16597 - DNA, 25 bp, Mus musculus
tcaacatccagaatctagacaaggc

SEQ ID NO: 16598 - DNA, 25 bp, Mus musculus
ttaatggcagtgcaccccgagacct

SEQ ID NO: 16599 - DNA, 25 bp, Mus musculus
ttgaagatgcacttcgggtgccacc

SEQ ID NO: 16600 - DNA, 25 bp, Mus musculus
ccatggctgagcagctgcaagggga

SEQ ID NO: 16601 - DNA, 25 bp, Mus musculus
cgctgctgcagctcaatggtgactt

SEQ ID NO: 16602 - DNA, 25 bp, Mus musculus
tcaatggtgacttcttggtgcgaga

SEQ ID NO: 16603 - DNA, 25 bp, Mus musculus
ttatcttgtgaatctacttagaaaa

SEQ ID NO: 16604 - DNA, 25 bp, Mus musculus
aacacacacaagcaatgttcacaac

SEQ ID NO: 16605 - DNA, 25 bp, Mus musculus
ttcttggcaactgtaatgttttagc

SEQ ID NO: 16606 - DNA, 25 bp, Mus musculus
tgttttagcaccaaatgatctccca

SEQ ID NO: 16607 - DNA, 25 bp, Mus musculus
ttttagcaccaaatgatctcccaca

SEQ ID NO: 16608 - DNA, 25 bp, Mus musculus
ttagcaccaaatgatctcccacaga

SEQ ID NO: 16609 - DNA, 25 bp, Mus musculus
agcaccaaatgatctcccacagagg

SEQ ID NO: 16610 - DNA, 25 bp, Mus musculus
ccaaatgatctcccacagagggact

SEQ ID NO: 16611 - DNA, 25 bp, Mus musculus
atgatctcccacagagggactagta

SEQ ID NO: 16612 - DNA, 25 bp, Mus musculus
gatctcccacagagggactagtaaa

SEQ ID NO: 16613 - DNA, 25 bp, Mus musculus
actagtaaagctggctgccgtgtga

SEQ ID NO: 16614 - DNA, 25 bp, Mus musculus
tagtaaagctggctgccgtgtgagg

SEQ ID NO: 16615 - DNA, 25 bp, Mus musculus
cacacacaagcaatgttcacaacta

SEQ ID NO: 16616 - DNA, 25 bp, Mus musculus
cacaagcaatgttcacaactataaa

SEQ ID NO: 16617 - DNA, 25 bp, Mus musculus
caagcaatgttcacaactataaatt

SEQ ID NO: 16618 - DNA, 25 bp, Mus musculus
aaccacaggcatgaactgtaaacct

SEQ ID NO: 16619 - DNA, 25 bp, Mus musculus
attcttagcagtaattcagttattt

SEQ ID NO: 16620 - DNA, 25 bp, Mus musculus
cagttattttccttcttggcaactg

SEQ ID NO: 16621 - DNA, 25 bp, Mus musculus
tattttccttcttggcaactgtaat

SEQ ID NO: 16622 - DNA, 25 bp, Mus musculus
ttccttcttggcaactgtaatgttt

SEQ ID NO: 16623 - DNA, 25 bp, Mus musculus
tctctttttgacagggtattccaag

SEQ ID NO: 16624 - DNA, 25 bp, Mus musculus
gtattccaaggcgtagaggcgatcc

SEQ ID NO: 16625 - DNA, 25 bp, Mus musculus
atttcatctcgcgagaactgtttga

SEQ ID NO: 16626 - DNA, 25 bp, Mus musculus
tgtttgacacggtccaggtgtacat

SEQ ID NO: 16627 - DNA, 25 bp, Mus musculus
acacggtccaggtgtacatcatcac

SEQ ID NO: 16628 - DNA, 25 bp, Mus musculus
aggtgtacatcatcaccaagcccga

SEQ ID NO: 16629 - DNA, 25 bp, Mus musculus
tgtacatcatcaccaagcccgagtt

SEQ ID NO: 16630 - DNA, 25 bp, Mus musculus
tcaccaagcccgagttacagaacaa

SEQ ID NO: 16631 - DNA, 25 bp, Mus musculus
ccaagcccgagttacagaacaagct

SEQ ID NO: 16632 - DNA, 25 bp, Mus musculus
tacagaacaagctcatcactgtcac

SEQ ID NO: 16633 - DNA, 25 bp, Mus musculus
acaagctcatcactgtcacagccat

SEQ ID NO: 16634 - DNA, 25 bp, Mus musculus
agctcatcactgtcacagccatgga

SEQ ID NO: 16635 - DNA, 25 bp, Mus musculus
attacagacttggatccagacagcg

SEQ ID NO: 16636 - DNA, 25 bp, Mus musculus
acagacttggatccagacagcgcca

SEQ ID NO: 16637 - DNA, 25 bp, Mus musculus
gatccagacagcgccatgggagcag

SEQ ID NO: 16638 - DNA, 25 bp, Mus musculus
aatgtatattcttcagcgagttcca

SEQ ID NO: 16639 - DNA, 25 bp, Mus musculus
tattcttcagcgagttccacccaac

SEQ ID NO: 16640 - DNA, 25 bp, Mus musculus
tcagcgagttccacccaacgctggg

SEQ ID NO: 16641 - DNA, 25 bp, Mus musculus
atcaggtccctgaggatttcatctc

SEQ ID NO: 16642 - DNA, 25 bp, Mus musculus
aggtccctgaggatttcatctcgcg

SEQ ID NO: 16643 - DNA, 25 bp, Mus musculus
aatattctatccctgggttcagaat

SEQ ID NO: 16644 - DNA, 25 bp, Mus musculus
ctatccctgggttcagaatctgggg

SEQ ID NO: 16645 - DNA, 25 bp, Mus musculus
agaatctgttcccaagtaactatat

SEQ ID NO: 16646 - DNA, 25 bp, Mus musculus
ttcaccttgggactatgtataactt

SEQ ID NO: 16647 - DNA, 25 bp, Mus musculus
taaggctctctgtaatgtggcagct

SEQ ID NO: 16648 - DNA, 25 bp, Mus musculus
tgtggcagctaattccacaaagggt

SEQ ID NO: 16649 - DNA, 25 bp, Mus musculus
tcaagcctctctgagatgattgcac

SEQ ID NO: 16650 - DNA, 25 bp, Mus musculus
agcctctctgagatgattgcaccag

SEQ ID NO: 16651 - DNA, 25 bp, Mus musculus
attgcaccagaggctgaataggaag

SEQ ID NO: 16652 - DNA, 25 bp, Mus musculus
gtgctttcttcatgaaacctgacag

SEQ ID NO: 16653 - DNA, 25 bp, Mus musculus
ctttcttcatgaaacctgacagtga

SEQ ID NO: 16654 - DNA, 25 bp, Mus musculus
tcttcatgaaacctgacagtgaata

SEQ ID NO: 16655 - DNA, 25 bp, Mus musculus
tctggggtccattcccagtaccata

SEQ ID NO: 16656 - DNA, 25 bp, Mus musculus
tgaataaacttgctctgacattcct

SEQ ID NO: 16657 - DNA, 25 bp, Mus musculus
aacattccagttcaaatgttgatgc

SEQ ID NO: 16658 - DNA, 25 bp, Mus musculus
atgttgatgcctctctacatcattt

SEQ ID NO: 16659 - DNA, 25 bp, Mus musculus
ttgatgcctctctacatcatttttg

SEQ ID NO: 16660 - DNA, 25 bp, Mus musculus
ctctacatcatttttgatcccacat

SEQ ID NO: 16661 - DNA, 25 bp, Mus musculus
tacatcatttttgatcccacatccc

SEQ ID NO: 16662 - DNA, 25 bp, Mus musculus
atttttgatcccacatcccatttct

SEQ ID NO: 16663 - DNA, 25 bp, Mus musculus
acatcccatttcttaagaagaatct

SEQ ID NO: 16664 - DNA, 25 bp, Mus musculus
ctctgaccattggagccagaatctg

SEQ ID NO: 16665 - DNA, 25 bp, Mus musculus
gaatctgtcccagttctttccggag

SEQ ID NO: 16666 - DNA, 25 bp, Mus musculus
gtggcctacctcatgcagaagcttc

SEQ ID NO: 16667 - DNA, 25 bp, Mus musculus
tacctcatgcagaagcttcacctct

SEQ ID NO: 16668 - DNA, 25 bp, Mus musculus
atgcagaagcttcacctctcactca

SEQ ID NO: 16669 - DNA, 25 bp, Mus musculus
tcactcaacgatgcctacgacttgg

SEQ ID NO: 16670 - DNA, 25 bp, Mus musculus
aacgatgcctacgacttggtcaagc

SEQ ID NO: 16671 - DNA, 25 bp, Mus musculus
gcctacgacttggtcaagcggaaga

SEQ ID NO: 16672 - DNA, 25 bp, Mus musculus
tacgacttggtcaagcggaagaagt

SEQ ID NO: 16673 - DNA, 25 bp, Mus musculus
cagctgctagactttgaacgcagcc

SEQ ID NO: 16674 - DNA, 25 bp, Mus musculus
ctgctagactttgaacgcagcctgc

SEQ ID NO: 16675 - DNA, 25 bp, Mus musculus
tttgaacgcagcctgcgcctagggg

SEQ ID NO: 16676 - DNA, 25 bp, Mus musculus
gtcccagttctttccggagccattg

SEQ ID NO: 16677 - DNA, 25 bp, Mus musculus
tccggagccattgcattcattgatg

SEQ ID NO: 16678 - DNA, 25 bp, Mus musculus
attgatgaggccttgtcgcagaact

SEQ ID NO: 16679 - DNA, 25 bp, Mus musculus
cgctctgtcactgtcaccgtggcct

SEQ ID NO: 16680 - DNA, 25 bp, Mus musculus
tctgtcactgtcaccgtggcctacc

SEQ ID NO: 16681 - DNA, 25 bp, Mus musculus
gtcactgtcaccgtggcctacctca

SEQ ID NO: 16682 - DNA, 25 bp, Mus musculus
gtcaccgtggcctacctcatgcaga

SEQ ID NO: 16683 - DNA, 25 bp, Mus musculus
accgtggcctacctcatgcagaagc

SEQ ID NO: 16684 - DNA, 25 bp, Mus musculus
tgagtctctgagcttagatcttacc

SEQ ID NO: 16685 - DNA, 25 bp, Mus musculus
gtctctgagcttagatcttacccac

SEQ ID NO: 16686 - DNA, 25 bp, Mus musculus
gctatcctatcagagactgggctct

SEQ ID NO: 16687 - DNA, 25 bp, Mus musculus
ctcttgtctctcctatcagactgag

SEQ ID NO: 16688 - DNA, 25 bp, Mus musculus
ttgtctctcctatcagactgagact

SEQ ID NO: 16689 - DNA, 25 bp, Mus musculus
ctcctatcagactgagactttggga

SEQ ID NO: 16690 - DNA, 25 bp, Mus musculus
ctatcagactgagactttgggaaga

SEQ ID NO: 16691 - DNA, 25 bp, Mus musculus
actgtgtctctgtcagacagggcag

SEQ ID NO: 16692 - DNA, 25 bp, Mus musculus
tctctgtcagacagggcaggaggat

SEQ ID NO: 16693 - DNA, 25 bp, Mus musculus
ctgtcagacagggcaggaggatgca

SEQ ID NO: 16694 - DNA, 25 bp, Mus musculus
ggatgcacctggtaactgggcacaa

SEQ ID NO: 16695 - DNA, 25 bp, Mus musculus
tgcacctggtaactgggcacaatac

SEQ ID NO: 16696 - DNA, 25 bp, Mus musculus
gctggacactactgctccctggggc

SEQ ID NO: 16697 - DNA, 25 bp, Mus musculus
agccagctgggcccagaactcacga

SEQ ID NO: 16698 - DNA, 25 bp, Mus musculus
cagctgggcccagaactcacgatcc

SEQ ID NO: 16699 - DNA, 25 bp, Mus musculus
cctcagtgctccttgttcaaagtgg

SEQ ID NO: 16700 - DNA, 25 bp, Mus musculus
gtatgtgatctgcctcttgtaaatg

SEQ ID NO: 16701 - DNA, 25 bp, Mus musculus
tgtgatctgcctcttgtaaatggag

SEQ ID NO: 16702 - DNA, 25 bp, Mus musculus
gatctgcctcttgtaaatggagcta

SEQ ID NO: 16703 - DNA, 25 bp, Mus musculus
aatggagctatcctatcagagactg

SEQ ID NO: 16704 - DNA, 25 bp, Mus musculus
gcactacgagatgcccggagctgct

SEQ ID NO: 16705 - DNA, 25 bp, Mus musculus
cgagatgcccggagctgctgtggcc

SEQ ID NO: 16706 - DNA, 25 bp, Mus musculus
atcaccaaaatggacgtcagcaacc

SEQ ID NO: 16707 - DNA, 25 bp, Mus musculus
gacgtcagcaacctggctatggtga

SEQ ID NO: 16708 - DNA, 25 bp, Mus musculus
agcaacctggctatggtgatggcac

SEQ ID NO: 16709 - DNA, 25 bp, Mus musculus
atggtgatggcacccaactgcctgc

SEQ ID NO: 16710 - DNA, 25 bp, Mus musculus
gatgatcctcgcgtcatcttcgaga

SEQ ID NO: 16711 - DNA, 25 bp, Mus musculus
cctcgcgtcatcttcgagaatacac

SEQ ID NO: 16712 - DNA, 25 bp, Mus musculus
gtcatcttcgagaatacacgaaagg

SEQ ID NO: 16713 - DNA, 25 bp, Mus musculus
gagatgtccttccttcgagtgctca

SEQ ID NO: 16714 - DNA, 25 bp, Mus musculus
tccttccttcgagtgctcattcagc

SEQ ID NO: 16715 - DNA, 25 bp, Mus musculus
cttcgagtgctcattcagcatttag

SEQ ID NO: 16716 - DNA, 25 bp, Mus musculus
aaccgaatggtgctgtgctacctca

SEQ ID NO: 16717 - DNA, 25 bp, Mus musculus
catttagataccagcttcatggagg

SEQ ID NO: 16718 - DNA, 25 bp, Mus musculus
atggtgctgtgctacctcattcgct

SEQ ID NO: 16719 - DNA, 25 bp, Mus musculus
tacctcattcgcttcctccaggtgt

SEQ ID NO: 16720 - DNA, 25 bp, Mus musculus
attcgcttcctccaggtgttcgtgc

SEQ ID NO: 16721 - DNA, 25 bp, Mus musculus
ttcctccaggtgttcgtgcagccag

SEQ ID NO: 16722 - DNA, 25 bp, Mus musculus
ttcgtgcagccagccaacgtagcca

SEQ ID NO: 16723 - DNA, 25 bp, Mus musculus
gccaacgtagccatcaccaaaatgg

SEQ ID NO: 16724 - DNA, 25 bp, Mus musculus
gtagccatcaccaaaatggacgtca

SEQ ID NO: 16725 - DNA, 25 bp, Mus musculus
aactggcaccgacgcaagcatgcag

SEQ ID NO: 16726 - DNA, 25 bp, Mus musculus
gagacagcagctgccctgcgattcc

SEQ ID NO: 16727 - DNA, 25 bp, Mus musculus
ccagcacaagagccacctggctcta

SEQ ID NO: 16728 - DNA, 25 bp, Mus musculus
ccacctggctctattggtgtctagt

SEQ ID NO: 16729 - DNA, 25 bp, Mus musculus
cctggctctattggtgtctagtccc

SEQ ID NO: 16730 - DNA, 25 bp, Mus musculus
ggctctattggtgtctagtcccagc

SEQ ID NO: 16731 - DNA, 25 bp, Mus musculus
attggtgtctagtcccagcatttct

SEQ ID NO: 16732 - DNA, 25 bp, Mus musculus
ggtgtctagtcccagcatttctgcc

SEQ ID NO: 16733 - DNA, 25 bp, Mus musculus
gtctagtcccagcatttctgcccct

SEQ ID NO: 16734 - DNA, 25 bp, Mus musculus
cagcatttctgcccctgaatccctg

SEQ ID NO: 16735 - DNA, 25 bp, Mus musculus
ccctgaatccctgcagtctcctgag

SEQ ID NO: 16736 - DNA, 25 bp, Mus musculus
tgaatccctgcagtctcctgagggg

SEQ ID NO: 16737 - DNA, 25 bp, Mus musculus
gctgccctgcgattcccctgtgaat

SEQ ID NO: 16738 - DNA, 25 bp, Mus musculus
gccctgcgattcccctgtgaattct

SEQ ID NO: 16739 - DNA, 25 bp, Mus musculus
ctgcgattcccctgtgaattctgtg

SEQ ID NO: 16740 - DNA, 25 bp, Mus musculus
ttcccctgtgaattctgtggcaaac

SEQ ID NO: 16741 - DNA, 25 bp, Mus musculus
ttctgtggcaaacgctttgagaagc

SEQ ID NO: 16742 - DNA, 25 bp, Mus musculus
agtgtggtagctcactgtagcaaaa

SEQ ID NO: 16743 - DNA, 25 bp, Mus musculus
gtagctcactgtagcaaaagccacc

SEQ ID NO: 16744 - DNA, 25 bp, Mus musculus
gctcactgtagcaaaagccacccag

SEQ ID NO: 16745 - DNA, 25 bp, Mus musculus
tgcgactcggcagtcacagtatgcc

SEQ ID NO: 16746 - DNA, 25 bp, Mus musculus
atgccgtgacatgcatggacaattc

SEQ ID NO: 16747 - DNA, 25 bp, Mus musculus
actgctcgtgggagactttgtggac

SEQ ID NO: 16748 - DNA, 25 bp, Mus musculus
ggagactttgtggaccgtggtatct

SEQ ID NO: 16749 - DNA, 25 bp, Mus musculus
tgaaaacgttctcctccgagcggag

SEQ ID NO: 16750 - DNA, 25 bp, Mus musculus
ttctcctccgagcggagtcttaagg

SEQ ID NO: 16751 - DNA, 25 bp, Mus musculus
aggttcaggatcgtgacggaatcac

SEQ ID NO: 16752 - DNA, 25 bp, Mus musculus
cggaatcacttttgatgcggggcaa

SEQ ID NO: 16753 - DNA, 25 bp, Mus musculus
gaatcacttttgatgcggggcaatc

SEQ ID NO: 16754 - DNA, 25 bp, Mus musculus
atcacttttgatgcggggcaatcat

SEQ ID NO: 16755 - DNA, 25 bp, Mus musculus
cttttgatgcggggcaatcatgaga

SEQ ID NO: 16756 - DNA, 25 bp, Mus musculus
tttgatgcggggcaatcatgagact

SEQ ID NO: 16757 - DNA, 25 bp, Mus musculus
ctatgacctcaaggagctgatcaga

SEQ ID NO: 16758 - DNA, 25 bp, Mus musculus
atgacctcaaggagctgatcagagt

SEQ ID NO: 16759 - DNA, 25 bp, Mus musculus
gacctcaaggagctgatcagagtaa

SEQ ID NO: 16760 - DNA, 25 bp, Mus musculus
taagtggcgatgtccctgagaccaa

SEQ ID NO: 16761 - DNA, 25 bp, Mus musculus
gcgatgtccctgagaccaactaact

SEQ ID NO: 16762 - DNA, 25 bp, Mus musculus
cctgagaccaactaactgctcgtgg

SEQ ID NO: 16763 - DNA, 25 bp, Mus musculus
accaactaactgctcgtgggagact

SEQ ID NO: 16764 - DNA, 25 bp, Mus musculus
actaactgctcgtgggagactttgt

SEQ ID NO: 16765 - DNA, 25 bp, Mus musculus
taatccggcgtcaaggcgccaaaat

SEQ ID NO: 16766 - DNA, 25 bp, Mus musculus
agatccgtcagatgtctggggcgca

SEQ ID NO: 16767 - DNA, 25 bp, Mus musculus
ttagcctggctcagtatctaatcaa

SEQ ID NO: 16768 - DNA, 25 bp, Mus musculus
agtatctaatcaatgtcaggctttc

SEQ ID NO: 16769 - DNA, 25 bp, Mus musculus
agaacagagcagacccatccataat

SEQ ID NO: 16770 - DNA, 25 bp, Mus musculus
gagcagacccatccataatcctgct

SEQ ID NO: 16771 - DNA, 25 bp, Mus musculus
ttctgaacagtcagcgactccaggt

SEQ ID NO: 16772 - DNA, 25 bp, Mus musculus
agtttctacacactttatcatccac

SEQ ID NO: 16773 - DNA, 25 bp, Mus musculus
tacacactttatcatccactcatga

SEQ ID NO: 16774 - DNA, 25 bp, Mus musculus
tttaattcctttctctgttcagcag

SEQ ID NO: 16775 - DNA, 25 bp, Mus musculus
ctctgttcagcagttacgctgagat

SEQ ID NO: 16776 - DNA, 25 bp, Mus musculus
tcagcagttacgctgagatatccat

SEQ ID NO: 16777 - DNA, 25 bp, Mus musculus
gtcagatgtctggggcgcagatcaa

SEQ ID NO: 16778 - DNA, 25 bp, Mus musculus
tgtctggggcgcagatcaaaattgc

SEQ ID NO: 16779 - DNA, 25 bp, Mus musculus
aaggatctactgatcggcaggttac

SEQ ID NO: 16780 - DNA, 25 bp, Mus musculus
atcggcaggttaccatcactggatc

SEQ ID NO: 16781 - DNA, 25 bp, Mus musculus
aggttaccatcactggatctgctgc

SEQ ID NO: 16782 - DNA, 25 bp, Mus musculus
ccatcactggatctgctgccagcat

SEQ ID NO: 16783 - DNA, 25 bp, Mus musculus
ctggatctgctgccagcattagcct

SEQ ID NO: 16784 - DNA, 25 bp, Mus musculus
ccagcattagcctggctcagtatct

SEQ ID NO: 16785 - DNA, 25 bp, Mus musculus
cctggctatgtcagtgggacagaag

SEQ ID NO: 16786 - DNA, 25 bp, Mus musculus
cactatgagctgcaagtccagtcag

SEQ ID NO: 16787 - DNA, 25 bp, Mus musculus
tgatcgtttcataggcagcggatct

SEQ ID NO: 16788 - DNA, 25 bp, Mus musculus
tcgtttcataggcagcggatctggg

SEQ ID NO: 16789 - DNA, 25 bp, Mus musculus
tttcataggcagcggatctgggaca

SEQ ID NO: 16790 - DNA, 25 bp, Mus musculus
gacagatttcgctcttaccatccgc

SEQ ID NO: 16791 - DNA, 25 bp, Mus musculus
ccgcagtgtgcaggctgaagacctg

SEQ ID NO: 16792 - DNA, 25 bp, Mus musculus
agacctggcagattacttctgtcag

SEQ ID NO: 16793 - DNA, 25 bp, Mus musculus
agattacttctgtcagcaacattat

SEQ ID NO: 16794 - DNA, 25 bp, Mus musculus
ttacttctgtcagcaacattatacc

SEQ ID NO: 16795 - DNA, 25 bp, Mus musculus
tcagcaacattataccactccgtgg

SEQ ID NO: 16796 - DNA, 25 bp, Mus musculus
gcaacattataccactccgtggacg

SEQ ID NO: 16797 - DNA, 25 bp, Mus musculus
gagctgcaagtccagtcagagcctt

SEQ ID NO: 16798 - DNA, 25 bp, Mus musculus
ctatttggcctggtatcagcagaaa

SEQ ID NO: 16799 - DNA, 25 bp, Mus musculus
acagtctcctaaacttctattatat

SEQ ID NO: 16800 - DNA, 25 bp, Mus musculus
atattttgcatccactagggaatct

SEQ ID NO: 16801 - DNA, 25 bp, Mus musculus
ttttgcatccactagggaatctggg

SEQ ID NO: 16802 - DNA, 25 bp, Mus musculus
tagggaatctggggtccctgatcgt

SEQ ID NO: 16803 - DNA, 25 bp, Mus musculus
atctggggtccctgatcgtttcata

SEQ ID NO: 16804 - DNA, 25 bp, Mus musculus
tggggtccctgatcgtttcataggc

SEQ ID NO: 16805 - DNA, 25 bp, Mus musculus
atattccaaggtactgaccatattg

SEQ ID NO: 16806 - DNA, 25 bp, Mus musculus
ttccaaggtactgaccatattgatc

SEQ ID NO: 16807 - DNA, 25 bp, Mus musculus
atatttccgtcagaatctgagagag

SEQ ID NO: 16808 - DNA, 25 bp, Mus musculus
agtcaagccagagatctgttatcaa

SEQ ID NO: 16809 - DNA, 25 bp, Mus musculus
atgctagtgattgctccagacaagc

SEQ ID NO: 16810 - DNA, 25 bp, Mus musculus
ctagtgattgctccagacaagcgga

SEQ ID NO: 16811 - DNA, 25 bp, Mus musculus
gtgattgctccagacaagcggatct

SEQ ID NO: 16812 - DNA, 25 bp, Mus musculus
attgctccagacaagcggatctctg

SEQ ID NO: 16813 - DNA, 25 bp, Mus musculus
ccagacaagcggatctctgtggacg

SEQ ID NO: 16814 - DNA, 25 bp, Mus musculus
gacaagcggatctctgtggacgaag

SEQ ID NO: 16815 - DNA, 25 bp, Mus musculus
aagcggatctctgtggacgaagcct

SEQ ID NO: 16816 - DNA, 25 bp, Mus musculus
cggatctctgtggacgaagccttgc

SEQ ID NO: 16817 - DNA, 25 bp, Mus musculus
cagctaggaacaccatccgcagagt

SEQ ID NO: 16818 - DNA, 25 bp, Mus musculus
ctaggaacaccatccgcagagttca

SEQ ID NO: 16819 - DNA, 25 bp, Mus musculus
acaccatccgcagagttcatgaaga

SEQ ID NO: 16820 - DNA, 25 bp, Mus musculus
ccatccgcagagttcatgaagaaac

SEQ ID NO: 16821 - DNA, 25 bp, Mus musculus
cttcagccaactgtaaggaattatg

SEQ ID NO: 16822 - DNA, 25 bp, Mus musculus
gaagagctctttccagattggatat

SEQ ID NO: 16823 - DNA, 25 bp, Mus musculus
gagctctttccagattggatatttc

SEQ ID NO: 16824 - DNA, 25 bp, Mus musculus
ctctttccagattggatatttccgt

SEQ ID NO: 16825 - DNA, 25 bp, Mus musculus
tagaagttctcaggagctggtggag

SEQ ID NO: 16826 - DNA, 25 bp, Mus musculus
cgctgagagtctctaagcgggcgct

SEQ ID NO: 16827 - DNA, 25 bp, Mus musculus
gatgagatcatcgactcttgactga

SEQ ID NO: 16828 - DNA, 25 bp, Mus musculus
tcttgactgactcggcgccgacaga

SEQ ID NO: 16829 - DNA, 25 bp, Mus musculus
actgactcggcgccgacagatctgc

SEQ ID NO: 16830 - DNA, 25 bp, Mus musculus
ctgactcggcgccgacagatctgct

SEQ ID NO: 16831 - DNA, 25 bp, Mus musculus
actcggcgccgacagatctgctggt

SEQ ID NO: 16832 - DNA, 25 bp, Mus musculus
cggcgccgacagatctgctggtatc

SEQ ID NO: 16833 - DNA, 25 bp, Mus musculus
gcgccgacagatctgctggtatcag

SEQ ID NO: 16834 - DNA, 25 bp, Mus musculus
ccgacagatctgctggtatcagaag

SEQ ID NO: 16835 - DNA, 25 bp, Mus musculus
catgaacgacgctctgcttctggaa

SEQ ID NO: 16836 - DNA, 25 bp, Mus musculus
cctgactctactcgcttgctgaaag

SEQ ID NO: 16837 - DNA, 25 bp, Mus musculus
tgagagtctctaagcgggcgctgat

SEQ ID NO: 16838 - DNA, 25 bp, Mus musculus
ctgactctactcgcttgctgaaagt

SEQ ID NO: 16839 - DNA, 25 bp, Mus musculus
gagtctctaagcgggcgctgatagt

SEQ ID NO: 16840 - DNA, 25 bp, Mus musculus
gtctctaagcgggcgctgatagtgc

SEQ ID NO: 16841 - DNA, 25 bp, Mus musculus
tctaagcgggcgctgatagtgcgct

SEQ ID NO: 16842 - DNA, 25 bp, Mus musculus
atagtgcgctggtgtgtagaactcg

SEQ ID NO: 16843 - DNA, 25 bp, Mus musculus
tagtgcgctggtgtgtagaactcgc

SEQ ID NO: 16844 - DNA, 25 bp, Mus musculus
ctctcgctcgtgtgagatgagatca

SEQ ID NO: 16845 - DNA, 25 bp, Mus musculus
ctcgctcgtgtgagatgagatcatc

SEQ ID NO: 16846 - DNA, 25 bp, Mus musculus
tatacattcactgaccactggatac

SEQ ID NO: 16847 - DNA, 25 bp, Mus musculus
acattcactgaccactggatacact

SEQ ID NO: 16848 - DNA, 25 bp, Mus musculus
ctctcttctattcagcttaaataga

SEQ ID NO: 16849 - DNA, 25 bp, Mus musculus
tcttctattcagcttaaatagattt

SEQ ID NO: 16850 - DNA, 25 bp, Mus musculus
tatctgaatttcaggtcatgaagga

SEQ ID NO: 16851 - DNA, 25 bp, Mus musculus
atgcagacagacatcctcagctccc

SEQ ID NO: 16852 - DNA, 25 bp, Mus musculus
cagacagacatcctcagctcccaga

SEQ ID NO: 16853 - DNA, 25 bp, Mus musculus
acagacatcctcagctcccagactt

SEQ ID NO: 16854 - DNA, 25 bp, Mus musculus
ctcagctcccagacttcatggccag

SEQ ID NO: 16855 - DNA, 25 bp, Mus musculus
agctcccagacttcatggccagaga

SEQ ID NO: 16856 - DNA, 25 bp, Mus musculus
tcccagacttcatggccagagattt

SEQ ID NO: 16857 - DNA, 25 bp, Mus musculus
cagacttcatggccagagatttata

SEQ ID NO: 16858 - DNA, 25 bp, Mus musculus
actgaccactggatacactgggtga

SEQ ID NO: 16859 - DNA, 25 bp, Mus musculus
agacttcatggccagagatttatag

SEQ ID NO: 16860 - DNA, 25 bp, Mus musculus
gaccactggatacactgggtgaaac

SEQ ID NO: 16861 - DNA, 25 bp, Mus musculus
aggcctggacaaggccttgaatgga

SEQ ID NO: 16862 - DNA, 25 bp, Mus musculus
cctggacaaggccttgaatggatcg

SEQ ID NO: 16863 - DNA, 25 bp, Mus musculus
gatagttatactacctacaatcata

SEQ ID NO: 16864 - DNA, 25 bp, Mus musculus
agttatactacctacaatcataaat

SEQ ID NO: 16865 - DNA, 25 bp, Mus musculus
tatactacctacaatcataaattca

SEQ ID NO: 16866 - DNA, 25 bp, Mus musculus
gggccatactactttgactactggg

SEQ ID NO: 16867 - DNA, 25 bp, Mus musculus
tctgtccattctttctaaccctggg

SEQ ID NO: 16868 - DNA, 25 bp, Mus musculus
cattctttctaaccctgggctgaca

SEQ ID NO: 16869 - DNA, 25 bp, Mus musculus
tttctctgctcagcctcattccatg

SEQ ID NO: 16870 - DNA, 25 bp, Mus musculus
ttccatgccaaagtgctgctgctat

SEQ ID NO: 16871 - DNA, 25 bp, Mus musculus
gccaaagtgctgctgctataggcct

SEQ ID NO: 16872 - DNA, 25 bp, Mus musculus
taggcctctttgtgttgcacaaaat

SEQ ID NO: 16873 - DNA, 25 bp, Mus musculus
tccactatattggacatgcagcttt

SEQ ID NO: 16874 - DNA, 25 bp, Mus musculus
gacatgcagctttccttaggggaag

SEQ ID NO: 16875 - DNA, 25 bp, Mus musculus
cagctttccttaggggaagcctgca

SEQ ID NO: 16876 - DNA, 25 bp, Mus musculus
gcctgcaacaggatggccattctga

SEQ ID NO: 16877 - DNA, 25 bp, Mus musculus
aacaggatggccattctgagccagc

SEQ ID NO: 16878 - DNA, 25 bp, Mus musculus
atggccattctgagccagcaaacct

SEQ ID NO: 16879 - DNA, 25 bp, Mus musculus
ttctaaccctgggctgacaccgcag

SEQ ID NO: 16880 - DNA, 25 bp, Mus musculus
gctggcagcacaatgaccagatatg

SEQ ID NO: 16881 - DNA, 25 bp, Mus musculus
gcagcagcagcagttctgaaaagcc

SEQ ID NO: 16882 - DNA, 25 bp, Mus musculus
catccatgtggccacattcatctgc

SEQ ID NO: 16883 - DNA, 25 bp, Mus musculus
tttcatgaaccatggtcagccccaa

SEQ ID NO: 16884 - DNA, 25 bp, Mus musculus
agtcatcccataacaggtgaccaac

SEQ ID NO: 16885 - DNA, 25 bp, Mus musculus
ccctgtgtgctcaggggcagctaag

SEQ ID NO: 16886 - DNA, 25 bp, Mus musculus
gtgctcaggggcagctaagaataca

SEQ ID NO: 16887 - DNA, 25 bp, Mus musculus
taaggttttctctgctcagcctcat

SEQ ID NO: 16888 - DNA, 25 bp, Mus musculus
aacatgtctcgtgatatccttacac

SEQ ID NO: 16889 - DNA, 25 bp, Mus musculus
acatgtctcgtgatatccttacaca

SEQ ID NO: 16890 - DNA, 25 bp, Mus musculus
gtgatatccttacacaacgtacaaa

SEQ ID NO: 16891 - DNA, 25 bp, Mus musculus
tgatatccttacacaacgtacaaat

SEQ ID NO: 16892 - DNA, 25 bp, Mus musculus
gatatccttacacaacgtacaaatt

SEQ ID NO: 16893 - DNA, 25 bp, Mus musculus
gattgatactgcagggcaagataga

SEQ ID NO: 16894 - DNA, 25 bp, Mus musculus
ttgatactgcagggcaagatagatt

SEQ ID NO: 16895 - DNA, 25 bp, Mus musculus
tgatactgcagggcaagatagatta

SEQ ID NO: 16896 - DNA, 25 bp, Mus musculus
catgtctcgtgatatccttacacaa

SEQ ID NO: 16897 - DNA, 25 bp, Mus musculus
atgtctcgtgatatccttacacaac

SEQ ID NO: 16898 - DNA, 25 bp, Mus musculus
tgtctcgtgatatccttacacaacg

SEQ ID NO: 16899 - DNA, 25 bp, Mus musculus
gtctcgtgatatccttacacaacgt

SEQ ID NO: 16900 - DNA, 25 bp, Mus musculus
tctcgtgatatccttacacaacgta

SEQ ID NO: 16901 - DNA, 25 bp, Mus musculus
ctcgtgatatccttacacaacgtac

SEQ ID NO: 16902 - DNA, 25 bp, Mus musculus
tcgtgatatccttacacaacgtaca

SEQ ID NO: 16903 - DNA, 25 bp, Mus musculus
cgtgatatccttacacaacgtacaa

SEQ ID NO: 16904 - DNA, 25 bp, Mus musculus
acagcgcttctgtaggacacacata

SEQ ID NO: 16905 - DNA, 25 bp, Mus musculus
acacatacccagcaatatcagttgt

SEQ ID NO: 16906 - DNA, 25 bp, Mus musculus
ggccaaatatgcactttccctagaa

SEQ ID NO: 16907 - DNA, 25 bp, Mus musculus
atatgcactttccctagaaagccat

SEQ ID NO: 16908 - DNA, 25 bp, Mus musculus
aagccatattccagcaatgaacctt

SEQ ID NO: 16909 - DNA, 25 bp, Mus musculus
tattccagcaatgaaccttgtgcta

SEQ ID NO: 16910 - DNA, 25 bp, Mus musculus
gaaccttgtgctatagtgactccca

SEQ ID NO: 16911 - DNA, 25 bp, Mus musculus
acctgtacatacattgtataggcca

SEQ ID NO: 16912 - DNA, 25 bp, Mus musculus
taggccacctgtacatatcccagag

SEQ ID NO: 16913 - DNA, 25 bp, Mus musculus
acctgtacatatcccagagaacaat

SEQ ID NO: 16914 - DNA, 25 bp, Mus musculus
acatatcccagagaacaatcactat

SEQ ID NO: 16915 - DNA, 25 bp, Mus musculus
tcactattcttaagcactttgttga

SEQ ID NO: 16916 - DNA, 25 bp, Mus musculus
atgatctggcttgagttctgaacaa

SEQ ID NO: 16917 - DNA, 25 bp, Mus musculus
aatcttggtctatgaggtctacacc

SEQ ID NO: 16918 - DNA, 25 bp, Mus musculus
ctacaccaataacaccctactctgg

SEQ ID NO: 16919 - DNA, 25 bp, Mus musculus
taacagagccagcgctgaagtctcc

SEQ ID NO: 16920 - DNA, 25 bp, Mus musculus
tcctcccatctggaagaacatcaag

SEQ ID NO: 16921 - DNA, 25 bp, Mus musculus
ttcttggccacattctacttcagct

SEQ ID NO: 16922 - DNA, 25 bp, Mus musculus
gccacattctacttcagctctggat

SEQ ID NO: 16923 - DNA, 25 bp, Mus musculus
cttgagcccctagacagtattgcca

SEQ ID NO: 16924 - DNA, 25 bp, Mus musculus
atgccacacggcgagagatgcacat

SEQ ID NO: 16925 - DNA, 25 bp, Mus musculus
cccccatatcagtgagcttgcattc

SEQ ID NO: 16926 - DNA, 25 bp, Mus musculus
attgcctctaggtcttcttcctcga

SEQ ID NO: 16927 - DNA, 25 bp, Mus musculus
gcctctaggtcttcttcctcgatct

SEQ ID NO: 16928 - DNA, 25 bp, Mus musculus
tctaggtcttcttcctcgatctctc

SEQ ID NO: 16929 - DNA, 25 bp, Mus musculus
aggtcttcttcctcgatctctctac

SEQ ID NO: 16930 - DNA, 25 bp, Mus musculus
tctctacctcctagcaatgccagtc

SEQ ID NO: 16931 - DNA, 25 bp, Mus musculus
ctacctcctagcaatgccagtctat

SEQ ID NO: 16932 - DNA, 25 bp, Mus musculus
cctcctagcaatgccagtctatggg

SEQ ID NO: 16933 - DNA, 25 bp, Mus musculus
cctagcaatgccagtctatgggtcc

SEQ ID NO: 16934 - DNA, 25 bp, Mus musculus
agcaatgccagtctatgggtccctg

SEQ ID NO: 16935 - DNA, 25 bp, Mus musculus
aatgccagtctatgggtccctgcag

SEQ ID NO: 16936 - DNA, 25 bp, Mus musculus
ccatatcagtgagcttgcattccct

SEQ ID NO: 16937 - DNA, 25 bp, Mus musculus
tgctggctgacagcccctatcccta

SEQ ID NO: 16938 - DNA, 25 bp, Mus musculus
tggctgacagcccctatccctactg

SEQ ID NO: 16939 - DNA, 25 bp, Mus musculus
cctatccctactggccctattcatg

SEQ ID NO: 16940 - DNA, 25 bp, Mus musculus
atccctactggccctattcatgacc

SEQ ID NO: 16941 - DNA, 25 bp, Mus musculus
caccctagaattgcctctaggtctt

SEQ ID NO: 16942 - DNA, 25 bp, Mus musculus
cctagaattgcctctaggtcttctt

SEQ ID NO: 16943 - DNA, 25 bp, Mus musculus
agaattgcctctaggtcttcttcct

SEQ ID NO: 16944 - DNA, 25 bp, Mus musculus
tccatctcatttcttgtcaaagcca

SEQ ID NO: 16945 - DNA, 25 bp, Mus musculus
tttcttgtcaaagccactttagtga

SEQ ID NO: 16946 - DNA, 25 bp, Mus musculus
agcctccactacagagctgggcaga

SEQ ID NO: 16947 - DNA, 25 bp, Mus musculus
gtgcatctgccctctgagttctttc

SEQ ID NO: 16948 - DNA, 25 bp, Mus musculus
ccctctgagttctttctgtgtgatc

SEQ ID NO: 16949 - DNA, 25 bp, Mus musculus
tttttcataacggctgcagcagcag

SEQ ID NO: 16950 - DNA, 25 bp, Mus musculus
ccatgtcttcactccgcttcagttg

SEQ ID NO: 16951 - DNA, 25 bp, Mus musculus
tgtcttcactccgcttcagttgacc

SEQ ID NO: 16952 - DNA, 25 bp, Mus musculus
tgaagctttcccagtgcactttgaa

SEQ ID NO: 16953 - DNA, 25 bp, Mus musculus
tccttgcctcggcccagtgatcatg

SEQ ID NO: 16954 - DNA, 25 bp, Mus musculus
ttgcctcggcccagtgatcatgaca

SEQ ID NO: 16955 - DNA, 25 bp, Mus musculus
cctcggcccagtgatcatgacagga

SEQ ID NO: 16956 - DNA, 25 bp, Mus musculus
cttgtcaaagccactttagtgagaa

SEQ ID NO: 16957 - DNA, 25 bp, Mus musculus
gtcaaagccactttagtgagaaata

SEQ ID NO: 16958 - DNA, 25 bp, Mus musculus
aataggtaccagtcctcaggacgag

SEQ ID NO: 16959 - DNA, 25 bp, Mus musculus
aggtaccagtcctcaggacgagcca

SEQ ID NO: 16960 - DNA, 25 bp, Mus musculus
cagtcctcaggacgagccaggatcc

SEQ ID NO: 16961 - DNA, 25 bp, Mus musculus
acgatgcctgggatccagctgacag

SEQ ID NO: 16962 - DNA, 25 bp, Mus musculus
atccagctgacaggagggtccagcc

SEQ ID NO: 16963 - DNA, 25 bp, Mus musculus
tccagcctccactacagagctgggc

SEQ ID NO: 16964 - DNA, 25 bp, Mus musculus
gaatcggaagccttggatgacccat

SEQ ID NO: 16965 - DNA, 25 bp, Mus musculus
gaagccttggatgacccatgcacgc

SEQ ID NO: 16966 - DNA, 25 bp, Mus musculus
atgcttcgtggtgttctgggaaagg

SEQ ID NO: 16967 - DNA, 25 bp, Mus musculus
aaggcttttcgacttgctggctata

SEQ ID NO: 16968 - DNA, 25 bp, Mus musculus
gcttttcgacttgctggctatacca

SEQ ID NO: 16969 - DNA, 25 bp, Mus musculus
gctggctataccattcagtatggct

SEQ ID NO: 16970 - DNA, 25 bp, Mus musculus
ggctataccattcagtatggctgca

SEQ ID NO: 16971 - DNA, 25 bp, Mus musculus
accattcagtatggctgcatagctc

SEQ ID NO: 16972 - DNA, 25 bp, Mus musculus
tgcatagctcattgtgcttttgaat

SEQ ID NO: 16973 - DNA, 25 bp, Mus musculus
atagctcattgtgcttttgaatacg

SEQ ID NO: 16974 - DNA, 25 bp, Mus musculus
tgttctggaccatcaatggaaccca

SEQ ID NO: 16975 - DNA, 25 bp, Mus musculus
ggaccatcaatggaacccacaattc

SEQ ID NO: 16976 - DNA, 25 bp, Mus musculus
gatgacccatgcacgctttgagacc

SEQ ID NO: 16977 - DNA, 25 bp, Mus musculus
tcaatggaacccacaattcaaaatt

SEQ ID NO: 16978 - DNA, 25 bp, Mus musculus
gacccatgcacgctttgagacctcc

SEQ ID NO: 16979 - DNA, 25 bp, Mus musculus
tgcacgctttgagacctccgtcaga

SEQ ID NO: 16980 - DNA, 25 bp, Mus musculus
ctttgagacctccgtcagatctggg

SEQ ID NO: 16981 - DNA, 25 bp, Mus musculus
ctccgtcagatctggggtttcctgg

SEQ ID NO: 16982 - DNA, 25 bp, Mus musculus
catacttttggctggtggtagcaga

SEQ ID NO: 16983 - DNA, 25 bp, Mus musculus
acttttggctggtggtagcagagtc

SEQ ID NO: 16984 - DNA, 25 bp, Mus musculus
catcaaagtatgcttcgtggtgttc

SEQ ID NO: 16985 - DNA, 25 bp, Mus musculus
ccagactaagctacagacgctcata

SEQ ID NO: 16986 - DNA, 25 bp, Mus musculus
taagctacagacgctcatagctccg

SEQ ID NO: 16987 - DNA, 25 bp, Mus musculus
cagagccttctggggtcctctgctc

SEQ ID NO: 16988 - DNA, 25 bp, Mus musculus
gggtcctctgctcctgtattcccag

SEQ ID NO: 16989 - DNA, 25 bp, Mus musculus
tctgctcctgtattcccaggccaac

SEQ ID NO: 16990 - DNA, 25 bp, Mus musculus
ggcccgggcagtgagttgtgatttt

SEQ ID NO: 16991 - DNA, 25 bp, Mus musculus
taaatctgttttgacagttgatttc

SEQ ID NO: 16992 - DNA, 25 bp, Mus musculus
cttcatagacttctcccgcttctga

SEQ ID NO: 16993 - DNA, 25 bp, Mus musculus
ctcccgcttctgagttcttatcttc

SEQ ID NO: 16994 - DNA, 25 bp, Mus musculus
tatcttctcccgggttgagatgttg

SEQ ID NO: 16995 - DNA, 25 bp, Mus musculus
gactatagtcctggtgtgtaaatag

SEQ ID NO: 16996 - DNA, 25 bp, Mus musculus
aagcataatttctgtgctgttttct

SEQ ID NO: 16997 - DNA, 25 bp, Mus musculus
acagacgctcatagctccgtgccag

SEQ ID NO: 16998 - DNA, 25 bp, Mus musculus
gctcatagctccgtgccagctgtat

SEQ ID NO: 16999 - DNA, 25 bp, Mus musculus
gtgccagctgtatgcccagaaaggt

SEQ ID NO: 17000 - DNA, 25 bp, Mus musculus
gctgtatgcccagaaaggtgtccat

SEQ ID NO: 17001 - DNA, 25 bp, Mus musculus
ggactgaatgccttctgcctgcaaa

SEQ ID NO: 17002 - DNA, 25 bp, Mus musculus
ttctgcctgcaaaggagtggcactg

SEQ ID NO: 17003 - DNA, 25 bp, Mus musculus
tgtctctgtctgcagatgccccttc

SEQ ID NO: 17004 - DNA, 25 bp, Mus musculus
ccacctggctttatacatgtactag

SEQ ID NO: 17005 - DNA, 25 bp, Mus musculus
tcacggctttgacaagcccgcagcg

SEQ ID NO: 17006 - DNA, 25 bp, Mus musculus
acgctgagcccgcgatgaactgcgc

SEQ ID NO: 17007 - DNA, 25 bp, Mus musculus
gcaccagcttcctcgtaagtgatca

SEQ ID NO: 17008 - DNA, 25 bp, Mus musculus
ccagcttcctcgtaagtgatcagag

SEQ ID NO: 17009 - DNA, 25 bp, Mus musculus
gcttcctcgtaagtgatcagagccg

SEQ ID NO: 17010 - DNA, 25 bp, Mus musculus
gtgatcagagccgcttcgccaagga

SEQ ID NO: 17011 - DNA, 25 bp, Mus musculus
agagccgcttcgccaaggaagtact

SEQ ID NO: 17012 - DNA, 25 bp, Mus musculus
gccgcttcgccaaggaagtactgcc

SEQ ID NO: 17013 - DNA, 25 bp, Mus musculus
gcttcgccaaggaagtactgcccca

SEQ ID NO: 17014 - DNA, 25 bp, Mus musculus
aagtactgccccagtatttcaagca

SEQ ID NO: 17015 - DNA, 25 bp, Mus musculus
cccagtatttcaagcacagcaatat

SEQ ID NO: 17016 - DNA, 25 bp, Mus musculus
atatggcgagctttgttcgtcaact

SEQ ID NO: 17017 - DNA, 25 bp, Mus musculus
ctgagcccgcgatgaactgcgccat

SEQ ID NO: 17018 - DNA, 25 bp, Mus musculus
ccgcgatgaactgcgccatgcagga

SEQ ID NO: 17019 - DNA, 25 bp, Mus musculus
cgatgaactgcgccatgcaggaagc

SEQ ID NO: 17020 - DNA, 25 bp, Mus musculus
tgaactgcgccatgcaggaagcgcc

SEQ ID NO: 17021 - DNA, 25 bp, Mus musculus
ccatgcaggaagcgccacgtgcgct

SEQ ID NO: 17022 - DNA, 25 bp, Mus musculus
ccttcctcggcaagctatgggcgct

SEQ ID NO: 17023 - DNA, 25 bp, Mus musculus
tcctcggcaagctatgggcgctggt

SEQ ID NO: 17024 - DNA, 25 bp, Mus musculus
agctatgggcgctggtaggcgaccc

SEQ ID NO: 17025 - DNA, 25 bp, Mus musculus
acgttcctgagtggccaaggccctg

SEQ ID NO: 17026 - DNA, 25 bp, Mus musculus
cgttcctgagtggccaaggccctgc

SEQ ID NO: 17027 - DNA, 25 bp, Mus musculus
aagacacgctgcccgatctacagat

SEQ ID NO: 17028 - DNA, 25 bp, Mus musculus
agacacgctgcccgatctacagatg

SEQ ID NO: 17029 - DNA, 25 bp, Mus musculus
gacacgctgcccgatctacagatga

SEQ ID NO: 17030 - DNA, 25 bp, Mus musculus
acacgctgcccgatctacagatgaa

SEQ ID NO: 17031 - DNA, 25 bp, Mus musculus
cacgctgcccgatctacagatgaag

SEQ ID NO: 17032 - DNA, 25 bp, Mus musculus
acgctgcccgatctacagatgaagt

SEQ ID NO: 17033 - DNA, 25 bp, Mus musculus
cgctgcccgatctacagatgaagta

SEQ ID NO: 17034 - DNA, 25 bp, Mus musculus
gctgcccgatctacagatgaagtac

SEQ ID NO: 17035 - DNA, 25 bp, Mus musculus
ctgcccgatctacagatgaagtaca

SEQ ID NO: 17036 - DNA, 25 bp, Mus musculus
tgcccgatctacagatgaagtacac

SEQ ID NO: 17037 - DNA, 25 bp, Mus musculus
gttcctgagtggccaaggccctgcg

SEQ ID NO: 17038 - DNA, 25 bp, Mus musculus
gcggagcaccatcgtaacctctgtc

SEQ ID NO: 17039 - DNA, 25 bp, Mus musculus
atcgtaacctctgtccaggaagttg

SEQ ID NO: 17040 - DNA, 25 bp, Mus musculus
tcgtaacctctgtccaggaagttga

SEQ ID NO: 17041 - DNA, 25 bp, Mus musculus
gtaacctctgtccaggaagttgact

SEQ ID NO: 17042 - DNA, 25 bp, Mus musculus
caggaagacacgctgcccgatctac

SEQ ID NO: 17043 - DNA, 25 bp, Mus musculus
aggaagacacgctgcccgatctaca

SEQ ID NO: 17044 - DNA, 25 bp, Mus musculus
ggaagacacgctgcccgatctacag

SEQ ID NO: 17045 - DNA, 25 bp, Mus musculus
catcttcattccaacaggaaaaaga

SEQ ID NO: 17046 - DNA, 25 bp, Mus musculus
acgttaaatcctgcagctccattct

SEQ ID NO: 17047 - DNA, 25 bp, Mus musculus
gccgccatgacctttctcctaggct

SEQ ID NO: 17048 - DNA, 25 bp, Mus musculus
gccatgacctttctcctaggctggt

SEQ ID NO: 17049 - DNA, 25 bp, Mus musculus
atgacctttctcctaggctggtgtc

SEQ ID NO: 17050 - DNA, 25 bp, Mus musculus
ctcctaggctggtgtcttgggcttc

SEQ ID NO: 17051 - DNA, 25 bp, Mus musculus
ctaggctggtgtcttgggcttccta

SEQ ID NO: 17052 - DNA, 25 bp, Mus musculus
tgtcttgggcttcctattgattcga

SEQ ID NO: 17053 - DNA, 25 bp, Mus musculus
cttgggcttcctattgattcgataa

SEQ ID NO: 17054 - DNA, 25 bp, Mus musculus
cttcctattgattcgataaaccgcg

SEQ ID NO: 17055 - DNA, 25 bp, Mus musculus
tcgataaaccgcgatgaatgagcag

SEQ ID NO: 17056 - DNA, 25 bp, Mus musculus
acttgtattcctacattacagtcta

SEQ ID NO: 17057 - DNA, 25 bp, Mus musculus
aatcctgcagctccattctcagcat

SEQ ID NO: 17058 - DNA, 25 bp, Mus musculus
gcagctccattctcagcatcggggc

SEQ ID NO: 17059 - DNA, 25 bp, Mus musculus
ttctcagcatcggggcccatgatcc

SEQ ID NO: 17060 - DNA, 25 bp, Mus musculus
tcggggcccatgatcctgtgatgtg

SEQ ID NO: 17061 - DNA, 25 bp, Mus musculus
gggcccatgatcctgtgatgtgctg

SEQ ID NO: 17062 - DNA, 25 bp, Mus musculus
cccatgatcctgtgatgtgctggac

SEQ ID NO: 17063 - DNA, 25 bp, Mus musculus
atcctgtgatgtgctggacagtctg

SEQ ID NO: 17064 - DNA, 25 bp, Mus musculus
ttgccatttccagccgccatgacct

SEQ ID NO: 17065 - DNA, 25 bp, Mus musculus
aagcctatgaggccgggagactgac

SEQ ID NO: 17066 - DNA, 25 bp, Mus musculus
aagtgcattgctgcagtcagtgggg

SEQ ID NO: 17067 - DNA, 25 bp, Mus musculus
gccagtttcccaacatctcactgat

SEQ ID NO: 17068 - DNA, 25 bp, Mus musculus
agtttcccaacatctcactgattgg

SEQ ID NO: 17069 - DNA, 25 bp, Mus musculus
ccaacatctcactgattgggctgac

SEQ ID NO: 17070 - DNA, 25 bp, Mus musculus
acatctcactgattgggctgacagc

SEQ ID NO: 17071 - DNA, 25 bp, Mus musculus
tctcactgattgggctgacagcaac

SEQ ID NO: 17072 - DNA, 25 bp, Mus musculus
cagcaacagcaaccaaccatgtttt

SEQ ID NO: 17073 - DNA, 25 bp, Mus musculus
caacagcaaccaaccatgttttgaa

SEQ ID NO: 17074 - DNA, 25 bp, Mus musculus
cagcaaccaaccatgttttgaagga

SEQ ID NO: 17075 - DNA, 25 bp, Mus musculus
cgtctttcaacagaccaaatctcta

SEQ ID NO: 17076 - DNA, 25 bp, Mus musculus
ctttcaacagaccaaatctctacta

SEQ ID NO: 17077 - DNA, 25 bp, Mus musculus
gacatgacttcaggccggattacaa

SEQ ID NO: 17078 - DNA, 25 bp, Mus musculus
acagaccaaatctctactatgaggt

SEQ ID NO: 17079 - DNA, 25 bp, Mus musculus
acttcaggccggattacaaagcact

SEQ ID NO: 17080 - DNA, 25 bp, Mus musculus
attacaaagcactcggcatcttgaa

SEQ ID NO: 17081 - DNA, 25 bp, Mus musculus
aagcactcggcatcttgaagcgcca

SEQ ID NO: 17082 - DNA, 25 bp, Mus musculus
tcggcatcttgaagcgccagtttcc

SEQ ID NO: 17083 - DNA, 25 bp, Mus musculus
gcatcttgaagcgccagtttcccaa

SEQ ID NO: 17084 - DNA, 25 bp, Mus musculus
tcttgaagcgccagtttcccaacat

SEQ ID NO: 17085 - DNA, 25 bp, Mus musculus
agcgccagtttcccaacatctcact

SEQ ID NO: 17086 - DNA, 25 bp, Mus musculus
agagctgagcagcaccgagtgccat

SEQ ID NO: 17087 - DNA, 25 bp, Mus musculus
gagcagcaccgagtgccatcagtgg

SEQ ID NO: 17088 - DNA, 25 bp, Mus musculus
tccctggagcgactcatccatgagt

SEQ ID NO: 17089 - DNA, 25 bp, Mus musculus
ctcatccatgagtgccgaggaattc

SEQ ID NO: 17090 - DNA, 25 bp, Mus musculus
ggaattcacagataccgtgtttgcc

SEQ ID NO: 17091 - DNA, 25 bp, Mus musculus
taccgtgtttgccaagatcgacatc

SEQ ID NO: 17092 - DNA, 25 bp, Mus musculus
gaaggaccagatgctcctggacacg

SEQ ID NO: 17093 - DNA, 25 bp, Mus musculus
ccgaagcctggacttgaccggcatc

SEQ ID NO: 17094 - DNA, 25 bp, Mus musculus
cctggacttgaccggcatcgtgcgc

SEQ ID NO: 17095 - DNA, 25 bp, Mus musculus
cttgaccggcatcgtgcgcagactc

SEQ ID NO: 17096 - DNA, 25 bp, Mus musculus
cagactccagaacggcgaacacgag

SEQ ID NO: 17097 - DNA, 25 bp, Mus musculus
ccagaacggcgaacacgaggaggca

SEQ ID NO: 17098 - DNA, 25 bp, Mus musculus
caccgagtgccatcagtggtataag

SEQ ID NO: 17099 - DNA, 25 bp, Mus musculus
tatgacggaggtcccatctggccag

SEQ ID NO: 17100 - DNA, 25 bp, Mus musculus
tggtctcaagaacctgagcccctca

SEQ ID NO: 17101 - DNA, 25 bp, Mus musculus
tgacttcatggagtacgtggcagcc

SEQ ID NO: 17102 - DNA, 25 bp, Mus musculus
tttcaagctctacgacgtcgacggc

SEQ ID NO: 17103 - DNA, 25 bp, Mus musculus
cgacggcaacgggtgcatagacagg

SEQ ID NO: 17104 - DNA, 25 bp, Mus musculus
ggccatccgaaccattaatccctgg

SEQ ID NO: 17105 - DNA, 25 bp, Mus musculus
cattaatccctggagcgactcatcc

SEQ ID NO: 17106 - DNA, 25 bp, Mus musculus
gagccgcagaagccagaccatccaa

SEQ ID NO: 17107 - DNA, 25 bp, Mus musculus
agccgcagaagccagaccatccaag

SEQ ID NO: 17108 - DNA, 25 bp, Mus musculus
gttgactggccacttggagcggaat

SEQ ID NO: 17109 - DNA, 25 bp, Mus musculus
gactggccacttggagcggaatcag

SEQ ID NO: 17110 - DNA, 25 bp, Mus musculus
ctggccacttggagcggaatcagga

SEQ ID NO: 17111 - DNA, 25 bp, Mus musculus
gagactgagccctagctcgcccact

SEQ ID NO: 17112 - DNA, 25 bp, Mus musculus
agactgagccctagctcgcccactt

SEQ ID NO: 17113 - DNA, 25 bp, Mus musculus
tagctcgcccacttgctggacaaga

SEQ ID NO: 17114 - DNA, 25 bp, Mus musculus
agctcgcccacttgctggacaagat

SEQ ID NO: 17115 - DNA, 25 bp, Mus musculus
ctcgcccacttgctggacaagatga

SEQ ID NO: 17116 - DNA, 25 bp, Mus musculus
tcgcccacttgctggacaagatgat

SEQ ID NO: 17117 - DNA, 25 bp, Mus musculus
cccacttgctggacaagatgatatt

SEQ ID NO: 17118 - DNA, 25 bp, Mus musculus
ccgcagaagccagaccatccaagtt

SEQ ID NO: 17119 - DNA, 25 bp, Mus musculus
cgcagaagccagaccatccaagttg

SEQ ID NO: 17120 - DNA, 25 bp, Mus musculus
agaagccagaccatccaagttgact

SEQ ID NO: 17121 - DNA, 25 bp, Mus musculus
aagccagaccatccaagttgactgg

SEQ ID NO: 17122 - DNA, 25 bp, Mus musculus
agccagaccatccaagttgactggc

SEQ ID NO: 17123 - DNA, 25 bp, Mus musculus
gaccatccaagttgactggccactt

SEQ ID NO: 17124 - DNA, 25 bp, Mus musculus
accatccaagttgactggccacttg

SEQ ID NO: 17125 - DNA, 25 bp, Mus musculus
caagttgactggccacttggagcgg

SEQ ID NO: 17126 - DNA, 25 bp, Mus musculus
gcgcccttgggaccagtgaaattct

SEQ ID NO: 17127 - DNA, 25 bp, Mus musculus
ccaggtgtcagcatctccgaagaga

SEQ ID NO: 17128 - DNA, 25 bp, Mus musculus
tccatagagcagcagcggcagaagc

SEQ ID NO: 17129 - DNA, 25 bp, Mus musculus
atagagcagcagcggcagaagctgc

SEQ ID NO: 17130 - DNA, 25 bp, Mus musculus
cagaagctgcccgtgttcaagctta

SEQ ID NO: 17131 - DNA, 25 bp, Mus musculus
tatcagaccgtggtgattgttggag

SEQ ID NO: 17132 - DNA, 25 bp, Mus musculus
cagaccgtggtgattgttggagaaa

SEQ ID NO: 17133 - DNA, 25 bp, Mus musculus
acccaggtcccacagtacctggcag

SEQ ID NO: 17134 - DNA, 25 bp, Mus musculus
caggtcccacagtacctggcagaag

SEQ ID NO: 17135 - DNA, 25 bp, Mus musculus
gtcccacagtacctggcagaagctg

SEQ ID NO: 17136 - DNA, 25 bp, Mus musculus
ccacagtacctggcagaagctggct

SEQ ID NO: 17137 - DNA, 25 bp, Mus musculus
tacctggcagaagctggctggacag

SEQ ID NO: 17138 - DNA, 25 bp, Mus musculus
gtcagcatctccgaagagagacaaa

SEQ ID NO: 17139 - DNA, 25 bp, Mus musculus
agcatctccgaagagagacaaagtg

SEQ ID NO: 17140 - DNA, 25 bp, Mus musculus
agtgtcactgagaactctgggacaa

SEQ ID NO: 17141 - DNA, 25 bp, Mus musculus
gagaactctgggacaaccgtcattt

SEQ ID NO: 17142 - DNA, 25 bp, Mus musculus
tctgggacaaccgtcatttacaatc

SEQ ID NO: 17143 - DNA, 25 bp, Mus musculus
accgtcatttacaatccctacgctg

SEQ ID NO: 17144 - DNA, 25 bp, Mus musculus
gtcatttacaatccctacgctgccc

SEQ ID NO: 17145 - DNA, 25 bp, Mus musculus
gccctttccatagagcagcagcggc

SEQ ID NO: 17146 - DNA, 25 bp, Mus musculus
aggatgtcttgctccttttctggaa

SEQ ID NO: 17147 - DNA, 25 bp, Mus musculus
gatgtcttgctccttttctggaaat

SEQ ID NO: 17148 - DNA, 25 bp, Mus musculus
gcatcttttgctcctggagtggtgt

SEQ ID NO: 17149 - DNA, 25 bp, Mus musculus
catcttttgctcctggagtggtgtt

SEQ ID NO: 17150 - DNA, 25 bp, Mus musculus
tttgctcctggagtggtgttttcgc

SEQ ID NO: 17151 - DNA, 25 bp, Mus musculus
ttgctcctggagtggtgttttcgct

SEQ ID NO: 17152 - DNA, 25 bp, Mus musculus
ctcctggagtggtgttttcgcttct

SEQ ID NO: 17153 - DNA, 25 bp, Mus musculus
cccacacacttgagtatttggtctc

SEQ ID NO: 17154 - DNA, 25 bp, Mus musculus
ccacacacttgagtatttggtctcg

SEQ ID NO: 17155 - DNA, 25 bp, Mus musculus
cacacacttgagtatttggtctcgt

SEQ ID NO: 17156 - DNA, 25 bp, Mus musculus
gagtatttggtctcgtccagcctgg

SEQ ID NO: 17157 - DNA, 25 bp, Mus musculus
agtatttggtctcgtccagcctggc

SEQ ID NO: 17158 - DNA, 25 bp, Mus musculus
atgtcttgctccttttctggaaata

SEQ ID NO: 17159 - DNA, 25 bp, Mus musculus
taaactacgtcgtgtgatctttgat

SEQ ID NO: 17160 - DNA, 25 bp, Mus musculus
actacgtcgtgtgatctttgatgag

SEQ ID NO: 17161 - DNA, 25 bp, Mus musculus
ctacgtcgtgtgatctttgatgagt

SEQ ID NO: 17162 - DNA, 25 bp, Mus musculus
acgtcgtgtgatctttgatgagtta

SEQ ID NO: 17163 - DNA, 25 bp, Mus musculus
ctgaggcatcttttgctcctggagt

SEQ ID NO: 17164 - DNA, 25 bp, Mus musculus
gaggcatcttttgctcctggagtgg

SEQ ID NO: 17165 - DNA, 25 bp, Mus musculus
aggcatcttttgctcctggagtggt

SEQ ID NO: 17166 - DNA, 25 bp, Mus musculus
gacttaattgctcaagcccggacag

SEQ ID NO: 17167 - DNA, 25 bp, Mus musculus
taattgctcaagcccggacaggaac

SEQ ID NO: 17168 - DNA, 25 bp, Mus musculus
tttggctccaacaagggaattggca

SEQ ID NO: 17169 - DNA, 25 bp, Mus musculus
tggctccaacaagggaattggcaaa

SEQ ID NO: 17170 - DNA, 25 bp, Mus musculus
ctcaatgtggcgtgtttttatggtg

SEQ ID NO: 17171 - DNA, 25 bp, Mus musculus
ggaacatcatatcaaagccagatta

SEQ ID NO: 17172 - DNA, 25 bp, Mus musculus
catcatatcaaagccagattaatca

SEQ ID NO: 17173 - DNA, 25 bp, Mus musculus
tcatatcaaagccagattaatcaaa

SEQ ID NO: 17174 - DNA, 25 bp, Mus musculus
gtattgacatccttgttgggaccca

SEQ ID NO: 17175 - DNA, 25 bp, Mus musculus
attgacatccttgttgggacccagg

SEQ ID NO: 17176 - DNA, 25 bp, Mus musculus
tgacatccttgttgggacccaggac

SEQ ID NO: 17177 - DNA, 25 bp, Mus musculus
ggacccaggacgtatcaaagaccat

SEQ ID NO: 17178 - DNA, 25 bp, Mus musculus
agacattctcttttgccataccctt

SEQ ID NO: 17179 - DNA, 25 bp, Mus musculus
acattctcttttgccatacccttga

SEQ ID NO: 17180 - DNA, 25 bp, Mus musculus
attctcttttgccatacccttgatt

SEQ ID NO: 17181 - DNA, 25 bp, Mus musculus
tctcttttgccatacccttgattga

SEQ ID NO: 17182 - DNA, 25 bp, Mus musculus
tcttttgccatacccttgattgaaa

SEQ ID NO: 17183 - DNA, 25 bp, Mus musculus
ttgccatacccttgattgaaaggct

SEQ ID NO: 17184 - DNA, 25 bp, Mus musculus
gccatacccttgattgaaaggctcc

SEQ ID NO: 17185 - DNA, 25 bp, Mus musculus
catacccttgattgaaaggctccaa

SEQ ID NO: 17186 - DNA, 25 bp, Mus musculus
tacttcgtggtcactagggaatatg

SEQ ID NO: 17187 - DNA, 25 bp, Mus musculus
gcacaggacacatacagcccagatg

SEQ ID NO: 17188 - DNA, 25 bp, Mus musculus
ggagtccacgtgcgctctgtgtgcg

SEQ ID NO: 17189 - DNA, 25 bp, Mus musculus
atggatgtcgacccctttgccatcc

SEQ ID NO: 17190 - DNA, 25 bp, Mus musculus
ccctttgccatccagtgtttggatg

SEQ ID NO: 17191 - DNA, 25 bp, Mus musculus
gccatccagtgtttggatgagcatc

SEQ ID NO: 17192 - DNA, 25 bp, Mus musculus
cactaagcgctgctggcagccctgg

SEQ ID NO: 17193 - DNA, 25 bp, Mus musculus
atgctcaaactgtactctcatctgc

SEQ ID NO: 17194 - DNA, 25 bp, Mus musculus
tgactttaaagtcttcctgtcaggg

SEQ ID NO: 17195 - DNA, 25 bp, Mus musculus
taaagtcttcctgtcagggaaactg

SEQ ID NO: 17196 - DNA, 25 bp, Mus musculus
cttcctgtcagggaaactgcatgaa

SEQ ID NO: 17197 - DNA, 25 bp, Mus musculus
gaaactgcatgaatcctacagaata

SEQ ID NO: 17198 - DNA, 25 bp, Mus musculus
gacacatacagcccagatgagttcc

SEQ ID NO: 17199 - DNA, 25 bp, Mus musculus
ctctgggccaccatccaaaggatcc

SEQ ID NO: 17200 - DNA, 25 bp, Mus musculus
gccaccatccaaaggatcccagaag

SEQ ID NO: 17201 - DNA, 25 bp, Mus musculus
aatgccattgctaggtttgtcaagt

SEQ ID NO: 17202 - DNA, 25 bp, Mus musculus
gatgtttccaatggtgccccttatc

SEQ ID NO: 17203 - DNA, 25 bp, Mus musculus
tccaatggtgccccttatccaccgt

SEQ ID NO: 17204 - DNA, 25 bp, Mus musculus
ccttatccaccgtgcagtggagtcc

SEQ ID NO: 17205 - DNA, 25 bp, Mus musculus
ccaccgtgcagtggagtccacgtgc

SEQ ID NO: 17206 - DNA, 25 bp, Mus musculus
gtcgtgacccaggtcgcacgctttc

SEQ ID NO: 17207 - DNA, 25 bp, Mus musculus
tcgtgacccaggtcgcacgctttcg

SEQ ID NO: 17208 - DNA, 25 bp, Mus musculus
gtgacttggatgccggcggtccctg

SEQ ID NO: 17209 - DNA, 25 bp, Mus musculus
acttggatgccggcggtccctgccg

SEQ ID NO: 17210 - DNA, 25 bp, Mus musculus
ggtccctgccgaaagagggaagatg

SEQ ID NO: 17211 - DNA, 25 bp, Mus musculus
gtccctgccgaaagagggaagatgg

SEQ ID NO: 17212 - DNA, 25 bp, Mus musculus
tccctgccgaaagagggaagatggc

SEQ ID NO: 17213 - DNA, 25 bp, Mus musculus
acaagagtcagaacctccggagact

SEQ ID NO: 17214 - DNA, 25 bp, Mus musculus
caagagtcagaacctccggagactg

SEQ ID NO: 17215 - DNA, 25 bp, Mus musculus
aagagtcagaacctccggagactgc

SEQ ID NO: 17216 - DNA, 25 bp, Mus musculus
agagtcagaacctccggagactgca

SEQ ID NO: 17217 - DNA, 25 bp, Mus musculus
tcagaacctccggagactgcaggcc

SEQ ID NO: 17218 - DNA, 25 bp, Mus musculus
cgtgacccaggtcgcacgctttcgg

SEQ ID NO: 17219 - DNA, 25 bp, Mus musculus
gtgacccaggtcgcacgctttcggc

SEQ ID NO: 17220 - DNA, 25 bp, Mus musculus
tgacccaggtcgcacgctttcggct

SEQ ID NO: 17221 - DNA, 25 bp, Mus musculus
gacccaggtcgcacgctttcggctc

SEQ ID NO: 17222 - DNA, 25 bp, Mus musculus
acgctttcggctccgcgcctggcaa

SEQ ID NO: 17223 - DNA, 25 bp, Mus musculus
gctccgcgcctggcaatagggtgac

SEQ ID NO: 17224 - DNA, 25 bp, Mus musculus
ctccgcgcctggcaatagggtgact

SEQ ID NO: 17225 - DNA, 25 bp, Mus musculus
cgcgcctggcaatagggtgacttgg

SEQ ID NO: 17226 - DNA, 25 bp, Mus musculus
ttttcaagcgcagatcacatcttgc

SEQ ID NO: 17227 - DNA, 25 bp, Mus musculus
ttcaagcgcagatcacatcttgctt

SEQ ID NO: 17228 - DNA, 25 bp, Mus musculus
gtgttgttcggcacagtctacgagc

SEQ ID NO: 17229 - DNA, 25 bp, Mus musculus
tgttgttcggcacagtctacgagct

SEQ ID NO: 17230 - DNA, 25 bp, Mus musculus
ttgttcggcacagtctacgagctga

SEQ ID NO: 17231 - DNA, 25 bp, Mus musculus
tgttcggcacagtctacgagctgag

SEQ ID NO: 17232 - DNA, 25 bp, Mus musculus
ggcacagtctacgagctgagaaaca

SEQ ID NO: 17233 - DNA, 25 bp, Mus musculus
gcacagtctacgagctgagaaacag

SEQ ID NO: 17234 - DNA, 25 bp, Mus musculus
acagtctacgagctgagaaacagtg

SEQ ID NO: 17235 - DNA, 25 bp, Mus musculus
aaggcgattcctgaacctccagtgg

SEQ ID NO: 17236 - DNA, 25 bp, Mus musculus
aggcgattcctgaacctccagtggc

SEQ ID NO: 17237 - DNA, 25 bp, Mus musculus
gcgattcctgaacctccagtggcct

SEQ ID NO: 17238 - DNA, 25 bp, Mus musculus
tcaagcgcagatcacatcttgcttc

SEQ ID NO: 17239 - DNA, 25 bp, Mus musculus
cgattcctgaacctccagtggcctt

SEQ ID NO: 17240 - DNA, 25 bp, Mus musculus
aagcgcagatcacatcttgcttcca

SEQ ID NO: 17241 - DNA, 25 bp, Mus musculus
agcgcagatcacatcttgcttccaa

SEQ ID NO: 17242 - DNA, 25 bp, Mus musculus
cgcagatcacatcttgcttccaatt

SEQ ID NO: 17243 - DNA, 25 bp, Mus musculus
tacccctgagactgaagatgacgtg

SEQ ID NO: 17244 - DNA, 25 bp, Mus musculus
acccctgagactgaagatgacgtga

SEQ ID NO: 17245 - DNA, 25 bp, Mus musculus
cgtgaggccgtgttgttcggcacag

SEQ ID NO: 17246 - DNA, 25 bp, Mus musculus
gccgtgttgttcggcacagtctacg

SEQ ID NO: 17247 - DNA, 25 bp, Mus musculus
gactatgaggctggcgttgtctcct

SEQ ID NO: 17248 - DNA, 25 bp, Mus musculus
ttctacaacataactgaccatggct

SEQ ID NO: 17249 - DNA, 25 bp, Mus musculus
tcctggggaccatttctggatactg

SEQ ID NO: 17250 - DNA, 25 bp, Mus musculus
tttctggatactgctgctcacttcc

SEQ ID NO: 17251 - DNA, 25 bp, Mus musculus
gatactgctgctcacttcctgttgg

SEQ ID NO: 17252 - DNA, 25 bp, Mus musculus
gtgttcttcagccatgcactttgtc

SEQ ID NO: 17253 - DNA, 25 bp, Mus musculus
ttcagccatgcactttgtcattttg

SEQ ID NO: 17254 - DNA, 25 bp, Mus musculus
catgcactttgtcattttgacccat

SEQ ID NO: 17255 - DNA, 25 bp, Mus musculus
gcatcagctggacataactgaaaat

SEQ ID NO: 17256 - DNA, 25 bp, Mus musculus
tcaaatgaccttcaccatcaatata

SEQ ID NO: 17257 - DNA, 25 bp, Mus musculus
gaccttcaccatcaatatacctgac

SEQ ID NO: 17258 - DNA, 25 bp, Mus musculus
caccatcaatatacctgacatagat

SEQ ID NO: 17259 - DNA, 25 bp, Mus musculus
tttgctggacctctgcgacctttct

SEQ ID NO: 17260 - DNA, 25 bp, Mus musculus
aatatacctgacatagattccgccg

SEQ ID NO: 17261 - DNA, 25 bp, Mus musculus
ggacctctgcgacctttcttcaatg

SEQ ID NO: 17262 - DNA, 25 bp, Mus musculus
gcgcctctaaagctctgtccactaa

SEQ ID NO: 17263 - DNA, 25 bp, Mus musculus
ctctgtccactaaagatgtgatggt

SEQ ID NO: 17264 - DNA, 25 bp, Mus musculus
tcaggagccagtgcctactgacggt

SEQ ID NO: 17265 - DNA, 25 bp, Mus musculus
gccagtgcctactgacggtacttcc

SEQ ID NO: 17266 - DNA, 25 bp, Mus musculus
ctcctcctgtcctgatcaagatcca

SEQ ID NO: 17267 - DNA, 25 bp, Mus musculus
agatccagtgactcctggggaccat

SEQ ID NO: 17268 - DNA, 25 bp, Mus musculus
cccctgaagtcagcactgtggacgc

SEQ ID NO: 17269 - DNA, 25 bp, Mus musculus
ccctgaagtcagcactgtggacgcc

SEQ ID NO: 17270 - DNA, 25 bp, Mus musculus
agtgaagcctgccagtgatcctggg

SEQ ID NO: 17271 - DNA, 25 bp, Mus musculus
ggtgtctgtcacacggccatgacaa

SEQ ID NO: 17272 - DNA, 25 bp, Mus musculus
gtctgtcacacggccatgacaacaa

SEQ ID NO: 17273 - DNA, 25 bp, Mus musculus
tctgtcacacggccatgacaacaat

SEQ ID NO: 17274 - DNA, 25 bp, Mus musculus
gtcacacggccatgacaacaatgct

SEQ ID NO: 17275 - DNA, 25 bp, Mus musculus
cacacggccatgacaacaatgctga

SEQ ID NO: 17276 - DNA, 25 bp, Mus musculus
acacggccatgacaacaatgctgag

SEQ ID NO: 17277 - DNA, 25 bp, Mus musculus
acggccatgacaacaatgctgagac

SEQ ID NO: 17278 - DNA, 25 bp, Mus musculus
cggccatgacaacaatgctgagaca

SEQ ID NO: 17279 - DNA, 25 bp, Mus musculus
gccatgacaacaatgctgagacaag

SEQ ID NO: 17280 - DNA, 25 bp, Mus musculus
tgaagtcagcactgtggacgccatg

SEQ ID NO: 17281 - DNA, 25 bp, Mus musculus
aagtcagcactgtggacgccatgtt

SEQ ID NO: 17282 - DNA, 25 bp, Mus musculus
agtcagcactgtggacgccatgttg

SEQ ID NO: 17283 - DNA, 25 bp, Mus musculus
tcagcactgtggacgccatgttgga

SEQ ID NO: 17284 - DNA, 25 bp, Mus musculus
cagcactgtggacgccatgttggat

SEQ ID NO: 17285 - DNA, 25 bp, Mus musculus
cactgtggacgccatgttggatctg

SEQ ID NO: 17286 - DNA, 25 bp, Mus musculus
ctgtggacgccatgttggatctgat

SEQ ID NO: 17287 - DNA, 25 bp, Mus musculus
aagtgaagcctgccagtgatcctgg

SEQ ID NO: 17288 - DNA, 25 bp, Mus musculus
acgccatgaacaacattgtggcgaa

SEQ ID NO: 17289 - DNA, 25 bp, Mus musculus
acaacattgtggcgaatctgctcct

SEQ ID NO: 17290 - DNA, 25 bp, Mus musculus
tcccacagcttcattatctcgtgtc

SEQ ID NO: 17291 - DNA, 25 bp, Mus musculus
agcttcattatctcgtgtcaagcct

SEQ ID NO: 17292 - DNA, 25 bp, Mus musculus
attatctcgtgtcaagcctgacacc

SEQ ID NO: 17293 - DNA, 25 bp, Mus musculus
tcgtgtcaagcctgacaccgctgta

SEQ ID NO: 17294 - DNA, 25 bp, Mus musculus
tgtcaagcctgacaccgctgtacac

SEQ ID NO: 17295 - DNA, 25 bp, Mus musculus
caagcctgacaccgctgtacacgct

SEQ ID NO: 17296 - DNA, 25 bp, Mus musculus
tgacaccgctgtacacgctggcgga

SEQ ID NO: 17297 - DNA, 25 bp, Mus musculus
caccgctgtacacgctggcggatgt

SEQ ID NO: 17298 - DNA, 25 bp, Mus musculus
cgctgtacacgctggcggatgttaa

SEQ ID NO: 17299 - DNA, 25 bp, Mus musculus
acacgctggcggatgttaacattcc

SEQ ID NO: 17300 - DNA, 25 bp, Mus musculus
cgaatctgctcctcagcctgacaag

SEQ ID NO: 17301 - DNA, 25 bp, Mus musculus
tgctcctcagcctgacaagctctgc

SEQ ID NO: 17302 - DNA, 25 bp, Mus musculus
tcagcctgacaagctctgcgaggtt

SEQ ID NO: 17303 - DNA, 25 bp, Mus musculus
gcctgacaagctctgcgaggttcga

SEQ ID NO: 17304 - DNA, 25 bp, Mus musculus
tgacaagctctgcgaggttcgaggg

SEQ ID NO: 17305 - DNA, 25 bp, Mus musculus
tcgagggctccctgaatatggacct

SEQ ID NO: 17306 - DNA, 25 bp, Mus musculus
agggctccctgaatatggacctgaa

SEQ ID NO: 17307 - DNA, 25 bp, Mus musculus
gctccctgaatatggacctgaatga

SEQ ID NO: 17308 - DNA, 25 bp, Mus musculus
gcataagcctcaaggacagggaaag

SEQ ID NO: 17309 - DNA, 25 bp, Mus musculus
tgttcagtgtcccctcaagcaaact

SEQ ID NO: 17310 - DNA, 25 bp, Mus musculus
acagctatcttcggtcatccttgag

SEQ ID NO: 17311 - DNA, 25 bp, Mus musculus
ggtcatccttgaggtcaacagcatc

SEQ ID NO: 17312 - DNA, 25 bp, Mus musculus
cagcatcatattgctccagggacag

SEQ ID NO: 17313 - DNA, 25 bp, Mus musculus
catattgctccagggacagtcgggg

SEQ ID NO: 17314 - DNA, 25 bp, Mus musculus
ttatgccttatgctgcaaataagaa

SEQ ID NO: 17315 - DNA, 25 bp, Mus musculus
tctaagatcttccatcagtgtttat

SEQ ID NO: 17316 - DNA, 25 bp, Mus musculus
atcttccatcagtgtttatctataa

SEQ ID NO: 17317 - DNA, 25 bp, Mus musculus
ggatgtccaatagcaccctactagg

SEQ ID NO: 17318 - DNA, 25 bp, Mus musculus
ccaatagcaccctactaggaggaag

SEQ ID NO: 17319 - DNA, 25 bp, Mus musculus
gcaccctactaggaggaagaggata

SEQ ID NO: 17320 - DNA, 25 bp, Mus musculus
gtgtcccctcaagcaaactcttggg

SEQ ID NO: 17321 - DNA, 25 bp, Mus musculus
tcccccaaggtctggaggacagcaa

SEQ ID NO: 17322 - DNA, 25 bp, Mus musculus
gcaaatctctcttgccagaccatac

SEQ ID NO: 17323 - DNA, 25 bp, Mus musculus
tgccagaccatacctctgataatcc

SEQ ID NO: 17324 - DNA, 25 bp, Mus musculus
accatacctctgataatcctttcct

SEQ ID NO: 17325 - DNA, 25 bp, Mus musculus
accaacgcttagttattgggagatg

SEQ ID NO: 17326 - DNA, 25 bp, Mus musculus
aacactcattgccatcacaggcagt

SEQ ID NO: 17327 - DNA, 25 bp, Mus musculus
cattgccatcacaggcagtaaatga

SEQ ID NO: 17328 - DNA, 25 bp, Mus musculus
ttcggtactcctgggtgtagcacat

SEQ ID NO: 17329 - DNA, 25 bp, Mus musculus
agcacatttggagcctggggtcagc

SEQ ID NO: 17330 - DNA, 25 bp, Mus musculus
agcaggctttctacctgcttaccct

SEQ ID NO: 17331 - DNA, 25 bp, Mus musculus
ctttctacctgcttaccctctgtgg

SEQ ID NO: 17332 - DNA, 25 bp, Mus musculus
cagtgaccattacccagtggaggtg

SEQ ID NO: 17333 - DNA, 25 bp, Mus musculus
ccattacccagtggaggtgacactc

SEQ ID NO: 17334 - DNA, 25 bp, Mus musculus
aatctgatgtcattgagcagttcag

SEQ ID NO: 17335 - DNA, 25 bp, Mus musculus
gccatactgcttctggtgaggaaga

SEQ ID NO: 17336 - DNA, 25 bp, Mus musculus
cttcaactctatttggtactacagc

SEQ ID NO: 17337 - DNA, 25 bp, Mus musculus
ttggtactacagcattccaccatct

SEQ ID NO: 17338 - DNA, 25 bp, Mus musculus
ctacagcattccaccatctcagaac

SEQ ID NO: 17339 - DNA, 25 bp, Mus musculus
accatctcagaacagagaaaacgtc

SEQ ID NO: 17340 - DNA, 25 bp, Mus musculus
tttggagcctggggtcagcaaactc

SEQ ID NO: 17341 - DNA, 25 bp, Mus musculus
cttcttctttgatatcctacaggat

SEQ ID NO: 17342 - DNA, 25 bp, Mus musculus
ctttgatatcctacaggattgtggt

SEQ ID NO: 17343 - DNA, 25 bp, Mus musculus
tatcctacaggattgtggttgtccg

SEQ ID NO: 17344 - DNA, 25 bp, Mus musculus
ttgtccgagctctgctccaggctgc

SEQ ID NO: 17345 - DNA, 25 bp, Mus musculus
ctgttccttttgatttccaagcaga

SEQ ID NO: 17346 - DNA, 25 bp, Mus musculus
tagcctggagccaagcaggagctac

SEQ ID NO: 17347 - DNA, 25 bp, Mus musculus
gagctactgtttccatactagatgt

SEQ ID NO: 17348 - DNA, 25 bp, Mus musculus
tgcagctgcaacagatccaggggct

SEQ ID NO: 17349 - DNA, 25 bp, Mus musculus
aacagatccaggggctcatcagcag

SEQ ID NO: 17350 - DNA, 25 bp, Mus musculus
tgtgatgcccagtcccattggcccc

SEQ ID NO: 17351 - DNA, 25 bp, Mus musculus
cccaggacccatggctctgacaagc

SEQ ID NO: 17352 - DNA, 25 bp, Mus musculus
aggacccatggctctgacaagccct

SEQ ID NO: 17353 - DNA, 25 bp, Mus musculus
catggctctgacaagccctgagggt

SEQ ID NO: 17354 - DNA, 25 bp, Mus musculus
catctcttctgattggaatctttct

SEQ ID NO: 17355 - DNA, 25 bp, Mus musculus
ctaccccattctctctattctttgg

SEQ ID NO: 17356 - DNA, 25 bp, Mus musculus
ctctattctttggccttctcagtgt

SEQ ID NO: 17357 - DNA, 25 bp, Mus musculus
ttggccttctcagtgtctctacaac

SEQ ID NO: 17358 - DNA, 25 bp, Mus musculus
gccttctcagtgtctctacaacaaa

SEQ ID NO: 17359 - DNA, 25 bp, Mus musculus
gtgtctctacaacaaagaatagatg

SEQ ID NO: 17360 - DNA, 25 bp, Mus musculus
agatccaggggctcatcagcagcat

SEQ ID NO: 17361 - DNA, 25 bp, Mus musculus
ggctcatcagcagcatcgaggctca

SEQ ID NO: 17362 - DNA, 25 bp, Mus musculus
tcatcagcagcatcgaggctcagct

SEQ ID NO: 17363 - DNA, 25 bp, Mus musculus
agctgagcgagctccgaagtgagat

SEQ ID NO: 17364 - DNA, 25 bp, Mus musculus
tgagcgagctccgaagtgagatgga

SEQ ID NO: 17365 - DNA, 25 bp, Mus musculus
ctaagatgaccggcttcaactccgg

SEQ ID NO: 17366 - DNA, 25 bp, Mus musculus
agatgaccggcttcaactccggagg

SEQ ID NO: 17367 - DNA, 25 bp, Mus musculus
cttcagcagccacaggaggagagct

SEQ ID NO: 17368 - DNA, 25 bp, Mus musculus
tctactccatgggtgacctgctctt

SEQ ID NO: 17369 - DNA, 25 bp, Mus musculus
actccatgggtgacctgctcttcag

SEQ ID NO: 17370 - DNA, 25 bp, Mus musculus
cttacaagtgccaaaagacactgga

SEQ ID NO: 17371 - DNA, 25 bp, Mus musculus
acaagtgccaaaagacactggaagg

SEQ ID NO: 17372 - DNA, 25 bp, Mus musculus
cgctctgtatccaggggtgcaaact

SEQ ID NO: 17373 - DNA, 25 bp, Mus musculus
tctgtatccaggggtgcaaactgta

SEQ ID NO: 17374 - DNA, 25 bp, Mus musculus
ggtctgcagactgcaccatcattgt

SEQ ID NO: 17375 - DNA, 25 bp, Mus musculus
cagactgcaccatcattgtatggga

SEQ ID NO: 17376 - DNA, 25 bp, Mus musculus
gcaccatcattgtatgggacatcca

SEQ ID NO: 17377 - DNA, 25 bp, Mus musculus
tatgggacatccagaacctgcagaa

SEQ ID NO: 17378 - DNA, 25 bp, Mus musculus
gggacatccagaacctgcagaaggt

SEQ ID NO: 17379 - DNA, 25 bp, Mus musculus
acatccagaacctgcagaaggtgaa

SEQ ID NO: 17380 - DNA, 25 bp, Mus musculus
acctgctcttcagtggctcttctga

SEQ ID NO: 17381 - DNA, 25 bp, Mus musculus
tgctcttcagtggctcttctgacaa

SEQ ID NO: 17382 - DNA, 25 bp, Mus musculus
tcagtggctcttctgacaagacgat

SEQ ID NO: 17383 - DNA, 25 bp, Mus musculus
gtggctcttctgacaagacgatcaa

SEQ ID NO: 17384 - DNA, 25 bp, Mus musculus
gctcttctgacaagacgatcaaggt

SEQ ID NO: 17385 - DNA, 25 bp, Mus musculus
cttctgacaagacgatcaaggtgtg

SEQ ID NO: 17386 - DNA, 25 bp, Mus musculus
acacgtgtaccacttacaagtgcca

SEQ ID NO: 17387 - DNA, 25 bp, Mus musculus
ccacttacaagtgccaaaagacact

SEQ ID NO: 17388 - DNA, 25 bp, Mus musculus
ccatgctgatccaggaggctctggt

SEQ ID NO: 17389 - DNA, 25 bp, Mus musculus
tgatccaggaggctctggttcgagg

SEQ ID NO: 17390 - DNA, 25 bp, Mus musculus
ttagaaataccatgaccaaaagcca

SEQ ID NO: 17391 - DNA, 25 bp, Mus musculus
ggttagcccagcttagcagcctccc

SEQ ID NO: 17392 - DNA, 25 bp, Mus musculus
cctggcccctcagtagccagctgta

SEQ ID NO: 17393 - DNA, 25 bp, Mus musculus
ccctcagtagccagctgtatggact

SEQ ID NO: 17394 - DNA, 25 bp, Mus musculus
gtagccagctgtatggactgagtag

SEQ ID NO: 17395 - DNA, 25 bp, Mus musculus
ccattcacaaaggcctgatcggtgc

SEQ ID NO: 17396 - DNA, 25 bp, Mus musculus
tctgtctgtcataaagccactctat

SEQ ID NO: 17397 - DNA, 25 bp, Mus musculus
aaagccactctatcttgctggacat

SEQ ID NO: 17398 - DNA, 25 bp, Mus musculus
actctatcttgctggacattaaagt

SEQ ID NO: 17399 - DNA, 25 bp, Mus musculus
ttaaagtctccaggcctgactttgg

SEQ ID NO: 17400 - DNA, 25 bp, Mus musculus
tagactccttagcagcagatgctaa

SEQ ID NO: 17401 - DNA, 25 bp, Mus musculus
acttcgtcatggcaacaggccaggc

SEQ ID NO: 17402 - DNA, 25 bp, Mus musculus
tcatggcaacaggccaggccctggc

SEQ ID NO: 17403 - DNA, 25 bp, Mus musculus
caacaggccaggccctggcagatgc

SEQ ID NO: 17404 - DNA, 25 bp, Mus musculus
cagatgcctgccagatggaaccaga

SEQ ID NO: 17405 - DNA, 25 bp, Mus musculus
cctgccagatggaaccagaggaagt

SEQ ID NO: 17406 - DNA, 25 bp, Mus musculus
cgacccttattactcccagatgtga

SEQ ID NO: 17407 - DNA, 25 bp, Mus musculus
ttattactcccagatgtgaggccta

SEQ ID NO: 17408 - DNA, 25 bp, Mus musculus
cccacgcagccgaggaagtgtgact

SEQ ID NO: 17409 - DNA, 25 bp, Mus musculus
ccacgcagccgaggaagtgtgactt

SEQ ID NO: 17410 - DNA, 25 bp, Mus musculus
actacgatgcctctgatgtcgtcct

SEQ ID NO: 17411 - DNA, 25 bp, Mus musculus
ctacgatgcctctgatgtcgtcctg

SEQ ID NO: 17412 - DNA, 25 bp, Mus musculus
tacgatgcctctgatgtcgtcctgg

SEQ ID NO: 17413 - DNA, 25 bp, Mus musculus
acgatgcctctgatgtcgtcctgga

SEQ ID NO: 17414 - DNA, 25 bp, Mus musculus
ctctgatgtcgtcctggagcttgaa

SEQ ID NO: 17415 - DNA, 25 bp, Mus musculus
tattccaggtgcttttggctgtggg

SEQ ID NO: 17416 - DNA, 25 bp, Mus musculus
attccaggtgcttttggctgtggga

SEQ ID NO: 17417 - DNA, 25 bp, Mus musculus
tccaggtgcttttggctgtgggaag

SEQ ID NO: 17418 - DNA, 25 bp, Mus musculus
cgcaccgcctgggaactacgatgcc

SEQ ID NO: 17419 - DNA, 25 bp, Mus musculus
gcaccgcctgggaactacgatgcct

SEQ ID NO: 17420 - DNA, 25 bp, Mus musculus
caccgcctgggaactacgatgcctc

SEQ ID NO: 17421 - DNA, 25 bp, Mus musculus
tgggaactacgatgcctctgatgtc

SEQ ID NO: 17422 - DNA, 25 bp, Mus musculus
gggaactacgatgcctctgatgtcg

SEQ ID NO: 17423 - DNA, 25 bp, Mus musculus
ggaactacgatgcctctgatgtcgt

SEQ ID NO: 17424 - DNA, 25 bp, Mus musculus
gaactacgatgcctctgatgtcgtc

SEQ ID NO: 17425 - DNA, 25 bp, Mus musculus
aactacgatgcctctgatgtcgtcc

SEQ ID NO: 17426 - DNA, 25 bp, Mus musculus
tgtacgtactttttcaagattgatc

SEQ ID NO: 17427 - DNA, 25 bp, Mus musculus
tttcctgaaaattctcaattcacca

SEQ ID NO: 17428 - DNA, 25 bp, Mus musculus
gtgtaaacaccaatggtctgtcagt

SEQ ID NO: 17429 - DNA, 25 bp, Mus musculus
taaacaccaatggtctgtcagtgtc

SEQ ID NO: 17430 - DNA, 25 bp, Mus musculus
acaccaatggtctgtcagtgtctaa

SEQ ID NO: 17431 - DNA, 25 bp, Mus musculus
ccaatggtctgtcagtgtctaagac

SEQ ID NO: 17432 - DNA, 25 bp, Mus musculus
ctctggatactgcaagctccgtccg

SEQ ID NO: 17433 - DNA, 25 bp, Mus musculus
tggatactgcaagctccgtccggtg

SEQ ID NO: 17434 - DNA, 25 bp, Mus musculus
atactgcaagctccgtccggtgcat

SEQ ID NO: 17435 - DNA, 25 bp, Mus musculus
caagctccgtccggtgcatttgttc

SEQ ID NO: 17436 - DNA, 25 bp, Mus musculus
gctccgtccggtgcatttgttcagg

SEQ ID NO: 17437 - DNA, 25 bp, Mus musculus
tccggtgcatttgttcaggtaaaat

SEQ ID NO: 17438 - DNA, 25 bp, Mus musculus
cctgaaaattctcaattcaccaata

SEQ ID NO: 17439 - DNA, 25 bp, Mus musculus
aattctcaattcaccaatatgaagg

SEQ ID NO: 17440 - DNA, 25 bp, Mus musculus
atgaaccaagcagacgttaatatgc

SEQ ID NO: 17441 - DNA, 25 bp, Mus musculus
taactgactgcccacggtttccagg

SEQ ID NO: 17442 - DNA, 25 bp, Mus musculus
tttttaatcctatggttgcatatgc

SEQ ID NO: 17443 - DNA, 25 bp, Mus musculus
ttctccccttctatttctgtctcca

SEQ ID NO: 17444 - DNA, 25 bp, Mus musculus
tccccttctatttctgtctccattc

SEQ ID NO: 17445 - DNA, 25 bp, Mus musculus
gtctccattctgttagagaccatga

SEQ ID NO: 17446 - DNA, 25 bp, Mus musculus
ttcagcctgatgggcagatgctagc

SEQ ID NO: 17447 - DNA, 25 bp, Mus musculus
gggatgactccttcacacttcttct

SEQ ID NO: 17448 - DNA, 25 bp, Mus musculus
tcacacttcttctgtgaactggagc

SEQ ID NO: 17449 - DNA, 25 bp, Mus musculus
acacttcttctgtgaactggagctg

SEQ ID NO: 17450 - DNA, 25 bp, Mus musculus
cacttcttctgtgaactggagctgg

SEQ ID NO: 17451 - DNA, 25 bp, Mus musculus
acttcttctgtgaactggagctgga

SEQ ID NO: 17452 - DNA, 25 bp, Mus musculus
ttcttctgtgaactggagctggaaa

SEQ ID NO: 17453 - DNA, 25 bp, Mus musculus
tcttctgtgaactggagctggaaac

SEQ ID NO: 17454 - DNA, 25 bp, Mus musculus
cttctgtgaactggagctggaaaca

SEQ ID NO: 17455 - DNA, 25 bp, Mus musculus
ctggaaacatgtgcctcgggagtct

SEQ ID NO: 17456 - DNA, 25 bp, Mus musculus
ggaaacatgtgcctcgggagtcttt

SEQ ID NO: 17457 - DNA, 25 bp, Mus musculus
gaaacatgtgcctcgggagtctttg

SEQ ID NO: 17458 - DNA, 25 bp, Mus musculus
gatgactccttcacacttcttctgt

SEQ ID NO: 17459 - DNA, 25 bp, Mus musculus
atgactccttcacacttcttctgtg

SEQ ID NO: 17460 - DNA, 25 bp, Mus musculus
tgactccttcacacttcttctgtga

SEQ ID NO: 17461 - DNA, 25 bp, Mus musculus
actccttcacacttcttctgtgaac

SEQ ID NO: 17462 - DNA, 25 bp, Mus musculus
ctccttcacacttcttctgtgaact

SEQ ID NO: 17463 - DNA, 25 bp, Mus musculus
tccttcacacttcttctgtgaactg

SEQ ID NO: 17464 - DNA, 25 bp, Mus musculus
cttcacacttcttctgtgaactgga

SEQ ID NO: 17465 - DNA, 25 bp, Mus musculus
ttcacacttcttctgtgaactggag

SEQ ID NO: 17466 - DNA, 25 bp, Mus musculus
ctcgctatccctgtgtgtctgctgt

SEQ ID NO: 17467 - DNA, 25 bp, Mus musculus
tgtctgctgtccgctaagctaaagt

SEQ ID NO: 17468 - DNA, 25 bp, Mus musculus
ccaggtctgcgccgtctggtgctcc

SEQ ID NO: 17469 - DNA, 25 bp, Mus musculus
caggtctgcgccgtctggtgctcca

SEQ ID NO: 17470 - DNA, 25 bp, Mus musculus
gtctggtgctccaggcgcgtacgta

SEQ ID NO: 17471 - DNA, 25 bp, Mus musculus
gtgctccaggcgcgtacgtacgccc

SEQ ID NO: 17472 - DNA, 25 bp, Mus musculus
tgctccaggcgcgtacgtacgccca

SEQ ID NO: 17473 - DNA, 25 bp, Mus musculus
tccaggcgcgtacgtacgcccaggc

SEQ ID NO: 17474 - DNA, 25 bp, Mus musculus
gtgttctttgatggtgccaatgtcc

SEQ ID NO: 17475 - DNA, 25 bp, Mus musculus
ttctttgatggtgccaatgtccggc

SEQ ID NO: 17476 - DNA, 25 bp, Mus musculus
tttgatggtgccaatgtccggcaag

SEQ ID NO: 17477 - DNA, 25 bp, Mus musculus
ttgatggtgccaatgtccggcaagt

SEQ ID NO: 17478 - DNA, 25 bp, Mus musculus
gtctgctgtccgctaagctaaagtc

SEQ ID NO: 17479 - DNA, 25 bp, Mus musculus
atggtgccaatgtccggcaagtgga

SEQ ID NO: 17480 - DNA, 25 bp, Mus musculus
ctgctgtccgctaagctaaagtcca

SEQ ID NO: 17481 - DNA, 25 bp, Mus musculus
tgctgtccgctaagctaaagtccac

SEQ ID NO: 17482 - DNA, 25 bp, Mus musculus
ctgtccgctaagctaaagtccactg

SEQ ID NO: 17483 - DNA, 25 bp, Mus musculus
tgtccgctaagctaaagtccactga

SEQ ID NO: 17484 - DNA, 25 bp, Mus musculus
tccgctaagctaaagtccactgacg

SEQ ID NO: 17485 - DNA, 25 bp, Mus musculus
ccgcattgcttcgtcacccaggtct

SEQ ID NO: 17486 - DNA, 25 bp, Mus musculus
gcattgcttcgtcacccaggtctgc

SEQ ID NO: 17487 - DNA, 25 bp, Mus musculus
ctggcccgaggcacttaccacaaca

SEQ ID NO: 17488 - DNA, 25 bp, Mus musculus
cacaacaagtccttcttcacggatg

SEQ ID NO: 17489 - DNA, 25 bp, Mus musculus
atgttttatcttaccccatctctca

SEQ ID NO: 17490 - DNA, 25 bp, Mus musculus
agagtgttccctgcaaatgagactt

SEQ ID NO: 17491 - DNA, 25 bp, Mus musculus
caccttgagtcctgaaggtcaagaa

SEQ ID NO: 17492 - DNA, 25 bp, Mus musculus
aatgggcaagctccggctgacgcct

SEQ ID NO: 17493 - DNA, 25 bp, Mus musculus
caagctccggctgacgcctccttgg

SEQ ID NO: 17494 - DNA, 25 bp, Mus musculus
gccttctgttcagaagtttattctt

SEQ ID NO: 17495 - DNA, 25 bp, Mus musculus
tgccactgggttcttccggttcgat

SEQ ID NO: 17496 - DNA, 25 bp, Mus musculus
ccgttgtcttctctgccaaggggag

SEQ ID NO: 17497 - DNA, 25 bp, Mus musculus
tcttctctgccaaggggagctctcc

SEQ ID NO: 17498 - DNA, 25 bp, Mus musculus
actgagaacctcatttgctttcctt

SEQ ID NO: 17499 - DNA, 25 bp, Mus musculus
ttcttcacggatgacgacaaacagg

SEQ ID NO: 17500 - DNA, 25 bp, Mus musculus
caccagaagagttctcccgaccatg

SEQ ID NO: 17501 - DNA, 25 bp, Mus musculus
aagagttctcccgaccatgttgatc

SEQ ID NO: 17502 - DNA, 25 bp, Mus musculus
ctgttcctagctaggccctttctct

SEQ ID NO: 17503 - DNA, 25 bp, Mus musculus
ctagctaggccctttctctgtcaca

SEQ ID NO: 17504 - DNA, 25 bp, Mus musculus
aggccctttctctgtcacacacaca

SEQ ID NO: 17505 - DNA, 25 bp, Mus musculus
acacacacacatttcatcaccaata

SEQ ID NO: 17506 - DNA, 25 bp, Mus musculus
acacatttcatcaccaatatgtttt

SEQ ID NO: 17507 - DNA, 25 bp, Mus musculus
tcttgctgcctgtgagggtatctca

SEQ ID NO: 17508 - DNA, 25 bp, Mus musculus
agggtatctcagaaccctgaagccg

SEQ ID NO: 17509 - DNA, 25 bp, Mus musculus
ctgtgagaacgtcttcggggagctc

SEQ ID NO: 17510 - DNA, 25 bp, Mus musculus
gtgagaacgtcttcggggagctctc

SEQ ID NO: 17511 - DNA, 25 bp, Mus musculus
ctctctgggaacgctcgtggctctt

SEQ ID NO: 17512 - DNA, 25 bp, Mus musculus
ctgggaacgctcgtggctcttgtga

SEQ ID NO: 17513 - DNA, 25 bp, Mus musculus
gaacgctcgtggctcttgtgaggaa

SEQ ID NO: 17514 - DNA, 25 bp, Mus musculus
tcgtggctcttgtgaggaaagggct

SEQ ID NO: 17515 - DNA, 25 bp, Mus musculus
acggctgggctgcagctatggaccg

SEQ ID NO: 17516 - DNA, 25 bp, Mus musculus
cagctatggaccgagagctggccca

SEQ ID NO: 17517 - DNA, 25 bp, Mus musculus
gcatccctgctgagcctgcccaagt

SEQ ID NO: 17518 - DNA, 25 bp, Mus musculus
gctgagcctgcccaagtgtggctgc

SEQ ID NO: 17519 - DNA, 25 bp, Mus musculus
ggtatctcagaaccctgaagccgag

SEQ ID NO: 17520 - DNA, 25 bp, Mus musculus
tctcagaaccctgaagccgagagga

SEQ ID NO: 17521 - DNA, 25 bp, Mus musculus
agccaggccagatcccctggagaag

SEQ ID NO: 17522 - DNA, 25 bp, Mus musculus
ccaggccagatcccctggagaagtc

SEQ ID NO: 17523 - DNA, 25 bp, Mus musculus
aggccagatcccctggagaagtcat

SEQ ID NO: 17524 - DNA, 25 bp, Mus musculus
gccagatcccctggagaagtcatga

SEQ ID NO: 17525 - DNA, 25 bp, Mus musculus
gatcccctggagaagtcatgatttt

SEQ ID NO: 17526 - DNA, 25 bp, Mus musculus
atgcagagtcgtctgtgagaacgtc

SEQ ID NO: 17527 - DNA, 25 bp, Mus musculus
caaccttcttccttagctgctcgct

SEQ ID NO: 17528 - DNA, 25 bp, Mus musculus
tcttccagcaccatggccttcagtg

SEQ ID NO: 17529 - DNA, 25 bp, Mus musculus
ttcaaggctaccgtgaagatggagg

SEQ ID NO: 17530 - DNA, 25 bp, Mus musculus
gtggcagagttccccaactatcacc

SEQ ID NO: 17531 - DNA, 25 bp, Mus musculus
gcagagttccccaactatcaccaga

SEQ ID NO: 17532 - DNA, 25 bp, Mus musculus
gagttccccaactatcaccagactt

SEQ ID NO: 17533 - DNA, 25 bp, Mus musculus
aactatcaccagacttcggaggtcg

SEQ ID NO: 17534 - DNA, 25 bp, Mus musculus
tatcaccagacttcggaggtcgtgg

SEQ ID NO: 17535 - DNA, 25 bp, Mus musculus
cagacttcggaggtcgtgggtgaca

SEQ ID NO: 17536 - DNA, 25 bp, Mus musculus
gtggagatctccaccatcggggatg

SEQ ID NO: 17537 - DNA, 25 bp, Mus musculus
tccaccatcggggatgtgacctatg

SEQ ID NO: 17538 - DNA, 25 bp, Mus musculus
accatcggggatgtgacctatgagc

SEQ ID NO: 17539 - DNA, 25 bp, Mus musculus
accatggccttcagtggcaaatatg

SEQ ID NO: 17540 - DNA, 25 bp, Mus musculus
ttcatgaagcgcctgggtcttccag

SEQ ID NO: 17541 - DNA, 25 bp, Mus musculus
cgtaacttcaagatcatcacagagg

SEQ ID NO: 17542 - DNA, 25 bp, Mus musculus
aacttcaagatcatcacagaggtcc

SEQ ID NO: 17543 - DNA, 25 bp, Mus musculus
atcatcacagaggtccagcaggacg

SEQ ID NO: 17544 - DNA, 25 bp, Mus musculus
ttcacctggtcccagtcttactctg

SEQ ID NO: 17545 - DNA, 25 bp, Mus musculus
tcttactctgggggcaacattatga

SEQ ID NO: 17546 - DNA, 25 bp, Mus musculus
atgagcaacaagttcaccattggca

SEQ ID NO: 17547 - DNA, 25 bp, Mus musculus
ttcgccaaatcgcagcccaatatgt

SEQ ID NO: 17548 - DNA, 25 bp, Mus musculus
gccaaatcgcagcccaatatgtacg

SEQ ID NO: 17549 - DNA, 25 bp, Mus musculus
tacacagatctctcggctcaccact

SEQ ID NO: 17550 - DNA, 25 bp, Mus musculus
tcggctcaccactcgtctcagggac

SEQ ID NO: 17551 - DNA, 25 bp, Mus musculus
cccaaactgacacatctgtagctgt

SEQ ID NO: 17552 - DNA, 25 bp, Mus musculus
aaactgacacatctgtagctgttgc

SEQ ID NO: 17553 - DNA, 25 bp, Mus musculus
acacatctgtagctgttgccgccgg

SEQ ID NO: 17554 - DNA, 25 bp, Mus musculus
gccaggcgcaattacctctctggtt

SEQ ID NO: 17555 - DNA, 25 bp, Mus musculus
aggcgcaattacctctctggttttg

SEQ ID NO: 17556 - DNA, 25 bp, Mus musculus
cgcaattacctctctggttttggtg

SEQ ID NO: 17557 - DNA, 25 bp, Mus musculus
tacctctctggttttggtggcagag

SEQ ID NO: 17558 - DNA, 25 bp, Mus musculus
ctctctggttttggtggcagaggtg

SEQ ID NO: 17559 - DNA, 25 bp, Mus musculus
aaatcgcagcccaatatgtacggcc

SEQ ID NO: 17560 - DNA, 25 bp, Mus musculus
aatatgtacggcctggccgcctaca

SEQ ID NO: 17561 - DNA, 25 bp, Mus musculus
tgcctgcctcagcagaagcggtacc

SEQ ID NO: 17562 - DNA, 25 bp, Mus musculus
ctgcctcagcagaagcggtacccgg

SEQ ID NO: 17563 - DNA, 25 bp, Mus musculus
ggcaacttcgtcgactccatggcgc

SEQ ID NO: 17564 - DNA, 25 bp, Mus musculus
ccggtcttcaatctgggccacctct

SEQ ID NO: 17565 - DNA, 25 bp, Mus musculus
tcgcacccgtcttcggccagcgtgg

SEQ ID NO: 17566 - DNA, 25 bp, Mus musculus
gactacagttgcgccgcgcaaatcc

SEQ ID NO: 17567 - DNA, 25 bp, Mus musculus
agcagtctgttactgcctctgcgaa

SEQ ID NO: 17568 - DNA, 25 bp, Mus musculus
ctgttactgcctctgcgaaagctgg

SEQ ID NO: 17569 - DNA, 25 bp, Mus musculus
aggtagcctcaaggctgaaatgtgc

SEQ ID NO: 17570 - DNA, 25 bp, Mus musculus
cctcctgcaagaacattctggcctg

SEQ ID NO: 17571 - DNA, 25 bp, Mus musculus
gcaagaacattctggcctgtcgcag

SEQ ID NO: 17572 - DNA, 25 bp, Mus musculus
aactctgtatggagtgccagcacct

SEQ ID NO: 17573 - DNA, 25 bp, Mus musculus
agtgccagcacctaagccaacgagt

SEQ ID NO: 17574 - DNA, 25 bp, Mus musculus
aagagccccctaaacagcgctgccg

SEQ ID NO: 17575 - DNA, 25 bp, Mus musculus
ctgcttgtgatcactttggcaatgc

SEQ ID NO: 17576 - DNA, 25 bp, Mus musculus
gtgatcactttggcaatgccaagtg

SEQ ID NO: 17577 - DNA, 25 bp, Mus musculus
actttggcaatgccaagtgtaatgg

SEQ ID NO: 17578 - DNA, 25 bp, Mus musculus
agtgctaccagttcaagcagatgta

SEQ ID NO: 17579 - DNA, 25 bp, Mus musculus
ctgcctctgcgaaagctggttcccc

SEQ ID NO: 17580 - DNA, 25 bp, Mus musculus
gtttcatcgaagctcagaaccagag

SEQ ID NO: 17581 - DNA, 25 bp, Mus musculus
tcgaagctcagaaccagagattcca

SEQ ID NO: 17582 - DNA, 25 bp, Mus musculus
ctcagaaccagagattccatgaagc

SEQ ID NO: 17583 - DNA, 25 bp, Mus musculus
gatcaagccagcatagagacatgcc

SEQ ID NO: 17584 - DNA, 25 bp, Mus musculus
atagagacatgcctcgaactacaca

SEQ ID NO: 17585 - DNA, 25 bp, Mus musculus
ctcgaactacacaggtagcctcaag

SEQ ID NO: 17586 - DNA, 25 bp, Mus musculus
ctacacaggtagcctcaaggctgaa

SEQ ID NO: 17587 - DNA, 25 bp, Mus musculus
ctcagcattgggacactgtcaagat

SEQ ID NO: 17588 - DNA, 25 bp, Mus musculus
cataccagcaaaacctgcagctgtg

SEQ ID NO: 17589 - DNA, 25 bp, Mus musculus
gaaagctctgttttccagacaatac

SEQ ID NO: 17590 - DNA, 25 bp, Mus musculus
tctgttttccagacaatactcttgt

SEQ ID NO: 17591 - DNA, 25 bp, Mus musculus
acaatactcttgtgtggaaaacgtg

SEQ ID NO: 17592 - DNA, 25 bp, Mus musculus
cttctaagtctggctcttgtgatca

SEQ ID NO: 17593 - DNA, 25 bp, Mus musculus
accaaaccctggtgcatcagtacaa

SEQ ID NO: 17594 - DNA, 25 bp, Mus musculus
ccctggtgcatcagtacaacacttt

SEQ ID NO: 17595 - DNA, 25 bp, Mus musculus
agtacaacactttgcgctaatctag

SEQ ID NO: 17596 - DNA, 25 bp, Mus musculus
acactttgcgctaatctagagctat

SEQ ID NO: 17597 - DNA, 25 bp, Mus musculus
tgcacaaccaaattgctgagatgtt

SEQ ID NO: 17598 - DNA, 25 bp, Mus musculus
gtctcctctgttggtttgtgaagtg

SEQ ID NO: 17599 - DNA, 25 bp, Mus musculus
agcaaaacctgcagctgtgtcacct

SEQ ID NO: 17600 - DNA, 25 bp, Mus musculus
acctgcagctgtgtcaccttcttct

SEQ ID NO: 17601 - DNA, 25 bp, Mus musculus
agctgtgtcaccttcttctgtcaac

SEQ ID NO: 17602 - DNA, 25 bp, Mus musculus
ttcttctgtcaacatacagactgat

SEQ ID NO: 17603 - DNA, 25 bp, Mus musculus
catacagactgatcataatgatccc

SEQ ID NO: 17604 - DNA, 25 bp, Mus musculus
tgatcccttctttacacacacacac

SEQ ID NO: 17605 - DNA, 25 bp, Mus musculus
cacacacacaaatggaatttaacca

SEQ ID NO: 17606 - DNA, 25 bp, Mus musculus
aacttcccagaattgatgaagcaaa

SEQ ID NO: 17607 - DNA, 25 bp, Mus musculus
tcgcctccacttgcaacacaattct

SEQ ID NO: 17608 - DNA, 25 bp, Mus musculus
caattctggagtcactgtcccggga

SEQ ID NO: 17609 - DNA, 25 bp, Mus musculus
gagttccaatctgaatctggacctg

SEQ ID NO: 17610 - DNA, 25 bp, Mus musculus
caatctgaatctggacctgcttgga

SEQ ID NO: 17611 - DNA, 25 bp, Mus musculus
gaatctggacctgcttggaactgcc

SEQ ID NO: 17612 - DNA, 25 bp, Mus musculus
cctcagagcaactgggtcatactag

SEQ ID NO: 17613 - DNA, 25 bp, Mus musculus
tgggtcatactagtgcccttcctca

SEQ ID NO: 17614 - DNA, 25 bp, Mus musculus
atactagtgcccttcctcaggactt

SEQ ID NO: 17615 - DNA, 25 bp, Mus musculus
ctgcgctgaggcgcgtcttagcact

SEQ ID NO: 17616 - DNA, 25 bp, Mus musculus
ccagcccatttggtggctaatgcct

SEQ ID NO: 17617 - DNA, 25 bp, Mus musculus
aatgcctgtccctgtttgtaaatat

SEQ ID NO: 17618 - DNA, 25 bp, Mus musculus
tgtccctgtttgtaaatatcctgta

SEQ ID NO: 17619 - DNA, 25 bp, Mus musculus
ctgagccagaacccgggagcctgtc

SEQ ID NO: 17620 - DNA, 25 bp, Mus musculus
cagaaaaggtctctcacctagagtc

SEQ ID NO: 17621 - DNA, 25 bp, Mus musculus
tagagtccatgctctggaagctcca

SEQ ID NO: 17622 - DNA, 25 bp, Mus musculus
acaacaaccagaggctgctggcaga

SEQ ID NO: 17623 - DNA, 25 bp, Mus musculus
ctaagcatctgggtgcacccactac

SEQ ID NO: 17624 - DNA, 25 bp, Mus musculus
atctgggtgcacccactactgacct

SEQ ID NO: 17625 - DNA, 25 bp, Mus musculus
gtgcacccactactgacctggcctg

SEQ ID NO: 17626 - DNA, 25 bp, Mus musculus
ccactactgacctggcctgagttcc

SEQ ID NO: 17627 - DNA, 25 bp, Mus musculus
agactttcatcatcatcatctgcta

SEQ ID NO: 17628 - DNA, 25 bp, Mus musculus
actttcatcatcatcatctgctaca

SEQ ID NO: 17629 - DNA, 25 bp, Mus musculus
gatatatgcttcttgggtattacca

SEQ ID NO: 17630 - DNA, 25 bp, Mus musculus
tatatgcttcttgggtattaccaga

SEQ ID NO: 17631 - DNA, 25 bp, Mus musculus
tatgcttcttgggtattaccagaaa

SEQ ID NO: 17632 - DNA, 25 bp, Mus musculus
tgcttcttgggtattaccagaaagt

SEQ ID NO: 17633 - DNA, 25 bp, Mus musculus
ggcatgacacgggtcgtcctcgaaa

SEQ ID NO: 17634 - DNA, 25 bp, Mus musculus
catgacacgggtcgtcctcgaaatt

SEQ ID NO: 17635 - DNA, 25 bp, Mus musculus
tgacacgggtcgtcctcgaaattga

SEQ ID NO: 17636 - DNA, 25 bp, Mus musculus
gggtcgtcctcgaaattgatcttgg

SEQ ID NO: 17637 - DNA, 25 bp, Mus musculus
gtcgtcctcgaaattgatcttggcg

SEQ ID NO: 17638 - DNA, 25 bp, Mus musculus
cgtcctcgaaattgatcttggcggg

SEQ ID NO: 17639 - DNA, 25 bp, Mus musculus
tttcatcatcatcatctgctacaga

SEQ ID NO: 17640 - DNA, 25 bp, Mus musculus
tcatcatcatcatctgctacagaaa

SEQ ID NO: 17641 - DNA, 25 bp, Mus musculus
atcatcatcatctgctacagaaatc

SEQ ID NO: 17642 - DNA, 25 bp, Mus musculus
catcatcatctgctacagaaatctg

SEQ ID NO: 17643 - DNA, 25 bp, Mus musculus
tcatcatctgctacagaaatctggg

SEQ ID NO: 17644 - DNA, 25 bp, Mus musculus
atcatctgctacagaaatctgggat

SEQ ID NO: 17645 - DNA, 25 bp, Mus musculus
catctgctacagaaatctgggatat

SEQ ID NO: 17646 - DNA, 25 bp, Mus musculus
tctgctacagaaatctgggatatat

SEQ ID NO: 17647 - DNA, 25 bp, Mus musculus
taatgttactgtaactctgtaacta

SEQ ID NO: 17648 - DNA, 25 bp, Mus musculus
tactgtaactctgtaactacaaata

SEQ ID NO: 17649 - DNA, 25 bp, Mus musculus
cctgtcatgttcactggtccatgta

SEQ ID NO: 17650 - DNA, 25 bp, Mus musculus
actggtccatgtatgcagtatctta

SEQ ID NO: 17651 - DNA, 25 bp, Mus musculus
atagttatgcaggctccttaagaaa

SEQ ID NO: 17652 - DNA, 25 bp, Mus musculus
tttttacgtgtgcttgtgtcgtcaa

SEQ ID NO: 17653 - DNA, 25 bp, Mus musculus
gtgcttgtgtcgtcaaaatgccaga

SEQ ID NO: 17654 - DNA, 25 bp, Mus musculus
tagcaagttctggcttctggcaaaa

SEQ ID NO: 17655 - DNA, 25 bp, Mus musculus
caagttctggcttctggcaaaatac

SEQ ID NO: 17656 - DNA, 25 bp, Mus musculus
gttctggcttctggcaaaatacaaa

SEQ ID NO: 17657 - DNA, 25 bp, Mus musculus
gcctttcattggttggtatggagag

SEQ ID NO: 17658 - DNA, 25 bp, Mus musculus
agttgcacacatttcaaaggaattc

SEQ ID NO: 17659 - DNA, 25 bp, Mus musculus
tgtaactctgtaactacaaatactt

SEQ ID NO: 17660 - DNA, 25 bp, Mus musculus
gttgcacacatttcaaaggaattcc

SEQ ID NO: 17661 - DNA, 25 bp, Mus musculus
actacaaatacttccagtaatccag

SEQ ID NO: 17662 - DNA, 25 bp, Mus musculus
acttccagtaatccagatgaaaaca

SEQ ID NO: 17663 - DNA, 25 bp, Mus musculus
ataatgtgcacgctgacccctgtca

SEQ ID NO: 17664 - DNA, 25 bp, Mus musculus
atgtgcacgctgacccctgtcatgt

SEQ ID NO: 17665 - DNA, 25 bp, Mus musculus
tgcacgctgacccctgtcatgttca

SEQ ID NO: 17666 - DNA, 25 bp, Mus musculus
ctgacccctgtcatgttcactggtc

SEQ ID NO: 17667 - DNA, 25 bp, Mus musculus
acccctgtcatgttcactggtccat

SEQ ID NO: 17668 - DNA, 25 bp, Mus musculus
actccaccagatccacgtcattcat

SEQ ID NO: 17669 - DNA, 25 bp, Mus musculus
ccagatccacgtcattcattgccac

SEQ ID NO: 17670 - DNA, 25 bp, Mus musculus
agcagagccagccctgcctacaacg

SEQ ID NO: 17671 - DNA, 25 bp, Mus musculus
tctccacggtgccctacatgctaaa

SEQ ID NO: 17672 - DNA, 25 bp, Mus musculus
ccacggtgccctacatgctaaatgt

SEQ ID NO: 17673 - DNA, 25 bp, Mus musculus
cggtgccctacatgctaaatgtcac

SEQ ID NO: 17674 - DNA, 25 bp, Mus musculus
cctacatgctaaatgtcactgcagt

SEQ ID NO: 17675 - DNA, 25 bp, Mus musculus
acatgctaaatgtcactgcagtgca

SEQ ID NO: 17676 - DNA, 25 bp, Mus musculus
tgctaaatgtcactgcagtgcaccc

SEQ ID NO: 17677 - DNA, 25 bp, Mus musculus
atgtcactgcagtgcacccaggcgg

SEQ ID NO: 17678 - DNA, 25 bp, Mus musculus
agcctttgtggctgagcgaatcatc

SEQ ID NO: 17679 - DNA, 25 bp, Mus musculus
tgagcgaatcatcaagccggaccct

SEQ ID NO: 17680 - DNA, 25 bp, Mus musculus
gatccacgtcattcattgccactta

SEQ ID NO: 17681 - DNA, 25 bp, Mus musculus
ccacgtcattcattgccacttacag

SEQ ID NO: 17682 - DNA, 25 bp, Mus musculus
cattcattgccacttacaggctcgg

SEQ ID NO: 17683 - DNA, 25 bp, Mus musculus
tcattgccacttacaggctcggtgt

SEQ ID NO: 17684 - DNA, 25 bp, Mus musculus
ttgccacttacaggctcggtgtggc

SEQ ID NO: 17685 - DNA, 25 bp, Mus musculus
cttacaggctcggtgtggccaccca

SEQ ID NO: 17686 - DNA, 25 bp, Mus musculus
gtgtggccacccagcagcagagcca

SEQ ID NO: 17687 - DNA, 25 bp, Mus musculus
agcagcagagccagccctgcctaca

SEQ ID NO: 17688 - DNA, 25 bp, Mus musculus
cagtatgtgcctaacggttggcaag

SEQ ID NO: 17689 - DNA, 25 bp, Mus musculus
tatgtgcctaacggttggcaagtac

SEQ ID NO: 17690 - DNA, 25 bp, Mus musculus
atgttgcctagtcagcctgctgggt

SEQ ID NO: 17691 - DNA, 25 bp, Mus musculus
cctagtcagcctgctgggtatcgag

SEQ ID NO: 17692 - DNA, 25 bp, Mus musculus
agtcagcctgctgggtatcgagtgg

SEQ ID NO: 17693 - DNA, 25 bp, Mus musculus
cagcctgctgggtatcgagtggccg

SEQ ID NO: 17694 - DNA, 25 bp, Mus musculus
agtttctcagatccttgtttcaaag

SEQ ID NO: 17695 - DNA, 25 bp, Mus musculus
tgaacttttctccactaaaatcgtg

SEQ ID NO: 17696 - DNA, 25 bp, Mus musculus
ctccactaaaatcgtgtgcagtttt

SEQ ID NO: 17697 - DNA, 25 bp, Mus musculus
ttttagtttgcattcctgataggat

SEQ ID NO: 17698 - DNA, 25 bp, Mus musculus
tagtttgcattcctgataggattta

SEQ ID NO: 17699 - DNA, 25 bp, Mus musculus
tttgcattcctgataggatttaaaa

SEQ ID NO: 17700 - DNA, 25 bp, Mus musculus
ttcaatcagacccagtcttctgcac

SEQ ID NO: 17701 - DNA, 25 bp, Mus musculus
aatcagacccagtcttctgcaccgt

SEQ ID NO: 17702 - DNA, 25 bp, Mus musculus
cagacccagtcttctgcaccgtgga

SEQ ID NO: 17703 - DNA, 25 bp, Mus musculus
cagtcttctgcaccgtggatgggac

SEQ ID NO: 17704 - DNA, 25 bp, Mus musculus
tcttctgcaccgtggatgggaccca

SEQ ID NO: 17705 - DNA, 25 bp, Mus musculus
tctgcaccgtggatgggacccaatt

SEQ ID NO: 17706 - DNA, 25 bp, Mus musculus
atgggacccaattacagtgtgccac

SEQ ID NO: 17707 - DNA, 25 bp, Mus musculus
agcatgttgcctagtcagcctgctg

SEQ ID NO: 17708 - DNA, 25 bp, Mus musculus
cctatgagtgccacctgtgccacaa

SEQ ID NO: 17709 - DNA, 25 bp, Mus musculus
atgagtgccacctgtgccacaaggc

SEQ ID NO: 17710 - DNA, 25 bp, Mus musculus
ccacaccacaggccgaaggtgccat

SEQ ID NO: 17711 - DNA, 25 bp, Mus musculus
caccacaggccgaaggtgccatgga

SEQ ID NO: 17712 - DNA, 25 bp, Mus musculus
ggaacagcctgggacaccacgccaa

SEQ ID NO: 17713 - DNA, 25 bp, Mus musculus
accacgccaagcaacggggagcaca

SEQ ID NO: 17714 - DNA, 25 bp, Mus musculus
ccagagccttcattccaattacaag

SEQ ID NO: 17715 - DNA, 25 bp, Mus musculus
gagccttcattccaattacaagctg

SEQ ID NO: 17716 - DNA, 25 bp, Mus musculus
tcattccaattacaagctgaggttt

SEQ ID NO: 17717 - DNA, 25 bp, Mus musculus
ttccaattacaagctgaggttttgg

SEQ ID NO: 17718 - DNA, 25 bp, Mus musculus
ctctctagattggggtgatcaccca

SEQ ID NO: 17719 - DNA, 25 bp, Mus musculus
tgatcacccaaggagttaaacatga

SEQ ID NO: 17720 - DNA, 25 bp, Mus musculus
ccttcgccaaggaggaccacctgca

SEQ ID NO: 17721 - DNA, 25 bp, Mus musculus
ccaaggaggaccacctgcagcgcca

SEQ ID NO: 17722 - DNA, 25 bp, Mus musculus
tgcagcgccatctcaagggtcagaa

SEQ ID NO: 17723 - DNA, 25 bp, Mus musculus
agcgccatctcaagggtcagaactg

SEQ ID NO: 17724 - DNA, 25 bp, Mus musculus
actgcctggaggtgcgcacccgaag

SEQ ID NO: 17725 - DNA, 25 bp, Mus musculus
gcacccgaaggcgccgcaaggatga

SEQ ID NO: 17726 - DNA, 25 bp, Mus musculus
tcgacctttccaatggccacctgga

SEQ ID NO: 17727 - DNA, 25 bp, Mus musculus
acctctctctggctcgattctggga

SEQ ID NO: 17728 - DNA, 25 bp, Mus musculus
gtgcattctgtactgggcactactg

SEQ ID NO: 17729 - DNA, 25 bp, Mus musculus
ctgggcactactgctcagccatcag

SEQ ID NO: 17730 - DNA, 25 bp, Mus musculus
atctcacataaacttctcaaaactc

SEQ ID NO: 17731 - DNA, 25 bp, Mus musculus
cataaacttctcaaaactctcaaag

SEQ ID NO: 17732 - DNA, 25 bp, Mus musculus
cttctcaaaactctcaaagctgtgc

SEQ ID NO: 17733 - DNA, 25 bp, Mus musculus
ctcaaagctgtgcatcagaaggagt

SEQ ID NO: 17734 - DNA, 25 bp, Mus musculus
taaatctcacaggatgcaaatttaa

SEQ ID NO: 17735 - DNA, 25 bp, Mus musculus
cattacatcacataagaaaatgtta

SEQ ID NO: 17736 - DNA, 25 bp, Mus musculus
aaactactcacaatatgatgcaagt

SEQ ID NO: 17737 - DNA, 25 bp, Mus musculus
tactatcacattccttatgtgtgtt

SEQ ID NO: 17738 - DNA, 25 bp, Mus musculus
cacattccttatgtgtgtttatagc

SEQ ID NO: 17739 - DNA, 25 bp, Mus musculus
tgcagttctctctgaatagggactt

SEQ ID NO: 17740 - DNA, 25 bp, Mus musculus
actactgctcagccatcagcaggaa

SEQ ID NO: 17741 - DNA, 25 bp, Mus musculus
gctcagccatcagcaggaactagta

SEQ ID NO: 17742 - DNA, 25 bp, Mus musculus
caattccagtgcattgtgctatggg

SEQ ID NO: 17743 - DNA, 25 bp, Mus musculus
cagtgcattgtgctatgggaaagaa

SEQ ID NO: 17744 - DNA, 25 bp, Mus musculus
gaaagaagcctgaccaaatggctac

SEQ ID NO: 17745 - DNA, 25 bp, Mus musculus
agcctgaccaaatggctacacactg

SEQ ID NO: 17746 - DNA, 25 bp, Mus musculus
accaaatggctacacactgcagata

SEQ ID NO: 17747 - DNA, 25 bp, Mus musculus
ggtggcatctcacataaacttctca

SEQ ID NO: 17748 - DNA, 25 bp, Mus musculus
ggtgttgaccgcagacacagcatgc

SEQ ID NO: 17749 - DNA, 25 bp, Mus musculus
ttgaccgcagacacagcatgcgtga

SEQ ID NO: 17750 - DNA, 25 bp, Mus musculus
gcctggcgctctacgcactgatgat

SEQ ID NO: 17751 - DNA, 25 bp, Mus musculus
ctggcgctctacgcactgatgatta

SEQ ID NO: 17752 - DNA, 25 bp, Mus musculus
ctctacgcactgatgattacctgga

SEQ ID NO: 17753 - DNA, 25 bp, Mus musculus
ctacgcactgatgattacctggata

SEQ ID NO: 17754 - DNA, 25 bp, Mus musculus
acgcactgatgattacctggatagc

SEQ ID NO: 17755 - DNA, 25 bp, Mus musculus
atgattacctggatagcatgtcttg

SEQ ID NO: 17756 - DNA, 25 bp, Mus musculus
agagccatatttgtacccatctatg

SEQ ID NO: 17757 - DNA, 25 bp, Mus musculus
agccatatttgtacccatctatggc

SEQ ID NO: 17758 - DNA, 25 bp, Mus musculus
ccatatttgtacccatctatggcct

SEQ ID NO: 17759 - DNA, 25 bp, Mus musculus
atatttgtacccatctatggcctgg

SEQ ID NO: 17760 - DNA, 25 bp, Mus musculus
gaccgcagacacagcatgcgtgatg

SEQ ID NO: 17761 - DNA, 25 bp, Mus musculus
atttgtacccatctatggcctgggt

SEQ ID NO: 17762 - DNA, 25 bp, Mus musculus
ccgcagacacagcatgcgtgatgtt

SEQ ID NO: 17763 - DNA, 25 bp, Mus musculus
gcagacacagcatgcgtgatgttac

SEQ ID NO: 17764 - DNA, 25 bp, Mus musculus
acacagcatgcgtgatgttacggaa

SEQ ID NO: 17765 - DNA, 25 bp, Mus musculus
agcatgcgtgatgttacggaagttt

SEQ ID NO: 17766 - DNA, 25 bp, Mus musculus
atgtcattgatttcactggcatgcc

SEQ ID NO: 17767 - DNA, 25 bp, Mus musculus
gtcattgatttcactggcatgcctg

SEQ ID NO: 17768 - DNA, 25 bp, Mus musculus
actggcatgcctggcgctctacgca

SEQ ID NO: 17769 - DNA, 25 bp, Mus musculus
ctaaccacctgcaagaattgaataa

SEQ ID NO: 17770 - DNA, 25 bp, Mus musculus
aagagctttctggcatccagcaggg

SEQ ID NO: 17771 - DNA, 25 bp, Mus musculus
tgcagtctacaaacttggccctggc

SEQ ID NO: 17772 - DNA, 25 bp, Mus musculus
ctacaaacttggccctggctgaatg

SEQ ID NO: 17773 - DNA, 25 bp, Mus musculus
agagtggctgtactggcctgaagag

SEQ ID NO: 17774 - DNA, 25 bp, Mus musculus
gctgtactggcctgaagagcagctt

SEQ ID NO: 17775 - DNA, 25 bp, Mus musculus
cctctctggaacagaagtcgcctgt

SEQ ID NO: 17776 - DNA, 25 bp, Mus musculus
agaagtcgcctgtttctccatggct

SEQ ID NO: 17777 - DNA, 25 bp, Mus musculus
cgcctgtttctccatggctgccagg

SEQ ID NO: 17778 - DNA, 25 bp, Mus musculus
tttctccatggctgccaggggcaac

SEQ ID NO: 17779 - DNA, 25 bp, Mus musculus
catggctgccaggggcaactagcca

SEQ ID NO: 17780 - DNA, 25 bp, Mus musculus
aaatgtcaatttccctgctcctccg

SEQ ID NO: 17781 - DNA, 25 bp, Mus musculus
tttctggcatccagcagggttttct

SEQ ID NO: 17782 - DNA, 25 bp, Mus musculus
gcatccagcagggttttctggctaa

SEQ ID NO: 17783 - DNA, 25 bp, Mus musculus
cggaggctctctgcaaacttgatag

SEQ ID NO: 17784 - DNA, 25 bp, Mus musculus
ctctctgcaaacttgataggaaagt

SEQ ID NO: 17785 - DNA, 25 bp, Mus musculus
ttgacacaatggtcctaccagaaca

SEQ ID NO: 17786 - DNA, 25 bp, Mus musculus
tcctaccagaacaatttaaagacag

SEQ ID NO: 17787 - DNA, 25 bp, Mus musculus
acatctgccaagagacagagcggct

SEQ ID NO: 17788 - DNA, 25 bp, Mus musculus
agacagagcggctgcagtctacaaa

SEQ ID NO: 17789 - DNA, 25 bp, Mus musculus
gtccaggctccgagccatctagcga

SEQ ID NO: 17790 - DNA, 25 bp, Mus musculus
ccaggctccgagccatctagcgact

SEQ ID NO: 17791 - DNA, 25 bp, Mus musculus
caggcccaccatggggaagaacaat

SEQ ID NO: 17792 - DNA, 25 bp, Mus musculus
acaatagcaagctggcccctgagga

SEQ ID NO: 17793 - DNA, 25 bp, Mus musculus
tagcaagctggcccctgaggagctg

SEQ ID NO: 17794 - DNA, 25 bp, Mus musculus
tggcccctgaggagctggaagatct

SEQ ID NO: 17795 - DNA, 25 bp, Mus musculus
aagatctggtccagaacacggagtt

SEQ ID NO: 17796 - DNA, 25 bp, Mus musculus
tctggtccagaacacggagttcagc

SEQ ID NO: 17797 - DNA, 25 bp, Mus musculus
ccagaacacggagttcagcgagcag

SEQ ID NO: 17798 - DNA, 25 bp, Mus musculus
agaacacggagttcagcgagcagga

SEQ ID NO: 17799 - DNA, 25 bp, Mus musculus
cacggagttcagcgagcaggagcta

SEQ ID NO: 17800 - DNA, 25 bp, Mus musculus
gttcagcgagcaggagctaaagcag

SEQ ID NO: 17801 - DNA, 25 bp, Mus musculus
agccatctagcgactcggcgagcgg

SEQ ID NO: 17802 - DNA, 25 bp, Mus musculus
ccatctagcgactcggcgagcggcc

SEQ ID NO: 17803 - DNA, 25 bp, Mus musculus
agcggcctcaggtggacaatcatct

SEQ ID NO: 17804 - DNA, 25 bp, Mus musculus
ccagggactttcacttcaagccgag

SEQ ID NO: 17805 - DNA, 25 bp, Mus musculus
tcacttcaagccgagtccccagttc

SEQ ID NO: 17806 - DNA, 25 bp, Mus musculus
caagccgagtccccagttcaagaag

SEQ ID NO: 17807 - DNA, 25 bp, Mus musculus
ccagctcaggcccaccatggggaag

SEQ ID NO: 17808 - DNA, 25 bp, Mus musculus
agctcaggcccaccatggggaagaa

SEQ ID NO: 17809 - DNA, 25 bp, Mus musculus
aactacagcccaggtgctgatccgg

SEQ ID NO: 17810 - DNA, 25 bp, Mus musculus
ggtctttgactttgaggtgagcagc

SEQ ID NO: 17811 - DNA, 25 bp, Mus musculus
ctgcctcatctgcccttgcaagtgt

SEQ ID NO: 17812 - DNA, 25 bp, Mus musculus
caagtgtcctgtgtctctgcactag

SEQ ID NO: 17813 - DNA, 25 bp, Mus musculus
tcctgtgtctctgcactaggtggca

SEQ ID NO: 17814 - DNA, 25 bp, Mus musculus
gtctctgcactaggtggcaccttgc

SEQ ID NO: 17815 - DNA, 25 bp, Mus musculus
acatagagtctggagggcagtacca

SEQ ID NO: 17816 - DNA, 25 bp, Mus musculus
tccagccttccttggtctttcttct

SEQ ID NO: 17817 - DNA, 25 bp, Mus musculus
gctttagagtccaagccgtgccact

SEQ ID NO: 17818 - DNA, 25 bp, Mus musculus
gagtccaagccgtgccactaacact

SEQ ID NO: 17819 - DNA, 25 bp, Mus musculus
aagccgtgccactaacacttaaatg

SEQ ID NO: 17820 - DNA, 25 bp, Mus musculus
ttgggtcagacttctccttgcctca

SEQ ID NO: 17821 - DNA, 25 bp, Mus musculus
catggccactctactcagctacaac

SEQ ID NO: 17822 - DNA, 25 bp, Mus musculus
cactctactcagctacaacaggaac

SEQ ID NO: 17823 - DNA, 25 bp, Mus musculus
cttccacgccgaagtctgaagctgt

SEQ ID NO: 17824 - DNA, 25 bp, Mus musculus
agtctgaagctgtggcgagcagatc

SEQ ID NO: 17825 - DNA, 25 bp, Mus musculus
tcctcctcaagtggcttgcacctgt

SEQ ID NO: 17826 - DNA, 25 bp, Mus musculus
tcaagtggcttgcacctgttctttc

SEQ ID NO: 17827 - DNA, 25 bp, Mus musculus
cacctgttctttctgcctcatctgc

SEQ ID NO: 17828 - DNA, 25 bp, Mus musculus
ttctttctgcctcatctgcccttgc

SEQ ID NO: 17829 - DNA, 25 bp, Mus musculus
tcagtctcagtcacatctgtacaca

SEQ ID NO: 17830 - DNA, 25 bp, Mus musculus
gtctcagtcacatctgtacacagac

SEQ ID NO: 17831 - DNA, 25 bp, Mus musculus
tcgttttgtgcaacgtgcagcatgt

SEQ ID NO: 17832 - DNA, 25 bp, Mus musculus
ttttgtgcaacgtgcagcatgtcag

SEQ ID NO: 17833 - DNA, 25 bp, Mus musculus
tgtgcaacgtgcagcatgtcagcaa

SEQ ID NO: 17834 - DNA, 25 bp, Mus musculus
gcaacgtgcagcatgtcagcaaccg

SEQ ID NO: 17835 - DNA, 25 bp, Mus musculus
acgtgcagcatgtcagcaaccgtgg

SEQ ID NO: 17836 - DNA, 25 bp, Mus musculus
tgcagcatgtcagcaaccgtggctt

SEQ ID NO: 17837 - DNA, 25 bp, Mus musculus
agcatgtcagcaaccgtggcttgtg

SEQ ID NO: 17838 - DNA, 25 bp, Mus musculus
tcagcaaccgtggcttgtgcacaga

SEQ ID NO: 17839 - DNA, 25 bp, Mus musculus
gcaaccgtggcttgtgcacagacca

SEQ ID NO: 17840 - DNA, 25 bp, Mus musculus
gcttgtgcacagaccatatagagtc

SEQ ID NO: 17841 - DNA, 25 bp, Mus musculus
tcagtcacatctgtacacagacgct

SEQ ID NO: 17842 - DNA, 25 bp, Mus musculus
cttgtgcacagaccatatagagtcc

SEQ ID NO: 17843 - DNA, 25 bp, Mus musculus
gtcacatctgtacacagacgcttcc

SEQ ID NO: 17844 - DNA, 25 bp, Mus musculus
acatctgtacacagacgcttccatt

SEQ ID NO: 17845 - DNA, 25 bp, Mus musculus
tctgtacacagacgcttccattcgt

SEQ ID NO: 17846 - DNA, 25 bp, Mus musculus
gtacacagacgcttccattcgtttt

SEQ ID NO: 17847 - DNA, 25 bp, Mus musculus
agacgcttccattcgttttgtgcaa

SEQ ID NO: 17848 - DNA, 25 bp, Mus musculus
cgcttccattcgttttgtgcaacgt

SEQ ID NO: 17849 - DNA, 25 bp, Mus musculus
cattcgttttgtgcaacgtgcagca

SEQ ID NO: 17850 - DNA, 25 bp, Mus musculus
atttcttcataagtctcagaagagc

SEQ ID NO: 17851 - DNA, 25 bp, Mus musculus
ttcttcataagtctcagaagagctg

SEQ ID NO: 17852 - DNA, 25 bp, Mus musculus
ccattacagctaacatagtaaacaa

SEQ ID NO: 17853 - DNA, 25 bp, Mus musculus
taaactgtatgtcacatctacctaa

SEQ ID NO: 17854 - DNA, 25 bp, Mus musculus
aactgtatgtcacatctacctaaat

SEQ ID NO: 17855 - DNA, 25 bp, Mus musculus
gtatgtcacatctacctaaatattg

SEQ ID NO: 17856 - DNA, 25 bp, Mus musculus
atgtcacatctacctaaatattgca

SEQ ID NO: 17857 - DNA, 25 bp, Mus musculus
gtcacatctacctaaatattgcact

SEQ ID NO: 17858 - DNA, 25 bp, Mus musculus
cacatctacctaaatattgcactat

SEQ ID NO: 17859 - DNA, 25 bp, Mus musculus
tctacctaaatattgcactatatgc

SEQ ID NO: 17860 - DNA, 25 bp, Mus musculus
cctaaatattgcactatatgcttaa

SEQ ID NO: 17861 - DNA, 25 bp, Mus musculus
tattgcactatatgcttaaaatcat

SEQ ID NO: 17862 - DNA, 25 bp, Mus musculus
tgtctagaagccagtgttgtttctt

SEQ ID NO: 17863 - DNA, 25 bp, Mus musculus
gaagccagtgttgtttcttgccatt

SEQ ID NO: 17864 - DNA, 25 bp, Mus musculus
ccagtgttgtttcttgccattacag

SEQ ID NO: 17865 - DNA, 25 bp, Mus musculus
tgttgtttcttgccattacagctaa

SEQ ID NO: 17866 - DNA, 25 bp, Mus musculus
ttgtttcttgccattacagctaaca

SEQ ID NO: 17867 - DNA, 25 bp, Mus musculus
gtttcttgccattacagctaacata

SEQ ID NO: 17868 - DNA, 25 bp, Mus musculus
ttcttgccattacagctaacatagt

SEQ ID NO: 17869 - DNA, 25 bp, Mus musculus
tgccattacagctaacatagtaaac

SEQ ID NO: 17870 - DNA, 25 bp, Mus musculus
gctacgaacgctaccccaagaattg

SEQ ID NO: 17871 - DNA, 25 bp, Mus musculus
aacgctaccccaagaattgcctgct

SEQ ID NO: 17872 - DNA, 25 bp, Mus musculus
agccttctgagggatgtgactgagt

SEQ ID NO: 17873 - DNA, 25 bp, Mus musculus
gtccaggacggaccccgatctctat

SEQ ID NO: 17874 - DNA, 25 bp, Mus musculus
cggaccccgatctctatacctatca

SEQ ID NO: 17875 - DNA, 25 bp, Mus musculus
gaccccgatctctatacctatcaca

SEQ ID NO: 17876 - DNA, 25 bp, Mus musculus
ccccgatctctatacctatcacatg

SEQ ID NO: 17877 - DNA, 25 bp, Mus musculus
ccgatctctatacctatcacatgct

SEQ ID NO: 17878 - DNA, 25 bp, Mus musculus
tacctatcacatgctcaagagcatc

SEQ ID NO: 17879 - DNA, 25 bp, Mus musculus
agaataacacggtgtgcgcgagaat

SEQ ID NO: 17880 - DNA, 25 bp, Mus musculus
taacacggtgtgcgcgagaatgagg

SEQ ID NO: 17881 - DNA, 25 bp, Mus musculus
acacggtgtgcgcgagaatgaggca

SEQ ID NO: 17882 - DNA, 25 bp, Mus musculus
cgctaccccaagaattgcctgctga

SEQ ID NO: 17883 - DNA, 25 bp, Mus musculus
ctaccccaagaattgcctgctgaag

SEQ ID NO: 17884 - DNA, 25 bp, Mus musculus
accccaagaattgcctgctgaaggt

SEQ ID NO: 17885 - DNA, 25 bp, Mus musculus
caagaattgcctgctgaaggtcaga

SEQ ID NO: 17886 - DNA, 25 bp, Mus musculus
agaattgcctgctgaaggtcagatc

SEQ ID NO: 17887 - DNA, 25 bp, Mus musculus
aattgcctgctgaaggtcagatcgg

SEQ ID NO: 17888 - DNA, 25 bp, Mus musculus
ttgcctgctgaaggtcagatcggta

SEQ ID NO: 17889 - DNA, 25 bp, Mus musculus
ccagccttctgagggatgtgactga

SEQ ID NO: 17890 - DNA, 25 bp, Mus musculus
caagtactgactccaagcctatcga

SEQ ID NO: 17891 - DNA, 25 bp, Mus musculus
ctgactccaagcctatcgacgcatc

SEQ ID NO: 17892 - DNA, 25 bp, Mus musculus
gtaatctgaagcctgcaaagatgcg

SEQ ID NO: 17893 - DNA, 25 bp, Mus musculus
ttctgtctcaagccatggtgatgtg

SEQ ID NO: 17894 - DNA, 25 bp, Mus musculus
tgatgtgtgccagttcaccagagaa

SEQ ID NO: 17895 - DNA, 25 bp, Mus musculus
ttacttttgatgcttttcctggaga

SEQ ID NO: 17896 - DNA, 25 bp, Mus musculus
ttgatgcttttcctggagagcctga

SEQ ID NO: 17897 - DNA, 25 bp, Mus musculus
cttttcctggagagcctgacaagga

SEQ ID NO: 17898 - DNA, 25 bp, Mus musculus
agatccagcctgacctgcacaccaa

SEQ ID NO: 17899 - DNA, 25 bp, Mus musculus
acctgcacaccaatgctgagtgtgt

SEQ ID NO: 17900 - DNA, 25 bp, Mus musculus
atgctgagtgtgtggccacatacaa

SEQ ID NO: 17901 - DNA, 25 bp, Mus musculus
catacaaaggagctccctttgaggt

SEQ ID NO: 17902 - DNA, 25 bp, Mus musculus
ccaagcctatcgacgcatcgcgtct

SEQ ID NO: 17903 - DNA, 25 bp, Mus musculus
acgcatcgcgtctggatcttcgaat

SEQ ID NO: 17904 - DNA, 25 bp, Mus musculus
cgcgtctggatcttcgaattggttg

SEQ ID NO: 17905 - DNA, 25 bp, Mus musculus
gtattgttactgccaagaagcaccc

SEQ ID NO: 17906 - DNA, 25 bp, Mus musculus
ccaagaagcaccctgatgcagattc

SEQ ID NO: 17907 - DNA, 25 bp, Mus musculus
agcaccctgatgcagattcactgta

SEQ ID NO: 17908 - DNA, 25 bp, Mus musculus
ttcctctagaacagatgcaaaatcg

SEQ ID NO: 17909 - DNA, 25 bp, Mus musculus
tggttttactctgtaatctgaagcc

SEQ ID NO: 17910 - DNA, 25 bp, Mus musculus
ggacataatgcagctccccaaagcg

SEQ ID NO: 17911 - DNA, 25 bp, Mus musculus
acataatgcagctccccaaagcgcg

SEQ ID NO: 17912 - DNA, 25 bp, Mus musculus
cacagccaaggcgaccgtgctctgt

SEQ ID NO: 17913 - DNA, 25 bp, Mus musculus
cagccaaggcgaccgtgctctgtgc

SEQ ID NO: 17914 - DNA, 25 bp, Mus musculus
tgctctgtgcatcttataccctgtt

SEQ ID NO: 17915 - DNA, 25 bp, Mus musculus
gctctgtgcatcttataccctgttt

SEQ ID NO: 17916 - DNA, 25 bp, Mus musculus
tctgtgcatcttataccctgtttaa

SEQ ID NO: 17917 - DNA, 25 bp, Mus musculus
gtgcatcttataccctgtttaagga

SEQ ID NO: 17918 - DNA, 25 bp, Mus musculus
tgcatcttataccctgtttaaggaa

SEQ ID NO: 17919 - DNA, 25 bp, Mus musculus
aagatactaatcgctttgatcttga

SEQ ID NO: 17920 - DNA, 25 bp, Mus musculus
agatactaatcgctttgatcttgaa

SEQ ID NO: 17921 - DNA, 25 bp, Mus musculus
atactaatcgctttgatcttgaact

SEQ ID NO: 17922 - DNA, 25 bp, Mus musculus
agattcatcccactggaaaaatgtt

SEQ ID NO: 17923 - DNA, 25 bp, Mus musculus
tactaatcgctttgatcttgaactt

SEQ ID NO: 17924 - DNA, 25 bp, Mus musculus
gattcatcccactggaaaaatgttt

SEQ ID NO: 17925 - DNA, 25 bp, Mus musculus
ttcatcccactggaaaaatgtttat

SEQ ID NO: 17926 - DNA, 25 bp, Mus musculus
tcatcccactggaaaaatgtttatt

SEQ ID NO: 17927 - DNA, 25 bp, Mus musculus
aatgtttattctttcagatggagaa

SEQ ID NO: 17928 - DNA, 25 bp, Mus musculus
ggagccacttgacgaggaaatctct

SEQ ID NO: 17929 - DNA, 25 bp, Mus musculus
aatctctgggattgtagaagtagtt

SEQ ID NO: 17930 - DNA, 25 bp, Mus musculus
tcacagccaaggcgaccgtgctctg

SEQ ID NO: 17931 - DNA, 25 bp, Mus musculus
tcattggccaaaccaggaactcata

SEQ ID NO: 17932 - DNA, 25 bp, Mus musculus
gccaaaccaggaactcatatcctcc

SEQ ID NO: 17933 - DNA, 25 bp, Mus musculus
gatgtttttgcaactgtgggcaagc

SEQ ID NO: 17934 - DNA, 25 bp, Mus musculus
agagtgcctttccctgcagtgctca

SEQ ID NO: 17935 - DNA, 25 bp, Mus musculus
cctttccctgcagtgctcagagacc

SEQ ID NO: 17936 - DNA, 25 bp, Mus musculus
cctgcagtgctcagagaccctggaa

SEQ ID NO: 17937 - DNA, 25 bp, Mus musculus
gtgctcagagaccctggaagactat

SEQ ID NO: 17938 - DNA, 25 bp, Mus musculus
agactatgtcgtggtccagtgcaag

SEQ ID NO: 17939 - DNA, 25 bp, Mus musculus
tgtcgtggtccagtgcaaggactgt

SEQ ID NO: 17940 - DNA, 25 bp, Mus musculus
ctgtacctagtgttctggcacagcc

SEQ ID NO: 17941 - DNA, 25 bp, Mus musculus
ctagtgttctggcacagcctatgta

SEQ ID NO: 17942 - DNA, 25 bp, Mus musculus
acacacacaccgacagcaacggaat

SEQ ID NO: 17943 - DNA, 25 bp, Mus musculus
actcatatcctcctgaggcacttag

SEQ ID NO: 17944 - DNA, 25 bp, Mus musculus
atcctcctgaggcacttagcatctg

SEQ ID NO: 17945 - DNA, 25 bp, Mus musculus
ctgaggcacttagcatctgctgctt

SEQ ID NO: 17946 - DNA, 25 bp, Mus musculus
tgagcagctctggatcccatgttgt

SEQ ID NO: 17947 - DNA, 25 bp, Mus musculus
cattcagcccagggtttgttctcta

SEQ ID NO: 17948 - DNA, 25 bp, Mus musculus
atcaagtattcctacccgatacttg

SEQ ID NO: 17949 - DNA, 25 bp, Mus musculus
tattcctacccgatacttgccaata

SEQ ID NO: 17950 - DNA, 25 bp, Mus musculus
ttttccgatgtttttgcaactgtgg

SEQ ID NO: 17951 - DNA, 25 bp, Mus musculus
ttcggtccaccagacgtgccaccag

SEQ ID NO: 17952 - DNA, 25 bp, Mus musculus
ccagacgtgccaccagcctggagct

SEQ ID NO: 17953 - DNA, 25 bp, Mus musculus
atctcaaaaagacatccaaagaggc

SEQ ID NO: 17954 - DNA, 25 bp, Mus musculus
catccaaagaggctgtgggagtcta

SEQ ID NO: 17955 - DNA, 25 bp, Mus musculus
tctacagatcagctatccatggacg

SEQ ID NO: 17956 - DNA, 25 bp, Mus musculus
acagatcagctatccatggacgagg

SEQ ID NO: 17957 - DNA, 25 bp, Mus musculus
ctatccatggacgaggtctgttttg

SEQ ID NO: 17958 - DNA, 25 bp, Mus musculus
aacgcaacatcgatgcgggagagat

SEQ ID NO: 17959 - DNA, 25 bp, Mus musculus
agtactctggcattgtcattcgctc

SEQ ID NO: 17960 - DNA, 25 bp, Mus musculus
ctggcattgtcattcgctctgtgct

SEQ ID NO: 17961 - DNA, 25 bp, Mus musculus
tgctgactgacaagcgagagaagtt

SEQ ID NO: 17962 - DNA, 25 bp, Mus musculus
acatgttccgcatggatgactttga

SEQ ID NO: 17963 - DNA, 25 bp, Mus musculus
gacgtgccaccagcctggagcttcc

SEQ ID NO: 17964 - DNA, 25 bp, Mus musculus
ccaccagcctggagcttcctatggc

SEQ ID NO: 17965 - DNA, 25 bp, Mus musculus
agcttcctatggccatgcgctttcg

SEQ ID NO: 17966 - DNA, 25 bp, Mus musculus
ttcctatggccatgcgctttcgtca

SEQ ID NO: 17967 - DNA, 25 bp, Mus musculus
ccatgcgctttcgtcatctcaaaaa

SEQ ID NO: 17968 - DNA, 25 bp, Mus musculus
tgcgctttcgtcatctcaaaaagac

SEQ ID NO: 17969 - DNA, 25 bp, Mus musculus
gctttcgtcatctcaaaaagacatc

SEQ ID NO: 17970 - DNA, 25 bp, Mus musculus
gtcatctcaaaaagacatccaaaga

SEQ ID NO: 17971 - DNA, 25 bp, Mus musculus
cttctccggaggcagcttttttgag

SEQ ID NO: 17972 - DNA, 25 bp, Mus musculus
aggcagcttttttgagcacgagggt

SEQ ID NO: 17973 - DNA, 25 bp, Mus musculus
cccattagcctggaatgtagctctc

SEQ ID NO: 17974 - DNA, 25 bp, Mus musculus
gaatgtagctctcactttgacatga

SEQ ID NO: 17975 - DNA, 25 bp, Mus musculus
gacatgattctggttctcttgtctg

SEQ ID NO: 17976 - DNA, 25 bp, Mus musculus
attctggttctcttgtctgaccaag

SEQ ID NO: 17977 - DNA, 25 bp, Mus musculus
ctggttctcttgtctgaccaagtag

SEQ ID NO: 17978 - DNA, 25 bp, Mus musculus
aggatgtccctgttcacccatggca

SEQ ID NO: 17979 - DNA, 25 bp, Mus musculus
atgtccctgttcacccatggcacac

SEQ ID NO: 17980 - DNA, 25 bp, Mus musculus
tccctgttcacccatggcacactat

SEQ ID NO: 17981 - DNA, 25 bp, Mus musculus
ttcacccatggcacactattctgta

SEQ ID NO: 17982 - DNA, 25 bp, Mus musculus
ggcacactattctgtacacattttt

SEQ ID NO: 17983 - DNA, 25 bp, Mus musculus
cagcttttttgagcacgagggtcgc

SEQ ID NO: 17984 - DNA, 25 bp, Mus musculus
gactgagtcctccagatccctggct

SEQ ID NO: 17985 - DNA, 25 bp, Mus musculus
tgagtcctccagatccctggctctg

SEQ ID NO: 17986 - DNA, 25 bp, Mus musculus
atccctggctctggagctacccagg

SEQ ID NO: 17987 - DNA, 25 bp, Mus musculus
cctggctctggagctacccaggcat

SEQ ID NO: 17988 - DNA, 25 bp, Mus musculus
tggcccagccactggagaggcctac

SEQ ID NO: 17989 - DNA, 25 bp, Mus musculus
agatgctctaggtttgtcaatttca

SEQ ID NO: 17990 - DNA, 25 bp, Mus musculus
ggccccattagcctggaatgtagct

SEQ ID NO: 17991 - DNA, 25 bp, Mus musculus
cagtaggccccaacgagctgtcctc

SEQ ID NO: 17992 - DNA, 25 bp, Mus musculus
agtaggccccaacgagctgtcctca

SEQ ID NO: 17993 - DNA, 25 bp, Mus musculus
gtacaaccactgttggcgagcagat

SEQ ID NO: 17994 - DNA, 25 bp, Mus musculus
acaaccactgttggcgagcagattg

SEQ ID NO: 17995 - DNA, 25 bp, Mus musculus
caaccactgttggcgagcagattga

SEQ ID NO: 17996 - DNA, 25 bp, Mus musculus
accactgttggcgagcagattgaca

SEQ ID NO: 17997 - DNA, 25 bp, Mus musculus
ccactgttggcgagcagattgacaa

SEQ ID NO: 17998 - DNA, 25 bp, Mus musculus
actactatgactaccaggaagtaga

SEQ ID NO: 17999 - DNA, 25 bp, Mus musculus
tactatgactaccaggaagtagatc

SEQ ID NO: 18000 - DNA, 25 bp, Mus musculus
actatgactaccaggaagtagatcc

SEQ ID NO: 18001 - DNA, 25 bp, Mus musculus
tatgactaccaggaagtagatcctc

SEQ ID NO: 18002 - DNA, 25 bp, Mus musculus
gatcctcgaaccccttgtagagaag

SEQ ID NO: 18003 - DNA, 25 bp, Mus musculus
agctgtcctcatcggcagcaacggc

SEQ ID NO: 18004 - DNA, 25 bp, Mus musculus
gaggtcaaccgcaggcgcctgcccg

SEQ ID NO: 18005 - DNA, 25 bp, Mus musculus
gctgtcctcatcggcagcaacggct

SEQ ID NO: 18006 - DNA, 25 bp, Mus musculus
tgtcctcatcggcagcaacggctcc

SEQ ID NO: 18007 - DNA, 25 bp, Mus musculus
gtcctcatcggcagcaacggctcct

SEQ ID NO: 18008 - DNA, 25 bp, Mus musculus
ggcagcaacggctcctcactccatg

SEQ ID NO: 18009 - DNA, 25 bp, Mus musculus
acatgagatgcacctgcctcttcct

SEQ ID NO: 18010 - DNA, 25 bp, Mus musculus
gcgcagtcccggaccatgtccggta

SEQ ID NO: 18011 - DNA, 25 bp, Mus musculus
ggtacaaccactgttggcgagcaga

SEQ ID NO: 18012 - DNA, 25 bp, Mus musculus
ttcattaaagccatcaaaggatatt

SEQ ID NO: 18013 - DNA, 25 bp, Mus musculus
attaaagccatcaaaggatattagg

SEQ ID NO: 18014 - DNA, 25 bp, Mus musculus
gcaagttcagcctctctgatggcca

SEQ ID NO: 18015 - DNA, 25 bp, Mus musculus
agttcagcctctctgatggccagct

SEQ ID NO: 18016 - DNA, 25 bp, Mus musculus
gccagctgcttagtgtgtaagccac

SEQ ID NO: 18017 - DNA, 25 bp, Mus musculus
ttctcattttcttgtctcaagtgag

SEQ ID NO: 18018 - DNA, 25 bp, Mus musculus
ttatgagtctgcatatggtgctgca

SEQ ID NO: 18019 - DNA, 25 bp, Mus musculus
tgagtctgcatatggtgctgcagcc

SEQ ID NO: 18020 - DNA, 25 bp, Mus musculus
tgctgcagccgcctttcctggcctt

SEQ ID NO: 18021 - DNA, 25 bp, Mus musculus
agccgcctttcctggccttgatcaa

SEQ ID NO: 18022 - DNA, 25 bp, Mus musculus
ctttcctggccttgatcaaattgag

SEQ ID NO: 18023 - DNA, 25 bp, Mus musculus
gagtgtttctacacatttgaggtgg

SEQ ID NO: 18024 - DNA, 25 bp, Mus musculus
caactatagaggggccactgaaaga

SEQ ID NO: 18025 - DNA, 25 bp, Mus musculus
aaccttgaaagctgtccaccatttg

SEQ ID NO: 18026 - DNA, 25 bp, Mus musculus
ccaccatttgcagtcatgaacggtg

SEQ ID NO: 18027 - DNA, 25 bp, Mus musculus
ggtgtcttcatatttcctggtgact

SEQ ID NO: 18028 - DNA, 25 bp, Mus musculus
gtcttcatatttcctggtgactacc

SEQ ID NO: 18029 - DNA, 25 bp, Mus musculus
ttcatatttcctggtgactacctca

SEQ ID NO: 18030 - DNA, 25 bp, Mus musculus
gacactgcgtgatcacctttgtata

SEQ ID NO: 18031 - DNA, 25 bp, Mus musculus
ttactctcgttaccccagaatgtgt

SEQ ID NO: 18032 - DNA, 25 bp, Mus musculus
ttgttacagaccatgtgacagttcc

SEQ ID NO: 18033 - DNA, 25 bp, Mus musculus
atgtgacagttcctctgcacagtgg

SEQ ID NO: 18034 - DNA, 25 bp, Mus musculus
caaccagctcttgactctaaggcag

SEQ ID NO: 18035 - DNA, 25 bp, Mus musculus
tgtatacctcatgaactactgaaac

SEQ ID NO: 18036 - DNA, 25 bp, Mus musculus
acaaggttctctttgtcttcattgt

SEQ ID NO: 18037 - DNA, 25 bp, Mus musculus
ttgtcttcattgttaaggacctcgg

SEQ ID NO: 18038 - DNA, 25 bp, Mus musculus
ggctgggtcctggtacagaactgtt

SEQ ID NO: 18039 - DNA, 25 bp, Mus musculus
gtacagaactgttctcgggcttgag

SEQ ID NO: 18040 - DNA, 25 bp, Mus musculus
gctgttcaatcatgtgcttgagaaa

SEQ ID NO: 18041 - DNA, 25 bp, Mus musculus
tgctgtgcaaaccataacatgtccc

SEQ ID NO: 18042 - DNA, 25 bp, Mus musculus
gcaaaccataacatgtcccagcaag

SEQ ID NO: 18043 - DNA, 25 bp, Mus musculus
cataacatgtcccagcaagaagtta

SEQ ID NO: 18044 - DNA, 25 bp, Mus musculus
cagttcctctgcacagtggatctgt

SEQ ID NO: 18045 - DNA, 25 bp, Mus musculus
acagaccagccatgcttgtcacttt

SEQ ID NO: 18046 - DNA, 25 bp, Mus musculus
tgcttgtcactttcctgaagaaaac

SEQ ID NO: 18047 - DNA, 25 bp, Mus musculus
tagaacctacagaaatactgcagcc

SEQ ID NO: 18048 - DNA, 25 bp, Mus musculus
tgcagcctgtgcttacatctgagtg

SEQ ID NO: 18049 - DNA, 25 bp, Mus musculus
ttacatctgagtggatggctcctct

SEQ ID NO: 18050 - DNA, 25 bp, Mus musculus
agtggctaccttcaaccagctcttg

SEQ ID NO: 18051 - DNA, 25 bp, Mus musculus
taccttcaaccagctcttgactcta

SEQ ID NO: 18052 - DNA, 25 bp, Mus musculus
taccccatacatagagtgaccccac

SEQ ID NO: 18053 - DNA, 25 bp, Mus musculus
accccatacatagagtgaccccacg

SEQ ID NO: 18054 - DNA, 25 bp, Mus musculus
ggtgtgcaccacgacacacgcagcc

SEQ ID NO: 18055 - DNA, 25 bp, Mus musculus
acacgcagccctgccaggcgagttc

SEQ ID NO: 18056 - DNA, 25 bp, Mus musculus
tgccaggcgagttctgggaggttct

SEQ ID NO: 18057 - DNA, 25 bp, Mus musculus
tgctatgtcccctgcgcagaacacg

SEQ ID NO: 18058 - DNA, 25 bp, Mus musculus
ggtgtctgctggtgatgtgctagat

SEQ ID NO: 18059 - DNA, 25 bp, Mus musculus
gtgtctgctggtgatgtgctagata

SEQ ID NO: 18060 - DNA, 25 bp, Mus musculus
tgtctgctggtgatgtgctagatag

SEQ ID NO: 18061 - DNA, 25 bp, Mus musculus
gtctgctggtgatgtgctagatagg

SEQ ID NO: 18062 - DNA, 25 bp, Mus musculus
tctgctggtgatgtgctagatagga

SEQ ID NO: 18063 - DNA, 25 bp, Mus musculus
gaagaaagcccactggctcgttcct

SEQ ID NO: 18064 - DNA, 25 bp, Mus musculus
gctctgctgactgcagtgtggatgc

SEQ ID NO: 18065 - DNA, 25 bp, Mus musculus
tctgctgactgcagtgtggatgcac

SEQ ID NO: 18066 - DNA, 25 bp, Mus musculus
ctgctgactgcagtgtggatgcact

SEQ ID NO: 18067 - DNA, 25 bp, Mus musculus
gatgcactgctaagcggcgcagagg

SEQ ID NO: 18068 - DNA, 25 bp, Mus musculus
gcactgctaagcggcgcagaggaag

SEQ ID NO: 18069 - DNA, 25 bp, Mus musculus
cactgctaagcggcgcagaggaagg

SEQ ID NO: 18070 - DNA, 25 bp, Mus musculus
ctgctaagcggcgcagaggaaggaa

SEQ ID NO: 18071 - DNA, 25 bp, Mus musculus
aggtgtgcaccacgacacacgcagc

SEQ ID NO: 18072 - DNA, 25 bp, Mus musculus
gctactccagtgccactgtcaaaag

SEQ ID NO: 18073 - DNA, 25 bp, Mus musculus
ccagtgccactgtcaaaagagccaa

SEQ ID NO: 18074 - DNA, 25 bp, Mus musculus
catacatgtcggcactgagagactg

SEQ ID NO: 18075 - DNA, 25 bp, Mus musculus
gagactgcacattccagtcagttca

SEQ ID NO: 18076 - DNA, 25 bp, Mus musculus
gcacattccagtcagttcagagcac

SEQ ID NO: 18077 - DNA, 25 bp, Mus musculus
tccagtcagttcagagcacccaaga

SEQ ID NO: 18078 - DNA, 25 bp, Mus musculus
aatccttagcccaagcaagtgtcac

SEQ ID NO: 18079 - DNA, 25 bp, Mus musculus
tagcccaagcaagtgtcacctctca

SEQ ID NO: 18080 - DNA, 25 bp, Mus musculus
gtcctgcagctgacgagatctttcc

SEQ ID NO: 18081 - DNA, 25 bp, Mus musculus
ttctggctcacgatgatactcgccc

SEQ ID NO: 18082 - DNA, 25 bp, Mus musculus
ctcacgatgatactcgcccaggaga

SEQ ID NO: 18083 - DNA, 25 bp, Mus musculus
atgatactcgcccaggagagttgga

SEQ ID NO: 18084 - DNA, 25 bp, Mus musculus
tcaaaagagccaagctccaggacgg

SEQ ID NO: 18085 - DNA, 25 bp, Mus musculus
gcccttgcacgcaaacctcatgtac

SEQ ID NO: 18086 - DNA, 25 bp, Mus musculus
tgaccaatagcagctctgtccactt

SEQ ID NO: 18087 - DNA, 25 bp, Mus musculus
atagcagctctgtccactttgcaga

SEQ ID NO: 18088 - DNA, 25 bp, Mus musculus
gctctgtccactttgcagaaagcac

SEQ ID NO: 18089 - DNA, 25 bp, Mus musculus
tccactttgcagaaagcacataggg

SEQ ID NO: 18090 - DNA, 25 bp, Mus musculus
gtcttgagtgcagtcagtcgcttct

SEQ ID NO: 18091 - DNA, 25 bp, Mus musculus
gtcagtcgcttctctgtccatacat

SEQ ID NO: 18092 - DNA, 25 bp, Mus musculus
caatacacatctccagattttctct

SEQ ID NO: 18093 - DNA, 25 bp, Mus musculus
atacacatctccagattttctctat

SEQ ID NO: 18094 - DNA, 25 bp, Mus musculus
cgctcttggttgccatgtatatttt

SEQ ID NO: 18095 - DNA, 25 bp, Mus musculus
attttttgctggagcataacgatgg

SEQ ID NO: 18096 - DNA, 25 bp, Mus musculus
tttttgctggagcataacgatggga

SEQ ID NO: 18097 - DNA, 25 bp, Mus musculus
acattggtcgtcagctagcaatgta

SEQ ID NO: 18098 - DNA, 25 bp, Mus musculus
tggtcgtcagctagcaatgtatgaa

SEQ ID NO: 18099 - DNA, 25 bp, Mus musculus
gtcgtcagctagcaatgtatgaatg

SEQ ID NO: 18100 - DNA, 25 bp, Mus musculus
tgctgaaaaatctcatcaagaatga

SEQ ID NO: 18101 - DNA, 25 bp, Mus musculus
ctgaaaaatctcatcaagaatgaag

SEQ ID NO: 18102 - DNA, 25 bp, Mus musculus
agaagtctcagctgttgtgtggaag

SEQ ID NO: 18103 - DNA, 25 bp, Mus musculus
gaggacacagtttttccctgaatgg

SEQ ID NO: 18104 - DNA, 25 bp, Mus musculus
acacatctccagattttctctatgt

SEQ ID NO: 18105 - DNA, 25 bp, Mus musculus
acatctccagattttctctatgtcc

SEQ ID NO: 18106 - DNA, 25 bp, Mus musculus
atctccagattttctctatgtccgc

SEQ ID NO: 18107 - DNA, 25 bp, Mus musculus
ctccagattttctctatgtccgctc

SEQ ID NO: 18108 - DNA, 25 bp, Mus musculus
ccagattttctctatgtccgctctt

SEQ ID NO: 18109 - DNA, 25 bp, Mus musculus
agattttctctatgtccgctcttgg

SEQ ID NO: 18110 - DNA, 25 bp, Mus musculus
tctctatgtccgctcttggttgcca

SEQ ID NO: 18111 - DNA, 25 bp, Mus musculus
tccgctcttggttgccatgtatatt

SEQ ID NO: 18112 - DNA, 25 bp, Mus musculus
gctcgagtcccataagctccctgga

SEQ ID NO: 18113 - DNA, 25 bp, Mus musculus
gtcccataagctccctggatggtgg

SEQ ID NO: 18114 - DNA, 25 bp, Mus musculus
ggacactgcctatgggtactgtgta

SEQ ID NO: 18115 - DNA, 25 bp, Mus musculus
tgcctatgggtactgtgtagatcct

SEQ ID NO: 18116 - DNA, 25 bp, Mus musculus
gaccagctcagcctctacgtgttgg

SEQ ID NO: 18117 - DNA, 25 bp, Mus musculus
ctcagcctctacgtgttggacagca

SEQ ID NO: 18118 - DNA, 25 bp, Mus musculus
gacagcagccacccagctgtcatgc

SEQ ID NO: 18119 - DNA, 25 bp, Mus musculus
ccagctgtcatgcgcacctgtgaaa

SEQ ID NO: 18120 - DNA, 25 bp, Mus musculus
gcctctgtgttggcattcactttct

SEQ ID NO: 18121 - DNA, 25 bp, Mus musculus
caggagctgacagcctccttggaat

SEQ ID NO: 18122 - DNA, 25 bp, Mus musculus
ctgacagcctccttggaatactagc

SEQ ID NO: 18123 - DNA, 25 bp, Mus musculus
cagttcaaacccttgctggcaagtc

SEQ ID NO: 18124 - DNA, 25 bp, Mus musculus
gcagccactcaagcacaaagccttg

SEQ ID NO: 18125 - DNA, 25 bp, Mus musculus
gcacaaagccttgccaccatcaggc

SEQ ID NO: 18126 - DNA, 25 bp, Mus musculus
gccaccatcaggccaagaagtcatg

SEQ ID NO: 18127 - DNA, 25 bp, Mus musculus
gtgttcaccagcagcctgtaaagcg

SEQ ID NO: 18128 - DNA, 25 bp, Mus musculus
gccaaaacctgtctgtacacagtga

SEQ ID NO: 18129 - DNA, 25 bp, Mus musculus
gccttcactatggtgaatgtttact

SEQ ID NO: 18130 - DNA, 25 bp, Mus musculus
agggctgctgtttctctaggacact

SEQ ID NO: 18131 - DNA, 25 bp, Mus musculus
gctgtttctctaggacactgcctat

SEQ ID NO: 18132 - DNA, 25 bp, Mus musculus
tccgggtcacctttctgaagatttg

SEQ ID NO: 18133 - DNA, 25 bp, Mus musculus
tcacctttctgaagatttggaatga

SEQ ID NO: 18134 - DNA, 25 bp, Mus musculus
tcgatgaagacctcccagaggagaa

SEQ ID NO: 18135 - DNA, 25 bp, Mus musculus
cgatgaagacctcccagaggagaaa

SEQ ID NO: 18136 - DNA, 25 bp, Mus musculus
atgaagacctcccagaggagaaagc

SEQ ID NO: 18137 - DNA, 25 bp, Mus musculus
aagacctcccagaggagaaagctga

SEQ ID NO: 18138 - DNA, 25 bp, Mus musculus
agacctcccagaggagaaagctgag

SEQ ID NO: 18139 - DNA, 25 bp, Mus musculus
cctcccagaggagaaagctgaggac

SEQ ID NO: 18140 - DNA, 25 bp, Mus musculus
agcccatgcccagcggctctctgtt

SEQ ID NO: 18141 - DNA, 25 bp, Mus musculus
ccatgcccagcggctctctgttcaa

SEQ ID NO: 18142 - DNA, 25 bp, Mus musculus
catgcccagcggctctctgttcaac

SEQ ID NO: 18143 - DNA, 25 bp, Mus musculus
tgcccagcggctctctgttcaactc

SEQ ID NO: 18144 - DNA, 25 bp, Mus musculus
cacctttctgaagatttggaatgac

SEQ ID NO: 18145 - DNA, 25 bp, Mus musculus
atgaccacttccgatgccagcctaa

SEQ ID NO: 18146 - DNA, 25 bp, Mus musculus
tgaccacttccgatgccagcctaag

SEQ ID NO: 18147 - DNA, 25 bp, Mus musculus
atgccagcctaagcctcccatcgat

SEQ ID NO: 18148 - DNA, 25 bp, Mus musculus
gccagcctaagcctcccatcgatga

SEQ ID NO: 18149 - DNA, 25 bp, Mus musculus
ccagcctaagcctcccatcgatgaa

SEQ ID NO: 18150 - DNA, 25 bp, Mus musculus
ctaagcctcccatcgatgaagacct

SEQ ID NO: 18151 - DNA, 25 bp, Mus musculus
ccatcgatgaagacctcccagagga

SEQ ID NO: 18152 - DNA, 25 bp, Mus musculus
gcatgctgaagaccttgccgcctgt

SEQ ID NO: 18153 - DNA, 25 bp, Mus musculus
tgaagaccttgccgcctgtgcacct

SEQ ID NO: 18154 - DNA, 25 bp, Mus musculus
cccggcaggccacggagttctgcgt

SEQ ID NO: 18155 - DNA, 25 bp, Mus musculus
aggccacggagttctgcgtgcagcg

SEQ ID NO: 18156 - DNA, 25 bp, Mus musculus
tgcagcgcatccggctgatcctcac

SEQ ID NO: 18157 - DNA, 25 bp, Mus musculus
actaaaagacctcttgctcccatct

SEQ ID NO: 18158 - DNA, 25 bp, Mus musculus
cccatctgcgcgggcttccgttatg

SEQ ID NO: 18159 - DNA, 25 bp, Mus musculus
ggcttccgttatgagtgcgctccga

SEQ ID NO: 18160 - DNA, 25 bp, Mus musculus
cacctgtcactgagacagctggatc

SEQ ID NO: 18161 - DNA, 25 bp, Mus musculus
tcactgagacagctggatctgcact

SEQ ID NO: 18162 - DNA, 25 bp, Mus musculus
tctaccactgccttctgctgctgtg

SEQ ID NO: 18163 - DNA, 25 bp, Mus musculus
actgccttctgctgctgtgaccgac

SEQ ID NO: 18164 - DNA, 25 bp, Mus musculus
tgcaccttgtggcttgcgctctgga

SEQ ID NO: 18165 - DNA, 25 bp, Mus musculus
ttgtggcttgcgctctggaccccat

SEQ ID NO: 18166 - DNA, 25 bp, Mus musculus
accccatgctagatgactcggtcat

SEQ ID NO: 18167 - DNA, 25 bp, Mus musculus
tgctagatgactcggtcatgttcgc

SEQ ID NO: 18168 - DNA, 25 bp, Mus musculus
tgggccagccggtgacgctgaaagt

SEQ ID NO: 18169 - DNA, 25 bp, Mus musculus
aagatctgccgcatggcttcctgag

SEQ ID NO: 18170 - DNA, 25 bp, Mus musculus
atggcttcctgagcctggcggcact

SEQ ID NO: 18171 - DNA, 25 bp, Mus musculus
tcctgagcctggcggcactgtgtcg

SEQ ID NO: 18172 - DNA, 25 bp, Mus musculus
gggatgtctcagccttatctcccca

SEQ ID NO: 18173 - DNA, 25 bp, Mus musculus
atgtctcagccttatctccccaaga

SEQ ID NO: 18174 - DNA, 25 bp, Mus musculus
caaatgacctttctcagaagaggaa

SEQ ID NO: 18175 - DNA, 25 bp, Mus musculus
aatctggtgaagtcggagtgaccca

SEQ ID NO: 18176 - DNA, 25 bp, Mus musculus
tcggagtgacccagacctcgcaacc

SEQ ID NO: 18177 - DNA, 25 bp, Mus musculus
gagtgacccagacctcgcaaccggt

SEQ ID NO: 18178 - DNA, 25 bp, Mus musculus
gcagaagccacgaagccaccggaga

SEQ ID NO: 18179 - DNA, 25 bp, Mus musculus
gaagccacgaagccaccggagagta

SEQ ID NO: 18180 - DNA, 25 bp, Mus musculus
acgaagccaccggagagtatcctca

SEQ ID NO: 18181 - DNA, 25 bp, Mus musculus
aagccaccggagagtatcctcagcc

SEQ ID NO: 18182 - DNA, 25 bp, Mus musculus
ggattctgagaccgaggcagtgtat

SEQ ID NO: 18183 - DNA, 25 bp, Mus musculus
ttctgagaccgaggcagtgtatggg

SEQ ID NO: 18184 - DNA, 25 bp, Mus musculus
tctcagccttatctccccaagaact

SEQ ID NO: 18185 - DNA, 25 bp, Mus musculus
tatctccccaagaactggataaggt

SEQ ID NO: 18186 - DNA, 25 bp, Mus musculus
ttgacctccataattaggaagacgg

SEQ ID NO: 18187 - DNA, 25 bp, Mus musculus
tcaaactgtcctccaagtcctcttg

SEQ ID NO: 18188 - DNA, 25 bp, Mus musculus
cctccaagtcctcttgggtgtctgc

SEQ ID NO: 18189 - DNA, 25 bp, Mus musculus
agtcctcttgggtgtctgcaaatga

SEQ ID NO: 18190 - DNA, 25 bp, Mus musculus
cctcttgggtgtctgcaaatgacct

SEQ ID NO: 18191 - DNA, 25 bp, Mus musculus
ctgcaaatgacctttctcagaagag

SEQ ID NO: 18192 - DNA, 25 bp, Mus musculus
ggctttgccccaatatcctggagaa

SEQ ID NO: 18193 - DNA, 25 bp, Mus musculus
ctttgccccaatatcctggagaaca

SEQ ID NO: 18194 - DNA, 25 bp, Mus musculus
aagccattgacaaggctggctacac

SEQ ID NO: 18195 - DNA, 25 bp, Mus musculus
gccattgacaaggctggctacacgg

SEQ ID NO: 18196 - DNA, 25 bp, Mus musculus
ttgacaaggctggctacacggaaaa

SEQ ID NO: 18197 - DNA, 25 bp, Mus musculus
aggctggctacacggaaaagatggt

SEQ ID NO: 18198 - DNA, 25 bp, Mus musculus
gtggctgcctctgagttttaccgcg

SEQ ID NO: 18199 - DNA, 25 bp, Mus musculus
ggctgcctctgagttttaccgcgat

SEQ ID NO: 18200 - DNA, 25 bp, Mus musculus
gcctctgagttttaccgcgatggca

SEQ ID NO: 18201 - DNA, 25 bp, Mus musculus
ctctgagttttaccgcgatggcaaa

SEQ ID NO: 18202 - DNA, 25 bp, Mus musculus
ctgagttttaccgcgatggcaaata

SEQ ID NO: 18203 - DNA, 25 bp, Mus musculus
gagttttaccgcgatggcaaatacg

SEQ ID NO: 18204 - DNA, 25 bp, Mus musculus
ttgccccaatatcctggagaacagc

SEQ ID NO: 18205 - DNA, 25 bp, Mus musculus
gccccaatatcctggagaacagcga

SEQ ID NO: 18206 - DNA, 25 bp, Mus musculus
cccaatatcctggagaacagcgacg

SEQ ID NO: 18207 - DNA, 25 bp, Mus musculus
caatatcctggagaacagcgacgtt

SEQ ID NO: 18208 - DNA, 25 bp, Mus musculus
atatcctggagaacagcgacgtttg

SEQ ID NO: 18209 - DNA, 25 bp, Mus musculus
atcctggagaacagcgacgtttgga

SEQ ID NO: 18210 - DNA, 25 bp, Mus musculus
gagaacagcgacgtttggagctggt

SEQ ID NO: 18211 - DNA, 25 bp, Mus musculus
acagcgacgtttggagctggtgaag

SEQ ID NO: 18212 - DNA, 25 bp, Mus musculus
taactgtgtgctttcatttgctgca

SEQ ID NO: 18213 - DNA, 25 bp, Mus musculus
tgtgctttcatttgctgcaggagga

SEQ ID NO: 18214 - DNA, 25 bp, Mus musculus
agtacccatgcagtcctttgtttgg

SEQ ID NO: 18215 - DNA, 25 bp, Mus musculus
acccatgcagtcctttgtttggctt

SEQ ID NO: 18216 - DNA, 25 bp, Mus musculus
agtattcggtgtgagtcccatgttt

SEQ ID NO: 18217 - DNA, 25 bp, Mus musculus
ttaaggtgctacttgggtcagctga

SEQ ID NO: 18218 - DNA, 25 bp, Mus musculus
aggtgctacttgggtcagctgacat

SEQ ID NO: 18219 - DNA, 25 bp, Mus musculus
tgctacttgggtcagctgacatcta

SEQ ID NO: 18220 - DNA, 25 bp, Mus musculus
aatattggcagtgtggattgtgagg

SEQ ID NO: 18221 - DNA, 25 bp, Mus musculus
ttactgcttttgctaacagatactt

SEQ ID NO: 18222 - DNA, 25 bp, Mus musculus
acagatacttgctctttcactaaga

SEQ ID NO: 18223 - DNA, 25 bp, Mus musculus
atttcacacttcaactttgtatcca

SEQ ID NO: 18224 - DNA, 25 bp, Mus musculus
gctttcatttgctgcaggaggaagg

SEQ ID NO: 18225 - DNA, 25 bp, Mus musculus
ttcatttgctgcaggaggaaggact

SEQ ID NO: 18226 - DNA, 25 bp, Mus musculus
taattcagtccaaaactcagtagta

SEQ ID NO: 18227 - DNA, 25 bp, Mus musculus
ttcagtccaaaactcagtagtacta

SEQ ID NO: 18228 - DNA, 25 bp, Mus musculus
catttgctcgctttgctcttcacat

SEQ ID NO: 18229 - DNA, 25 bp, Mus musculus
gctttgctcttcacattgcatcact

SEQ ID NO: 18230 - DNA, 25 bp, Mus musculus
agttcctatcaagaaaagcgtcaat

SEQ ID NO: 18231 - DNA, 25 bp, Mus musculus
tagagtacccatgcagtcctttgtt

SEQ ID NO: 18232 - DNA, 25 bp, Mus musculus
agagccacaggtcccatgggcatgc

SEQ ID NO: 18233 - DNA, 25 bp, Mus musculus
agccacaggtcccatgggcatgcgc

SEQ ID NO: 18234 - DNA, 25 bp, Mus musculus
tgattcgcctggtgaatggctctgg

SEQ ID NO: 18235 - DNA, 25 bp, Mus musculus
attcgcctggtgaatggctctggcc

SEQ ID NO: 18236 - DNA, 25 bp, Mus musculus
tcgcctggtgaatggctctggccca

SEQ ID NO: 18237 - DNA, 25 bp, Mus musculus
gaggtattccacgatcgtcgctggg

SEQ ID NO: 18238 - DNA, 25 bp, Mus musculus
ttccacgatcgtcgctggggcacag

SEQ ID NO: 18239 - DNA, 25 bp, Mus musculus
ccacgatcgtcgctggggcacagtg

SEQ ID NO: 18240 - DNA, 25 bp, Mus musculus
tgtgccgcatgctgggcttccacag

SEQ ID NO: 18241 - DNA, 25 bp, Mus musculus
tgcaccggacagctcgttttgggca

SEQ ID NO: 18242 - DNA, 25 bp, Mus musculus
ggacagctcgttttgggcaaggaca

SEQ ID NO: 18243 - DNA, 25 bp, Mus musculus
ttttgggcaaggacagggaggatct

SEQ ID NO: 18244 - DNA, 25 bp, Mus musculus
aggtcccatgggcatgcgcggattc

SEQ ID NO: 18245 - DNA, 25 bp, Mus musculus
gtcccatgggcatgcgcggattcaa

SEQ ID NO: 18246 - DNA, 25 bp, Mus musculus
cccatgggcatgcgcggattcaaag

SEQ ID NO: 18247 - DNA, 25 bp, Mus musculus
tgggcatgcgcggattcaaaggtga

SEQ ID NO: 18248 - DNA, 25 bp, Mus musculus
gatttcacaatgattcgcctggtga

SEQ ID NO: 18249 - DNA, 25 bp, Mus musculus
tttcacaatgattcgcctggtgaat

SEQ ID NO: 18250 - DNA, 25 bp, Mus musculus
tcacaatgattcgcctggtgaatgg

SEQ ID NO: 18251 - DNA, 25 bp, Mus musculus
acaatgattcgcctggtgaatggct

SEQ ID NO: 18252 - DNA, 25 bp, Mus musculus
gtgcctctggctgactgcgtgctga

SEQ ID NO: 18253 - DNA, 25 bp, Mus musculus
gatatagatacctaccgggcagcct

SEQ ID NO: 18254 - DNA, 25 bp, Mus musculus
aagggtcccagtgcctgaggccact

SEQ ID NO: 18255 - DNA, 25 bp, Mus musculus
tgaggccactggcagcgaatcgcct

SEQ ID NO: 18256 - DNA, 25 bp, Mus musculus
aaagccttgctccacagctttctaa

SEQ ID NO: 18257 - DNA, 25 bp, Mus musculus
ttgctccacagctttctaacacgga

SEQ ID NO: 18258 - DNA, 25 bp, Mus musculus
cggaccatgttgcttctatctaata

SEQ ID NO: 18259 - DNA, 25 bp, Mus musculus
accatgttgcttctatctaatacct

SEQ ID NO: 18260 - DNA, 25 bp, Mus musculus
ttgcttctatctaatacctggtcac

SEQ ID NO: 18261 - DNA, 25 bp, Mus musculus
ctatctaatacctggtcacagtcac

SEQ ID NO: 18262 - DNA, 25 bp, Mus musculus
aatacctggtcacagtcacaaggga

SEQ ID NO: 18263 - DNA, 25 bp, Mus musculus
ctattttcagcaccaacatccatcc

SEQ ID NO: 18264 - DNA, 25 bp, Mus musculus
ctgctgaaaccaggagggcacctgg

SEQ ID NO: 18265 - DNA, 25 bp, Mus musculus
gctattcaagatgctggctgtcagg

SEQ ID NO: 18266 - DNA, 25 bp, Mus musculus
caagatgctggctgtcaggtgctga

SEQ ID NO: 18267 - DNA, 25 bp, Mus musculus
gctggctgtcaggtgctgaagtgca

SEQ ID NO: 18268 - DNA, 25 bp, Mus musculus
gtctccctcagctactcggaggctt

SEQ ID NO: 18269 - DNA, 25 bp, Mus musculus
tactcggaggcttactgctcccacg

SEQ ID NO: 18270 - DNA, 25 bp, Mus musculus
tactgctcccacgacggtttgtgct

SEQ ID NO: 18271 - DNA, 25 bp, Mus musculus
tgctcccacgacggtttgtgctttg

SEQ ID NO: 18272 - DNA, 25 bp, Mus musculus
tccttcctggccactgacaaaacct

SEQ ID NO: 18273 - DNA, 25 bp, Mus musculus
actgacaaaacctgggagcacacct

SEQ ID NO: 18274 - DNA, 25 bp, Mus musculus
ccaacccaatctgtctcagacacaa

SEQ ID NO: 18275 - DNA, 25 bp, Mus musculus
caatctgtctcagacacaaagcttg

SEQ ID NO: 18276 - DNA, 25 bp, Mus musculus
gacacaaagcttgaccacgtgaaag

SEQ ID NO: 18277 - DNA, 25 bp, Mus musculus
atcattcctgaaaacaggatcttgg

SEQ ID NO: 18278 - DNA, 25 bp, Mus musculus
aacaggatcttggctacctgttggt

SEQ ID NO: 18279 - DNA, 25 bp, Mus musculus
atcttggctacctgttggttctgta

SEQ ID NO: 18280 - DNA, 25 bp, Mus musculus
atttattccctggtgatccgctctt

SEQ ID NO: 18281 - DNA, 25 bp, Mus musculus
tccctggtgatccgctctttccaag

SEQ ID NO: 18282 - DNA, 25 bp, Mus musculus
gtgatccgctctttccaagacttca

SEQ ID NO: 18283 - DNA, 25 bp, Mus musculus
cgctctttccaagacttcaataaat

SEQ ID NO: 18284 - DNA, 25 bp, Mus musculus
gtctccagatcattctgttctggaa

SEQ ID NO: 18285 - DNA, 25 bp, Mus musculus
ttctgttctggaatgccgtgtgttg

SEQ ID NO: 18286 - DNA, 25 bp, Mus musculus
cgtagcctctaaatgcgagaacaat

SEQ ID NO: 18287 - DNA, 25 bp, Mus musculus
atgcgagaacaattccccttcggag

SEQ ID NO: 18288 - DNA, 25 bp, Mus musculus
gaacaattccccttcggaggcacag

SEQ ID NO: 18289 - DNA, 25 bp, Mus musculus
ttgtgcaccgtgaacagacaccttt

SEQ ID NO: 18290 - DNA, 25 bp, Mus musculus
aacagacacctttgccaaacagact

SEQ ID NO: 18291 - DNA, 25 bp, Mus musculus
acagactgtggtcccgagcagggtc

SEQ ID NO: 18292 - DNA, 25 bp, Mus musculus
ctcggccaccgcagaacttgggctc

SEQ ID NO: 18293 - DNA, 25 bp, Mus musculus
cggccaccgcagaacttgggctcga

SEQ ID NO: 18294 - DNA, 25 bp, Mus musculus
cagctccagagccggtttagtctcc

SEQ ID NO: 18295 - DNA, 25 bp, Mus musculus
cggtttagtctccactgccagctgc

SEQ ID NO: 18296 - DNA, 25 bp, Mus musculus
gtttagtctccactgccagctgcca

SEQ ID NO: 18297 - DNA, 25 bp, Mus musculus
ttagtctccactgccagctgccatg

SEQ ID NO: 18298 - DNA, 25 bp, Mus musculus
cactgccagctgccatgggaagcag

SEQ ID NO: 18299 - DNA, 25 bp, Mus musculus
ctgccagctgccatgggaagcagaa

SEQ ID NO: 18300 - DNA, 25 bp, Mus musculus
gccagctgccatgggaagcagaaca

SEQ ID NO: 18301 - DNA, 25 bp, Mus musculus
cagctgccatgggaagcagaacagc

SEQ ID NO: 18302 - DNA, 25 bp, Mus musculus
acagcaagctgcgtcctgaggtgct

SEQ ID NO: 18303 - DNA, 25 bp, Mus musculus
aggtgctgcaggacctgcgggaaca

SEQ ID NO: 18304 - DNA, 25 bp, Mus musculus
gccaccgcagaacttgggctcgaga

SEQ ID NO: 18305 - DNA, 25 bp, Mus musculus
gtgctgcaggacctgcgggaacaca

SEQ ID NO: 18306 - DNA, 25 bp, Mus musculus
caccgcagaacttgggctcgagaag

SEQ ID NO: 18307 - DNA, 25 bp, Mus musculus
ccgcagaacttgggctcgagaagcc

SEQ ID NO: 18308 - DNA, 25 bp, Mus musculus
agaacttgggctcgagaagccagcg

SEQ ID NO: 18309 - DNA, 25 bp, Mus musculus
aacttgggctcgagaagccagcgga

SEQ ID NO: 18310 - DNA, 25 bp, Mus musculus
cgcgtccagctccagagccggttta

SEQ ID NO: 18311 - DNA, 25 bp, Mus musculus
cgtccagctccagagccggtttagt

SEQ ID NO: 18312 - DNA, 25 bp, Mus musculus
tccagctccagagccggtttagtct

SEQ ID NO: 18313 - DNA, 25 bp, Mus musculus
tggtacctcagctttgagacttttt

SEQ ID NO: 18314 - DNA, 25 bp, Mus musculus
tttcccagggaccagtgcaggcaca

SEQ ID NO: 18315 - DNA, 25 bp, Mus musculus
tctgtgccatctgtgagggaaggac

SEQ ID NO: 18316 - DNA, 25 bp, Mus musculus
gtgccatctgtgagggaaggacctg

SEQ ID NO: 18317 - DNA, 25 bp, Mus musculus
ctctcctagggacctttcatctggg

SEQ ID NO: 18318 - DNA, 25 bp, Mus musculus
ttcatctgggtcaaccaacctagca

SEQ ID NO: 18319 - DNA, 25 bp, Mus musculus
atctgggtcaaccaacctagcaggt

SEQ ID NO: 18320 - DNA, 25 bp, Mus musculus
tgggtcaaccaacctagcaggtgtc

SEQ ID NO: 18321 - DNA, 25 bp, Mus musculus
aggtgtcatttctcggctggactgg

SEQ ID NO: 18322 - DNA, 25 bp, Mus musculus
tgtcatttctcggctggactgggta

SEQ ID NO: 18323 - DNA, 25 bp, Mus musculus
aggcaccagtgttccgtgcacctat

SEQ ID NO: 18324 - DNA, 25 bp, Mus musculus
caccagtgttccgtgcacctattta

SEQ ID NO: 18325 - DNA, 25 bp, Mus musculus
ttgttgtttcctgactttgcccaag

SEQ ID NO: 18326 - DNA, 25 bp, Mus musculus
cctgactttgcccaagaacagtaca

SEQ ID NO: 18327 - DNA, 25 bp, Mus musculus
gactttgcccaagaacagtacaatg

SEQ ID NO: 18328 - DNA, 25 bp, Mus musculus
tttgcccaagaacagtacaatggtt

SEQ ID NO: 18329 - DNA, 25 bp, Mus musculus
tggttacttcgcctccagggagagc

SEQ ID NO: 18330 - DNA, 25 bp, Mus musculus
ggcggtcacagagcttggaggactc

SEQ ID NO: 18331 - DNA, 25 bp, Mus musculus
ttgaggtctgtgccatctgtgaggg

SEQ ID NO: 18332 - DNA, 25 bp, Mus musculus
aggtctgtgccatctgtgagggaag

SEQ ID NO: 18333 - DNA, 25 bp, Mus musculus
gagaacctctcagaaatagaccaca

SEQ ID NO: 18334 - DNA, 25 bp, Mus musculus
gaccacaccaggcttctttaccaag

SEQ ID NO: 18335 - DNA, 25 bp, Mus musculus
atggtccacagcctgctcttgtgga

SEQ ID NO: 18336 - DNA, 25 bp, Mus musculus
tctggagctgcaccatcttataggc

SEQ ID NO: 18337 - DNA, 25 bp, Mus musculus
gctgcaccatcttataggcctcatg

SEQ ID NO: 18338 - DNA, 25 bp, Mus musculus
ccatcttataggcctcatgacatat

SEQ ID NO: 18339 - DNA, 25 bp, Mus musculus
tgtctatggctttcctcagggtgta

SEQ ID NO: 18340 - DNA, 25 bp, Mus musculus
tggctttcctcagggtgtagggcac

SEQ ID NO: 18341 - DNA, 25 bp, Mus musculus
ggcaggcactcagcattgttttcct

SEQ ID NO: 18342 - DNA, 25 bp, Mus musculus
cactcagcattgttttcctaacaaa

SEQ ID NO: 18343 - DNA, 25 bp, Mus musculus
gcattgttttcctaacaaagcagat

SEQ ID NO: 18344 - DNA, 25 bp, Mus musculus
ttttcctaacaaagcagatacacat

SEQ ID NO: 18345 - DNA, 25 bp, Mus musculus
caggcacagggacttctgggtattc

SEQ ID NO: 18346 - DNA, 25 bp, Mus musculus
ctgacatcaccacctgtttttctac

SEQ ID NO: 18347 - DNA, 25 bp, Mus musculus
tttctactttcatcatttgtaacaa

SEQ ID NO: 18348 - DNA, 25 bp, Mus musculus
ctttcatcatttgtaacaaactcgt

SEQ ID NO: 18349 - DNA, 25 bp, Mus musculus
tcatttgtaacaaactcgtgataag

SEQ ID NO: 18350 - DNA, 25 bp, Mus musculus
ctttctgctctgacagtagaggtgg

SEQ ID NO: 18351 - DNA, 25 bp, Mus musculus
caggtttccttgcccagaagaggtg

SEQ ID NO: 18352 - DNA, 25 bp, Mus musculus
tccttgcccagaagaggtgaggcaa

SEQ ID NO: 18353 - DNA, 25 bp, Mus musculus
aagcctgaactcaccgaagatcaaa

SEQ ID NO: 18354 - DNA, 25 bp, Mus musculus
cctgaactcaccgaagatcaaaagc

SEQ ID NO: 18355 - DNA, 25 bp, Mus musculus
tcattcaaaaacctcaagcgtgtgg

SEQ ID NO: 18356 - DNA, 25 bp, Mus musculus
ttcaaaaacctcaagcgtgtggcca

SEQ ID NO: 18357 - DNA, 25 bp, Mus musculus
ctcaagcgtgtggccaatgagctgg

SEQ ID NO: 18358 - DNA, 25 bp, Mus musculus
gaaagcctcacagacgaggagctgc

SEQ ID NO: 18359 - DNA, 25 bp, Mus musculus
agcctcacagacgaggagctgcagg

SEQ ID NO: 18360 - DNA, 25 bp, Mus musculus
aacctttattaagtgactggctgag

SEQ ID NO: 18361 - DNA, 25 bp, Mus musculus
ccctgcttctgcttttgtgaaagta

SEQ ID NO: 18362 - DNA, 25 bp, Mus musculus
tgcctcctttgtcttggttggcttc

SEQ ID NO: 18363 - DNA, 25 bp, Mus musculus
ggttggcttctaagcctctagatca

SEQ ID NO: 18364 - DNA, 25 bp, Mus musculus
tggcttctaagcctctagatcaatt

SEQ ID NO: 18365 - DNA, 25 bp, Mus musculus
gaactcaccgaagatcaaaagcaag

SEQ ID NO: 18366 - DNA, 25 bp, Mus musculus
gacctcttcgattctgatgggagcg

SEQ ID NO: 18367 - DNA, 25 bp, Mus musculus
gcacttggctttgaacccaggaagg

SEQ ID NO: 18368 - DNA, 25 bp, Mus musculus
aagatcagcttcaatgacttcttgg

SEQ ID NO: 18369 - DNA, 25 bp, Mus musculus
ttcaatgacttcttggctgtgatga

SEQ ID NO: 18370 - DNA, 25 bp, Mus musculus
aatgacttcttggctgtgatgactc

SEQ ID NO: 18371 - DNA, 25 bp, Mus musculus
gacttcttggctgtgatgactcaga

SEQ ID NO: 18372 - DNA, 25 bp, Mus musculus
aaggctttcaggttgtttgatgacg

SEQ ID NO: 18373 - DNA, 25 bp, Mus musculus
tcttctaaactcatcgggtttgtag

SEQ ID NO: 18374 - DNA, 25 bp, Mus musculus
aaggtcttcagaactgagtgtcaat

SEQ ID NO: 18375 - DNA, 25 bp, Mus musculus
cgactgccatctaaatcattgaaat

SEQ ID NO: 18376 - DNA, 25 bp, Mus musculus
actgccatctaaatcattgaaatat

SEQ ID NO: 18377 - DNA, 25 bp, Mus musculus
aaggcagcctaagtgccatttgaag

SEQ ID NO: 18378 - DNA, 25 bp, Mus musculus
cagcctaagtgccatttgaagtcag

SEQ ID NO: 18379 - DNA, 25 bp, Mus musculus
tttgaagtcagaaccacaggaatat

SEQ ID NO: 18380 - DNA, 25 bp, Mus musculus
cagaaccacaggaatatccatacga

SEQ ID NO: 18381 - DNA, 25 bp, Mus musculus
catacgagtgacagccattggttga

SEQ ID NO: 18382 - DNA, 25 bp, Mus musculus
cgagtgacagccattggttgagaag

SEQ ID NO: 18383 - DNA, 25 bp, Mus musculus
agtgacagccattggttgagaagag

SEQ ID NO: 18384 - DNA, 25 bp, Mus musculus
tgacagccattggttgagaagagaa

SEQ ID NO: 18385 - DNA, 25 bp, Mus musculus
gagtgacctggactacaggattgat

SEQ ID NO: 18386 - DNA, 25 bp, Mus musculus
gaaggcatcttccacttatagtggt

SEQ ID NO: 18387 - DNA, 25 bp, Mus musculus
atcttccacttatagtggtgcattc

SEQ ID NO: 18388 - DNA, 25 bp, Mus musculus
tccacttatagtggtgcattcccac

SEQ ID NO: 18389 - DNA, 25 bp, Mus musculus
agcaaactgctgtagactgaggaac

SEQ ID NO: 18390 - DNA, 25 bp, Mus musculus
gaaagagaaacaccctcgactgcca

SEQ ID NO: 18391 - DNA, 25 bp, Mus musculus
caccctcgactgccatctaaatcat

SEQ ID NO: 18392 - DNA, 25 bp, Mus musculus
ctcgactgccatctaaatcattgaa

SEQ ID NO: 18393 - DNA, 25 bp, Mus musculus
tttcagctcagccttgagtccattg

SEQ ID NO: 18394 - DNA, 25 bp, Mus musculus
ctcagccttgagtccattgccaaaa

SEQ ID NO: 18395 - DNA, 25 bp, Mus musculus
actttgcgctgggtcattcccaaga

SEQ ID NO: 18396 - DNA, 25 bp, Mus musculus
gctttgctgctagaacctgttgtgg

SEQ ID NO: 18397 - DNA, 25 bp, Mus musculus
gaacctgttgtggctgcgtttcctg

SEQ ID NO: 18398 - DNA, 25 bp, Mus musculus
agtgacaactgtgtaaccagaatag

SEQ ID NO: 18399 - DNA, 25 bp, Mus musculus
gtaaccagaatagctgcatggcgct

SEQ ID NO: 18400 - DNA, 25 bp, Mus musculus
tggcgctgaccctttggtcggaact

SEQ ID NO: 18401 - DNA, 25 bp, Mus musculus
cagtgctgcccatgtccagcacaac

SEQ ID NO: 18402 - DNA, 25 bp, Mus musculus
tcaggacccagctcacctctgtcaa

SEQ ID NO: 18403 - DNA, 25 bp, Mus musculus
ggccaatccaataagcaccatgcag

SEQ ID NO: 18404 - DNA, 25 bp, Mus musculus
tccaataagcaccatgcagcaacct

SEQ ID NO: 18405 - DNA, 25 bp, Mus musculus
cttgagtccattgccaaaattcagc

SEQ ID NO: 18406 - DNA, 25 bp, Mus musculus
agcaccatgcagcaaccttgattta

SEQ ID NO: 18407 - DNA, 25 bp, Mus musculus
attcagcatacctgccagcaacttg

SEQ ID NO: 18408 - DNA, 25 bp, Mus musculus
catacctgccagcaacttgggggat

SEQ ID NO: 18409 - DNA, 25 bp, Mus musculus
tgccagcaacttgggggataagcca

SEQ ID NO: 18410 - DNA, 25 bp, Mus musculus
agagtatccccacaagcgggagaga

SEQ ID NO: 18411 - DNA, 25 bp, Mus musculus
tccccacaagcgggagagaaggcaa

SEQ ID NO: 18412 - DNA, 25 bp, Mus musculus
ctgtctccaaaacacatctgctttg

SEQ ID NO: 18413 - DNA, 25 bp, Mus musculus
agaacctccgcacaaaagtgcaggt

SEQ ID NO: 18414 - DNA, 25 bp, Mus musculus
gtcctgtaaggagctgcaggaactg

SEQ ID NO: 18415 - DNA, 25 bp, Mus musculus
taaatggtgcctgctgaccatcatc

SEQ ID NO: 18416 - DNA, 25 bp, Mus musculus
ggacgacctgcgcacgaagttcttg

SEQ ID NO: 18417 - DNA, 25 bp, Mus musculus
cgacctgcgcacgaagttcttggtg

SEQ ID NO: 18418 - DNA, 25 bp, Mus musculus
tgacgtgcgtgtgctgcacctggct

SEQ ID NO: 18419 - DNA, 25 bp, Mus musculus
gctgcacctggctcacaaggatctc

SEQ ID NO: 18420 - DNA, 25 bp, Mus musculus
gcacctggctcacaaggatctcaca

SEQ ID NO: 18421 - DNA, 25 bp, Mus musculus
ggctcacaaggatctcacagtgctc

SEQ ID NO: 18422 - DNA, 25 bp, Mus musculus
tcacaaggatctcacagtgctctgc

SEQ ID NO: 18423 - DNA, 25 bp, Mus musculus
caaggatctcacagtgctctgccat

SEQ ID NO: 18424 - DNA, 25 bp, Mus musculus
tctcacagtgctctgccatttggaa

SEQ ID NO: 18425 - DNA, 25 bp, Mus musculus
cacagtgctctgccatttggaacaa

SEQ ID NO: 18426 - DNA, 25 bp, Mus musculus
atggtgcctgctgaccatcatcctc

SEQ ID NO: 18427 - DNA, 25 bp, Mus musculus
ccatttggaacaactgctcttggtc

SEQ ID NO: 18428 - DNA, 25 bp, Mus musculus
gtgcctgctgaccatcatcctcctg

SEQ ID NO: 18429 - DNA, 25 bp, Mus musculus
gaccatcatcctcctgatgagggca

SEQ ID NO: 18430 - DNA, 25 bp, Mus musculus
catcatcctcctgatgagggcactg

SEQ ID NO: 18431 - DNA, 25 bp, Mus musculus
catcctcctgatgagggcactggac

SEQ ID NO: 18432 - DNA, 25 bp, Mus musculus
cctcctgatgagggcactggacccc

SEQ ID NO: 18433 - DNA, 25 bp, Mus musculus
ctacttggacgacctgcgcacgaag

SEQ ID NO: 18434 - DNA, 25 bp, Mus musculus
cttggacgacctgcgcacgaagttc

SEQ ID NO: 18435 - DNA, 25 bp, Mus musculus
atcctctctccagacagacaataca

SEQ ID NO: 18436 - DNA, 25 bp, Mus musculus
tctccagacagacaatacatcaagg

SEQ ID NO: 18437 - DNA, 25 bp, Mus musculus
tttgtacctggtttcactcaagaat

SEQ ID NO: 18438 - DNA, 25 bp, Mus musculus
cctggtttcactcaagaatctcaat

SEQ ID NO: 18439 - DNA, 25 bp, Mus musculus
aggcttcaggaaaccccactggcat

SEQ ID NO: 18440 - DNA, 25 bp, Mus musculus
caggaaaccccactggcatgccctt

SEQ ID NO: 18441 - DNA, 25 bp, Mus musculus
ctggcatgcccttttggcctaatta

SEQ ID NO: 18442 - DNA, 25 bp, Mus musculus
attgttacttcaattctatctactg

SEQ ID NO: 18443 - DNA, 25 bp, Mus musculus
acttcaattctatctactgagctag

SEQ ID NO: 18444 - DNA, 25 bp, Mus musculus
attctatctactgagctaggggcat

SEQ ID NO: 18445 - DNA, 25 bp, Mus musculus
tctactgagctaggggcatattatt

SEQ ID NO: 18446 - DNA, 25 bp, Mus musculus
tattattcttcattcgacaatatta

SEQ ID NO: 18447 - DNA, 25 bp, Mus musculus
caggagcccctgcttgatgtgctac

SEQ ID NO: 18448 - DNA, 25 bp, Mus musculus
cccctgcttgatgtgctacaaaagc

SEQ ID NO: 18449 - DNA, 25 bp, Mus musculus
aagatgtaccagcctgagaacccac

SEQ ID NO: 18450 - DNA, 25 bp, Mus musculus
cctgagaacccacagcatttcgcct

SEQ ID NO: 18451 - DNA, 25 bp, Mus musculus
acattcaaccatcaccacgctgaga

SEQ ID NO: 18452 - DNA, 25 bp, Mus musculus
aaccatcaccacgctgagatgctga

SEQ ID NO: 18453 - DNA, 25 bp, Mus musculus
ctcctctgtgagatctgggatgtgc

SEQ ID NO: 18454 - DNA, 25 bp, Mus musculus
tgtcctcctcggaacagaaaccttg

SEQ ID NO: 18455 - DNA, 25 bp, Mus musculus
tggaccacctgacaggatggttggt

SEQ ID NO: 18456 - DNA, 25 bp, Mus musculus
accacctgacaggatggttggtctc

SEQ ID NO: 18457 - DNA, 25 bp, Mus musculus
tgacctcgctgtcagagagctggta

SEQ ID NO: 18458 - DNA, 25 bp, Mus musculus
cctcgctgtcagagagctggtataa

SEQ ID NO: 18459 - DNA, 25 bp, Mus musculus
agagctggtataacctcctgttgga

SEQ ID NO: 18460 - DNA, 25 bp, Mus musculus
ggtataacctcctgttggacatgca

SEQ ID NO: 18461 - DNA, 25 bp, Mus musculus
ataacctcctgttggacatgcagaa

SEQ ID NO: 18462 - DNA, 25 bp, Mus musculus
acctcctgttggacatgcagaaccg

SEQ ID NO: 18463 - DNA, 25 bp, Mus musculus
acatgcagaaccgatccataaaggt

SEQ ID NO: 18464 - DNA, 25 bp, Mus musculus
agaaccgatccataaaggtcatcaa

SEQ ID NO: 18465 - DNA, 25 bp, Mus musculus
taaaggtcatcaaaaccttggccag

SEQ ID NO: 18466 - DNA, 25 bp, Mus musculus
ttgggcactccttctggagatcctt

SEQ ID NO: 18467 - DNA, 25 bp, Mus musculus
atggctccctagttatgcagaatct

SEQ ID NO: 18468 - DNA, 25 bp, Mus musculus
tgggcactccttctggagatccttt

SEQ ID NO: 18469 - DNA, 25 bp, Mus musculus
ctacccctacacagggctcggtgct

SEQ ID NO: 18470 - DNA, 25 bp, Mus musculus
ctacacagggctcggtgctctttgg

SEQ ID NO: 18471 - DNA, 25 bp, Mus musculus
cacagggctcggtgctctttggcac

SEQ ID NO: 18472 - DNA, 25 bp, Mus musculus
cggtgctctttggcacagtcaacgg

SEQ ID NO: 18473 - DNA, 25 bp, Mus musculus
tctttggcacagtcaacggcatgat

SEQ ID NO: 18474 - DNA, 25 bp, Mus musculus
gcacagtcaacggcatgatagggct

SEQ ID NO: 18475 - DNA, 25 bp, Mus musculus
cagtcaacggcatgatagggctggt

SEQ ID NO: 18476 - DNA, 25 bp, Mus musculus
cctctcctacacgaggatcaagcgc

SEQ ID NO: 18477 - DNA, 25 bp, Mus musculus
acgcatgctcatgaagctggtgagc

SEQ ID NO: 18478 - DNA, 25 bp, Mus musculus
ttggtggtgtcttcttgaagatgga

SEQ ID NO: 18479 - DNA, 25 bp, Mus musculus
agtccctcgggctcagcctcaaact

SEQ ID NO: 18480 - DNA, 25 bp, Mus musculus
tcgggctcagcctcaaactcagcgg

SEQ ID NO: 18481 - DNA, 25 bp, Mus musculus
gcctcaaactcagcggcagttggca

SEQ ID NO: 18482 - DNA, 25 bp, Mus musculus
tcaaactcagcggcagttggcacta

SEQ ID NO: 18483 - DNA, 25 bp, Mus musculus
tcagcggcagttggcactaagaagg

SEQ ID NO: 18484 - DNA, 25 bp, Mus musculus
ccattgagtcttccaagagtggtga

SEQ ID NO: 18485 - DNA, 25 bp, Mus musculus
agggtcacaggtcctagcctctgac

SEQ ID NO: 18486 - DNA, 25 bp, Mus musculus
accacaccatgcaccttgagtggag

SEQ ID NO: 18487 - DNA, 25 bp, Mus musculus
tgcaccttgagtggagagaggttag

SEQ ID NO: 18488 - DNA, 25 bp, Mus musculus
cagctccgtgcactcggagcaggtc

SEQ ID NO: 18489 - DNA, 25 bp, Mus musculus
cgtgcactcggagcaggtctttgca

SEQ ID NO: 18490 - DNA, 25 bp, Mus musculus
gcactcggagcaggtctttgcattg

SEQ ID NO: 18491 - DNA, 25 bp, Mus musculus
ggtctttgcattgcgactccaggac

SEQ ID NO: 18492 - DNA, 25 bp, Mus musculus
ctttgcattgcgactccaggacaag

SEQ ID NO: 18493 - DNA, 25 bp, Mus musculus
attgcgactccaggacaagaagctg

SEQ ID NO: 18494 - DNA, 25 bp, Mus musculus
gtccgagatctgggatgtgcacgag

SEQ ID NO: 18495 - DNA, 25 bp, Mus musculus
gccttggtggtgtcttcttgaagat

SEQ ID NO: 18496 - DNA, 25 bp, Mus musculus
tttctgataggcacatcatgatcag

SEQ ID NO: 18497 - DNA, 25 bp, Mus musculus
ttctgataggcacatcatgatcagt

SEQ ID NO: 18498 - DNA, 25 bp, Mus musculus
ttgtactatgggtcacatggaactg

SEQ ID NO: 18499 - DNA, 25 bp, Mus musculus
aactgagcaaacatccaacattttg

SEQ ID NO: 18500 - DNA, 25 bp, Mus musculus
actgagcaaacatccaacattttgg

SEQ ID NO: 18501 - DNA, 25 bp, Mus musculus
tgagcaaacatccaacattttggca

SEQ ID NO: 18502 - DNA, 25 bp, Mus musculus
gagcaaacatccaacattttggcaa

SEQ ID NO: 18503 - DNA, 25 bp, Mus musculus
gcaaacatccaacattttggcaagc

SEQ ID NO: 18504 - DNA, 25 bp, Mus musculus
aacatccaacattttggcaagcagc

SEQ ID NO: 18505 - DNA, 25 bp, Mus musculus
acatccaacattttggcaagcagct

SEQ ID NO: 18506 - DNA, 25 bp, Mus musculus
tccaacattttggcaagcagctaaa

SEQ ID NO: 18507 - DNA, 25 bp, Mus musculus
aacattttggcaagcagctaaaagg

SEQ ID NO: 18508 - DNA, 25 bp, Mus musculus
acatcatgatcagtgaccaaagaca

SEQ ID NO: 18509 - DNA, 25 bp, Mus musculus
catcatgatcagtgaccaaagacac

SEQ ID NO: 18510 - DNA, 25 bp, Mus musculus
tgaccaaagacacaactgaccatag

SEQ ID NO: 18511 - DNA, 25 bp, Mus musculus
accaaagacacaactgaccataggt

SEQ ID NO: 18512 - DNA, 25 bp, Mus musculus
ccaaagacacaactgaccataggta

SEQ ID NO: 18513 - DNA, 25 bp, Mus musculus
aagacacaactgaccataggtaccg

SEQ ID NO: 18514 - DNA, 25 bp, Mus musculus
gacacaactgaccataggtaccggg

SEQ ID NO: 18515 - DNA, 25 bp, Mus musculus
cttgtactatgggtcacatggaact

SEQ ID NO: 18516 - DNA, 25 bp, Mus musculus
gagcggcccatcttttggagaggac

SEQ ID NO: 18517 - DNA, 25 bp, Mus musculus
cccatcttttggagaggactgctat

SEQ ID NO: 18518 - DNA, 25 bp, Mus musculus
ccgtaccaggtcttgtagcagtgct

SEQ ID NO: 18519 - DNA, 25 bp, Mus musculus
taccaggtcttgtagcagtgcttcc

SEQ ID NO: 18520 - DNA, 25 bp, Mus musculus
gtcttgtagcagtgcttcctcgaga

SEQ ID NO: 18521 - DNA, 25 bp, Mus musculus
ttgtagcagtgcttcctcgagaagc

SEQ ID NO: 18522 - DNA, 25 bp, Mus musculus
ttcctcgagaagccaacagagcagt

SEQ ID NO: 18523 - DNA, 25 bp, Mus musculus
tgacaaggagggccacctggtgtgc

SEQ ID NO: 18524 - DNA, 25 bp, Mus musculus
tgtgccggatcggcgattggctcca

SEQ ID NO: 18525 - DNA, 25 bp, Mus musculus
gtgccggatcggcgattggctccaa

SEQ ID NO: 18526 - DNA, 25 bp, Mus musculus
tgccggatcggcgattggctccaag

SEQ ID NO: 18527 - DNA, 25 bp, Mus musculus
gatcggcgattggctccaagagcga

SEQ ID NO: 18528 - DNA, 25 bp, Mus musculus
ctgctatgggtcttcacgttctcga

SEQ ID NO: 18529 - DNA, 25 bp, Mus musculus
ctatgggtcttcacgttctcgacat

SEQ ID NO: 18530 - DNA, 25 bp, Mus musculus
tgggtcttcacgttctcgacatctg

SEQ ID NO: 18531 - DNA, 25 bp, Mus musculus
ttcacgttctcgacatctgagacgg

SEQ ID NO: 18532 - DNA, 25 bp, Mus musculus
acgttctcgacatctgagacggtca

SEQ ID NO: 18533 - DNA, 25 bp, Mus musculus
ttctcgacatctgagacggtcacga

SEQ ID NO: 18534 - DNA, 25 bp, Mus musculus
tcgacatctgagacggtcacgagag

SEQ ID NO: 18535 - DNA, 25 bp, Mus musculus
acgccgtaccaggtcttgtagcagt

SEQ ID NO: 18536 - DNA, 25 bp, Mus musculus
catctggtcaatcaacaccaccagc

SEQ ID NO: 18537 - DNA, 25 bp, Mus musculus
gggttacattgcttcagttggtggg

SEQ ID NO: 18538 - DNA, 25 bp, Mus musculus
caagctctgtgctgccaaggacatg

SEQ ID NO: 18539 - DNA, 25 bp, Mus musculus
ggacatgacgcatctgttgaactca

SEQ ID NO: 18540 - DNA, 25 bp, Mus musculus
gacgcatctgttgaactcacattct

SEQ ID NO: 18541 - DNA, 25 bp, Mus musculus
tctgttgaactcacattctagcacg

SEQ ID NO: 18542 - DNA, 25 bp, Mus musculus
gaactcacattctagcacgtgcttc

SEQ ID NO: 18543 - DNA, 25 bp, Mus musculus
tagcacgtgcttcaatagctcaagg

SEQ ID NO: 18544 - DNA, 25 bp, Mus musculus
gtgcttcaatagctcaaggaaccga

SEQ ID NO: 18545 - DNA, 25 bp, Mus musculus
aaagtcattaatcctacgtgactcg

SEQ ID NO: 18546 - DNA, 25 bp, Mus musculus
tgactcgtgctctgtggtctctatc

SEQ ID NO: 18547 - DNA, 25 bp, Mus musculus
gtgctctgtggtctctatcagctcc

SEQ ID NO: 18548 - DNA, 25 bp, Mus musculus
cctcatggaggcaggctggaaagtc

SEQ ID NO: 18549 - DNA, 25 bp, Mus musculus
tctatcagctccctggggaaagtgg

SEQ ID NO: 18550 - DNA, 25 bp, Mus musculus
tttctgcacccaactgcggcatcca

SEQ ID NO: 18551 - DNA, 25 bp, Mus musculus
actgcggcatccacacgaccagtct

SEQ ID NO: 18552 - DNA, 25 bp, Mus musculus
ccagtctgcctcatgtgccaaatca

SEQ ID NO: 18553 - DNA, 25 bp, Mus musculus
atgtgccaaatcaggctttgccctg

SEQ ID NO: 18554 - DNA, 25 bp, Mus musculus
gtctctgctcacttccaccagagct

SEQ ID NO: 18555 - DNA, 25 bp, Mus musculus
cagagctctggactgtctgtcctgt

SEQ ID NO: 18556 - DNA, 25 bp, Mus musculus
ccatcacaagctctgtgctgccaag

SEQ ID NO: 18557 - DNA, 25 bp, Mus musculus
tttgcaacagcatgaatcaagaaaa

SEQ ID NO: 18558 - DNA, 25 bp, Mus musculus
aaagttagccaaacttcaagctcag

SEQ ID NO: 18559 - DNA, 25 bp, Mus musculus
taggacagctactgctgatgacaaa

SEQ ID NO: 18560 - DNA, 25 bp, Mus musculus
ggacagctactgctgatgacaaaaa

SEQ ID NO: 18561 - DNA, 25 bp, Mus musculus
gacagctactgctgatgacaaaaag

SEQ ID NO: 18562 - DNA, 25 bp, Mus musculus
cagctactgctgatgacaaaaagct

SEQ ID NO: 18563 - DNA, 25 bp, Mus musculus
agctactgctgatgacaaaaagctt

SEQ ID NO: 18564 - DNA, 25 bp, Mus musculus
agcttcagagttcactaaagaaact

SEQ ID NO: 18565 - DNA, 25 bp, Mus musculus
ttattcatttcaacaatcccaaagt

SEQ ID NO: 18566 - DNA, 25 bp, Mus musculus
tattcatttcaacaatcccaaagtc

SEQ ID NO: 18567 - DNA, 25 bp, Mus musculus
ttcatttcaacaatcccaaagtcca

SEQ ID NO: 18568 - DNA, 25 bp, Mus musculus
tttcaacaatcccaaagtccaagct

SEQ ID NO: 18569 - DNA, 25 bp, Mus musculus
agttagccaaacttcaagctcaggt

SEQ ID NO: 18570 - DNA, 25 bp, Mus musculus
gttagccaaacttcaagctcaggtc

SEQ ID NO: 18571 - DNA, 25 bp, Mus musculus
tagccaaacttcaagctcaggtccg

SEQ ID NO: 18572 - DNA, 25 bp, Mus musculus
agccaaacttcaagctcaggtccgg

SEQ ID NO: 18573 - DNA, 25 bp, Mus musculus
ccaaacttcaagctcaggtccggat

SEQ ID NO: 18574 - DNA, 25 bp, Mus musculus
aacttcaagctcaggtccggatagg

SEQ ID NO: 18575 - DNA, 25 bp, Mus musculus
agggtacagctcgcaggaagaagaa

SEQ ID NO: 18576 - DNA, 25 bp, Mus musculus
acataggacagctactgctgatgac

SEQ ID NO: 18577 - DNA, 25 bp, Mus musculus
tgccactcagagctcatccagctgg

SEQ ID NO: 18578 - DNA, 25 bp, Mus musculus
tcagagctcatccagctggtcaaca

SEQ ID NO: 18579 - DNA, 25 bp, Mus musculus
gagaagcgtccacctacattgcgac

SEQ ID NO: 18580 - DNA, 25 bp, Mus musculus
cgtccacctacattgcgactggaga

SEQ ID NO: 18581 - DNA, 25 bp, Mus musculus
cctacattgcgactggagatcattg

SEQ ID NO: 18582 - DNA, 25 bp, Mus musculus
gacagcaagacccgcaaactggaca

SEQ ID NO: 18583 - DNA, 25 bp, Mus musculus
aaggtgtgctacaccatctagcatc

SEQ ID NO: 18584 - DNA, 25 bp, Mus musculus
tgctacaccatctagcatccacctg

SEQ ID NO: 18585 - DNA, 25 bp, Mus musculus
accatctagcatccacctgtctgtg

SEQ ID NO: 18586 - DNA, 25 bp, Mus musculus
gtctgtgccctgaacatctaataaa

SEQ ID NO: 18587 - DNA, 25 bp, Mus musculus
aacatctaataaaggccccttgctg

SEQ ID NO: 18588 - DNA, 25 bp, Mus musculus
taataaaggccccttgctgtggcat

SEQ ID NO: 18589 - DNA, 25 bp, Mus musculus
ctcatccagctggtcaacaaggaac

SEQ ID NO: 18590 - DNA, 25 bp, Mus musculus
ggccccttgctgtggcatggcaacc

SEQ ID NO: 18591 - DNA, 25 bp, Mus musculus
ctgaacttctgggccaagagagcca

SEQ ID NO: 18592 - DNA, 25 bp, Mus musculus
aggcacaacatcacactactgtggg

SEQ ID NO: 18593 - DNA, 25 bp, Mus musculus
acactactgtgggaccgcgaggtgg

SEQ ID NO: 18594 - DNA, 25 bp, Mus musculus
aaccaactggcggcagcctatgagc

SEQ ID NO: 18595 - DNA, 25 bp, Mus musculus
accctgcgtatcactgtggaggatt

SEQ ID NO: 18596 - DNA, 25 bp, Mus musculus
tcggacaagcacctcctcaagagcc

SEQ ID NO: 18597 - DNA, 25 bp, Mus musculus
tcaccccaggctgagaagcgtccac

SEQ ID NO: 18598 - DNA, 25 bp, Mus musculus
taaagtcactgccaagaagatcaaa

SEQ ID NO: 18599 - DNA, 25 bp, Mus musculus
aaaccgtcttgagctggtggtagat

SEQ ID NO: 18600 - DNA, 25 bp, Mus musculus
ccgaggctgcatccgatctctgaag

SEQ ID NO: 18601 - DNA, 25 bp, Mus musculus
ctgcatccgatctctgaagctcacc

SEQ ID NO: 18602 - DNA, 25 bp, Mus musculus
tctgaagctcaccaaaggcactgca

SEQ ID NO: 18603 - DNA, 25 bp, Mus musculus
gctcaccaaaggcactgcaaaccgc

SEQ ID NO: 18604 - DNA, 25 bp, Mus musculus
cactgcaaaccgctggaggttaatt

SEQ ID NO: 18605 - DNA, 25 bp, Mus musculus
tttgccaaggccctggaactgaggg

SEQ ID NO: 18606 - DNA, 25 bp, Mus musculus
ggtgttcaacctgtatcatgcccga

SEQ ID NO: 18607 - DNA, 25 bp, Mus musculus
caacctgtatcatgcccgactacct

SEQ ID NO: 18608 - DNA, 25 bp, Mus musculus
gtatcatgcccgactacctaataaa

SEQ ID NO: 18609 - DNA, 25 bp, Mus musculus
agatagttcaatcctgaggagaatt

SEQ ID NO: 18610 - DNA, 25 bp, Mus musculus
tcttgagctggtggtagatgggaac

SEQ ID NO: 18611 - DNA, 25 bp, Mus musculus
ggatgcccagagcccaaactcagca

SEQ ID NO: 18612 - DNA, 25 bp, Mus musculus
cccaaactcagcatcgacatcagct

SEQ ID NO: 18613 - DNA, 25 bp, Mus musculus
atcgacatcagctgatacaaacgac

SEQ ID NO: 18614 - DNA, 25 bp, Mus musculus
aggtggcctcaatcagtttggcctg

SEQ ID NO: 18615 - DNA, 25 bp, Mus musculus
tcagtttggcctgaccaccaacatt

SEQ ID NO: 18616 - DNA, 25 bp, Mus musculus
tggcctgaccaccaacattaggttc

SEQ ID NO: 18617 - DNA, 25 bp, Mus musculus
taggttccgaggctgcatccgatct

SEQ ID NO: 18618 - DNA, 25 bp, Mus musculus
ctttgaatctctggcctcacagttc

SEQ ID NO: 18619 - DNA, 25 bp, Mus musculus
tctggcctcacagttcagtgattgc

SEQ ID NO: 18620 - DNA, 25 bp, Mus musculus
gtcgtttgctctacggacaggggag

SEQ ID NO: 18621 - DNA, 25 bp, Mus musculus
tgctctacggacaggggagatgagt

SEQ ID NO: 18622 - DNA, 25 bp, Mus musculus
cgtgttcacggactcgggcatccat

SEQ ID NO: 18623 - DNA, 25 bp, Mus musculus
gttcacggactcgggcatccatatc

SEQ ID NO: 18624 - DNA, 25 bp, Mus musculus
cacggactcgggcatccatatcatc

SEQ ID NO: 18625 - DNA, 25 bp, Mus musculus
ctcgggcatccatatcatcctgcgc

SEQ ID NO: 18626 - DNA, 25 bp, Mus musculus
gggcatccatatcatcctgcgcaca

SEQ ID NO: 18627 - DNA, 25 bp, Mus musculus
catccatatcatcctgcgcacagaa

SEQ ID NO: 18628 - DNA, 25 bp, Mus musculus
tatcatcctgcgcacagaatgaggg

SEQ ID NO: 18629 - DNA, 25 bp, Mus musculus
catcctgcgcacagaatgagggcag

SEQ ID NO: 18630 - DNA, 25 bp, Mus musculus
ggcctcacagttcagtgattgcagc

SEQ ID NO: 18631 - DNA, 25 bp, Mus musculus
ctcacagttcagtgattgcagctct

SEQ ID NO: 18632 - DNA, 25 bp, Mus musculus
tgattgcagctctgccaaagccagg

SEQ ID NO: 18633 - DNA, 25 bp, Mus musculus
ctctgccaaagccaggggagacctg

SEQ ID NO: 18634 - DNA, 25 bp, Mus musculus
cctgggtcccttcagcagaggtcag

SEQ ID NO: 18635 - DNA, 25 bp, Mus musculus
gggtcccttcagcagaggtcagatg

SEQ ID NO: 18636 - DNA, 25 bp, Mus musculus
tcccttcagcagaggtcagatgcag

SEQ ID NO: 18637 - DNA, 25 bp, Mus musculus
atttgaggatgcgtcgtttgctcta

SEQ ID NO: 18638 - DNA, 25 bp, Mus musculus
tccaagtcgcacaccgaggccaagc

SEQ ID NO: 18639 - DNA, 25 bp, Mus musculus
cacaccgaggccaagcccacaagtg

SEQ ID NO: 18640 - DNA, 25 bp, Mus musculus
acctccagcaacataccagaatcca

SEQ ID NO: 18641 - DNA, 25 bp, Mus musculus
tccagcaacataccagaatccacac

SEQ ID NO: 18642 - DNA, 25 bp, Mus musculus
ccagaatccacacaggcgacagacc

SEQ ID NO: 18643 - DNA, 25 bp, Mus musculus
tccacacaggcgacagaccatacaa

SEQ ID NO: 18644 - DNA, 25 bp, Mus musculus
caggcgacagaccatacaagtgccc

SEQ ID NO: 18645 - DNA, 25 bp, Mus musculus
acagaccatacaagtgcccgcatcc

SEQ ID NO: 18646 - DNA, 25 bp, Mus musculus
gaccatacaagtgcccgcatcctgg

SEQ ID NO: 18647 - DNA, 25 bp, Mus musculus
catacaagtgcccgcatcctggctg

SEQ ID NO: 18648 - DNA, 25 bp, Mus musculus
gcccgcatcctggctgcgaaaaggc

SEQ ID NO: 18649 - DNA, 25 bp, Mus musculus
cgcatcctggctgcgaaaaggcttt

SEQ ID NO: 18650 - DNA, 25 bp, Mus musculus
agtgcccacactgctccaagtcctt

SEQ ID NO: 18651 - DNA, 25 bp, Mus musculus
agcgccacgacaactaaggacaagc

SEQ ID NO: 18652 - DNA, 25 bp, Mus musculus
cacactgctccaagtcctttgccaa

SEQ ID NO: 18653 - DNA, 25 bp, Mus musculus
tgcgcatccacctgggtgtcaagcc

SEQ ID NO: 18654 - DNA, 25 bp, Mus musculus
tccacctgggtgtcaagccctacca

SEQ ID NO: 18655 - DNA, 25 bp, Mus musculus
acctgggtgtcaagccctaccactg

SEQ ID NO: 18656 - DNA, 25 bp, Mus musculus
actgctcctactgtgacaagtcctt

SEQ ID NO: 18657 - DNA, 25 bp, Mus musculus
gctcctactgtgacaagtccttccg

SEQ ID NO: 18658 - DNA, 25 bp, Mus musculus
cctactgtgacaagtccttccggca

SEQ ID NO: 18659 - DNA, 25 bp, Mus musculus
gtagctgtcatccacaaagatgcag

SEQ ID NO: 18660 - DNA, 25 bp, Mus musculus
gctgtcatccacaaagatgcagaga

SEQ ID NO: 18661 - DNA, 25 bp, Mus musculus
ctccgtgcacatggggcccctgaac

SEQ ID NO: 18662 - DNA, 25 bp, Mus musculus
gacgataagcttagcccttgcagca

SEQ ID NO: 18663 - DNA, 25 bp, Mus musculus
gataagcttagcccttgcagcagca

SEQ ID NO: 18664 - DNA, 25 bp, Mus musculus
cttagcccttgcagcagcagcggca

SEQ ID NO: 18665 - DNA, 25 bp, Mus musculus
ccttgcagcagcagcggcagcgaca

SEQ ID NO: 18666 - DNA, 25 bp, Mus musculus
gatgacatcgtggttcacagtggca

SEQ ID NO: 18667 - DNA, 25 bp, Mus musculus
gtggttcacagtggcaggagccaaa

SEQ ID NO: 18668 - DNA, 25 bp, Mus musculus
gttcacagtggcaggagccaaaacc

SEQ ID NO: 18669 - DNA, 25 bp, Mus musculus
gcatccaaacctcttcctgatgacc

SEQ ID NO: 18670 - DNA, 25 bp, Mus musculus
cctgcctgacttaagtgctaatatt

SEQ ID NO: 18671 - DNA, 25 bp, Mus musculus
ctcagggatgccggagccgacctca

SEQ ID NO: 18672 - DNA, 25 bp, Mus musculus
gatgccggagccgacctcaataaac

SEQ ID NO: 18673 - DNA, 25 bp, Mus musculus
ctcaataaaccggagcctacgtgtg

SEQ ID NO: 18674 - DNA, 25 bp, Mus musculus
cctctgcacctggcagtagaagccc

SEQ ID NO: 18675 - DNA, 25 bp, Mus musculus
ctgcacctggcagtagaagcccagg

SEQ ID NO: 18676 - DNA, 25 bp, Mus musculus
gtgctggaacttctcctgaaagccg

SEQ ID NO: 18677 - DNA, 25 bp, Mus musculus
gaacttctcctgaaagccggtgctg

SEQ ID NO: 18678 - DNA, 25 bp, Mus musculus
ctcctgaaagccggtgctgacccca

SEQ ID NO: 18679 - DNA, 25 bp, Mus musculus
cgatttctgtgcgatttcatgtaca

SEQ ID NO: 18680 - DNA, 25 bp, Mus musculus
cacggacgctccgagcaatttactg

SEQ ID NO: 18681 - DNA, 25 bp, Mus musculus
tcgatcataccctaatgcctgtgca

SEQ ID NO: 18682 - DNA, 25 bp, Mus musculus
ataccctaatgcctgtgcaatttaa

SEQ ID NO: 18683 - DNA, 25 bp, Mus musculus
taatgcctgtgcaatttaatgttca

SEQ ID NO: 18684 - DNA, 25 bp, Mus musculus
atgttcacgctaaaaagcagtagga

SEQ ID NO: 18685 - DNA, 25 bp, Mus musculus
ttcattgctctttctaactggaacc

SEQ ID NO: 18686 - DNA, 25 bp, Mus musculus
gctcactagtgaaccccagggattt

SEQ ID NO: 18687 - DNA, 25 bp, Mus musculus
gggatttcatcagctgacggtgcct

SEQ ID NO: 18688 - DNA, 25 bp, Mus musculus
tcatcagctgacggtgccttgcttc

SEQ ID NO: 18689 - DNA, 25 bp, Mus musculus
cttccaccagcaataaagtccgcat

SEQ ID NO: 18690 - DNA, 25 bp, Mus musculus
ccagcaataaagtccgcataacttc

SEQ ID NO: 18691 - DNA, 25 bp, Mus musculus
cgctccgagcaatttactggtacag

SEQ ID NO: 18692 - DNA, 25 bp, Mus musculus
taaagtccgcataacttctgcaaca

SEQ ID NO: 18693 - DNA, 25 bp, Mus musculus
gatttataacagcctccaataagat

SEQ ID NO: 18694 - DNA, 25 bp, Mus musculus
taacagcctccaataagattatatt

SEQ ID NO: 18695 - DNA, 25 bp, Mus musculus
ttatattggggcctgcacacagcga

SEQ ID NO: 18696 - DNA, 25 bp, Mus musculus
agggagcctacgcactagatatgct

SEQ ID NO: 18697 - DNA, 25 bp, Mus musculus
cctacgcactagatatgctatttca

SEQ ID NO: 18698 - DNA, 25 bp, Mus musculus
atatgctatttcaaaacttcgatca

SEQ ID NO: 18699 - DNA, 25 bp, Mus musculus
tatttcaaaacttcgatcataccct

SEQ ID NO: 18700 - DNA, 25 bp, Mus musculus
gtcgatactcaccttcacgcgatcg

SEQ ID NO: 18701 - DNA, 25 bp, Mus musculus
actcaccttcacgcgatcgaagaga

SEQ ID NO: 18702 - DNA, 25 bp, Mus musculus
ccacatatgcacaacctactacttg

SEQ ID NO: 18703 - DNA, 25 bp, Mus musculus
cacaacctactacttgcatgaatac

SEQ ID NO: 18704 - DNA, 25 bp, Mus musculus
aacctactacttgcatgaatacgtg

SEQ ID NO: 18705 - DNA, 25 bp, Mus musculus
ctactacttgcatgaatacgtgcgt

SEQ ID NO: 18706 - DNA, 25 bp, Mus musculus
atacgtgcgtcgcattgaaccggac

SEQ ID NO: 18707 - DNA, 25 bp, Mus musculus
cattgaaccggacgcccatgtacca

SEQ ID NO: 18708 - DNA, 25 bp, Mus musculus
tgaaccggacgcccatgtaccaggg

SEQ ID NO: 18709 - DNA, 25 bp, Mus musculus
ggacgcccatgtaccagggagcagc

SEQ ID NO: 18710 - DNA, 25 bp, Mus musculus
cgcccatgtaccagggagcagcaga

SEQ ID NO: 18711 - DNA, 25 bp, Mus musculus
ccatgtaccagggagcagcagatga

SEQ ID NO: 18712 - DNA, 25 bp, Mus musculus
caccttcacgcgatcgaagagagac

SEQ ID NO: 18713 - DNA, 25 bp, Mus musculus
agactgactcagagtctgagactac

SEQ ID NO: 18714 - DNA, 25 bp, Mus musculus
agtctgagactactcaaccaggacc

SEQ ID NO: 18715 - DNA, 25 bp, Mus musculus
ctgagactactcaaccaggaccctc

SEQ ID NO: 18716 - DNA, 25 bp, Mus musculus
ctcgctcaagagcttgctccacata

SEQ ID NO: 18717 - DNA, 25 bp, Mus musculus
gagcttgctccacatatgcacaacc

SEQ ID NO: 18718 - DNA, 25 bp, Mus musculus
cttgctccacatatgcacaacctac

SEQ ID NO: 18719 - DNA, 25 bp, Mus musculus
gctccacatatgcacaacctactac

SEQ ID NO: 18720 - DNA, 25 bp, Mus musculus
gcatattcaccacctagcctatgac

SEQ ID NO: 18721 - DNA, 25 bp, Mus musculus
tcaccacctagcctatgacacaact

SEQ ID NO: 18722 - DNA, 25 bp, Mus musculus
agctctacatcaaaatgtagatgag

SEQ ID NO: 18723 - DNA, 25 bp, Mus musculus
atttgaggcacttcatggggtatag

SEQ ID NO: 18724 - DNA, 25 bp, Mus musculus
tgaggcacttcatggggtatagaac

SEQ ID NO: 18725 - DNA, 25 bp, Mus musculus
agtgctactggtctcactttcagag

SEQ ID NO: 18726 - DNA, 25 bp, Mus musculus
gctactggtctcactttcagagaag

SEQ ID NO: 18727 - DNA, 25 bp, Mus musculus
actggtctcactttcagagaagatc

SEQ ID NO: 18728 - DNA, 25 bp, Mus musculus
tcaacttcatctttgtcatacttca

SEQ ID NO: 18729 - DNA, 25 bp, Mus musculus
acttcatctttgtcatacttcatgg

SEQ ID NO: 18730 - DNA, 25 bp, Mus musculus
tcatctttgtcatacttcatggctc

SEQ ID NO: 18731 - DNA, 25 bp, Mus musculus
tctttgtcatacttcatggctctat

SEQ ID NO: 18732 - DNA, 25 bp, Mus musculus
cctagcctatgacacaactcattaa

SEQ ID NO: 18733 - DNA, 25 bp, Mus musculus
ttgtcatacttcatggctctatgaa

SEQ ID NO: 18734 - DNA, 25 bp, Mus musculus
agcctatgacacaactcattaatta

SEQ ID NO: 18735 - DNA, 25 bp, Mus musculus
attataacatcgcagtctccaagga

SEQ ID NO: 18736 - DNA, 25 bp, Mus musculus
ataacatcgcagtctccaaggagct

SEQ ID NO: 18737 - DNA, 25 bp, Mus musculus
acatcgcagtctccaaggagctcta

SEQ ID NO: 18738 - DNA, 25 bp, Mus musculus
cagtctccaaggagctctacatcaa

SEQ ID NO: 18739 - DNA, 25 bp, Mus musculus
tctccaaggagctctacatcaaaat

SEQ ID NO: 18740 - DNA, 25 bp, Mus musculus
ccaaggagctctacatcaaaatgta

SEQ ID NO: 18741 - DNA, 25 bp, Mus musculus
agacagacagctctgacaagaagtt

SEQ ID NO: 18742 - DNA, 25 bp, Mus musculus
gacagacagctctgacaagaagttg

SEQ ID NO: 18743 - DNA, 25 bp, Mus musculus
atcaagtactatccagagcaagtag

SEQ ID NO: 18744 - DNA, 25 bp, Mus musculus
ccgagctaaagtccatctggcacca

SEQ ID NO: 18745 - DNA, 25 bp, Mus musculus
cgagctaaagtccatctggcaccac

SEQ ID NO: 18746 - DNA, 25 bp, Mus musculus
gagctaaagtccatctggcaccacg

SEQ ID NO: 18747 - DNA, 25 bp, Mus musculus
agctaaagtccatctggcaccacgg

SEQ ID NO: 18748 - DNA, 25 bp, Mus musculus
gctaaagtccatctggcaccacggt

SEQ ID NO: 18749 - DNA, 25 bp, Mus musculus
ctaaagtccatctggcaccacggtc

SEQ ID NO: 18750 - DNA, 25 bp, Mus musculus
taaagtccatctggcaccacggtcc

SEQ ID NO: 18751 - DNA, 25 bp, Mus musculus
aaagtccatctggcaccacggtcct

SEQ ID NO: 18752 - DNA, 25 bp, Mus musculus
acagacagctctgacaagaagttgc

SEQ ID NO: 18753 - DNA, 25 bp, Mus musculus
cagacagctctgacaagaagttgca

SEQ ID NO: 18754 - DNA, 25 bp, Mus musculus
agacagctctgacaagaagttgcag

SEQ ID NO: 18755 - DNA, 25 bp, Mus musculus
agcttatcaagtactatccagagca

SEQ ID NO: 18756 - DNA, 25 bp, Mus musculus
gcttatcaagtactatccagagcaa

SEQ ID NO: 18757 - DNA, 25 bp, Mus musculus
cttatcaagtactatccagagcaag

SEQ ID NO: 18758 - DNA, 25 bp, Mus musculus
ttatcaagtactatccagagcaagt

SEQ ID NO: 18759 - DNA, 25 bp, Mus musculus
tatcaagtactatccagagcaagta

SEQ ID NO: 18760 - DNA, 25 bp, Mus musculus
gtttcggtatcgcccaagcttcgtg

SEQ ID NO: 18761 - DNA, 25 bp, Mus musculus
gtctgacaagagaccccagacggtt

SEQ ID NO: 18762 - DNA, 25 bp, Mus musculus
tgagctcctggctaagaatccacct

SEQ ID NO: 18763 - DNA, 25 bp, Mus musculus
cctggctaagaatccacctgagaca

SEQ ID NO: 18764 - DNA, 25 bp, Mus musculus
taagaatccacctgagacagaccct

SEQ ID NO: 18765 - DNA, 25 bp, Mus musculus
tccacctgagacagaccctactgaa

SEQ ID NO: 18766 - DNA, 25 bp, Mus musculus
tgagacagaccctactgaacacaca

SEQ ID NO: 18767 - DNA, 25 bp, Mus musculus
agaccctactgaacacacagaacac

SEQ ID NO: 18768 - DNA, 25 bp, Mus musculus
tctcaggaccagcggagcgaaaatg

SEQ ID NO: 18769 - DNA, 25 bp, Mus musculus
ggagctattccacaaaggatgacta

SEQ ID NO: 18770 - DNA, 25 bp, Mus musculus
attccacaaaggatgactattcacc

SEQ ID NO: 18771 - DNA, 25 bp, Mus musculus
atgactattcaccaaagatggatct

SEQ ID NO: 18772 - DNA, 25 bp, Mus musculus
accccagacggttgagggtgatcat

SEQ ID NO: 18773 - DNA, 25 bp, Mus musculus
tgaaatcttctttgtattcggggct

SEQ ID NO: 18774 - DNA, 25 bp, Mus musculus
ggaaaccaacctcagcaagatggtg

SEQ ID NO: 18775 - DNA, 25 bp, Mus musculus
caacctcagcaagatggtgatgaaa

SEQ ID NO: 18776 - DNA, 25 bp, Mus musculus
tctacagattggagccactacccag

SEQ ID NO: 18777 - DNA, 25 bp, Mus musculus
gattggagccactacccagcaagcc

SEQ ID NO: 18778 - DNA, 25 bp, Mus musculus
tacccagcaagcccagagactgaaa

SEQ ID NO: 18779 - DNA, 25 bp, Mus musculus
gcaagcccagagactgaaagcagag

SEQ ID NO: 18780 - DNA, 25 bp, Mus musculus
tgacaagcacctatactggacagca

SEQ ID NO: 18781 - DNA, 25 bp, Mus musculus
acaagcacctatactggacagcaac

SEQ ID NO: 18782 - DNA, 25 bp, Mus musculus
aggactcgagacaactctcaatggg

SEQ ID NO: 18783 - DNA, 25 bp, Mus musculus
gactcgagacaactctcaatgggct

SEQ ID NO: 18784 - DNA, 25 bp, Mus musculus
ctcgagacaactctcaatgggctac

SEQ ID NO: 18785 - DNA, 25 bp, Mus musculus
cgagacaactctcaatgggctacat

SEQ ID NO: 18786 - DNA, 25 bp, Mus musculus
agacaactctcaatgggctacatga

SEQ ID NO: 18787 - DNA, 25 bp, Mus musculus
acaactctcaatgggctacatgatg

SEQ ID NO: 18788 - DNA, 25 bp, Mus musculus
aactctcaatgggctacatgatggc

SEQ ID NO: 18789 - DNA, 25 bp, Mus musculus
ctctcaatgggctacatgatggcca

SEQ ID NO: 18790 - DNA, 25 bp, Mus musculus
ctgaccacccatcgtggagaccctg

SEQ ID NO: 18791 - DNA, 25 bp, Mus musculus
gaccacccatcgtggagaccctgcg

SEQ ID NO: 18792 - DNA, 25 bp, Mus musculus
aagcacctatactggacagcaacat

SEQ ID NO: 18793 - DNA, 25 bp, Mus musculus
gcacctatactggacagcaacatgg

SEQ ID NO: 18794 - DNA, 25 bp, Mus musculus
acctatactggacagcaacatggaa

SEQ ID NO: 18795 - DNA, 25 bp, Mus musculus
ctatactggacagcaacatggaacg

SEQ ID NO: 18796 - DNA, 25 bp, Mus musculus
atcatgaaggccaggactcgagaca

SEQ ID NO: 18797 - DNA, 25 bp, Mus musculus
catgaaggccaggactcgagacaac

SEQ ID NO: 18798 - DNA, 25 bp, Mus musculus
aaggccaggactcgagacaactctc

SEQ ID NO: 18799 - DNA, 25 bp, Mus musculus
ccaggactcgagacaactctcaatg

SEQ ID NO: 18800 - DNA, 25 bp, Mus musculus
atatgcagatccgaaactggacaag

SEQ ID NO: 18801 - DNA, 25 bp, Mus musculus
tgcagatccgaaactggacaaggag

SEQ ID NO: 18802 - DNA, 25 bp, Mus musculus
agagcagatgccctccagacgaagc

SEQ ID NO: 18803 - DNA, 25 bp, Mus musculus
gcagatgccctccagacgaagctga

SEQ ID NO: 18804 - DNA, 25 bp, Mus musculus
gatgcctagcgagacctgtgagcag

SEQ ID NO: 18805 - DNA, 25 bp, Mus musculus
tagcgagacctgtgagcaggctgag

SEQ ID NO: 18806 - DNA, 25 bp, Mus musculus
cgagacctgtgagcaggctgagatg

SEQ ID NO: 18807 - DNA, 25 bp, Mus musculus
gaaggccagctacactgaaccagat

SEQ ID NO: 18808 - DNA, 25 bp, Mus musculus
ggccagctacactgaaccagatgtg

SEQ ID NO: 18809 - DNA, 25 bp, Mus musculus
cagctacactgaaccagatgtggcc

SEQ ID NO: 18810 - DNA, 25 bp, Mus musculus
agtgccgcattcagctcgtagacta

SEQ ID NO: 18811 - DNA, 25 bp, Mus musculus
gtgccgcattcagctcgtagactag

SEQ ID NO: 18812 - DNA, 25 bp, Mus musculus
agatccgaaactggacaaggagaat

SEQ ID NO: 18813 - DNA, 25 bp, Mus musculus
gaataccatcgaccgcgcggcagac

SEQ ID NO: 18814 - DNA, 25 bp, Mus musculus
taccatcgaccgcgcggcagaccga

SEQ ID NO: 18815 - DNA, 25 bp, Mus musculus
cgcggcagaccgaactgccaaaaag

SEQ ID NO: 18816 - DNA, 25 bp, Mus musculus
ggcagaccgaactgccaaaaaggag

SEQ ID NO: 18817 - DNA, 25 bp, Mus musculus
agaccgaactgccaaaaaggagctg

SEQ ID NO: 18818 - DNA, 25 bp, Mus musculus
gagaccgatgcagcagctggaggaa

SEQ ID NO: 18819 - DNA, 25 bp, Mus musculus
accgatgcagcagctggaggaagag

SEQ ID NO: 18820 - DNA, 25 bp, Mus musculus
tgtcctcattggacttgaggggttg

SEQ ID NO: 18821 - DNA, 25 bp, Mus musculus
atgactcaggggagccaggctatca

SEQ ID NO: 18822 - DNA, 25 bp, Mus musculus
agcactcaccattgctgactgtaac

SEQ ID NO: 18823 - DNA, 25 bp, Mus musculus
caccattgctgactgtaacatctat

SEQ ID NO: 18824 - DNA, 25 bp, Mus musculus
aaactgatgcttacctcagcactgg

SEQ ID NO: 18825 - DNA, 25 bp, Mus musculus
aatctcactgtcactgtaagtctgt

SEQ ID NO: 18826 - DNA, 25 bp, Mus musculus
gccccagagcacacctcctgatgta

SEQ ID NO: 18827 - DNA, 25 bp, Mus musculus
tgatgtagtctcccttaaaccaatg

SEQ ID NO: 18828 - DNA, 25 bp, Mus musculus
cttgtcctgagacacataatcacat

SEQ ID NO: 18829 - DNA, 25 bp, Mus musculus
cacataatcacatctctaaggcctg

SEQ ID NO: 18830 - DNA, 25 bp, Mus musculus
atcacatctctaaggcctgtttatc

SEQ ID NO: 18831 - DNA, 25 bp, Mus musculus
tctctaaggcctgtttatcctgaat

SEQ ID NO: 18832 - DNA, 25 bp, Mus musculus
atctgtatcctgccttatgcggagg

SEQ ID NO: 18833 - DNA, 25 bp, Mus musculus
atcctgccttatgcggaggtaggca

SEQ ID NO: 18834 - DNA, 25 bp, Mus musculus
tagggcaccctgtatccatagctat

SEQ ID NO: 18835 - DNA, 25 bp, Mus musculus
tatccatagctatgtctcaccttct

SEQ ID NO: 18836 - DNA, 25 bp, Mus musculus
tgtctcaccttctgtcttgaaaagg

SEQ ID NO: 18837 - DNA, 25 bp, Mus musculus
gggcacacatgcagccactgtcagc

SEQ ID NO: 18838 - DNA, 25 bp, Mus musculus
acatgcagccactgtcagcttagtc

SEQ ID NO: 18839 - DNA, 25 bp, Mus musculus
taaacactggatagcactcaccatt

SEQ ID NO: 18840 - DNA, 25 bp, Mus musculus
cagcttcgactacgaggattatccc

SEQ ID NO: 18841 - DNA, 25 bp, Mus musculus
caagggcaccttcaaggactatgtg

SEQ ID NO: 18842 - DNA, 25 bp, Mus musculus
ctttatcagctggacaggagatggc

SEQ ID NO: 18843 - DNA, 25 bp, Mus musculus
gctttctgacccagatgaggtggcc

SEQ ID NO: 18844 - DNA, 25 bp, Mus musculus
ccgtggccttcgctactattatgac

SEQ ID NO: 18845 - DNA, 25 bp, Mus musculus
gcgctacgtataccgctttgtgtgc

SEQ ID NO: 18846 - DNA, 25 bp, Mus musculus
cgtataccgctttgtgtgcgacctg

SEQ ID NO: 18847 - DNA, 25 bp, Mus musculus
ccgctttgtgtgcgacctgcagagc

SEQ ID NO: 18848 - DNA, 25 bp, Mus musculus
cctgctgggatacacccctgaagag

SEQ ID NO: 18849 - DNA, 25 bp, Mus musculus
gggatacacccctgaagagctgcac

SEQ ID NO: 18850 - DNA, 25 bp, Mus musculus
gctgcacgccatgctggatgtaaag

SEQ ID NO: 18851 - DNA, 25 bp, Mus musculus
tgctgactagtcatggacagacgcg

SEQ ID NO: 18852 - DNA, 25 bp, Mus musculus
caccttcaaggactatgtgcgtgac

SEQ ID NO: 18853 - DNA, 25 bp, Mus musculus
ctgctgagacctttcaagagcttaa

SEQ ID NO: 18854 - DNA, 25 bp, Mus musculus
ccgtgctgacctcaacaaggacaag

SEQ ID NO: 18855 - DNA, 25 bp, Mus musculus
tgacctcaacaaggacaagcctgtc

SEQ ID NO: 18856 - DNA, 25 bp, Mus musculus
ctacacaggaagtgggccgatccag

SEQ ID NO: 18857 - DNA, 25 bp, Mus musculus
tcttctggaattactcactgataag

SEQ ID NO: 18858 - DNA, 25 bp, Mus musculus
ggaattactcactgataagtcttgt

SEQ ID NO: 18859 - DNA, 25 bp, Mus musculus
gtcttgtcagtcctttatcagctgg

SEQ ID NO: 18860 - DNA, 25 bp, Mus musculus
tcagtcctttatcagctggacagga

SEQ ID NO: 18861 - DNA, 25 bp, Mus musculus
atcaaagcattctcccgggataatc

SEQ ID NO: 18862 - DNA, 25 bp, Mus musculus
gcattctcccgggataatctcagga

SEQ ID NO: 18863 - DNA, 25 bp, Mus musculus
gacctgcaagttggcgttattaagc

SEQ ID NO: 18864 - DNA, 25 bp, Mus musculus
gttattaagccctggttgcttctgg

SEQ ID NO: 18865 - DNA, 25 bp, Mus musculus
ccctggttgcttctggggtcacagg

SEQ ID NO: 18866 - DNA, 25 bp, Mus musculus
tggttgcttctggggtcacaggatg

SEQ ID NO: 18867 - DNA, 25 bp, Mus musculus
ttgcttctggggtcacaggatgctg

SEQ ID NO: 18868 - DNA, 25 bp, Mus musculus
gctcatgacctggagctactgagaa

SEQ ID NO: 18869 - DNA, 25 bp, Mus musculus
catgacctggagctactgagaaagc

SEQ ID NO: 18870 - DNA, 25 bp, Mus musculus
gtgactcatattctcaatgttgcat

SEQ ID NO: 18871 - DNA, 25 bp, Mus musculus
actcatattctcaatgttgcatatg

SEQ ID NO: 18872 - DNA, 25 bp, Mus musculus
catattctcaatgttgcatatggag

SEQ ID NO: 18873 - DNA, 25 bp, Mus musculus
ttctcccgggataatctcaggaagc

SEQ ID NO: 18874 - DNA, 25 bp, Mus musculus
tgcaccagggtgaccacgctaactg

SEQ ID NO: 18875 - DNA, 25 bp, Mus musculus
gaagatgccacagttcatgttgtgg

SEQ ID NO: 18876 - DNA, 25 bp, Mus musculus
gatgccacagttcatgttgtggaga

SEQ ID NO: 18877 - DNA, 25 bp, Mus musculus
tatgtgcaggaccttaccttggacc

SEQ ID NO: 18878 - DNA, 25 bp, Mus musculus
gtgcaggaccttaccttggacctgc

SEQ ID NO: 18879 - DNA, 25 bp, Mus musculus
gaccttaccttggacctgcaagttg

SEQ ID NO: 18880 - DNA, 25 bp, Mus musculus
ttggacctgcaagttggcgttatta

SEQ ID NO: 18881 - DNA, 25 bp, Mus musculus
ctaagccgccagccaaaatgtgtaa

SEQ ID NO: 18882 - DNA, 25 bp, Mus musculus
tggcagctctgcgcactcatgcctg

SEQ ID NO: 18883 - DNA, 25 bp, Mus musculus
ccagaagccagactctgctgttgac

SEQ ID NO: 18884 - DNA, 25 bp, Mus musculus
ctctgctgttgaccttgtcattcca

SEQ ID NO: 18885 - DNA, 25 bp, Mus musculus
tgttgaccttgtcattccatacaat

SEQ ID NO: 18886 - DNA, 25 bp, Mus musculus
tgaccttgtcattccatacaatgag

SEQ ID NO: 18887 - DNA, 25 bp, Mus musculus
ccttgtcattccatacaatgagaag

SEQ ID NO: 18888 - DNA, 25 bp, Mus musculus
tgccaagcgacacaagccctcactg

SEQ ID NO: 18889 - DNA, 25 bp, Mus musculus
gcgacacaagccctcactggaggag

SEQ ID NO: 18890 - DNA, 25 bp, Mus musculus
ccagtccctggacaagcttctccag

SEQ ID NO: 18891 - DNA, 25 bp, Mus musculus
ggacaagcttctccagaacagctat

SEQ ID NO: 18892 - DNA, 25 bp, Mus musculus
gcttctccagaacagctatggattt

SEQ ID NO: 18893 - DNA, 25 bp, Mus musculus
cagctctgcgcactcatgcctggaa

SEQ ID NO: 18894 - DNA, 25 bp, Mus musculus
tggatttgccagcttcaaaagtttc

SEQ ID NO: 18895 - DNA, 25 bp, Mus musculus
ctctgcgcactcatgcctggaaagg

SEQ ID NO: 18896 - DNA, 25 bp, Mus musculus
gcactcatgcctggaaagggccaag

SEQ ID NO: 18897 - DNA, 25 bp, Mus musculus
ctcatgcctggaaagggccaaggag

SEQ ID NO: 18898 - DNA, 25 bp, Mus musculus
atgcctggaaagggccaaggagatc

SEQ ID NO: 18899 - DNA, 25 bp, Mus musculus
gggaattctcctccagaagccagac

SEQ ID NO: 18900 - DNA, 25 bp, Mus musculus
tctcctccagaagccagactctgct

SEQ ID NO: 18901 - DNA, 25 bp, Mus musculus
cctccagaagccagactctgctgtt

SEQ ID NO: 18902 - DNA, 25 bp, Mus musculus
catcattgagcgagtgcagcctacc

SEQ ID NO: 18903 - DNA, 25 bp, Mus musculus
cattgagcgagtgcagcctacctgg

SEQ ID NO: 18904 - DNA, 25 bp, Mus musculus
cgcatcctgcacacgtactacaagt

SEQ ID NO: 18905 - DNA, 25 bp, Mus musculus
atcctgcacacgtactacaagtttg

SEQ ID NO: 18906 - DNA, 25 bp, Mus musculus
cacacgtactacaagtttgactaca

SEQ ID NO: 18907 - DNA, 25 bp, Mus musculus
aagtttgactacaaggcccatcagc

SEQ ID NO: 18908 - DNA, 25 bp, Mus musculus
tttgactacaaggcccatcagcggc

SEQ ID NO: 18909 - DNA, 25 bp, Mus musculus
catcagcggcacgttactcctcctg

SEQ ID NO: 18910 - DNA, 25 bp, Mus musculus
cggcacgttactcctcctgaaggat

SEQ ID NO: 18911 - DNA, 25 bp, Mus musculus
cacgttactcctcctgaaggatcct

SEQ ID NO: 18912 - DNA, 25 bp, Mus musculus
gaaggatcctcaaagtctgagcaag

SEQ ID NO: 18913 - DNA, 25 bp, Mus musculus
gactcagctgtgctaatggaaagac

SEQ ID NO: 18914 - DNA, 25 bp, Mus musculus
agtgcagcctacctggaggagaaag

SEQ ID NO: 18915 - DNA, 25 bp, Mus musculus
gcagcctacctggaggagaaaggta

SEQ ID NO: 18916 - DNA, 25 bp, Mus musculus
ggtaccactgaggagatctgccaga

SEQ ID NO: 18917 - DNA, 25 bp, Mus musculus
gagatctgccagatctacttaaggc

SEQ ID NO: 18918 - DNA, 25 bp, Mus musculus
atctgccagatctacttaaggcgca

SEQ ID NO: 18919 - DNA, 25 bp, Mus musculus
cagatctacttaaggcgcatcctgc

SEQ ID NO: 18920 - DNA, 25 bp, Mus musculus
atctacttaaggcgcatcctgcaca

SEQ ID NO: 18921 - DNA, 25 bp, Mus musculus
tacttaaggcgcatcctgcacacgt

SEQ ID NO: 18922 - DNA, 25 bp, Mus musculus
gtatgaccaagtcctggtggagtca

SEQ ID NO: 18923 - DNA, 25 bp, Mus musculus
agacaagatcctgcactcacacttg

SEQ ID NO: 18924 - DNA, 25 bp, Mus musculus
cgcacgcgagttcattctgaagatg

SEQ ID NO: 18925 - DNA, 25 bp, Mus musculus
atgtgccaccgacaccgagaacatc

SEQ ID NO: 18926 - DNA, 25 bp, Mus musculus
ctttgtgttcgcagctgtgaaggac

SEQ ID NO: 18927 - DNA, 25 bp, Mus musculus
gttcgcagctgtgaaggacaccatc

SEQ ID NO: 18928 - DNA, 25 bp, Mus musculus
tcctcaagggcagagtggcctcatt

SEQ ID NO: 18929 - DNA, 25 bp, Mus musculus
tggcctcatttcggccttgactcaa

SEQ ID NO: 18930 - DNA, 25 bp, Mus musculus
catttcggccttgactcaatgtggc

SEQ ID NO: 18931 - DNA, 25 bp, Mus musculus
ttcggccttgactcaatgtggcttg

SEQ ID NO: 18932 - DNA, 25 bp, Mus musculus
ggccttgactcaatgtggcttgagg

SEQ ID NO: 18933 - DNA, 25 bp, Mus musculus
gactcaatgtggcttgaggtttttt

SEQ ID NO: 18934 - DNA, 25 bp, Mus musculus
caagatcctgcactcacacttggtc

SEQ ID NO: 18935 - DNA, 25 bp, Mus musculus
gatcctgcactcacacttggtcgat

SEQ ID NO: 18936 - DNA, 25 bp, Mus musculus
gcactcacacttggtcgattacttc

SEQ ID NO: 18937 - DNA, 25 bp, Mus musculus
ctcacacttggtcgattacttccct

SEQ ID NO: 18938 - DNA, 25 bp, Mus musculus
acacttggtcgattacttccctgag

SEQ ID NO: 18939 - DNA, 25 bp, Mus musculus
cgattacttccctgagtttgatggg

SEQ ID NO: 18940 - DNA, 25 bp, Mus musculus
ttacttccctgagtttgatgggcca

SEQ ID NO: 18941 - DNA, 25 bp, Mus musculus
gtttgatgggccacagagggatgca

SEQ ID NO: 18942 - DNA, 25 bp, Mus musculus
tgccaggggtctggccgtcagaaca

SEQ ID NO: 18943 - DNA, 25 bp, Mus musculus
tctggccgtcagaacagcacagctg

SEQ ID NO: 18944 - DNA, 25 bp, Mus musculus
ctgcagaccttactccatagccata

SEQ ID NO: 18945 - DNA, 25 bp, Mus musculus
cagaccttactccatagccatatct

SEQ ID NO: 18946 - DNA, 25 bp, Mus musculus
accttactccatagccatatctaga

SEQ ID NO: 18947 - DNA, 25 bp, Mus musculus
ctccatagccatatctagagtgatc

SEQ ID NO: 18948 - DNA, 25 bp, Mus musculus
catatctagagtgatcccgtgcttt

SEQ ID NO: 18949 - DNA, 25 bp, Mus musculus
tagagtgatcccgtgcttttgctgg

SEQ ID NO: 18950 - DNA, 25 bp, Mus musculus
agtgatcccgtgcttttgctggtgg

SEQ ID NO: 18951 - DNA, 25 bp, Mus musculus
cccgtgcttttgctggtggcagtgc

SEQ ID NO: 18952 - DNA, 25 bp, Mus musculus
cttttgctggtggcagtgctgactg

SEQ ID NO: 18953 - DNA, 25 bp, Mus musculus
gtatgtcccctgagcagagcacaag

SEQ ID NO: 18954 - DNA, 25 bp, Mus musculus
cgtcagaacagcacagctgctggtt

SEQ ID NO: 18955 - DNA, 25 bp, Mus musculus
aacagcacagctgctggtttcctgt

SEQ ID NO: 18956 - DNA, 25 bp, Mus musculus
agcacagctgctggtttcctgtttt

SEQ ID NO: 18957 - DNA, 25 bp, Mus musculus
acagctgctggtttcctgttttctt

SEQ ID NO: 18958 - DNA, 25 bp, Mus musculus
tttctgcccctttgctatctgcaga

SEQ ID NO: 18959 - DNA, 25 bp, Mus musculus
cccctttgctatctgcagaccttac

SEQ ID NO: 18960 - DNA, 25 bp, Mus musculus
ctttgctatctgcagaccttactcc

SEQ ID NO: 18961 - DNA, 25 bp, Mus musculus
tatctgcagaccttactccatagcc

SEQ ID NO: 18962 - DNA, 25 bp, Mus musculus
gactctcatgtcggacagtgttgca

SEQ ID NO: 18963 - DNA, 25 bp, Mus musculus
catgtcggacagtgttgcagccaga

SEQ ID NO: 18964 - DNA, 25 bp, Mus musculus
tcgtcagtgcactataactccgcca

SEQ ID NO: 18965 - DNA, 25 bp, Mus musculus
gtgcactataactccgccagatgtc

SEQ ID NO: 18966 - DNA, 25 bp, Mus musculus
tataactccgccagatgtcgcaatc

SEQ ID NO: 18967 - DNA, 25 bp, Mus musculus
tccgccagatgtcgcaatctctgta

SEQ ID NO: 18968 - DNA, 25 bp, Mus musculus
agatgtcgcaatctctgtacctcga

SEQ ID NO: 18969 - DNA, 25 bp, Mus musculus
ctctgtacctcgagcaatctggggt

SEQ ID NO: 18970 - DNA, 25 bp, Mus musculus
acctcgagcaatctggggtcgatct

SEQ ID NO: 18971 - DNA, 25 bp, Mus musculus
agcaatctggggtcgatctagaaca

SEQ ID NO: 18972 - DNA, 25 bp, Mus musculus
tagaacactgggactatgcgcttcc

SEQ ID NO: 18973 - DNA, 25 bp, Mus musculus
tcaggccctttgggctcgatcttca

SEQ ID NO: 18974 - DNA, 25 bp, Mus musculus
cctaattactggcacatgatcagcg

SEQ ID NO: 18975 - DNA, 25 bp, Mus musculus
tactggcacatgatcagcgcttgac

SEQ ID NO: 18976 - DNA, 25 bp, Mus musculus
cacatgatcagcgcttgacacggca

SEQ ID NO: 18977 - DNA, 25 bp, Mus musculus
atcagcgcttgacacggcatctact

SEQ ID NO: 18978 - DNA, 25 bp, Mus musculus
gcttgacacggcatctactccactc

SEQ ID NO: 18979 - DNA, 25 bp, Mus musculus
ctacaaccgtgacaccgaccttcat

SEQ ID NO: 18980 - DNA, 25 bp, Mus musculus
ccttcatgccggacccaatcgtcag

SEQ ID NO: 18981 - DNA, 25 bp, Mus musculus
acccaatcgtcagtgcactataact

SEQ ID NO: 18982 - DNA, 25 bp, Mus musculus
atgtattcccacctagtcgactact

SEQ ID NO: 18983 - DNA, 25 bp, Mus musculus
ctagtcgactacttcccagaatatg

SEQ ID NO: 18984 - DNA, 25 bp, Mus musculus
gtctttgcagccgtcaaggacacca

SEQ ID NO: 18985 - DNA, 25 bp, Mus musculus
gtctaaccgtgcctcccagaaactg

SEQ ID NO: 18986 - DNA, 25 bp, Mus musculus
cgtcctggactctgtgagcgtgtcc

SEQ ID NO: 18987 - DNA, 25 bp, Mus musculus
ctgaagtacagtcccagcacatttc

SEQ ID NO: 18988 - DNA, 25 bp, Mus musculus
aagtacagtcccagcacatttcctc

SEQ ID NO: 18989 - DNA, 25 bp, Mus musculus
tacagtcccagcacatttcctcttt

SEQ ID NO: 18990 - DNA, 25 bp, Mus musculus
aaattttcagtcattcactcacagt

SEQ ID NO: 18991 - DNA, 25 bp, Mus musculus
ttttcagtcattcactcacagtata

SEQ ID NO: 18992 - DNA, 25 bp, Mus musculus
attcactcacagtataaaagcactc

SEQ ID NO: 18993 - DNA, 25 bp, Mus musculus
cagtataaaagcactcctgtcattc

SEQ ID NO: 18994 - DNA, 25 bp, Mus musculus
gtcgactacttcccagaatatgatg

SEQ ID NO: 18995 - DNA, 25 bp, Mus musculus
tacttcccagaatatgatggacccc

SEQ ID NO: 18996 - DNA, 25 bp, Mus musculus
agagatgcccaggcagctcgagaat

SEQ ID NO: 18997 - DNA, 25 bp, Mus musculus
gatgcccaggcagctcgagaattca

SEQ ID NO: 18998 - DNA, 25 bp, Mus musculus
ttcatcctgaaaatgttcgtggacc

SEQ ID NO: 18999 - DNA, 25 bp, Mus musculus
acgtgcgccacagataccgagaaca

SEQ ID NO: 19000 - DNA, 25 bp, Mus musculus
aacatccgcttcgtctttgcagccg

SEQ ID NO: 19001 - DNA, 25 bp, Mus musculus
ttcgtctttgcagccgtcaaggaca

SEQ ID NO: 19002 - DNA, 25 bp, Mus musculus
gctggctgaagacaccccagcttgt

SEQ ID NO: 19003 - DNA, 25 bp, Mus musculus
ggctgaagacaccccagcttgtgct

SEQ ID NO: 19004 - DNA, 25 bp, Mus musculus
caccctagctcaccatggggaacca

SEQ ID NO: 19005 - DNA, 25 bp, Mus musculus
cctagctcaccatggggaaccactt

SEQ ID NO: 19006 - DNA, 25 bp, Mus musculus
agctcaccatggggaaccacttgac

SEQ ID NO: 19007 - DNA, 25 bp, Mus musculus
tcaccatggggaaccacttgactga

SEQ ID NO: 19008 - DNA, 25 bp, Mus musculus
tgactgaaatggcccctacagcctc

SEQ ID NO: 19009 - DNA, 25 bp, Mus musculus
ctgaaatggcccctacagcctcgtc

SEQ ID NO: 19010 - DNA, 25 bp, Mus musculus
cgcacttccaggccctgcatgtcgt

SEQ ID NO: 19011 - DNA, 25 bp, Mus musculus
acttccaggccctgcatgtcgtcgt

SEQ ID NO: 19012 - DNA, 25 bp, Mus musculus
tgcatgtcgtcgtcattgggttgga

SEQ ID NO: 19013 - DNA, 25 bp, Mus musculus
atgtcgtcgtcattgggttggattc

SEQ ID NO: 19014 - DNA, 25 bp, Mus musculus
tgaagacaccccagcttgtgctacc

SEQ ID NO: 19015 - DNA, 25 bp, Mus musculus
agacaccccagcttgtgctacctgc

SEQ ID NO: 19016 - DNA, 25 bp, Mus musculus
agcttgtgctacctgccgttttaag

SEQ ID NO: 19017 - DNA, 25 bp, Mus musculus
taaggtctcctcttcttggcctctg

SEQ ID NO: 19018 - DNA, 25 bp, Mus musculus
ttcttggcctctgcttgagtcccag

SEQ ID NO: 19019 - DNA, 25 bp, Mus musculus
gcttgagtcccagacctactcctga

SEQ ID NO: 19020 - DNA, 25 bp, Mus musculus
tgagtcccagacctactcctgaggt

SEQ ID NO: 19021 - DNA, 25 bp, Mus musculus
gtcccagacctactcctgaggtcca

SEQ ID NO: 19022 - DNA, 25 bp, Mus musculus
ctaacatcgtcgagggcacgttaca

SEQ ID NO: 19023 - DNA, 25 bp, Mus musculus
catcgtcgagggcacgttacacagc

SEQ ID NO: 19024 - DNA, 25 bp, Mus musculus
ctctaagaactacaactcgatgagc

SEQ ID NO: 19025 - DNA, 25 bp, Mus musculus
ctaagaactacaactcgatgagcag

SEQ ID NO: 19026 - DNA, 25 bp, Mus musculus
gaactacaactcgatgagcagcaga

SEQ ID NO: 19027 - DNA, 25 bp, Mus musculus
actacaactcgatgagcagcagagc

SEQ ID NO: 19028 - DNA, 25 bp, Mus musculus
caagcgtttacaagctctgcttatc

SEQ ID NO: 19029 - DNA, 25 bp, Mus musculus
agcgtttacaagctctgcttatcca

SEQ ID NO: 19030 - DNA, 25 bp, Mus musculus
cgtttacaagctctgcttatccaga

SEQ ID NO: 19031 - DNA, 25 bp, Mus musculus
tttacaagctctgcttatccagaag

SEQ ID NO: 19032 - DNA, 25 bp, Mus musculus
tacaagctctgcttatccagaagtc

SEQ ID NO: 19033 - DNA, 25 bp, Mus musculus
caagctctgcttatccagaagtcaa

SEQ ID NO: 19034 - DNA, 25 bp, Mus musculus
agggcacgttacacagcaccgagcg

SEQ ID NO: 19035 - DNA, 25 bp, Mus musculus
agctctgcttatccagaagtcaaaa

SEQ ID NO: 19036 - DNA, 25 bp, Mus musculus
ggcacgttacacagcaccgagcgcg

SEQ ID NO: 19037 - DNA, 25 bp, Mus musculus
cgttacacagcaccgagcgcggctc

SEQ ID NO: 19038 - DNA, 25 bp, Mus musculus
ttacacagcaccgagcgcggctctg

SEQ ID NO: 19039 - DNA, 25 bp, Mus musculus
acacagcaccgagcgcggctctgaa

SEQ ID NO: 19040 - DNA, 25 bp, Mus musculus
acagcaccgagcgcggctctgaagc

SEQ ID NO: 19041 - DNA, 25 bp, Mus musculus
agcaccgagcgcggctctgaagcaa

SEQ ID NO: 19042 - DNA, 25 bp, Mus musculus
caccgagcgcggctctgaagcaaaa

SEQ ID NO: 19043 - DNA, 25 bp, Mus musculus
tctgtgctggctacaaagaaggcgg

SEQ ID NO: 19044 - DNA, 25 bp, Mus musculus
gccccttagtctgtaaacacagtgg

SEQ ID NO: 19045 - DNA, 25 bp, Mus musculus
gcaaactagagctccaggattctcg

SEQ ID NO: 19046 - DNA, 25 bp, Mus musculus
tagagctccaggattctcggctgta

SEQ ID NO: 19047 - DNA, 25 bp, Mus musculus
tccaggattctcggctgtaaaatgt

SEQ ID NO: 19048 - DNA, 25 bp, Mus musculus
attctcggctgtaaaatgttgataa

SEQ ID NO: 19049 - DNA, 25 bp, Mus musculus
tctacctcacatccgtatcattgga

SEQ ID NO: 19050 - DNA, 25 bp, Mus musculus
tcacatccgtatcattggattgaaa

SEQ ID NO: 19051 - DNA, 25 bp, Mus musculus
aagtgtgtttcctgccttgagtcac

SEQ ID NO: 19052 - DNA, 25 bp, Mus musculus
gtttcctgccttgagtcacaggagc

SEQ ID NO: 19053 - DNA, 25 bp, Mus musculus
tgccttgagtcacaggagctccaat

SEQ ID NO: 19054 - DNA, 25 bp, Mus musculus
gagtcacaggagctccaatgggagc

SEQ ID NO: 19055 - DNA, 25 bp, Mus musculus
gtaaacacagtggacggtggcagtt

SEQ ID NO: 19056 - DNA, 25 bp, Mus musculus
gtatcaccagctggggtgaaggctg

SEQ ID NO: 19057 - DNA, 25 bp, Mus musculus
gcaaggaccaaccaggagtctacac

SEQ ID NO: 19058 - DNA, 25 bp, Mus musculus
tctacaccaaagtttctgagtacat

SEQ ID NO: 19059 - DNA, 25 bp, Mus musculus
tttctgagtacatggactggatatt

SEQ ID NO: 19060 - DNA, 25 bp, Mus musculus
agacatcttcagcctgaggaggctg

SEQ ID NO: 19061 - DNA, 25 bp, Mus musculus
ctggctttaccacctgccctcaagg

SEQ ID NO: 19062 - DNA, 25 bp, Mus musculus
cctgccctcaaggcaaactagagct

SEQ ID NO: 19063 - DNA, 25 bp, Mus musculus
acatgatctccttgaaggggcacag

SEQ ID NO: 19064 - DNA, 25 bp, Mus musculus
tgatctccttgaaggggcacaggtc

SEQ ID NO: 19065 - DNA, 25 bp, Mus musculus
agaagctggcggccttcatgaagaa

SEQ ID NO: 19066 - DNA, 25 bp, Mus musculus
agctggcggccttcatgaagaattt

SEQ ID NO: 19067 - DNA, 25 bp, Mus musculus
agatgcatcagctgtgaacatgacc

SEQ ID NO: 19068 - DNA, 25 bp, Mus musculus
tgtgaacatgaccagccacgctctg

SEQ ID NO: 19069 - DNA, 25 bp, Mus musculus
gaacatgaccagccacgctctgcct

SEQ ID NO: 19070 - DNA, 25 bp, Mus musculus
gaccagccacgctctgcctgtgagc

SEQ ID NO: 19071 - DNA, 25 bp, Mus musculus
gagcagcacgcagcgtcgtttagag

SEQ ID NO: 19072 - DNA, 25 bp, Mus musculus
cagcacgcagcgtcgtttagagtaa

SEQ ID NO: 19073 - DNA, 25 bp, Mus musculus
tttcccaaatacatgcttattacag

SEQ ID NO: 19074 - DNA, 25 bp, Mus musculus
cccaaatacatgcttattacagatt

SEQ ID NO: 19075 - DNA, 25 bp, Mus musculus
tctccttgaaggggcacaggtcagt

SEQ ID NO: 19076 - DNA, 25 bp, Mus musculus
gaggcattcgtgcctctctgtataa

SEQ ID NO: 19077 - DNA, 25 bp, Mus musculus
cctctctgtataacgctgtcacaac

SEQ ID NO: 19078 - DNA, 25 bp, Mus musculus
ctctgtataacgctgtcacaaccga

SEQ ID NO: 19079 - DNA, 25 bp, Mus musculus
tgtataacgctgtcacaaccgaaga

SEQ ID NO: 19080 - DNA, 25 bp, Mus musculus
ataacgctgtcacaaccgaagacgt

SEQ ID NO: 19081 - DNA, 25 bp, Mus musculus
ctgtcacaaccgaagacgttgagaa

SEQ ID NO: 19082 - DNA, 25 bp, Mus musculus
tcacaaccgaagacgttgagaagct

SEQ ID NO: 19083 - DNA, 25 bp, Mus musculus
gagcttccaggatgtctactttgta

SEQ ID NO: 19084 - DNA, 25 bp, Mus musculus
tgtctactttgtatctgagagcttt

SEQ ID NO: 19085 - DNA, 25 bp, Mus musculus
tcagtctagagccagggctagttct

SEQ ID NO: 19086 - DNA, 25 bp, Mus musculus
agctcccagcttagcaatgtctctc

SEQ ID NO: 19087 - DNA, 25 bp, Mus musculus
cagcttagcaatgtctctcgcctct

SEQ ID NO: 19088 - DNA, 25 bp, Mus musculus
agcaatgtctctcgcctctctccat

SEQ ID NO: 19089 - DNA, 25 bp, Mus musculus
tctccatattcaatcactcactctc

SEQ ID NO: 19090 - DNA, 25 bp, Mus musculus
tattcaatcactcactctctctgaa

SEQ ID NO: 19091 - DNA, 25 bp, Mus musculus
cactctctctgaaaatgcacacctg

SEQ ID NO: 19092 - DNA, 25 bp, Mus musculus
aaatgcacacctggaactgcttatc

SEQ ID NO: 19093 - DNA, 25 bp, Mus musculus
cacgtgccacgtgatgcccaggaca

SEQ ID NO: 19094 - DNA, 25 bp, Mus musculus
ccacgtgatgcccaggacacacatt

SEQ ID NO: 19095 - DNA, 25 bp, Mus musculus
ctttgtatctgagagctttgaagat

SEQ ID NO: 19096 - DNA, 25 bp, Mus musculus
gtacacacagagtgttcaggttctc

SEQ ID NO: 19097 - DNA, 25 bp, Mus musculus
tgttcaggttctcagagacaccaag

SEQ ID NO: 19098 - DNA, 25 bp, Mus musculus
ggttctcagagacaccaagagcata

SEQ ID NO: 19099 - DNA, 25 bp, Mus musculus
ccttgatgtcatcagtgatgccctc

SEQ ID NO: 19100 - DNA, 25 bp, Mus musculus
tgtcatcagtgatgccctcgctagg

SEQ ID NO: 19101 - DNA, 25 bp, Mus musculus
ggtcaccaggtggcccagtgtgtga

SEQ ID NO: 19102 - DNA, 25 bp, Mus musculus
gcatatccaaaaagcctttgagcat

SEQ ID NO: 19103 - DNA, 25 bp, Mus musculus
agctgcgagtggcctgcttgaggac

SEQ ID NO: 19104 - DNA, 25 bp, Mus musculus
gacctcgctggagcccagcttaagg

SEQ ID NO: 19105 - DNA, 25 bp, Mus musculus
gatcaaactgtctccccaggaaact

SEQ ID NO: 19106 - DNA, 25 bp, Mus musculus
gctaatccaattattcctgtcactg

SEQ ID NO: 19107 - DNA, 25 bp, Mus musculus
attattcctgtcactgttaccataa

SEQ ID NO: 19108 - DNA, 25 bp, Mus musculus
attcctgtcactgttaccataattt

SEQ ID NO: 19109 - DNA, 25 bp, Mus musculus
tatcttggtgctgctgactctgttt

SEQ ID NO: 19110 - DNA, 25 bp, Mus musculus
taacataatgcactttaggtataca

SEQ ID NO: 19111 - DNA, 25 bp, Mus musculus
ttatctagactgatttccttctgtg

SEQ ID NO: 19112 - DNA, 25 bp, Mus musculus
tctagactgatttccttctgtgcat

SEQ ID NO: 19113 - DNA, 25 bp, Mus musculus
agactgatttccttctgtgcatgta

SEQ ID NO: 19114 - DNA, 25 bp, Mus musculus
tccttctgtgcatgtaaaaatggca

SEQ ID NO: 19115 - DNA, 25 bp, Mus musculus
ctcgctggagcccagcttaaggacg

SEQ ID NO: 19116 - DNA, 25 bp, Mus musculus
aaattttcatcgaagatcttccaag

SEQ ID NO: 19117 - DNA, 25 bp, Mus musculus
ttttcatcgaagatcttccaaggac

SEQ ID NO: 19118 - DNA, 25 bp, Mus musculus
tcatcgaagatcttccaaggacacg

SEQ ID NO: 19119 - DNA, 25 bp, Mus musculus
aagatcttccaaggacacgttacag

SEQ ID NO: 19120 - DNA, 25 bp, Mus musculus
atcttccaaggacacgttacaggat

SEQ ID NO: 19121 - DNA, 25 bp, Mus musculus
atttattgcctgtacatactgtaaa

SEQ ID NO: 19122 - DNA, 25 bp, Mus musculus
tattgcctgtacatactgtaaatgc

SEQ ID NO: 19123 - DNA, 25 bp, Mus musculus
acagatggcccagcgactcagccag

SEQ ID NO: 19124 - DNA, 25 bp, Mus musculus
ggcccagcgactcagccagggtcac

SEQ ID NO: 19125 - DNA, 25 bp, Mus musculus
ccgtcagggccactctcgtacttga

SEQ ID NO: 19126 - DNA, 25 bp, Mus musculus
tacttgaccacgtccatattgagac

SEQ ID NO: 19127 - DNA, 25 bp, Mus musculus
accacgtccatattgagactctccc

SEQ ID NO: 19128 - DNA, 25 bp, Mus musculus
ttctccatgctctcagggtcattta

SEQ ID NO: 19129 - DNA, 25 bp, Mus musculus
atgctctcagggtcatttagcactt

SEQ ID NO: 19130 - DNA, 25 bp, Mus musculus
tcatttagcacttcagccactctct

SEQ ID NO: 19131 - DNA, 25 bp, Mus musculus
agcacttcagccactctctgtttgt

SEQ ID NO: 19132 - DNA, 25 bp, Mus musculus
tcagccactctctgtttgtgaacat

SEQ ID NO: 19133 - DNA, 25 bp, Mus musculus
ttgtcaagaccctgcttacgtgacc

SEQ ID NO: 19134 - DNA, 25 bp, Mus musculus
agaccctgcttacgtgacctcatgg

SEQ ID NO: 19135 - DNA, 25 bp, Mus musculus
gcgactcagccagggtcacgttagt

SEQ ID NO: 19136 - DNA, 25 bp, Mus musculus
tgcttacgtgacctcatggcggctt

SEQ ID NO: 19137 - DNA, 25 bp, Mus musculus
cagccagggtcacgttagtgctagc

SEQ ID NO: 19138 - DNA, 25 bp, Mus musculus
cgttagtgctagcgtcttctaggct

SEQ ID NO: 19139 - DNA, 25 bp, Mus musculus
cgtcttctaggctgctgctgtcgtt

SEQ ID NO: 19140 - DNA, 25 bp, Mus musculus
ctaggctgctgctgtcgttttccac

SEQ ID NO: 19141 - DNA, 25 bp, Mus musculus
tgctgctgtcgttttccacacaaag

SEQ ID NO: 19142 - DNA, 25 bp, Mus musculus
tgtcgttttccacacaaagaggctc

SEQ ID NO: 19143 - DNA, 25 bp, Mus musculus
tttccacacaaagaggctctgcggg

SEQ ID NO: 19144 - DNA, 25 bp, Mus musculus
cagagtaccgtgcaggcacagatga

SEQ ID NO: 19145 - DNA, 25 bp, Mus musculus
accgtgcaggcacagatgaatatcc

SEQ ID NO: 19146 - DNA, 25 bp, Mus musculus
tcttgccctatttcagtccttgcta

SEQ ID NO: 19147 - DNA, 25 bp, Mus musculus
tgccctatttcagtccttgctacag

SEQ ID NO: 19148 - DNA, 25 bp, Mus musculus
cctatttcagtccttgctacagcat

SEQ ID NO: 19149 - DNA, 25 bp, Mus musculus
tcagtccttgctacagcattgacac

SEQ ID NO: 19150 - DNA, 25 bp, Mus musculus
gtccttgctacagcattgacactaa

SEQ ID NO: 19151 - DNA, 25 bp, Mus musculus
cttgctacagcattgacactaacaa

SEQ ID NO: 19152 - DNA, 25 bp, Mus musculus
gctacagcattgacactaacaatac

SEQ ID NO: 19153 - DNA, 25 bp, Mus musculus
ttgacactaacaataccactccact

SEQ ID NO: 19154 - DNA, 25 bp, Mus musculus
agagccatcctaacttaatagatca

SEQ ID NO: 19155 - DNA, 25 bp, Mus musculus
gccatcctaacttaatagatcattg

SEQ ID NO: 19156 - DNA, 25 bp, Mus musculus
atgaatatccgctcctgcccttgac

SEQ ID NO: 19157 - DNA, 25 bp, Mus musculus
actatgaggcccatgacatctcctt

SEQ ID NO: 19158 - DNA, 25 bp, Mus musculus
atgaggcccatgacatctccttcta

SEQ ID NO: 19159 - DNA, 25 bp, Mus musculus
aggcccatgacatctccttctataa

SEQ ID NO: 19160 - DNA, 25 bp, Mus musculus
atgacatctccttctataatgtgac

SEQ ID NO: 19161 - DNA, 25 bp, Mus musculus
acatctccttctataatgtgactga

SEQ ID NO: 19162 - DNA, 25 bp, Mus musculus
tctccttctataatgtgactgatgg

SEQ ID NO: 19163 - DNA, 25 bp, Mus musculus
caggccgtctcttgccctatttcag

SEQ ID NO: 19164 - DNA, 25 bp, Mus musculus
catagtcaaggccgactcctcagtc

SEQ ID NO: 19165 - DNA, 25 bp, Mus musculus
tctgagcataggaccacaggtgtag

SEQ ID NO: 19166 - DNA, 25 bp, Mus musculus
ttccggtcacgaactaaatcaggca

SEQ ID NO: 19167 - DNA, 25 bp, Mus musculus
cggtcacgaactaaatcaggcaggg

SEQ ID NO: 19168 - DNA, 25 bp, Mus musculus
gttgaccagaacacacatcgttggg

SEQ ID NO: 19169 - DNA, 25 bp, Mus musculus
aacacacatcgttgggttgatcgtg

SEQ ID NO: 19170 - DNA, 25 bp, Mus musculus
acacatcgttgggttgatcgtgttc

SEQ ID NO: 19171 - DNA, 25 bp, Mus musculus
agttctgaccctgttgttatcacca

SEQ ID NO: 19172 - DNA, 25 bp, Mus musculus
gttgttatcaccaccagcacccatt

SEQ ID NO: 19173 - DNA, 25 bp, Mus musculus
accagcacccattcagtatcctggc

SEQ ID NO: 19174 - DNA, 25 bp, Mus musculus
agcacccattcagtatcctggcttt

SEQ ID NO: 19175 - DNA, 25 bp, Mus musculus
gatcagttcagacaactgtgaatat

SEQ ID NO: 19176 - DNA, 25 bp, Mus musculus
atgcagagtaccctctcacagctca

SEQ ID NO: 19177 - DNA, 25 bp, Mus musculus
ctctcacagctcaacttaaatgagt

SEQ ID NO: 19178 - DNA, 25 bp, Mus musculus
tcacagctcaacttaaatgagtctc

SEQ ID NO: 19179 - DNA, 25 bp, Mus musculus
aacttaaatgagtctcccatcaagt

SEQ ID NO: 19180 - DNA, 25 bp, Mus musculus
tctcccatcaagtcttttgttcctg

SEQ ID NO: 19181 - DNA, 25 bp, Mus musculus
atcaagtcttttgttcctgtttcag

SEQ ID NO: 19182 - DNA, 25 bp, Mus musculus
tcttttgttcctgtttcagaagcta

SEQ ID NO: 19183 - DNA, 25 bp, Mus musculus
gttcctgtttcagaagctacaaatt

SEQ ID NO: 19184 - DNA, 25 bp, Mus musculus
ttttgtctctctccagtcttgaaca

SEQ ID NO: 19185 - DNA, 25 bp, Mus musculus
tctccagtcttgaacacttttgtct

SEQ ID NO: 19186 - DNA, 25 bp, Mus musculus
tccagctcatagagatccacttgcc

SEQ ID NO: 19187 - DNA, 25 bp, Mus musculus
tcatagagatccacttgcctccgac

SEQ ID NO: 19188 - DNA, 25 bp, Mus musculus
tagagatccacttgcctccgactcc

SEQ ID NO: 19189 - DNA, 25 bp, Mus musculus
tctgtctccctgtgatccatatggg

SEQ ID NO: 19190 - DNA, 25 bp, Mus musculus
gtctccctgtgatccatatgggtat

SEQ ID NO: 19191 - DNA, 25 bp, Mus musculus
acccttactttgtctcatggaggtg

SEQ ID NO: 19192 - DNA, 25 bp, Mus musculus
cttactttgtctcatggaggtgaca

SEQ ID NO: 19193 - DNA, 25 bp, Mus musculus
actttgtctcatggaggtgacaatt

SEQ ID NO: 19194 - DNA, 25 bp, Mus musculus
cttgtcccctggtggcaaggccatt

SEQ ID NO: 19195 - DNA, 25 bp, Mus musculus
taccgccctaggctggtcaatggag

SEQ ID NO: 19196 - DNA, 25 bp, Mus musculus
ccagtcttgaacacttttgtctccg

SEQ ID NO: 19197 - DNA, 25 bp, Mus musculus
gtcttgaacacttttgtctccgaga

SEQ ID NO: 19198 - DNA, 25 bp, Mus musculus
cttgcttgcttgcttgttgttgaga

SEQ ID NO: 19199 - DNA, 25 bp, Mus musculus
ttgcttgttgttgagacagggtctc

SEQ ID NO: 19200 - DNA, 25 bp, Mus musculus
acagggtctcaccatatagctctgg

SEQ ID NO: 19201 - DNA, 25 bp, Mus musculus
tctcaccatatagctctggatggcc

SEQ ID NO: 19202 - DNA, 25 bp, Mus musculus
caccatatagctctggatggcctgg

SEQ ID NO: 19203 - DNA, 25 bp, Mus musculus
ctggcctccagctcatagagatcca

SEQ ID NO: 19204 - DNA, 25 bp, Mus musculus
tgtttagcggtgccagactgaagct

SEQ ID NO: 19205 - DNA, 25 bp, Mus musculus
ttagcggtgccagactgaagctccg

SEQ ID NO: 19206 - DNA, 25 bp, Mus musculus
ctctctgagagaccctcaaagtttt

SEQ ID NO: 19207 - DNA, 25 bp, Mus musculus
tctgagagaccctcaaagtttttga

SEQ ID NO: 19208 - DNA, 25 bp, Mus musculus
aggtgtagctcagtcagtagagtgc

SEQ ID NO: 19209 - DNA, 25 bp, Mus musculus
gtgctgcatctgcaagagcaaatct

SEQ ID NO: 19210 - DNA, 25 bp, Mus musculus
tacctaaaaccaggaatggcagtgc

SEQ ID NO: 19211 - DNA, 25 bp, Mus musculus
tgtaatcccagcactcctgaggtac

SEQ ID NO: 19212 - DNA, 25 bp, Mus musculus
aatcccagcactcctgaggtacaag

SEQ ID NO: 19213 - DNA, 25 bp, Mus musculus
actcctgaggtacaagcaggaagat

SEQ ID NO: 19214 - DNA, 25 bp, Mus musculus
aagttcgaagccagcctgagctagt

SEQ ID NO: 19215 - DNA, 25 bp, Mus musculus
ttcgaagccagcctgagctagttga

SEQ ID NO: 19216 - DNA, 25 bp, Mus musculus
gtgccagactgaagctccggccttc

SEQ ID NO: 19217 - DNA, 25 bp, Mus musculus
ccagactgaagctccggccttccgg

SEQ ID NO: 19218 - DNA, 25 bp, Mus musculus
ggccttccggtgtaccaagcaagtg

SEQ ID NO: 19219 - DNA, 25 bp, Mus musculus
gttgtactcctgagtcaggttttct

SEQ ID NO: 19220 - DNA, 25 bp, Mus musculus
ctcctgagtcaggttttcttcagtt

SEQ ID NO: 19221 - DNA, 25 bp, Mus musculus
gttttcttcagttagatgctaacta

SEQ ID NO: 19222 - DNA, 25 bp, Mus musculus
atgctaactaagctctctgagagac

SEQ ID NO: 19223 - DNA, 25 bp, Mus musculus
ctaactaagctctctgagagaccct

SEQ ID NO: 19224 - DNA, 25 bp, Mus musculus
gtactgatctgctgaaggaagagtg

SEQ ID NO: 19225 - DNA, 25 bp, Mus musculus
agtgcgctgctattttcgcatacga

SEQ ID NO: 19226 - DNA, 25 bp, Mus musculus
aagtgcgtgacggattcgcatacct

SEQ ID NO: 19227 - DNA, 25 bp, Mus musculus
acggattcgcataccttgatacttg

SEQ ID NO: 19228 - DNA, 25 bp, Mus musculus
gattcgcataccttgatacttgtct

SEQ ID NO: 19229 - DNA, 25 bp, Mus musculus
agcaagatcagcaacatcagttctg

SEQ ID NO: 19230 - DNA, 25 bp, Mus musculus
agcaacatcagttctgaggcattcg

SEQ ID NO: 19231 - DNA, 25 bp, Mus musculus
aacatcagttctgaggcattcgcat

SEQ ID NO: 19232 - DNA, 25 bp, Mus musculus
atcagttctgaggcattcgcatctc

SEQ ID NO: 19233 - DNA, 25 bp, Mus musculus
agttctgaggcattcgcatctctcg

SEQ ID NO: 19234 - DNA, 25 bp, Mus musculus
tctgaggcattcgcatctctcgtgt

SEQ ID NO: 19235 - DNA, 25 bp, Mus musculus
ttcgcatctctcgtgtagttgcaga

SEQ ID NO: 19236 - DNA, 25 bp, Mus musculus
gcgctgctattttcgcatacgacac

SEQ ID NO: 19237 - DNA, 25 bp, Mus musculus
ctgctattttcgcatacgacacaag

SEQ ID NO: 19238 - DNA, 25 bp, Mus musculus
ctattttcgcatacgacacaagctg

SEQ ID NO: 19239 - DNA, 25 bp, Mus musculus
ttttcgcatacgacacaagctggct

SEQ ID NO: 19240 - DNA, 25 bp, Mus musculus
tcgcatacgacacaagctggctagg

SEQ ID NO: 19241 - DNA, 25 bp, Mus musculus
catacgacacaagctggctaggaat

SEQ ID NO: 19242 - DNA, 25 bp, Mus musculus
acgacacaagctggctaggaattgc

SEQ ID NO: 19243 - DNA, 25 bp, Mus musculus
aaagtaggtgccttcaagtgcgtga

SEQ ID NO: 19244 - DNA, 25 bp, Mus musculus
gacatagtgcgctggtgagatgcat

SEQ ID NO: 19245 - DNA, 25 bp, Mus musculus
gacctgcataacaacacaagtagag

SEQ ID NO: 19246 - DNA, 25 bp, Mus musculus
gaggcaaccgaacctctcgtgcagt

SEQ ID NO: 19247 - DNA, 25 bp, Mus musculus
gaacctctcgtgcagttgtaaagac

SEQ ID NO: 19248 - DNA, 25 bp, Mus musculus
taaagactttacctgtctaagcatc

SEQ ID NO: 19249 - DNA, 25 bp, Mus musculus
agactttacctgtctaagcatcatc

SEQ ID NO: 19250 - DNA, 25 bp, Mus musculus
tacctgtctaagcatcatctacagg

SEQ ID NO: 19251 - DNA, 25 bp, Mus musculus
ctgtctaagcatcatctacaggaac

SEQ ID NO: 19252 - DNA, 25 bp, Mus musculus
tctaagcatcatctacaggaactgc

SEQ ID NO: 19253 - DNA, 25 bp, Mus musculus
aagcatcatctacaggaactgcctg

SEQ ID NO: 19254 - DNA, 25 bp, Mus musculus
catctacaggaactgcctgtcaaaa

SEQ ID NO: 19255 - DNA, 25 bp, Mus musculus
caggaactgcctgtcaaaatgcaca

SEQ ID NO: 19256 - DNA, 25 bp, Mus musculus
ctgcataacaacacaagtagagaga

SEQ ID NO: 19257 - DNA, 25 bp, Mus musculus
atcatagaacgggcctgcaagtgac

SEQ ID NO: 19258 - DNA, 25 bp, Mus musculus
atagaacgggcctgcaagtgactga

SEQ ID NO: 19259 - DNA, 25 bp, Mus musculus
cataccttgaccgttgtcagcagca

SEQ ID NO: 19260 - DNA, 25 bp, Mus musculus
ttgaccgttgtcagcagcaagatca

SEQ ID NO: 19261 - DNA, 25 bp, Mus musculus
accgttgtcagcagcaagatcagtg

SEQ ID NO: 19262 - DNA, 25 bp, Mus musculus
atcagtgacatcagtccagaggcaa

SEQ ID NO: 19263 - DNA, 25 bp, Mus musculus
agtgacatcagtccagaggcaaccg

SEQ ID NO: 19264 - DNA, 25 bp, Mus musculus
tgaaagtccagctcaagggcagagg

SEQ ID NO: 19265 - DNA, 25 bp, Mus musculus
gaaagtccagctcaagggcagaggc

SEQ ID NO: 19266 - DNA, 25 bp, Mus musculus
agcgctatggtccaatggataagcc

SEQ ID NO: 19267 - DNA, 25 bp, Mus musculus
ggataagcctcaggtgatagagaag

SEQ ID NO: 19268 - DNA, 25 bp, Mus musculus
agctgctgtgctatctctagctagc

SEQ ID NO: 19269 - DNA, 25 bp, Mus musculus
gctgctgtgctatctctagctagca

SEQ ID NO: 19270 - DNA, 25 bp, Mus musculus
tgctgtgctatctctagctagcact

SEQ ID NO: 19271 - DNA, 25 bp, Mus musculus
gctgtgctatctctagctagcacta

SEQ ID NO: 19272 - DNA, 25 bp, Mus musculus
tgtgctatctctagctagcactaca

SEQ ID NO: 19273 - DNA, 25 bp, Mus musculus
gctatctctagctagcactacaaga

SEQ ID NO: 19274 - DNA, 25 bp, Mus musculus
tctagctagcactacaagagtgtgt

SEQ ID NO: 19275 - DNA, 25 bp, Mus musculus
ctagctagcactacaagagtgtgtc

SEQ ID NO: 19276 - DNA, 25 bp, Mus musculus
aagtccagctcaagggcagaggcat

SEQ ID NO: 19277 - DNA, 25 bp, Mus musculus
agctagcactacaagagtgtgtccc

SEQ ID NO: 19278 - DNA, 25 bp, Mus musculus
ggaactttaccaagtatctcatgaa

SEQ ID NO: 19279 - DNA, 25 bp, Mus musculus
gaactttaccaagtatctcatgaat

SEQ ID NO: 19280 - DNA, 25 bp, Mus musculus
actttaccaagtatctcatgaatat

SEQ ID NO: 19281 - DNA, 25 bp, Mus musculus
ttaccaagtatctcatgaatatgag

SEQ ID NO: 19282 - DNA, 25 bp, Mus musculus
taccaagtatctcatgaatatgagc

SEQ ID NO: 19283 - DNA, 25 bp, Mus musculus
tgaagcgctatggtccaatggataa

SEQ ID NO: 19284 - DNA, 25 bp, Mus musculus
gaagcgctatggtccaatggataag

SEQ ID NO: 19285 - DNA, 25 bp, Mus musculus
gccagcagagcccaggcaggctcca

SEQ ID NO: 19286 - DNA, 25 bp, Mus musculus
agagcccaggcaggctccactgtgg

SEQ ID NO: 19287 - DNA, 25 bp, Mus musculus
gtttgtgccactgatttagccacat

SEQ ID NO: 19288 - DNA, 25 bp, Mus musculus
gccactgatttagccacatgaacat

SEQ ID NO: 19289 - DNA, 25 bp, Mus musculus
gatttagccacatgaacatcatctc

SEQ ID NO: 19290 - DNA, 25 bp, Mus musculus
gccacatgaacatcatctcatcgcc

SEQ ID NO: 19291 - DNA, 25 bp, Mus musculus
cctctcctgaagctgcggtctctaa

SEQ ID NO: 19292 - DNA, 25 bp, Mus musculus
ctgaagctgcggtctctaaagtgcc

SEQ ID NO: 19293 - DNA, 25 bp, Mus musculus
tctctaaagtgccatctcattgtgc

SEQ ID NO: 19294 - DNA, 25 bp, Mus musculus
aagtgccatctcattgtgctttgta

SEQ ID NO: 19295 - DNA, 25 bp, Mus musculus
catctcattgtgctttgtatcagtc

SEQ ID NO: 19296 - DNA, 25 bp, Mus musculus
atcagtcagtgctggagaaatcttg

SEQ ID NO: 19297 - DNA, 25 bp, Mus musculus
ggctccactgtgggagacctcagtg

SEQ ID NO: 19298 - DNA, 25 bp, Mus musculus
ggagacctcagtgctctgcaccaac

SEQ ID NO: 19299 - DNA, 25 bp, Mus musculus
ctcagtgctctgcaccaactcttag

SEQ ID NO: 19300 - DNA, 25 bp, Mus musculus
caccaactcttagccaaacaacagg

SEQ ID NO: 19301 - DNA, 25 bp, Mus musculus
tcagctttggtgtctttgaacaatt

SEQ ID NO: 19302 - DNA, 25 bp, Mus musculus
ttttactttttccatcagatgtgac

SEQ ID NO: 19303 - DNA, 25 bp, Mus musculus
agggcctcatgcatgttagttaggc

SEQ ID NO: 19304 - DNA, 25 bp, Mus musculus
ccctttcctaactgctcaaagatgg

SEQ ID NO: 19305 - DNA, 25 bp, Mus musculus
aatgcctatatgttaactttgattt

SEQ ID NO: 19306 - DNA, 25 bp, Mus musculus
aatgtgaatcagtgctcgtgaatga

SEQ ID NO: 19307 - DNA, 25 bp, Mus musculus
gtatccaccagtgtatcagcattaa

SEQ ID NO: 19308 - DNA, 25 bp, Mus musculus
gcaacaatgcagtctcgccctacca

SEQ ID NO: 19309 - DNA, 25 bp, Mus musculus
tctcgccctaccagcaagtgattga

SEQ ID NO: 19310 - DNA, 25 bp, Mus musculus
gatcagaggctcccaactgggcaac

SEQ ID NO: 19311 - DNA, 25 bp, Mus musculus
gggcaacccaagactctggcttcta

SEQ ID NO: 19312 - DNA, 25 bp, Mus musculus
caacccaagactctggcttctatta

SEQ ID NO: 19313 - DNA, 25 bp, Mus musculus
cccaagactctggcttctattaaag

SEQ ID NO: 19314 - DNA, 25 bp, Mus musculus
actctggcttctattaaaggattat

SEQ ID NO: 19315 - DNA, 25 bp, Mus musculus
agacacagtagccattgtgtataaa

SEQ ID NO: 19316 - DNA, 25 bp, Mus musculus
catgtttgctacaaattttggagaa

SEQ ID NO: 19317 - DNA, 25 bp, Mus musculus
atgacttcttcctggtagcgtgtct

SEQ ID NO: 19318 - DNA, 25 bp, Mus musculus
acttcttcctggtagcgtgtctgga

SEQ ID NO: 19319 - DNA, 25 bp, Mus musculus
tcttcctggtagcgtgtctggagga

SEQ ID NO: 19320 - DNA, 25 bp, Mus musculus
acttcattgagaatgcccgtctctt

SEQ ID NO: 19321 - DNA, 25 bp, Mus musculus
agaatgcccgtctcttcatatttga

SEQ ID NO: 19322 - DNA, 25 bp, Mus musculus
gtctcttcatatttgagacgttttg

SEQ ID NO: 19323 - DNA, 25 bp, Mus musculus
tcttcatatttgagacgttttgtcg

SEQ ID NO: 19324 - DNA, 25 bp, Mus musculus
cgttttgtcgtatccaccagtgtat

SEQ ID NO: 19325 - DNA, 25 bp, Mus musculus
acatgcttcagctgaaggtccgagc

SEQ ID NO: 19326 - DNA, 25 bp, Mus musculus
catgcttcagctgaaggtccgagca

SEQ ID NO: 19327 - DNA, 25 bp, Mus musculus
cagcacagtagacaccgctgttaac

SEQ ID NO: 19328 - DNA, 25 bp, Mus musculus
agtagacaccgctgttaacattgtc

SEQ ID NO: 19329 - DNA, 25 bp, Mus musculus
gcagtacatcaacgactacatgaag

SEQ ID NO: 19330 - DNA, 25 bp, Mus musculus
agctgcagacacgttaagcacgacc

SEQ ID NO: 19331 - DNA, 25 bp, Mus musculus
agacacgttaagcacgaccttgcta

SEQ ID NO: 19332 - DNA, 25 bp, Mus musculus
acacgttaagcacgaccttgctaat

SEQ ID NO: 19333 - DNA, 25 bp, Mus musculus
gttaagcacgaccttgctaatgtca

SEQ ID NO: 19334 - DNA, 25 bp, Mus musculus
ataactaccagttatgtattcgtgt

SEQ ID NO: 19335 - DNA, 25 bp, Mus musculus
aactaccagttatgtattcgtgtca

SEQ ID NO: 19336 - DNA, 25 bp, Mus musculus
actaccagttatgtattcgtgtcaa

SEQ ID NO: 19337 - DNA, 25 bp, Mus musculus
atgcttcagctgaaggtccgagcag

SEQ ID NO: 19338 - DNA, 25 bp, Mus musculus
tgcttcagctgaaggtccgagcagg

SEQ ID NO: 19339 - DNA, 25 bp, Mus musculus
gcttcagctgaaggtccgagcaggc

SEQ ID NO: 19340 - DNA, 25 bp, Mus musculus
cttcagctgaaggtccgagcaggcg

SEQ ID NO: 19341 - DNA, 25 bp, Mus musculus
ttcagctgaaggtccgagcaggcga

SEQ ID NO: 19342 - DNA, 25 bp, Mus musculus
tcagctgaaggtccgagcaggcgaa

SEQ ID NO: 19343 - DNA, 25 bp, Mus musculus
aaggtccgagcaggcgaaggtacag

SEQ ID NO: 19344 - DNA, 25 bp, Mus musculus
gcagcacagtagacaccgctgttaa

SEQ ID NO: 19345 - DNA, 25 bp, Mus musculus
ttcagtctgggctcagtctggggac

SEQ ID NO: 19346 - DNA, 25 bp, Mus musculus
atggaaagtcacactctccacagtg

SEQ ID NO: 19347 - DNA, 25 bp, Mus musculus
agttggccacaattcaagcaacgag

SEQ ID NO: 19348 - DNA, 25 bp, Mus musculus
ttcaagcaacgagatgttggagaga

SEQ ID NO: 19349 - DNA, 25 bp, Mus musculus
ggacatatccatgcccctcttctta

SEQ ID NO: 19350 - DNA, 25 bp, Mus musculus
taggcccaagcaggccttcctgtgg

SEQ ID NO: 19351 - DNA, 25 bp, Mus musculus
tcctgtcaccccaaagggtggcatc

SEQ ID NO: 19352 - DNA, 25 bp, Mus musculus
caccccaaagggtggcatctgcacc

SEQ ID NO: 19353 - DNA, 25 bp, Mus musculus
cacctgtgccagggactaatattct

SEQ ID NO: 19354 - DNA, 25 bp, Mus musculus
aggcccttcaggctccgaaagcaag

SEQ ID NO: 19355 - DNA, 25 bp, Mus musculus
ctctgtccctggagcagaagagggg

SEQ ID NO: 19356 - DNA, 25 bp, Mus musculus
gggcaagccaacagacttgaaaagg

SEQ ID NO: 19357 - DNA, 25 bp, Mus musculus
actctccacagtgccagacagaagg

SEQ ID NO: 19358 - DNA, 25 bp, Mus musculus
gaggatcccccaaatcagagtatgc

SEQ ID NO: 19359 - DNA, 25 bp, Mus musculus
cccccaaatcagagtatgcctggga

SEQ ID NO: 19360 - DNA, 25 bp, Mus musculus
agtatgcctgggagtgattgaaaca

SEQ ID NO: 19361 - DNA, 25 bp, Mus musculus
cccaggatctcagtgacatcagcca

SEQ ID NO: 19362 - DNA, 25 bp, Mus musculus
atctcagtgacatcagccaggcatc

SEQ ID NO: 19363 - DNA, 25 bp, Mus musculus
gtgacatcagccaggcatctgtgga

SEQ ID NO: 19364 - DNA, 25 bp, Mus musculus
tcagccaggcatctgtggagttggc

SEQ ID NO: 19365 - DNA, 25 bp, Mus musculus
aaagcattattgctatccaagagaa

SEQ ID NO: 19366 - DNA, 25 bp, Mus musculus
gcattattgctatccaagagaacga

SEQ ID NO: 19367 - DNA, 25 bp, Mus musculus
acaaggcattgctccatcagggcca

SEQ ID NO: 19368 - DNA, 25 bp, Mus musculus
aggcattgctccatcagggccagcg

SEQ ID NO: 19369 - DNA, 25 bp, Mus musculus
cattgctccatcagggccagcggga

SEQ ID NO: 19370 - DNA, 25 bp, Mus musculus
gaagtttgagccacacacataaagt

SEQ ID NO: 19371 - DNA, 25 bp, Mus musculus
gtttgagccacacacataaagtcct

SEQ ID NO: 19372 - DNA, 25 bp, Mus musculus
tgagccacacacataaagtcctgat

SEQ ID NO: 19373 - DNA, 25 bp, Mus musculus
acacacataaagtcctgatgtctgc

SEQ ID NO: 19374 - DNA, 25 bp, Mus musculus
cacataaagtcctgatgtctgccag

SEQ ID NO: 19375 - DNA, 25 bp, Mus musculus
tcctgatgtctgccagaacttggaa

SEQ ID NO: 19376 - DNA, 25 bp, Mus musculus
tgatgtctgccagaacttggaagaa

SEQ ID NO: 19377 - DNA, 25 bp, Mus musculus
ttgctatccaagagaacgagcttaa

SEQ ID NO: 19378 - DNA, 25 bp, Mus musculus
tgcagcggcacacgaccacctcgag

SEQ ID NO: 19379 - DNA, 25 bp, Mus musculus
agcggcacacgaccacctcgaggcg

SEQ ID NO: 19380 - DNA, 25 bp, Mus musculus
cgaccacctcgaggcgcagaagcag

SEQ ID NO: 19381 - DNA, 25 bp, Mus musculus
gtatcatcaggccgtccagcacctg

SEQ ID NO: 19382 - DNA, 25 bp, Mus musculus
tcaggccgtccagcacctggaacag

SEQ ID NO: 19383 - DNA, 25 bp, Mus musculus
ggccgtccagcacctggaacagaag

SEQ ID NO: 19384 - DNA, 25 bp, Mus musculus
acttcaacaaggcattgctccatca

SEQ ID NO: 19385 - DNA, 25 bp, Mus musculus
ctcatcaactgccggggaccaatga

SEQ ID NO: 19386 - DNA, 25 bp, Mus musculus
ccaatgaatcagtgcctggtggcta

SEQ ID NO: 19387 - DNA, 25 bp, Mus musculus
ggccctgctcaactcagcctcattg

SEQ ID NO: 19388 - DNA, 25 bp, Mus musculus
agcctcattgcctctctgctcctga

SEQ ID NO: 19389 - DNA, 25 bp, Mus musculus
ctcctgaccctcggactatggggcg

SEQ ID NO: 19390 - DNA, 25 bp, Mus musculus
gtcctcctctggacctgactcctga

SEQ ID NO: 19391 - DNA, 25 bp, Mus musculus
ctctggacctgactcctgagccggc

SEQ ID NO: 19392 - DNA, 25 bp, Mus musculus
tcgtgttgtcttctttggacctcag

SEQ ID NO: 19393 - DNA, 25 bp, Mus musculus
tggacctcagtttttccatgaacca

SEQ ID NO: 19394 - DNA, 25 bp, Mus musculus
tcagtttttccatgaaccagaagag

SEQ ID NO: 19395 - DNA, 25 bp, Mus musculus
gtttttccatgaaccagaagagaat

SEQ ID NO: 19396 - DNA, 25 bp, Mus musculus
tttccatgaaccagaagagaattgg

SEQ ID NO: 19397 - DNA, 25 bp, Mus musculus
atgaatcagtgcctggtggctacag

SEQ ID NO: 19398 - DNA, 25 bp, Mus musculus
aatcagtgcctggtggctacaggct

SEQ ID NO: 19399 - DNA, 25 bp, Mus musculus
tgcctggtggctacaggcttagatg

SEQ ID NO: 19400 - DNA, 25 bp, Mus musculus
agttataccgtaagaggctgcgcca

SEQ ID NO: 19401 - DNA, 25 bp, Mus musculus
tgccaaggctcccacgtggcagact

SEQ ID NO: 19402 - DNA, 25 bp, Mus musculus
tgccacggcagcggctgtaacagcc

SEQ ID NO: 19403 - DNA, 25 bp, Mus musculus
cacggcagcggctgtaacagcccca

SEQ ID NO: 19404 - DNA, 25 bp, Mus musculus
agcggctgtaacagccccacagggg

SEQ ID NO: 19405 - DNA, 25 bp, Mus musculus
accactgtcaacactggccgaggga

SEQ ID NO: 19406 - DNA, 25 bp, Mus musculus
actgtcaacactggccgagggatgg

SEQ ID NO: 19407 - DNA, 25 bp, Mus musculus
gttgtcatctatttccagggcttcc

SEQ ID NO: 19408 - DNA, 25 bp, Mus musculus
gtcatctatttccagggcttccgag

SEQ ID NO: 19409 - DNA, 25 bp, Mus musculus
atctatttccagggcttccgagtgg

SEQ ID NO: 19410 - DNA, 25 bp, Mus musculus
ggcttccgagtggaccttccaatca

SEQ ID NO: 19411 - DNA, 25 bp, Mus musculus
gtggaccttccaatcaagtcggcgc

SEQ ID NO: 19412 - DNA, 25 bp, Mus musculus
gaccttccaatcaagtcggcgcgtt

SEQ ID NO: 19413 - DNA, 25 bp, Mus musculus
ccaatcaagtcggcgcgttaccgag

SEQ ID NO: 19414 - DNA, 25 bp, Mus musculus
gcgcgttaccgaggccagtacaaca

SEQ ID NO: 19415 - DNA, 25 bp, Mus musculus
ggccagtacaacacctatcccatca

SEQ ID NO: 19416 - DNA, 25 bp, Mus musculus
cagtacaacacctatcccatcaagc

SEQ ID NO: 19417 - DNA, 25 bp, Mus musculus
gaattcgaaggcgccatcatagcgc

SEQ ID NO: 19418 - DNA, 25 bp, Mus musculus
gaaggcgccatcatagcgctattcc

SEQ ID NO: 19419 - DNA, 25 bp, Mus musculus
atagcgctattccacctgctggcca

SEQ ID NO: 19420 - DNA, 25 bp, Mus musculus
acagacaaggtccgagcccttcgag

SEQ ID NO: 19421 - DNA, 25 bp, Mus musculus
aaggtccgagcccttcgagaggcat

SEQ ID NO: 19422 - DNA, 25 bp, Mus musculus
cgagcccttcgagaggcattctacc

SEQ ID NO: 19423 - DNA, 25 bp, Mus musculus
attgccaccatcttcgtctttgccg

SEQ ID NO: 19424 - DNA, 25 bp, Mus musculus
accatcttcgtctttgccgttgtca

SEQ ID NO: 19425 - DNA, 25 bp, Mus musculus
cacctctcgtgttcagttctattac

SEQ ID NO: 19426 - DNA, 25 bp, Mus musculus
gccaatctctcatttgaccgtattt

SEQ ID NO: 19427 - DNA, 25 bp, Mus musculus
tagcgtcccgtgttctaatgctctt

SEQ ID NO: 19428 - DNA, 25 bp, Mus musculus
cccgtgttctaatgctcttctaaga

SEQ ID NO: 19429 - DNA, 25 bp, Mus musculus
ttctaatgctcttctaagaaactga

SEQ ID NO: 19430 - DNA, 25 bp, Mus musculus
ttattgctcagcaataatcatgtca

SEQ ID NO: 19431 - DNA, 25 bp, Mus musculus
catgtcaccaggagttagcagcacg

SEQ ID NO: 19432 - DNA, 25 bp, Mus musculus
agttagcagcacgcctcatctcctg

SEQ ID NO: 19433 - DNA, 25 bp, Mus musculus
gcctcatctcctgatagcattatga

SEQ ID NO: 19434 - DNA, 25 bp, Mus musculus
tctcctgatagcattatgatgtttc

SEQ ID NO: 19435 - DNA, 25 bp, Mus musculus
ttgtttaccgtgtgttacatgtaag

SEQ ID NO: 19436 - DNA, 25 bp, Mus musculus
aattttgtaatgctcaagtgtctat

SEQ ID NO: 19437 - DNA, 25 bp, Mus musculus
tttaatctgcctgttttgacacatg

SEQ ID NO: 19438 - DNA, 25 bp, Mus musculus
ctgcctgttttgacacatgccgtct

SEQ ID NO: 19439 - DNA, 25 bp, Mus musculus
gttttgacacatgccgtctgtagta

SEQ ID NO: 19440 - DNA, 25 bp, Mus musculus
acacatgccgtctgtagtaaccgct

SEQ ID NO: 19441 - DNA, 25 bp, Mus musculus
aaccgctcgctgtgaggccccatct

SEQ ID NO: 19442 - DNA, 25 bp, Mus musculus
tcgctgtgaggccccatcttgacag

SEQ ID NO: 19443 - DNA, 25 bp, Mus musculus
tgaggccccatcttgacagtccaag

SEQ ID NO: 19444 - DNA, 25 bp, Mus musculus
ttgacagtccaagtgatcgtgacca

SEQ ID NO: 19445 - DNA, 25 bp, Mus musculus
catactctcctagaaggcggccaag

SEQ ID NO: 19446 - DNA, 25 bp, Mus musculus
ctcctagaaggcggccaagcccaag

SEQ ID NO: 19447 - DNA, 25 bp, Mus musculus
gtaggttatcaccttcagcaagtcc

SEQ ID NO: 19448 - DNA, 25 bp, Mus musculus
aggttatcaccttcagcaagtcctc

SEQ ID NO: 19449 - DNA, 25 bp, Mus musculus
gttatcaccttcagcaagtcctcca

SEQ ID NO: 19450 - DNA, 25 bp, Mus musculus
tatcaccttcagcaagtcctccacg

SEQ ID NO: 19451 - DNA, 25 bp, Mus musculus
accttcagcaagtcctccacggcga

SEQ ID NO: 19452 - DNA, 25 bp, Mus musculus
cttcagcaagtcctccacggcgaag

SEQ ID NO: 19453 - DNA, 25 bp, Mus musculus
tcagcaagtcctccacggcgaagac

SEQ ID NO: 19454 - DNA, 25 bp, Mus musculus
agcaagtcctccacggcgaagacac

SEQ ID NO: 19455 - DNA, 25 bp, Mus musculus
cgaagacaccggccgtcatctccag

SEQ ID NO: 19456 - DNA, 25 bp, Mus musculus
aagacaccggccgtcatctccagca

SEQ ID NO: 19457 - DNA, 25 bp, Mus musculus
tagaaggcggccaagcccaagacga

SEQ ID NO: 19458 - DNA, 25 bp, Mus musculus
gcggccaagcccaagacgacgacca

SEQ ID NO: 19459 - DNA, 25 bp, Mus musculus
gaagaagaactccaccaagacggat

SEQ ID NO: 19460 - DNA, 25 bp, Mus musculus
agaagaactccaccaagacggatgc

SEQ ID NO: 19461 - DNA, 25 bp, Mus musculus
gaactccaccaagacggatgcctcc

SEQ ID NO: 19462 - DNA, 25 bp, Mus musculus
ctccaccaaggcaccggaggagtag

SEQ ID NO: 19463 - DNA, 25 bp, Mus musculus
gcatccctgtctggaagtagctcgt

SEQ ID NO: 19464 - DNA, 25 bp, Mus musculus
gtcctcttcatctcgttcccggtca

SEQ ID NO: 19465 - DNA, 25 bp, Mus musculus
gggaaccctgcttgcagtctattgc

SEQ ID NO: 19466 - DNA, 25 bp, Mus musculus
cctgcttgcagtctattgcatttac

SEQ ID NO: 19467 - DNA, 25 bp, Mus musculus
tttcataataccgtatagacactgc

SEQ ID NO: 19468 - DNA, 25 bp, Mus musculus
aataccgtatagacactgcttgaag

SEQ ID NO: 19469 - DNA, 25 bp, Mus musculus
tttttacagcatgaacctgtctact

SEQ ID NO: 19470 - DNA, 25 bp, Mus musculus
cagcatgaacctgtctactcatgcc

SEQ ID NO: 19471 - DNA, 25 bp, Mus musculus
gaacctgtctactcatgccagcact

SEQ ID NO: 19472 - DNA, 25 bp, Mus musculus
gtctactcatgccagcactcaaaaa

SEQ ID NO: 19473 - DNA, 25 bp, Mus musculus
gcttatacctaaaaccataatggca

SEQ ID NO: 19474 - DNA, 25 bp, Mus musculus
agccctgaagtgtgcccttccagcc

SEQ ID NO: 19475 - DNA, 25 bp, Mus musculus
tccagccaggtcataccctgtggag

SEQ ID NO: 19476 - DNA, 25 bp, Mus musculus
ataccctgtggaggtgagcgggatc

SEQ ID NO: 19477 - DNA, 25 bp, Mus musculus
catttacataccgcatttcagggca

SEQ ID NO: 19478 - DNA, 25 bp, Mus musculus
cataccgcatttcagggcacattag

SEQ ID NO: 19479 - DNA, 25 bp, Mus musculus
gcatttcagggcacattagcatcca

SEQ ID NO: 19480 - DNA, 25 bp, Mus musculus
gcatccactcctatggtagcacact

SEQ ID NO: 19481 - DNA, 25 bp, Mus musculus
actcctatggtagcacactgttgac

SEQ ID NO: 19482 - DNA, 25 bp, Mus musculus
ccttatccaaaatgcttgggactag

SEQ ID NO: 19483 - DNA, 25 bp, Mus musculus
attttagagtcttttcaggcatagg

SEQ ID NO: 19484 - DNA, 25 bp, Mus musculus
gagtcttttcaggcataggtatatt

SEQ ID NO: 19485 - DNA, 25 bp, Mus musculus
cccctgagaatccatcttcatggcc

SEQ ID NO: 19486 - DNA, 25 bp, Mus musculus
ctgagaatccatcttcatggccaac

SEQ ID NO: 19487 - DNA, 25 bp, Mus musculus
ttggcaatgctgccccagtacccac

SEQ ID NO: 19488 - DNA, 25 bp, Mus musculus
gtcgtccatctccgtctgagggcaa

SEQ ID NO: 19489 - DNA, 25 bp, Mus musculus
ctccgtctgagggcaactgggtgtg

SEQ ID NO: 19490 - DNA, 25 bp, Mus musculus
cctcgcctagtctggaagcagttcc

SEQ ID NO: 19491 - DNA, 25 bp, Mus musculus
cagttccatcataaagtgttcaaca

SEQ ID NO: 19492 - DNA, 25 bp, Mus musculus
aaagtgttcaacatgccctacttca

SEQ ID NO: 19493 - DNA, 25 bp, Mus musculus
gtgttcaacatgccctacttcatcc

SEQ ID NO: 19494 - DNA, 25 bp, Mus musculus
ttcaacatgccctacttcatccttt

SEQ ID NO: 19495 - DNA, 25 bp, Mus musculus
tcaccagggccacaccagaggtcct

SEQ ID NO: 19496 - DNA, 25 bp, Mus musculus
tcctgggtccatcaataaatacagt

SEQ ID NO: 19497 - DNA, 25 bp, Mus musculus
catcttcatggccaactctgcctga

SEQ ID NO: 19498 - DNA, 25 bp, Mus musculus
ggccaactctgcctgacccgggaga

SEQ ID NO: 19499 - DNA, 25 bp, Mus musculus
atcatcctggagccaagcctctacc

SEQ ID NO: 19500 - DNA, 25 bp, Mus musculus
ctctaccccgggatgacttcatcat

SEQ ID NO: 19501 - DNA, 25 bp, Mus musculus
tttgttccttccttgcttgagagac

SEQ ID NO: 19502 - DNA, 25 bp, Mus musculus
gcactaagtcgattgcactggtttg

SEQ ID NO: 19503 - DNA, 25 bp, Mus musculus
ctaagtcgattgcactggtttggag

SEQ ID NO: 19504 - DNA, 25 bp, Mus musculus
ttgagtctctccgtatgaatgtata

SEQ ID NO: 19505 - DNA, 25 bp, Mus musculus
cagtgcagttgcagcgccgacagat

SEQ ID NO: 19506 - DNA, 25 bp, Mus musculus
tgcagcgccgacagatgctactaga

SEQ ID NO: 19507 - DNA, 25 bp, Mus musculus
gcgccattctcaggcacatcgacac

SEQ ID NO: 19508 - DNA, 25 bp, Mus musculus
ttctcaggcacatcgacacaggtgc

SEQ ID NO: 19509 - DNA, 25 bp, Mus musculus
ctgcgacaccttcgctgcctgggta

SEQ ID NO: 19510 - DNA, 25 bp, Mus musculus
cgacaccttcgctgcctgggtatcc

SEQ ID NO: 19511 - DNA, 25 bp, Mus musculus
tgcctgggtatccgccagggactcg

SEQ ID NO: 19512 - DNA, 25 bp, Mus musculus
ggtatccgccagggactcggagtgt

SEQ ID NO: 19513 - DNA, 25 bp, Mus musculus
tttttccgactgtcattattcgcta

SEQ ID NO: 19514 - DNA, 25 bp, Mus musculus
tcattattcgctatgcagcgaccgc

SEQ ID NO: 19515 - DNA, 25 bp, Mus musculus
ttattcgctatgcagcgaccgcttc

SEQ ID NO: 19516 - DNA, 25 bp, Mus musculus
ttcgctatgcagcgaccgcttctct

SEQ ID NO: 19517 - DNA, 25 bp, Mus musculus
agcgccgacagatgctactagatga

SEQ ID NO: 19518 - DNA, 25 bp, Mus musculus
ggtggcctctgatttcacttatctg

SEQ ID NO: 19519 - DNA, 25 bp, Mus musculus
tgatttcacttatctgtacgcgcag

SEQ ID NO: 19520 - DNA, 25 bp, Mus musculus
tttcacttatctgtacgcgcagtgt

SEQ ID NO: 19521 - DNA, 25 bp, Mus musculus
cacttatctgtacgcgcagtgtgta

SEQ ID NO: 19522 - DNA, 25 bp, Mus musculus
tctgtacgcgcagtgtgtacaccag

SEQ ID NO: 19523 - DNA, 25 bp, Mus musculus
tgtacaccagcgccattctcaggca

SEQ ID NO: 19524 - DNA, 25 bp, Mus musculus
acaccagcgccattctcaggcacat

SEQ ID NO: 19525 - DNA, 25 bp, Mus musculus
tcctgtattgtatcaccacagaggt

SEQ ID NO: 19526 - DNA, 25 bp, Mus musculus
cctgtattgtatcaccacagaggtc

SEQ ID NO: 19527 - DNA, 25 bp, Mus musculus
acttagcgagactgtcatgcagtgt

SEQ ID NO: 19528 - DNA, 25 bp, Mus musculus
cttagcgagactgtcatgcagtgtt

SEQ ID NO: 19529 - DNA, 25 bp, Mus musculus
ttagcgagactgtcatgcagtgttg

SEQ ID NO: 19530 - DNA, 25 bp, Mus musculus
agcgagactgtcatgcagtgttggt

SEQ ID NO: 19531 - DNA, 25 bp, Mus musculus
agactgtcatgcagtgttggtgacg

SEQ ID NO: 19532 - DNA, 25 bp, Mus musculus
gactgtcatgcagtgttggtgacga

SEQ ID NO: 19533 - DNA, 25 bp, Mus musculus
actgtcatgcagtgttggtgacgat

SEQ ID NO: 19534 - DNA, 25 bp, Mus musculus
ctgtcatgcagtgttggtgacgatg

SEQ ID NO: 19535 - DNA, 25 bp, Mus musculus
gtcatgcagtgttggtgacgatgac

SEQ ID NO: 19536 - DNA, 25 bp, Mus musculus
tcatgcagtgttggtgacgatgact

SEQ ID NO: 19537 - DNA, 25 bp, Mus musculus
tgtattgtatcaccacagaggtcat

SEQ ID NO: 19538 - DNA, 25 bp, Mus musculus
gtattgtatcaccacagaggtcatc

SEQ ID NO: 19539 - DNA, 25 bp, Mus musculus
tattgtatcaccacagaggtcatca

SEQ ID NO: 19540 - DNA, 25 bp, Mus musculus
caagtcggtcgtggatcggttcgag

SEQ ID NO: 19541 - DNA, 25 bp, Mus musculus
tcgtggatcggttcgaggctgtaga

SEQ ID NO: 19542 - DNA, 25 bp, Mus musculus
cgtggatcggttcgaggctgtagaa

SEQ ID NO: 19543 - DNA, 25 bp, Mus musculus
attgatacttagcgagactgtcatg

SEQ ID NO: 19544 - DNA, 25 bp, Mus musculus
atacttagcgagactgtcatgcagt

SEQ ID NO: 19545 - DNA, 25 bp, Mus musculus
gagtcctcacaggtggaagaaatct

SEQ ID NO: 19546 - DNA, 25 bp, Mus musculus
tcacaaacagacaacgaagagtcat

SEQ ID NO: 19547 - DNA, 25 bp, Mus musculus
gcaccacttggacccaagactgata

SEQ ID NO: 19548 - DNA, 25 bp, Mus musculus
cttggacccaagactgatatcaggc

SEQ ID NO: 19549 - DNA, 25 bp, Mus musculus
actgatatcaggcttggcaagggag

SEQ ID NO: 19550 - DNA, 25 bp, Mus musculus
atcaggcttggcaagggagttcatt

SEQ ID NO: 19551 - DNA, 25 bp, Mus musculus
cctaacacagtatccttcagattcc

SEQ ID NO: 19552 - DNA, 25 bp, Mus musculus
tccttcagattccccaaaatattca

SEQ ID NO: 19553 - DNA, 25 bp, Mus musculus
ggtgactccatctaattcccaacca

SEQ ID NO: 19554 - DNA, 25 bp, Mus musculus
gttattttccatacagtttaagctg

SEQ ID NO: 19555 - DNA, 25 bp, Mus musculus
ttccatacagtttaagctggcttcc

SEQ ID NO: 19556 - DNA, 25 bp, Mus musculus
taagctggcttcccatgttgttttc

SEQ ID NO: 19557 - DNA, 25 bp, Mus musculus
cagcagtccaggtccacaaagccag

SEQ ID NO: 19558 - DNA, 25 bp, Mus musculus
tccaggtccacaaagccagagccac

SEQ ID NO: 19559 - DNA, 25 bp, Mus musculus
tccacaaagccagagccacagaacc

SEQ ID NO: 19560 - DNA, 25 bp, Mus musculus
gagccacagaacctgagcccagcta

SEQ ID NO: 19561 - DNA, 25 bp, Mus musculus
cagaacctgagcccagctaaggcag

SEQ ID NO: 19562 - DNA, 25 bp, Mus musculus
ctgagcccagctaaggcagcaccac

SEQ ID NO: 19563 - DNA, 25 bp, Mus musculus
ccagctaaggcagcaccacttggac

SEQ ID NO: 19564 - DNA, 25 bp, Mus musculus
aaggcagcaccacttggacccaaga

SEQ ID NO: 19565 - DNA, 25 bp, Mus musculus
tacctggtgcagatccgtgttctac

SEQ ID NO: 19566 - DNA, 25 bp, Mus musculus
gtgcagatccgtgttctacaacccc

SEQ ID NO: 19567 - DNA, 25 bp, Mus musculus
ctaaagtctggggtctcatgagcct

SEQ ID NO: 19568 - DNA, 25 bp, Mus musculus
tctggggtctcatgagccttgagat

SEQ ID NO: 19569 - DNA, 25 bp, Mus musculus
ggggtctcatgagccttgagatggc

SEQ ID NO: 19570 - DNA, 25 bp, Mus musculus
gtctcatgagccttgagatggcgtt

SEQ ID NO: 19571 - DNA, 25 bp, Mus musculus
tcatgagccttgagatggcgttgac

SEQ ID NO: 19572 - DNA, 25 bp, Mus musculus
ctcctcgccttccagtaaggaccag

SEQ ID NO: 19573 - DNA, 25 bp, Mus musculus
ctcgccttccagtaaggaccagact

SEQ ID NO: 19574 - DNA, 25 bp, Mus musculus
tggactgccttacccatgccagttc

SEQ ID NO: 19575 - DNA, 25 bp, Mus musculus
actgccttacccatgccagttctgt

SEQ ID NO: 19576 - DNA, 25 bp, Mus musculus
ttacccatgccagttctgtgacaag

SEQ ID NO: 19577 - DNA, 25 bp, Mus musculus
ccccttctgtttctcttgagtgact

SEQ ID NO: 19578 - DNA, 25 bp, Mus musculus
cttctgtttctcttgagtgacttcc

SEQ ID NO: 19579 - DNA, 25 bp, Mus musculus
tttctcttgagtgacttcccatgga

SEQ ID NO: 19580 - DNA, 25 bp, Mus musculus
ctcttgagtgacttcccatggattg

SEQ ID NO: 19581 - DNA, 25 bp, Mus musculus
ttgagtgacttcccatggattgcat

SEQ ID NO: 19582 - DNA, 25 bp, Mus musculus
agtgacttcccatggattgcatggt

SEQ ID NO: 19583 - DNA, 25 bp, Mus musculus
gacttcccatggattgcatggttga

SEQ ID NO: 19584 - DNA, 25 bp, Mus musculus
acagttctaaagtctggggtctcat

SEQ ID NO: 19585 - DNA, 25 bp, Mus musculus
gaatggtgcgaacggcctgggctct

SEQ ID NO: 19586 - DNA, 25 bp, Mus musculus
tggtgcgaacggcctgggctctcta

SEQ ID NO: 19587 - DNA, 25 bp, Mus musculus
acagcctgacttggctgtgattcat

SEQ ID NO: 19588 - DNA, 25 bp, Mus musculus
agcctgacttggctgtgattcatca

SEQ ID NO: 19589 - DNA, 25 bp, Mus musculus
ctgacttggctgtgattcatcacat

SEQ ID NO: 19590 - DNA, 25 bp, Mus musculus
tgacttggctgtgattcatcacatg

SEQ ID NO: 19591 - DNA, 25 bp, Mus musculus
ctgtgattcatcacatgagcccttc

SEQ ID NO: 19592 - DNA, 25 bp, Mus musculus
tgattcatcacatgagcccttcctg

SEQ ID NO: 19593 - DNA, 25 bp, Mus musculus
gattcatcacatgagcccttcctgg

SEQ ID NO: 19594 - DNA, 25 bp, Mus musculus
ttcatcacatgagcccttcctggat

SEQ ID NO: 19595 - DNA, 25 bp, Mus musculus
tcatcacatgagcccttcctggatt

SEQ ID NO: 19596 - DNA, 25 bp, Mus musculus
ggatttcctctgggcttctccgccg

SEQ ID NO: 19597 - DNA, 25 bp, Mus musculus
agaccaggtctgggcgcagacttgg

SEQ ID NO: 19598 - DNA, 25 bp, Mus musculus
ccaggtctgggcgcagacttggccc

SEQ ID NO: 19599 - DNA, 25 bp, Mus musculus
caggtctgggcgcagacttggccca

SEQ ID NO: 19600 - DNA, 25 bp, Mus musculus
gcccttagtctttggctacgtactg

SEQ ID NO: 19601 - DNA, 25 bp, Mus musculus
ccttagtctttggctacgtactgag

SEQ ID NO: 19602 - DNA, 25 bp, Mus musculus
tagtctttggctacgtactgaggat

SEQ ID NO: 19603 - DNA, 25 bp, Mus musculus
agtctttggctacgtactgaggatg

SEQ ID NO: 19604 - DNA, 25 bp, Mus musculus
tctttggctacgtactgaggatggg

SEQ ID NO: 19605 - DNA, 25 bp, Mus musculus
ccagcgacctgctgttgacagctcc

SEQ ID NO: 19606 - DNA, 25 bp, Mus musculus
acctgctgttgacagctcctacctg

SEQ ID NO: 19607 - DNA, 25 bp, Mus musculus
cttctccgactctacagctgctgct

SEQ ID NO: 19608 - DNA, 25 bp, Mus musculus
tgccagggactcctgttttagctac

SEQ ID NO: 19609 - DNA, 25 bp, Mus musculus
tgcccttcctggacagctgcgaagc

SEQ ID NO: 19610 - DNA, 25 bp, Mus musculus
ccttcctggacagctgcgaagccca

SEQ ID NO: 19611 - DNA, 25 bp, Mus musculus
tggacagctgcgaagcccactcatg

SEQ ID NO: 19612 - DNA, 25 bp, Mus musculus
acagctgcgaagcccactcatgccg

SEQ ID NO: 19613 - DNA, 25 bp, Mus musculus
gctgcgaagcccactcatgccgtga

SEQ ID NO: 19614 - DNA, 25 bp, Mus musculus
gcgaagcccactcatgccgtgaatg

SEQ ID NO: 19615 - DNA, 25 bp, Mus musculus
aagcccactcatgccgtgaatgatc

SEQ ID NO: 19616 - DNA, 25 bp, Mus musculus
cccactcatgccgtgaatgatcaga

SEQ ID NO: 19617 - DNA, 25 bp, Mus musculus
tgctgttgacagctcctacctgtca

SEQ ID NO: 19618 - DNA, 25 bp, Mus musculus
actcatgccgtgaatgatcagatct

SEQ ID NO: 19619 - DNA, 25 bp, Mus musculus
gcgtatgatccctagtcactaggtt

SEQ ID NO: 19620 - DNA, 25 bp, Mus musculus
tatgatccctagtcactaggttttg

SEQ ID NO: 19621 - DNA, 25 bp, Mus musculus
gatccctagtcactaggttttgaat

SEQ ID NO: 19622 - DNA, 25 bp, Mus musculus
tagtcactaggttttgaatgcactg

SEQ ID NO: 19623 - DNA, 25 bp, Mus musculus
gaatgcactggagccaatggtgact

SEQ ID NO: 19624 - DNA, 25 bp, Mus musculus
tgcactggagccaatggtgactgga

SEQ ID NO: 19625 - DNA, 25 bp, Mus musculus
cctcgcagactttatacggaccatc

SEQ ID NO: 19626 - DNA, 25 bp, Mus musculus
aatctacaataccatttcaaatcta

SEQ ID NO: 19627 - DNA, 25 bp, Mus musculus
caataccatttcaaatctaagcatc

SEQ ID NO: 19628 - DNA, 25 bp, Mus musculus
aacgccgtcagcaacgagaagatgg

SEQ ID NO: 19629 - DNA, 25 bp, Mus musculus
cctggtagcagtgtctcagtggtcc

SEQ ID NO: 19630 - DNA, 25 bp, Mus musculus
agcagtgtctcagtggtccaggtaa

SEQ ID NO: 19631 - DNA, 25 bp, Mus musculus
agtgtctcagtggtccaggtaagta

SEQ ID NO: 19632 - DNA, 25 bp, Mus musculus
gtctcagtggtccaggtaagtacca

SEQ ID NO: 19633 - DNA, 25 bp, Mus musculus
gtaagtaccaggactcggaagtcag

SEQ ID NO: 19634 - DNA, 25 bp, Mus musculus
agtaccaggactcggaagtcagcgg

SEQ ID NO: 19635 - DNA, 25 bp, Mus musculus
catccctccgaagagcctgtgaacg

SEQ ID NO: 19636 - DNA, 25 bp, Mus musculus
ccctccgaagagcctgtgaacgagg

SEQ ID NO: 19637 - DNA, 25 bp, Mus musculus
tccgaagagcctgtgaacgagggac

SEQ ID NO: 19638 - DNA, 25 bp, Mus musculus
taccatttcaaatctaagcatccca

SEQ ID NO: 19639 - DNA, 25 bp, Mus musculus
catttcaaatctaagcatcccacct

SEQ ID NO: 19640 - DNA, 25 bp, Mus musculus
cccacctgtcccagcaaaagaatgg

SEQ ID NO: 19641 - DNA, 25 bp, Mus musculus
acctgtcccagcaaaagaatggatg

SEQ ID NO: 19642 - DNA, 25 bp, Mus musculus
gaggctgacctgcttaataacgccg

SEQ ID NO: 19643 - DNA, 25 bp, Mus musculus
gctgacctgcttaataacgccgtca

SEQ ID NO: 19644 - DNA, 25 bp, Mus musculus
gacctgcttaataacgccgtcagca

SEQ ID NO: 19645 - DNA, 25 bp, Mus musculus
cttaataacgccgtcagcaacgaga

SEQ ID NO: 19646 - DNA, 25 bp, Mus musculus
atctaattattctccaggccccttg

SEQ ID NO: 19647 - DNA, 25 bp, Mus musculus
tccaggccccttggagaaagggctg

SEQ ID NO: 19648 - DNA, 25 bp, Mus musculus
gtgctttgtgtagctggtctgagaa

SEQ ID NO: 19649 - DNA, 25 bp, Mus musculus
ctttgtgtagctggtctgagaagtg

SEQ ID NO: 19650 - DNA, 25 bp, Mus musculus
atctccctgaataggcagacttact

SEQ ID NO: 19651 - DNA, 25 bp, Mus musculus
ttgtctgtaaccaaaatcaaacata

SEQ ID NO: 19652 - DNA, 25 bp, Mus musculus
tctgtaaccaaaatcaaacatagtt

SEQ ID NO: 19653 - DNA, 25 bp, Mus musculus
accaaaatcaaacatagttaatgtg

SEQ ID NO: 19654 - DNA, 25 bp, Mus musculus
gtccaggtgtatccaacttgggaag

SEQ ID NO: 19655 - DNA, 25 bp, Mus musculus
cacagaaatatcaccgttgtgaggt

SEQ ID NO: 19656 - DNA, 25 bp, Mus musculus
aatatcaccgttgtgaggttgaaca

SEQ ID NO: 19657 - DNA, 25 bp, Mus musculus
atcaccgttgtgaggttgaacaata

SEQ ID NO: 19658 - DNA, 25 bp, Mus musculus
ctcatatgacgccaaacagactccc

SEQ ID NO: 19659 - DNA, 25 bp, Mus musculus
cccagtgggccatcacatctcagga

SEQ ID NO: 19660 - DNA, 25 bp, Mus musculus
tcacatctcaggaggttaaaagcaa

SEQ ID NO: 19661 - DNA, 25 bp, Mus musculus
ttaaaagcaacaactccaggtctgt

SEQ ID NO: 19662 - DNA, 25 bp, Mus musculus
acaactccaggtctgtctgcctaag

SEQ ID NO: 19663 - DNA, 25 bp, Mus musculus
actccaggtctgtctgcctaagaag

SEQ ID NO: 19664 - DNA, 25 bp, Mus musculus
ggtctgtctgcctaagaagtgtgtg

SEQ ID NO: 19665 - DNA, 25 bp, Mus musculus
tttgtgctttgtgtagctggtctga

SEQ ID NO: 19666 - DNA, 25 bp, Mus musculus
ggtctacaacgtcacctacactgtc

SEQ ID NO: 19667 - DNA, 25 bp, Mus musculus
ctacaacgtcacctacactgtcaag

SEQ ID NO: 19668 - DNA, 25 bp, Mus musculus
caaggtcaatgtgccctgaatctca

SEQ ID NO: 19669 - DNA, 25 bp, Mus musculus
ggtcaatgtgccctgaatctcagaa

SEQ ID NO: 19670 - DNA, 25 bp, Mus musculus
tgtgccctgaatctcagaagtattg

SEQ ID NO: 19671 - DNA, 25 bp, Mus musculus
gccctgaatctcagaagtattgccc

SEQ ID NO: 19672 - DNA, 25 bp, Mus musculus
cctctgcacactcacagaatcagac

SEQ ID NO: 19673 - DNA, 25 bp, Mus musculus
ctgcacactcacagaatcagacact

SEQ ID NO: 19674 - DNA, 25 bp, Mus musculus
atcagacactaaaacacctgcctta

SEQ ID NO: 19675 - DNA, 25 bp, Mus musculus
cactaaaacacctgccttaggtgtg

SEQ ID NO: 19676 - DNA, 25 bp, Mus musculus
aacacctgccttaggtgtgatgtga

SEQ ID NO: 19677 - DNA, 25 bp, Mus musculus
acacctgccttaggtgtgatgtgag

SEQ ID NO: 19678 - DNA, 25 bp, Mus musculus
caacgtcacctacactgtcaaggag

SEQ ID NO: 19679 - DNA, 25 bp, Mus musculus
cgtcacctacactgtcaaggagaag

SEQ ID NO: 19680 - DNA, 25 bp, Mus musculus
cacctacactgtcaaggagaaggga

SEQ ID NO: 19681 - DNA, 25 bp, Mus musculus
ctacactgtcaaggagaagggagac

SEQ ID NO: 19682 - DNA, 25 bp, Mus musculus
gggagactacatcctcattgtcaag

SEQ ID NO: 19683 - DNA, 25 bp, Mus musculus
agactacatcctcattgtcaagtgg

SEQ ID NO: 19684 - DNA, 25 bp, Mus musculus
ctacatcctcattgtcaagtggggt

SEQ ID NO: 19685 - DNA, 25 bp, Mus musculus
gagccccttcaaggtcaatgtgccc

SEQ ID NO: 19686 - DNA, 25 bp, Mus musculus
ctctttctgtatctccttgcctata

SEQ ID NO: 19687 - DNA, 25 bp, Mus musculus
ctgtatctccttgcctatatctctg

SEQ ID NO: 19688 - DNA, 25 bp, Mus musculus
agggttcatactctgctatcaagac

SEQ ID NO: 19689 - DNA, 25 bp, Mus musculus
catactctgctatcaagacgaggat

SEQ ID NO: 19690 - DNA, 25 bp, Mus musculus
cagcaggccatcagagccgccagaa

SEQ ID NO: 19691 - DNA, 25 bp, Mus musculus
gccatcagagccgccagaaccagtt

SEQ ID NO: 19692 - DNA, 25 bp, Mus musculus
agagccgccagaaccagtttgcatt

SEQ ID NO: 19693 - DNA, 25 bp, Mus musculus
gccagaaccagtttgcattggcccc

SEQ ID NO: 19694 - DNA, 25 bp, Mus musculus
accagtttgcattggcccctgctct

SEQ ID NO: 19695 - DNA, 25 bp, Mus musculus
atggtcagttgcacccagcaagagg

SEQ ID NO: 19696 - DNA, 25 bp, Mus musculus
agttgcacccagcaagagggagtgc

SEQ ID NO: 19697 - DNA, 25 bp, Mus musculus
tcagttgtctctcaattaaagaaac

SEQ ID NO: 19698 - DNA, 25 bp, Mus musculus
gcctatatctctgtctgtctctatt

SEQ ID NO: 19699 - DNA, 25 bp, Mus musculus
gtatctgtctctctctgacaacaca

SEQ ID NO: 19700 - DNA, 25 bp, Mus musculus
gtctctctctgacaacacacacaca

SEQ ID NO: 19701 - DNA, 25 bp, Mus musculus
acacacggatcatctgccccaggct

SEQ ID NO: 19702 - DNA, 25 bp, Mus musculus
ggatcatctgccccaggctgctttc

SEQ ID NO: 19703 - DNA, 25 bp, Mus musculus
tgctttctgcttcacaggtctctag

SEQ ID NO: 19704 - DNA, 25 bp, Mus musculus
ctgcttcacaggtctctagccagtc

SEQ ID NO: 19705 - DNA, 25 bp, Mus musculus
ggggcaactatcttcctgattgccc

SEQ ID NO: 19706 - DNA, 25 bp, Mus musculus
cttcctgtctgtattcctggtcatc

SEQ ID NO: 19707 - DNA, 25 bp, Mus musculus
tgtattcctggtcatcgtgatgttg

SEQ ID NO: 19708 - DNA, 25 bp, Mus musculus
ctagtagacatgcccgatcagcatg

SEQ ID NO: 19709 - DNA, 25 bp, Mus musculus
caagagctcggatgccatgagcact

SEQ ID NO: 19710 - DNA, 25 bp, Mus musculus
ggatgccatgagcacttacgcatgc

SEQ ID NO: 19711 - DNA, 25 bp, Mus musculus
tgccatgagcacttacgcatgcgtt

SEQ ID NO: 19712 - DNA, 25 bp, Mus musculus
catgagcacttacgcatgcgttttt

SEQ ID NO: 19713 - DNA, 25 bp, Mus musculus
cacttacgcatgcgtttttacagag

SEQ ID NO: 19714 - DNA, 25 bp, Mus musculus
ttacgcatgcgtttttacagagcag

SEQ ID NO: 19715 - DNA, 25 bp, Mus musculus
cgtttttacagagcagctcgttact

SEQ ID NO: 19716 - DNA, 25 bp, Mus musculus
ttttacagagcagctcgttactctc

SEQ ID NO: 19717 - DNA, 25 bp, Mus musculus
tacagagcagctcgttactctcctt

SEQ ID NO: 19718 - DNA, 25 bp, Mus musculus
tgactcgggcagactgtctctgcag

SEQ ID NO: 19719 - DNA, 25 bp, Mus musculus
tctccttatgggagagtagatgcta

SEQ ID NO: 19720 - DNA, 25 bp, Mus musculus
cagactgtctctgcaggtcacggtg

SEQ ID NO: 19721 - DNA, 25 bp, Mus musculus
actgtctctgcaggtcacggtgcat

SEQ ID NO: 19722 - DNA, 25 bp, Mus musculus
gcaggtcacggtgcatggctgcctc

SEQ ID NO: 19723 - DNA, 25 bp, Mus musculus
ggtgcatggctgcctcttaagttac

SEQ ID NO: 19724 - DNA, 25 bp, Mus musculus
gcatggctgcctcttaagttactgg

SEQ ID NO: 19725 - DNA, 25 bp, Mus musculus
ctggacctctgccaagtaggttgct

SEQ ID NO: 19726 - DNA, 25 bp, Mus musculus
taaagacctgtactagtagacatgc

SEQ ID NO: 19727 - DNA, 25 bp, Mus musculus
ctacttctgtcttaaaggacacacg

SEQ ID NO: 19728 - DNA, 25 bp, Mus musculus
ctgtcttaaaggacacacgaggacg

SEQ ID NO: 19729 - DNA, 25 bp, Mus musculus
agagccttctggtactctgtgtccc

SEQ ID NO: 19730 - DNA, 25 bp, Mus musculus
catttgggaaccagtccttactatg

SEQ ID NO: 19731 - DNA, 25 bp, Mus musculus
ggaaccagtccttactatgtgagca

SEQ ID NO: 19732 - DNA, 25 bp, Mus musculus
agtccttactatgtgagcagtgtgg

SEQ ID NO: 19733 - DNA, 25 bp, Mus musculus
aagcctacttccagacacacctgaa

SEQ ID NO: 19734 - DNA, 25 bp, Mus musculus
acttccagacacacctgaagatgca

SEQ ID NO: 19735 - DNA, 25 bp, Mus musculus
agacacacctgaagatgcacgctgg

SEQ ID NO: 19736 - DNA, 25 bp, Mus musculus
acctgaagatgcacgctggggtgaa

SEQ ID NO: 19737 - DNA, 25 bp, Mus musculus
agccacacgcacgtgcacagtgctg

SEQ ID NO: 19738 - DNA, 25 bp, Mus musculus
acgcacgtgcacagtgctgtagggc

SEQ ID NO: 19739 - DNA, 25 bp, Mus musculus
aggacacacgaggacgcacaagtgt

SEQ ID NO: 19740 - DNA, 25 bp, Mus musculus
gtgcacagtgctgtagggccttcag

SEQ ID NO: 19741 - DNA, 25 bp, Mus musculus
acacacgaggacgcacaagtgtaaa

SEQ ID NO: 19742 - DNA, 25 bp, Mus musculus
gagagcctttggtcgtcactcatct

SEQ ID NO: 19743 - DNA, 25 bp, Mus musculus
tcgtcactcatcttcccgagatgac

SEQ ID NO: 19744 - DNA, 25 bp, Mus musculus
atcttcccgagatgaccacacatgt

SEQ ID NO: 19745 - DNA, 25 bp, Mus musculus
ttcccgagatgaccacacatgtgtc

SEQ ID NO: 19746 - DNA, 25 bp, Mus musculus
ccgagatgaccacacatgtgtcgtg

SEQ ID NO: 19747 - DNA, 25 bp, Mus musculus
cacatgtgtcgtgagtggagcagag

SEQ ID NO: 19748 - DNA, 25 bp, Mus musculus
aacagacccagcaaatggcaagttt

SEQ ID NO: 19749 - DNA, 25 bp, Mus musculus
tttctgggcacagttccagaatgta

SEQ ID NO: 19750 - DNA, 25 bp, Mus musculus
ttctctgcctgtcccatattatacc

SEQ ID NO: 19751 - DNA, 25 bp, Mus musculus
gcctgtcccatattataccaggtca

SEQ ID NO: 19752 - DNA, 25 bp, Mus musculus
cccatattataccaggtcacctaag

SEQ ID NO: 19753 - DNA, 25 bp, Mus musculus
caggtcacctaagaccttcctggat

SEQ ID NO: 19754 - DNA, 25 bp, Mus musculus
acctaagaccttcctggattgatgc

SEQ ID NO: 19755 - DNA, 25 bp, Mus musculus
gaccttcctggattgatgctgacct

SEQ ID NO: 19756 - DNA, 25 bp, Mus musculus
ttgatgctgacctatgaggtagatt

SEQ ID NO: 19757 - DNA, 25 bp, Mus musculus
gaacttaacatttctgtcagattcc

SEQ ID NO: 19758 - DNA, 25 bp, Mus musculus
aacatttctgtcagattccaggcgt

SEQ ID NO: 19759 - DNA, 25 bp, Mus musculus
tccttggaaaaccctgatttcatgt

SEQ ID NO: 19760 - DNA, 25 bp, Mus musculus
gcccaggtccacagaactcattctt

SEQ ID NO: 19761 - DNA, 25 bp, Mus musculus
gtccacagaactcattcttaacacg

SEQ ID NO: 19762 - DNA, 25 bp, Mus musculus
agaactcattcttaacacgagtaca

SEQ ID NO: 19763 - DNA, 25 bp, Mus musculus
cattcttaacacgagtacatctctt

SEQ ID NO: 19764 - DNA, 25 bp, Mus musculus
gagtacatctcttacattagaggaa

SEQ ID NO: 19765 - DNA, 25 bp, Mus musculus
atctcttacattagaggaatataat

SEQ ID NO: 19766 - DNA, 25 bp, Mus musculus
tacctgaagctgtgttacctaaagt

SEQ ID NO: 19767 - DNA, 25 bp, Mus musculus
atgtcattctctgcctgtcccatat

SEQ ID NO: 19768 - DNA, 25 bp, Mus musculus
gccgtgagctccgaaggatgagcga

SEQ ID NO: 19769 - DNA, 25 bp, Mus musculus
gcgcaggcactgcaacacagatgcg

SEQ ID NO: 19770 - DNA, 25 bp, Mus musculus
agaggatcgctgtgtccctttaaca

SEQ ID NO: 19771 - DNA, 25 bp, Mus musculus
ggatcgctgtgtccctttaacaggg

SEQ ID NO: 19772 - DNA, 25 bp, Mus musculus
tcgctgtgtccctttaacagggaga

SEQ ID NO: 19773 - DNA, 25 bp, Mus musculus
tgtccctttaacagggagaagagct

SEQ ID NO: 19774 - DNA, 25 bp, Mus musculus
aagagctgacgtacagcttgagtcc

SEQ ID NO: 19775 - DNA, 25 bp, Mus musculus
agctgacgtacagcttgagtccctt

SEQ ID NO: 19776 - DNA, 25 bp, Mus musculus
tgacgtacagcttgagtcccttccg

SEQ ID NO: 19777 - DNA, 25 bp, Mus musculus
cgtacagcttgagtcccttccggtg

SEQ ID NO: 19778 - DNA, 25 bp, Mus musculus
ctctcctgttctggactgccctcgg

SEQ ID NO: 19779 - DNA, 25 bp, Mus musculus
ctgtcctgtcataactggggacccg

SEQ ID NO: 19780 - DNA, 25 bp, Mus musculus
caggcactgcaacacagatgcgaca

SEQ ID NO: 19781 - DNA, 25 bp, Mus musculus
gcactgcaacacagatgcgacaaag

SEQ ID NO: 19782 - DNA, 25 bp, Mus musculus
ctgcaacacagatgcgacaaagcgc

SEQ ID NO: 19783 - DNA, 25 bp, Mus musculus
agatgcgacaaagcgccggctggac

SEQ ID NO: 19784 - DNA, 25 bp, Mus musculus
cgcgcattatccagtcctggtggga

SEQ ID NO: 19785 - DNA, 25 bp, Mus musculus
gcattatccagtcctggtgggatcg

SEQ ID NO: 19786 - DNA, 25 bp, Mus musculus
ttatccagtcctggtgggatcgaaa

SEQ ID NO: 19787 - DNA, 25 bp, Mus musculus
tccagtcctggtgggatcgaaactt

SEQ ID NO: 19788 - DNA, 25 bp, Mus musculus
tgcgcgctcctgcagcacatctcgg

SEQ ID NO: 19789 - DNA, 25 bp, Mus musculus
gcgctcctgcagcacatctcggaga

SEQ ID NO: 19790 - DNA, 25 bp, Mus musculus
ggccaagaccgctggagatcaccct

SEQ ID NO: 19791 - DNA, 25 bp, Mus musculus
gaccgctggagatcaccctggacaa

SEQ ID NO: 19792 - DNA, 25 bp, Mus musculus
tggagatcaccctggacaagccatc

SEQ ID NO: 19793 - DNA, 25 bp, Mus musculus
agatcaccctggacaagccatcgtc

SEQ ID NO: 19794 - DNA, 25 bp, Mus musculus
tggacaagccatcgtccagacgctg

SEQ ID NO: 19795 - DNA, 25 bp, Mus musculus
acaagccatcgtccagacgctgcgg

SEQ ID NO: 19796 - DNA, 25 bp, Mus musculus
ccagacgctgcggcagaaggctgac

SEQ ID NO: 19797 - DNA, 25 bp, Mus musculus
ggacaacaaccgccaagctgtcaag

SEQ ID NO: 19798 - DNA, 25 bp, Mus musculus
caaccgccaagctgtcaaggacctg

SEQ ID NO: 19799 - DNA, 25 bp, Mus musculus
ccgccaagctgtcaaggacctggtt

SEQ ID NO: 19800 - DNA, 25 bp, Mus musculus
ctcctgcagcacatctcggagaaga

SEQ ID NO: 19801 - DNA, 25 bp, Mus musculus
aagcgccaggcactgcgagaccaac

SEQ ID NO: 19802 - DNA, 25 bp, Mus musculus
caggcactgcgagaccaactctaca

SEQ ID NO: 19803 - DNA, 25 bp, Mus musculus
gcactgcgagaccaactctacaatg

SEQ ID NO: 19804 - DNA, 25 bp, Mus musculus
ctgcgagaccaactctacaatgggc

SEQ ID NO: 19805 - DNA, 25 bp, Mus musculus
cgagaccaactctacaatgggctac

SEQ ID NO: 19806 - DNA, 25 bp, Mus musculus
catgctggccaagaccgctggagat

SEQ ID NO: 19807 - DNA, 25 bp, Mus musculus
gctggccaagaccgctggagatcac

SEQ ID NO: 19808 - DNA, 25 bp, Mus musculus
cggcctgggcagactgcttctgtat

SEQ ID NO: 19809 - DNA, 25 bp, Mus musculus
tgcttctgtatgaatgcaggggtcg

SEQ ID NO: 19810 - DNA, 25 bp, Mus musculus
tccaagttccggtgtctaggagaga

SEQ ID NO: 19811 - DNA, 25 bp, Mus musculus
agttccggtgtctaggagagagtgt

SEQ ID NO: 19812 - DNA, 25 bp, Mus musculus
agcttgaagacactgcgtggatctt

SEQ ID NO: 19813 - DNA, 25 bp, Mus musculus
cttgaagacactgcgtggatcttct

SEQ ID NO: 19814 - DNA, 25 bp, Mus musculus
aagacactgcgtggatcttctctct

SEQ ID NO: 19815 - DNA, 25 bp, Mus musculus
ggatcttctctctgtaggagatcca

SEQ ID NO: 19816 - DNA, 25 bp, Mus musculus
taggagatccagctctagaaggatc

SEQ ID NO: 19817 - DNA, 25 bp, Mus musculus
agctctagaaggatccagggcatcc

SEQ ID NO: 19818 - DNA, 25 bp, Mus musculus
atccagggcatccgtggcttggcgt

SEQ ID NO: 19819 - DNA, 25 bp, Mus musculus
ccagggcatccgtggcttggcgttc

SEQ ID NO: 19820 - DNA, 25 bp, Mus musculus
tgaatgcaggggtcgcatgtgatca

SEQ ID NO: 19821 - DNA, 25 bp, Mus musculus
agggcatccgtggcttggcgttcca

SEQ ID NO: 19822 - DNA, 25 bp, Mus musculus
aatgcaggggtcgcatgtgatcaga

SEQ ID NO: 19823 - DNA, 25 bp, Mus musculus
gtgatcagaggctgcccaggagtca

SEQ ID NO: 19824 - DNA, 25 bp, Mus musculus
agaggctgcccaggagtcaatccaa

SEQ ID NO: 19825 - DNA, 25 bp, Mus musculus
aggctgcccaggagtcaatccaagt

SEQ ID NO: 19826 - DNA, 25 bp, Mus musculus
tgcccaggagtcaatccaagttccg

SEQ ID NO: 19827 - DNA, 25 bp, Mus musculus
ggagtcaatccaagttccggtgtct

SEQ ID NO: 19828 - DNA, 25 bp, Mus musculus
agtcaatccaagttccggtgtctag

SEQ ID NO: 19829 - DNA, 25 bp, Mus musculus
caagtatatacctactggaggaagt

SEQ ID NO: 19830 - DNA, 25 bp, Mus musculus
gtatatacctactggaggaagtaat

SEQ ID NO: 19831 - DNA, 25 bp, Mus musculus
taatccaccagattctcatctatta

SEQ ID NO: 19832 - DNA, 25 bp, Mus musculus
accagattctcatctattagttaaa

SEQ ID NO: 19833 - DNA, 25 bp, Mus musculus
caaacagactcctttatcgctatca

SEQ ID NO: 19834 - DNA, 25 bp, Mus musculus
gactcctttatcgctatcaactcct

SEQ ID NO: 19835 - DNA, 25 bp, Mus musculus
tcctttatcgctatcaactcctgca

SEQ ID NO: 19836 - DNA, 25 bp, Mus musculus
tttatcgctatcaactcctgcatct

SEQ ID NO: 19837 - DNA, 25 bp, Mus musculus
gctatcaactcctgcatcttttatg

SEQ ID NO: 19838 - DNA, 25 bp, Mus musculus
atcaactcctgcatcttttatgaag

SEQ ID NO: 19839 - DNA, 25 bp, Mus musculus
aactcctgcatcttttatgaagttt

SEQ ID NO: 19840 - DNA, 25 bp, Mus musculus
tattatttccaagagagccaaactt

SEQ ID NO: 19841 - DNA, 25 bp, Mus musculus
aacagcctttgaatttgatgttaat

SEQ ID NO: 19842 - DNA, 25 bp, Mus musculus
ttcagaaactgctgatctcttgagc

SEQ ID NO: 19843 - DNA, 25 bp, Mus musculus
aactgctgatctcttgagcctggtt

SEQ ID NO: 19844 - DNA, 25 bp, Mus musculus
tgatctcttgagcctggtttcagag

SEQ ID NO: 19845 - DNA, 25 bp, Mus musculus
tctcttgagcctggtttcagaggaa

SEQ ID NO: 19846 - DNA, 25 bp, Mus musculus
cttgagcctggtttcagaggaagat

SEQ ID NO: 19847 - DNA, 25 bp, Mus musculus
tgataataatccaccagattctcat

SEQ ID NO: 19848 - DNA, 25 bp, Mus musculus
taataatccaccagattctcatcta

SEQ ID NO: 19849 - DNA, 25 bp, Mus musculus
cgacactggcttcaaggcttcagca

SEQ ID NO: 19850 - DNA, 25 bp, Mus musculus
cactggcttcaaggcttcagcatta

SEQ ID NO: 19851 - DNA, 25 bp, Mus musculus
gcctagctcacctagatcagagttc

SEQ ID NO: 19852 - DNA, 25 bp, Mus musculus
tagctcacctagatcagagttctaa

SEQ ID NO: 19853 - DNA, 25 bp, Mus musculus
ctcacctagatcagagttctaatct

SEQ ID NO: 19854 - DNA, 25 bp, Mus musculus
ccaatcgtgcctttgtgcatatggt

SEQ ID NO: 19855 - DNA, 25 bp, Mus musculus
atcgtgcctttgtgcatatggtatg

SEQ ID NO: 19856 - DNA, 25 bp, Mus musculus
tgtgcattctctgaagcacgtgagg

SEQ ID NO: 19857 - DNA, 25 bp, Mus musculus
gcattctctgaagcacgtgaggaca

SEQ ID NO: 19858 - DNA, 25 bp, Mus musculus
gaggacattgctgctccaaagtagg

SEQ ID NO: 19859 - DNA, 25 bp, Mus musculus
gacattgctgctccaaagtaggagt

SEQ ID NO: 19860 - DNA, 25 bp, Mus musculus
attgctgctccaaagtaggagtatg

SEQ ID NO: 19861 - DNA, 25 bp, Mus musculus
gagcttaccacggtgtagagatgct

SEQ ID NO: 19862 - DNA, 25 bp, Mus musculus
cttaccacggtgtagagatgctgtg

SEQ ID NO: 19863 - DNA, 25 bp, Mus musculus
tgactgtgcaacaccacagccattg

SEQ ID NO: 19864 - DNA, 25 bp, Mus musculus
acagccattgctgacgcctagctca

SEQ ID NO: 19865 - DNA, 25 bp, Mus musculus
gccattgctgacgcctagctcacct

SEQ ID NO: 19866 - DNA, 25 bp, Mus musculus
attgctgacgcctagctcacctaga

SEQ ID NO: 19867 - DNA, 25 bp, Mus musculus
gctgacgcctagctcacctagatca

SEQ ID NO: 19868 - DNA, 25 bp, Mus musculus
gacgcctagctcacctagatcagag

SEQ ID NO: 19869 - DNA, 25 bp, Mus musculus
cgtttcaacgatatcttgggcagac

SEQ ID NO: 19870 - DNA, 25 bp, Mus musculus
ggcagacactcccgtaagcgatggg

SEQ ID NO: 19871 - DNA, 25 bp, Mus musculus
ttctacactgttgtgaaggaccagg

SEQ ID NO: 19872 - DNA, 25 bp, Mus musculus
acacctgtcagcagcgccaatatga

SEQ ID NO: 19873 - DNA, 25 bp, Mus musculus
gtcagcagcgccaatatgatgtcag

SEQ ID NO: 19874 - DNA, 25 bp, Mus musculus
agcgccaatatgatgtcagggattt

SEQ ID NO: 19875 - DNA, 25 bp, Mus musculus
gggatttcttcagtgccaactcctt

SEQ ID NO: 19876 - DNA, 25 bp, Mus musculus
tcaccagtgattgccgctgccaact

SEQ ID NO: 19877 - DNA, 25 bp, Mus musculus
gccaactcacttgggatacctgttc

SEQ ID NO: 19878 - DNA, 25 bp, Mus musculus
ctcctcgatgcagcttgcgcctgtt

SEQ ID NO: 19879 - DNA, 25 bp, Mus musculus
cgtgtctgaaccgttgcttgtggat

SEQ ID NO: 19880 - DNA, 25 bp, Mus musculus
tgaaccgttgcttgtggatttagta

SEQ ID NO: 19881 - DNA, 25 bp, Mus musculus
tttgtccacagtgaaaaccagcatc

SEQ ID NO: 19882 - DNA, 25 bp, Mus musculus
cagcatcttgtcagccctgaggcct

SEQ ID NO: 19883 - DNA, 25 bp, Mus musculus
ctgcttcgatatgaccaccagtcac

SEQ ID NO: 19884 - DNA, 25 bp, Mus musculus
cgatatgaccaccagtcacggctca

SEQ ID NO: 19885 - DNA, 25 bp, Mus musculus
gaccaccagtcacggctcactgcaa

SEQ ID NO: 19886 - DNA, 25 bp, Mus musculus
cagtcacggctcactgcaagagagg

SEQ ID NO: 19887 - DNA, 25 bp, Mus musculus
gccatggagcacccttacttctaca

SEQ ID NO: 19888 - DNA, 25 bp, Mus musculus
gagcacccttacttctacactgttg

SEQ ID NO: 19889 - DNA, 25 bp, Mus musculus
tgttcattggaccgaaagcagagga

SEQ ID NO: 19890 - DNA, 25 bp, Mus musculus
ggctgctgaccatccgataccccat

SEQ ID NO: 19891 - DNA, 25 bp, Mus musculus
agtacgtctactctaaggaccagct

SEQ ID NO: 19892 - DNA, 25 bp, Mus musculus
acgtctactctaaggaccagctgca

SEQ ID NO: 19893 - DNA, 25 bp, Mus musculus
actctaaggaccagctgcagacctt

SEQ ID NO: 19894 - DNA, 25 bp, Mus musculus
ctaaggaccagctgcagaccttctc

SEQ ID NO: 19895 - DNA, 25 bp, Mus musculus
aggaccagctgcagaccttctctga

SEQ ID NO: 19896 - DNA, 25 bp, Mus musculus
agctgcagaccttctctgaggagca

SEQ ID NO: 19897 - DNA, 25 bp, Mus musculus
tgcagaccttctctgaggagcatcc

SEQ ID NO: 19898 - DNA, 25 bp, Mus musculus
agaccttctctgaggagcatcctgt

SEQ ID NO: 19899 - DNA, 25 bp, Mus musculus
aggagcatcctgttcttctaacgga

SEQ ID NO: 19900 - DNA, 25 bp, Mus musculus
accgggacactcttctccaatatcg

SEQ ID NO: 19901 - DNA, 25 bp, Mus musculus
tgctgaccatccgataccccatgga

SEQ ID NO: 19902 - DNA, 25 bp, Mus musculus
acactcttctccaatatcgtgctgt

SEQ ID NO: 19903 - DNA, 25 bp, Mus musculus
tccgataccccatggaacacggtgt

SEQ ID NO: 19904 - DNA, 25 bp, Mus musculus
gataccccatggaacacggtgtggt

SEQ ID NO: 19905 - DNA, 25 bp, Mus musculus
atgacatggaacgcatctggcagta

SEQ ID NO: 19906 - DNA, 25 bp, Mus musculus
tggaacgcatctggcagtacgtcta

SEQ ID NO: 19907 - DNA, 25 bp, Mus musculus
aacgcatctggcagtacgtctactc

SEQ ID NO: 19908 - DNA, 25 bp, Mus musculus
gcatctggcagtacgtctactctaa

SEQ ID NO: 19909 - DNA, 25 bp, Mus musculus
ggcagtacgtctactctaaggacca

SEQ ID NO: 19910 - DNA, 25 bp, Mus musculus
ttaatccacagaacaatttgggctt

SEQ ID NO: 19911 - DNA, 25 bp, Mus musculus
gacatgggcctcagtcaaaacagcc

SEQ ID NO: 19912 - DNA, 25 bp, Mus musculus
tcatagcaccagaagggtatgctgc

SEQ ID NO: 19913 - DNA, 25 bp, Mus musculus
cacttaatgcccatatgaatgccac

SEQ ID NO: 19914 - DNA, 25 bp, Mus musculus
atgccatagtccagaccctggtaca

SEQ ID NO: 19915 - DNA, 25 bp, Mus musculus
tagtccagaccctggtacacctgat

SEQ ID NO: 19916 - DNA, 25 bp, Mus musculus
tggtacacctgatgtttccagacca

SEQ ID NO: 19917 - DNA, 25 bp, Mus musculus
cagaccatgttcccaagccttgctg

SEQ ID NO: 19918 - DNA, 25 bp, Mus musculus
atgttcccaagccttgctgtgctcc

SEQ ID NO: 19919 - DNA, 25 bp, Mus musculus
ccaagccttgctgtgctccaaccaa

SEQ ID NO: 19920 - DNA, 25 bp, Mus musculus
cttgctgtgctccaaccaaactaaa

SEQ ID NO: 19921 - DNA, 25 bp, Mus musculus
tctcggtcctgtattttgatgacag

SEQ ID NO: 19922 - DNA, 25 bp, Mus musculus
agtcaaaacagccattcatggtggc

SEQ ID NO: 19923 - DNA, 25 bp, Mus musculus
agtacgttcgtgtggctgccactag

SEQ ID NO: 19924 - DNA, 25 bp, Mus musculus
ccttcttcaaggcaagcgaggtact

SEQ ID NO: 19925 - DNA, 25 bp, Mus musculus
aggtacttcttcgatccgtgagagc

SEQ ID NO: 19926 - DNA, 25 bp, Mus musculus
ttcttcgatccgtgagagcagccag

SEQ ID NO: 19927 - DNA, 25 bp, Mus musculus
accgcaataaatccaactctcatca

SEQ ID NO: 19928 - DNA, 25 bp, Mus musculus
aagcctgcaagaagcacgaactcta

SEQ ID NO: 19929 - DNA, 25 bp, Mus musculus
agcacgaactctatgtgagtttccg

SEQ ID NO: 19930 - DNA, 25 bp, Mus musculus
gtttccgagatctgggatggcagga

SEQ ID NO: 19931 - DNA, 25 bp, Mus musculus
tgttgctgtcattgaggtctgtccc

SEQ ID NO: 19932 - DNA, 25 bp, Mus musculus
gttgctgtcattgaggtctgtccct

SEQ ID NO: 19933 - DNA, 25 bp, Mus musculus
catgtgcttctagagctgccctgac

SEQ ID NO: 19934 - DNA, 25 bp, Mus musculus
gtgcttctagagctgccctgacccc

SEQ ID NO: 19935 - DNA, 25 bp, Mus musculus
tgcttctagagctgccctgacccca

SEQ ID NO: 19936 - DNA, 25 bp, Mus musculus
agattgggtactgtccctctctggg

SEQ ID NO: 19937 - DNA, 25 bp, Mus musculus
ttgggtactgtccctctctgggcct

SEQ ID NO: 19938 - DNA, 25 bp, Mus musculus
tgggtactgtccctctctgggcctc

SEQ ID NO: 19939 - DNA, 25 bp, Mus musculus
tgggcctccttcagcagcctgcctg

SEQ ID NO: 19940 - DNA, 25 bp, Mus musculus
agcagcctgcctgtctgcctcaggg

SEQ ID NO: 19941 - DNA, 25 bp, Mus musculus
tgcctgtctgcctcagggtggttgt

SEQ ID NO: 19942 - DNA, 25 bp, Mus musculus
ctgtctgcctcagggtggttgtgac

SEQ ID NO: 19943 - DNA, 25 bp, Mus musculus
cgtgccctgggttctgtctcgaata

SEQ ID NO: 19944 - DNA, 25 bp, Mus musculus
gcccttgcattgctgcttcctgtga

SEQ ID NO: 19945 - DNA, 25 bp, Mus musculus
cttgcattgctgcttcctgtgaact

SEQ ID NO: 19946 - DNA, 25 bp, Mus musculus
ttgcattgctgcttcctgtgaactg

SEQ ID NO: 19947 - DNA, 25 bp, Mus musculus
gcattgctgcttcctgtgaactgag

SEQ ID NO: 19948 - DNA, 25 bp, Mus musculus
cattgctgcttcctgtgaactgagt

SEQ ID NO: 19949 - DNA, 25 bp, Mus musculus
tgctgcttcctgtgaactgagtggt

SEQ ID NO: 19950 - DNA, 25 bp, Mus musculus
cttcctgtgaactgagtggtccatg

SEQ ID NO: 19951 - DNA, 25 bp, Mus musculus
tgagctagccagccagtaagttcaa

SEQ ID NO: 19952 - DNA, 25 bp, Mus musculus
gctagccagccagtaagttcaagga

SEQ ID NO: 19953 - DNA, 25 bp, Mus musculus
aaactcaggtcttcctggacagcag

SEQ ID NO: 19954 - DNA, 25 bp, Mus musculus
cctgtctctaagggccgcccgtatg

SEQ ID NO: 19955 - DNA, 25 bp, Mus musculus
ccgtatgtgtaccgctgagtgttcc

SEQ ID NO: 19956 - DNA, 25 bp, Mus musculus
tatgtgtaccgctgagtgttcctga

SEQ ID NO: 19957 - DNA, 25 bp, Mus musculus
ggaacacagaccatcagtttcactt

SEQ ID NO: 19958 - DNA, 25 bp, Mus musculus
acacagaccatcagtttcactttaa

SEQ ID NO: 19959 - DNA, 25 bp, Mus musculus
cagaccatcagtttcactttaagca

SEQ ID NO: 19960 - DNA, 25 bp, Mus musculus
tgctttaatcccaaccagaaataat

SEQ ID NO: 19961 - DNA, 25 bp, Mus musculus
aatcccaaccagaaataatcatcct

SEQ ID NO: 19962 - DNA, 25 bp, Mus musculus
aaccagaaataatcatccttgttat

SEQ ID NO: 19963 - DNA, 25 bp, Mus musculus
cccaacactgtggtcccagatcagc

SEQ ID NO: 19964 - DNA, 25 bp, Mus musculus
aacactgtggtcccagatcagctgc

SEQ ID NO: 19965 - DNA, 25 bp, Mus musculus
actgtggtcccagatcagctgctac

SEQ ID NO: 19966 - DNA, 25 bp, Mus musculus
ccagatcagctgctacgcccagatt

SEQ ID NO: 19967 - DNA, 25 bp, Mus musculus
gatcagctgctacgcccagatttta

SEQ ID NO: 19968 - DNA, 25 bp, Mus musculus
ctacgcccagattttacacagtgct

SEQ ID NO: 19969 - DNA, 25 bp, Mus musculus
gattttacacagtgctggggaccca

SEQ ID NO: 19970 - DNA, 25 bp, Mus musculus
acacagtgctggggacccaaactca

SEQ ID NO: 19971 - DNA, 25 bp, Mus musculus
cgcatccgccagacagtcaaccggg

SEQ ID NO: 19972 - DNA, 25 bp, Mus musculus
ggctccacgcagggccagaccattg

SEQ ID NO: 19973 - DNA, 25 bp, Mus musculus
gacaacaagcgcttcttcttcgatg

SEQ ID NO: 19974 - DNA, 25 bp, Mus musculus
aagcgcttcttcttcgatgtgggtt

SEQ ID NO: 19975 - DNA, 25 bp, Mus musculus
tccaacaagtacggcgtgtttatgc

SEQ ID NO: 19976 - DNA, 25 bp, Mus musculus
aagtacggcgtgtttatgcgagtga

SEQ ID NO: 19977 - DNA, 25 bp, Mus musculus
gccaagttcggacacaccttctgca

SEQ ID NO: 19978 - DNA, 25 bp, Mus musculus
ttctgcaagtactccgaggagatga

SEQ ID NO: 19979 - DNA, 25 bp, Mus musculus
caacagcagcagcaagaggagacca

SEQ ID NO: 19980 - DNA, 25 bp, Mus musculus
cacgcatacacatacgtgtacacac

SEQ ID NO: 19981 - DNA, 25 bp, Mus musculus
tacacatacgtgtacacacacacac

SEQ ID NO: 19982 - DNA, 25 bp, Mus musculus
gccacacacagagaaaatatactgt

SEQ ID NO: 19983 - DNA, 25 bp, Mus musculus
acgcagggccagaccattgcgctgc

SEQ ID NO: 19984 - DNA, 25 bp, Mus musculus
cccgcacagggtctcatcgagttcc

SEQ ID NO: 19985 - DNA, 25 bp, Mus musculus
cagggtctcatcgagttccgtgacg

SEQ ID NO: 19986 - DNA, 25 bp, Mus musculus
ctcatcgagttccgtgacgctctgg

SEQ ID NO: 19987 - DNA, 25 bp, Mus musculus
gctctggccaagctcatcgacgact

SEQ ID NO: 19988 - DNA, 25 bp, Mus musculus
gccaagctcatcgacgactatggag

SEQ ID NO: 19989 - DNA, 25 bp, Mus musculus
ggcacctccttgactgtggacaaca

SEQ ID NO: 19990 - DNA, 25 bp, Mus musculus
tccttgactgtggacaacaagcgct

SEQ ID NO: 19991 - DNA, 25 bp, Mus musculus
gaacctcgtgttcatccagtataac

SEQ ID NO: 19992 - DNA, 25 bp, Mus musculus
acctcgtgttcatccagtataacag

SEQ ID NO: 19993 - DNA, 25 bp, Mus musculus
gacaccgaccttttcatgccttact

SEQ ID NO: 19994 - DNA, 25 bp, Mus musculus
ttttcatgccttacttcgaagccat

SEQ ID NO: 19995 - DNA, 25 bp, Mus musculus
ttcatgccttacttcgaagccattc

SEQ ID NO: 19996 - DNA, 25 bp, Mus musculus
catgccttacttcgaagccattcag

SEQ ID NO: 19997 - DNA, 25 bp, Mus musculus
acttcgaagccattcagaagggcac

SEQ ID NO: 19998 - DNA, 25 bp, Mus musculus
gccattcagaagggcaccggcgccc

SEQ ID NO: 19999 - DNA, 25 bp, Mus musculus
tcgacatggcctaccgggttctggc

SEQ ID NO: 20000 - DNA, 25 bp, Mus musculus
gacatggcctaccgggttctggctg

SEQ ID NO: 20001 - DNA, 25 bp, Mus musculus
catggcctaccgggttctggctgac

SEQ ID NO: 20002 - DNA, 25 bp, Mus musculus
tggcctaccgggttctggctgacca

SEQ ID NO: 20003 - DNA, 25 bp, Mus musculus
tgttcatccagtataacagggagtc

SEQ ID NO: 20004 - DNA, 25 bp, Mus musculus
ttcatccagtataacagggagtcgg

SEQ ID NO: 20005 - DNA, 25 bp, Mus musculus
tgaaacctcttcccaagaaaagcat

SEQ ID NO: 20006 - DNA, 25 bp, Mus musculus
ctcttcccaagaaaagcatcgacac

SEQ ID NO: 20007 - DNA, 25 bp, Mus musculus
cttcccaagaaaagcatcgacacag

SEQ ID NO: 20008 - DNA, 25 bp, Mus musculus
ctggtgtctgtgctgcagaacaaga

SEQ ID NO: 20009 - DNA, 25 bp, Mus musculus
tgtctgtgctgcagaacaagatgtc

SEQ ID NO: 20010 - DNA, 25 bp, Mus musculus
caagatgtccaactacgacaccgac

SEQ ID NO: 20011 - DNA, 25 bp, Mus musculus
tctttcccaaagagtttgagacagc

SEQ ID NO: 20012 - DNA, 25 bp, Mus musculus
acagcggagactctgctgaactcgg

SEQ ID NO: 20013 - DNA, 25 bp, Mus musculus
tcatgaaaaccctcaactacacggc

SEQ ID NO: 20014 - DNA, 25 bp, Mus musculus
cgcttcagccggttcaaaaacagag

SEQ ID NO: 20015 - DNA, 25 bp, Mus musculus
cttcagccggttcaaaaacagagag

SEQ ID NO: 20016 - DNA, 25 bp, Mus musculus
cagagagaccattgccagtgtgcgc

SEQ ID NO: 20017 - DNA, 25 bp, Mus musculus
gagagaccattgccagtgtgcgcac

SEQ ID NO: 20018 - DNA, 25 bp, Mus musculus
gaccattgccagtgtgcgcacgttg

SEQ ID NO: 20019 - DNA, 25 bp, Mus musculus
ccagtgtgcgcacgttgcttctcca

SEQ ID NO: 20020 - DNA, 25 bp, Mus musculus
tgcgcacgttgcttctccagaaaaa

SEQ ID NO: 20021 - DNA, 25 bp, Mus musculus
cgcacgttgcttctccagaaaaagt

SEQ ID NO: 20022 - DNA, 25 bp, Mus musculus
gcttctccagaaaaagttacataag

SEQ ID NO: 20023 - DNA, 25 bp, Mus musculus
gagactctgctgaactcggaagtcc

SEQ ID NO: 20024 - DNA, 25 bp, Mus musculus
gactctgctgaactcggaagtccac

SEQ ID NO: 20025 - DNA, 25 bp, Mus musculus
ctgctgaactcggaagtccacatgc

SEQ ID NO: 20026 - DNA, 25 bp, Mus musculus
tgaactcggaagtccacatgcttct

SEQ ID NO: 20027 - DNA, 25 bp, Mus musculus
cacatgcttctggagcatcgaaagc

SEQ ID NO: 20028 - DNA, 25 bp, Mus musculus
gctgtcggaggtcttcatgaaaacc

SEQ ID NO: 20029 - DNA, 25 bp, Mus musculus
gtcttcatgaaaaccctcaactaca

SEQ ID NO: 20030 - DNA, 25 bp, Mus musculus
cttcatgaaaaccctcaactacacg

SEQ ID NO: 20031 - DNA, 25 bp, Mus musculus
gtatggcctgcaggcgtacacagaa

SEQ ID NO: 20032 - DNA, 25 bp, Mus musculus
cctgcaggcgtacacagaagtgaag

SEQ ID NO: 20033 - DNA, 25 bp, Mus musculus
aagctcagtgcagaccgatcacgcg

SEQ ID NO: 20034 - DNA, 25 bp, Mus musculus
agtgcagaccgatcacgcgtccaga

SEQ ID NO: 20035 - DNA, 25 bp, Mus musculus
gcagaccgatcacgcgtccagatgt

SEQ ID NO: 20036 - DNA, 25 bp, Mus musculus
gaccgatcacgcgtccagatgtgca

SEQ ID NO: 20037 - DNA, 25 bp, Mus musculus
aggatgctgccttcaacctgcagtc

SEQ ID NO: 20038 - DNA, 25 bp, Mus musculus
ctgccttcaacctgcagtccctaag

SEQ ID NO: 20039 - DNA, 25 bp, Mus musculus
ccttcaacctgcagtccctaagcag

SEQ ID NO: 20040 - DNA, 25 bp, Mus musculus
tcaacctgcagtccctaagcagcaa

SEQ ID NO: 20041 - DNA, 25 bp, Mus musculus
tgcagtccctaagcagcaaatgagc

SEQ ID NO: 20042 - DNA, 25 bp, Mus musculus
agtccctaagcagcaaatgagcaat

SEQ ID NO: 20043 - DNA, 25 bp, Mus musculus
tactgtcaaagtgccacagaagaac

SEQ ID NO: 20044 - DNA, 25 bp, Mus musculus
agtgccacagaagaactcgtaaagc

SEQ ID NO: 20045 - DNA, 25 bp, Mus musculus
ctcgtaaagcggcatgcctgcttcc

SEQ ID NO: 20046 - DNA, 25 bp, Mus musculus
aagcggcatgcctgcttcctcagcc

SEQ ID NO: 20047 - DNA, 25 bp, Mus musculus
ctgagaaaaaccgccacacacactg

SEQ ID NO: 20048 - DNA, 25 bp, Mus musculus
ttcaccaaagtgtcttgggtcaaga

SEQ ID NO: 20049 - DNA, 25 bp, Mus musculus
gaaagctcctgataaactgggtagg

SEQ ID NO: 20050 - DNA, 25 bp, Mus musculus
atgaagctcagtgcagaccgatcac

SEQ ID NO: 20051 - DNA, 25 bp, Mus musculus
acgagcagcttcaaacctgtcctcc

SEQ ID NO: 20052 - DNA, 25 bp, Mus musculus
agcttcaaacctgtcctccctgtgc

SEQ ID NO: 20053 - DNA, 25 bp, Mus musculus
ctgggcattcagcctcctgtcctta

SEQ ID NO: 20054 - DNA, 25 bp, Mus musculus
attaggagcctctgcctcctgcctg

SEQ ID NO: 20055 - DNA, 25 bp, Mus musculus
tgcctcctgcctgtgtatcctggct

SEQ ID NO: 20056 - DNA, 25 bp, Mus musculus
gcacgctagctagtagctggtaagg

SEQ ID NO: 20057 - DNA, 25 bp, Mus musculus
ttctgtttcctgcttagtggcactg

SEQ ID NO: 20058 - DNA, 25 bp, Mus musculus
cagtcctctgcagtactctagagag

SEQ ID NO: 20059 - DNA, 25 bp, Mus musculus
tctgcagtactctagagagtggctt

SEQ ID NO: 20060 - DNA, 25 bp, Mus musculus
ttggctgtgggcaggccctaactgt

SEQ ID NO: 20061 - DNA, 25 bp, Mus musculus
taactgttttctgcaaagttgaggg

SEQ ID NO: 20062 - DNA, 25 bp, Mus musculus
cctcgcatatttagttcctgtattc

SEQ ID NO: 20063 - DNA, 25 bp, Mus musculus
gtcctccctgtgcttggtggcttgc

SEQ ID NO: 20064 - DNA, 25 bp, Mus musculus
ggcttgctcacaggtgcgctctggc

SEQ ID NO: 20065 - DNA, 25 bp, Mus musculus
ctcacaggtgcgctctggctaccca

SEQ ID NO: 20066 - DNA, 25 bp, Mus musculus
ctctggctacccagacatttcctat

SEQ ID NO: 20067 - DNA, 25 bp, Mus musculus
ctacccagacatttcctatcctcag

SEQ ID NO: 20068 - DNA, 25 bp, Mus musculus
ttcctatcctcagaacttcccatct

SEQ ID NO: 20069 - DNA, 25 bp, Mus musculus
ttcttcctgaacctgggcattcagc

SEQ ID NO: 20070 - DNA, 25 bp, Mus musculus
ctgaacctgggcattcagcctcctg

SEQ ID NO: 20071 - DNA, 25 bp, Mus musculus
ctttaattctcacttcttcatcatc

SEQ ID NO: 20072 - DNA, 25 bp, Mus musculus
ttaattctcacttcttcatcatctg

SEQ ID NO: 20073 - DNA, 25 bp, Mus musculus
ttcttgacttctggttgtagatctc

SEQ ID NO: 20074 - DNA, 25 bp, Mus musculus
tcttgacttctggttgtagatctct

SEQ ID NO: 20075 - DNA, 25 bp, Mus musculus
ttgacttctggttgtagatctctcg

SEQ ID NO: 20076 - DNA, 25 bp, Mus musculus
tgacttctggttgtagatctctcgc

SEQ ID NO: 20077 - DNA, 25 bp, Mus musculus
acttctggttgtagatctctcgcta

SEQ ID NO: 20078 - DNA, 25 bp, Mus musculus
ggttgtagatctctcgctatgaatg

SEQ ID NO: 20079 - DNA, 25 bp, Mus musculus
gttgtagatctctcgctatgaatgg

SEQ ID NO: 20080 - DNA, 25 bp, Mus musculus
tgtagatctctcgctatgaatggat

SEQ ID NO: 20081 - DNA, 25 bp, Mus musculus
gtagatctctcgctatgaatggata

SEQ ID NO: 20082 - DNA, 25 bp, Mus musculus
tctctcgctatgaatggataatgct

SEQ ID NO: 20083 - DNA, 25 bp, Mus musculus
taattctcacttcttcatcatctgg

SEQ ID NO: 20084 - DNA, 25 bp, Mus musculus
attctcacttcttcatcatctggtt

SEQ ID NO: 20085 - DNA, 25 bp, Mus musculus
ttctcacttcttcatcatctggttg

SEQ ID NO: 20086 - DNA, 25 bp, Mus musculus
cacatgtattcttgacttctggttg

SEQ ID NO: 20087 - DNA, 25 bp, Mus musculus
catgtattcttgacttctggttgta

SEQ ID NO: 20088 - DNA, 25 bp, Mus musculus
atgtattcttgacttctggttgtag

SEQ ID NO: 20089 - DNA, 25 bp, Mus musculus
gtattcttgacttctggttgtagat

SEQ ID NO: 20090 - DNA, 25 bp, Mus musculus
tattcttgacttctggttgtagatc

SEQ ID NO: 20091 - DNA, 25 bp, Mus musculus
atcagcagagtggttatgggaaagt

SEQ ID NO: 20092 - DNA, 25 bp, Mus musculus
aaagtatccaggcgaggtggacatc

SEQ ID NO: 20093 - DNA, 25 bp, Mus musculus
catttgaaggtggctcctgtcgact

SEQ ID NO: 20094 - DNA, 25 bp, Mus musculus
tggctcctgtcgactaatagcagtt

SEQ ID NO: 20095 - DNA, 25 bp, Mus musculus
gctcctgtcgactaatagcagttca

SEQ ID NO: 20096 - DNA, 25 bp, Mus musculus
tcctgtcgactaatagcagttcaaa

SEQ ID NO: 20097 - DNA, 25 bp, Mus musculus
ctatcaagttcctgaatggaagtat

SEQ ID NO: 20098 - DNA, 25 bp, Mus musculus
aattctgagttctcattaaaagaat

SEQ ID NO: 20099 - DNA, 25 bp, Mus musculus
ttctgagttctcattaaaagaattt

SEQ ID NO: 20100 - DNA, 25 bp, Mus musculus
tcttaattcgtatgcttcagtatca

SEQ ID NO: 20101 - DNA, 25 bp, Mus musculus
ttaattcgtatgcttcagtatcaat

SEQ ID NO: 20102 - DNA, 25 bp, Mus musculus
ttcgtatgcttcagtatcaatttgt

SEQ ID NO: 20103 - DNA, 25 bp, Mus musculus
agtatccaggcgaggtggacatcaa

SEQ ID NO: 20104 - DNA, 25 bp, Mus musculus
atagctacaaaccatactaaattat

SEQ ID NO: 20105 - DNA, 25 bp, Mus musculus
tattccatttgcaacttatccccaa

SEQ ID NO: 20106 - DNA, 25 bp, Mus musculus
ttccatttgcaacttatccccaaca

SEQ ID NO: 20107 - DNA, 25 bp, Mus musculus
ccatttgcaacttatccccaacagg

SEQ ID NO: 20108 - DNA, 25 bp, Mus musculus
ttgcaacttatccccaacaggtggt

SEQ ID NO: 20109 - DNA, 25 bp, Mus musculus
cttatccccaacaggtggtgaagca

SEQ ID NO: 20110 - DNA, 25 bp, Mus musculus
tccccaacaggtggtgaagcagtat

SEQ ID NO: 20111 - DNA, 25 bp, Mus musculus
attcggatccatggttcgagttcct

SEQ ID NO: 20112 - DNA, 25 bp, Mus musculus
ggatccatggttcgagttcctcagc

SEQ ID NO: 20113 - DNA, 25 bp, Mus musculus
ttcatccatgaccagacttcctcca

SEQ ID NO: 20114 - DNA, 25 bp, Mus musculus
gggaacataccaaggccttactgcg

SEQ ID NO: 20115 - DNA, 25 bp, Mus musculus
acataccaaggccttactgcgactg

SEQ ID NO: 20116 - DNA, 25 bp, Mus musculus
ataccaaggccttactgcgactgta

SEQ ID NO: 20117 - DNA, 25 bp, Mus musculus
caaggccttactgcgactgtactga

SEQ ID NO: 20118 - DNA, 25 bp, Mus musculus
aggccttactgcgactgtactgaag

SEQ ID NO: 20119 - DNA, 25 bp, Mus musculus
gccttactgcgactgtactgaagca

SEQ ID NO: 20120 - DNA, 25 bp, Mus musculus
cttactgcgactgtactgaagcagg

SEQ ID NO: 20121 - DNA, 25 bp, Mus musculus
tactgcgactgtactgaagcagggc

SEQ ID NO: 20122 - DNA, 25 bp, Mus musculus
ctgcgactgtactgaagcagggctc

SEQ ID NO: 20123 - DNA, 25 bp, Mus musculus
atccatggttcgagttcctcagcaa

SEQ ID NO: 20124 - DNA, 25 bp, Mus musculus
ggttcgagttcctcagcaaccacat

SEQ ID NO: 20125 - DNA, 25 bp, Mus musculus
cgagttcctcagcaaccacatgcgg

SEQ ID NO: 20126 - DNA, 25 bp, Mus musculus
accacatgcgggatgccaaggtagg

SEQ ID NO: 20127 - DNA, 25 bp, Mus musculus
aggctcgacagcaggagaggactat

SEQ ID NO: 20128 - DNA, 25 bp, Mus musculus
gtagtcgtgtgccctatggagacca

SEQ ID NO: 20129 - DNA, 25 bp, Mus musculus
gtgtgccctatggagaccatcaagg

SEQ ID NO: 20130 - DNA, 25 bp, Mus musculus
gtgccctatggagaccatcaaggtg

SEQ ID NO: 20131 - DNA, 25 bp, Mus musculus
atcatctcttcaatttcggatgtga

SEQ ID NO: 20132 - DNA, 25 bp, Mus musculus
atctcttcaatttcggatgtgaaat

SEQ ID NO: 20133 - DNA, 25 bp, Mus musculus
aagttgtgctccctctatgaaaacg

SEQ ID NO: 20134 - DNA, 25 bp, Mus musculus
ttgtgctccctctatgaaaacgact

SEQ ID NO: 20135 - DNA, 25 bp, Mus musculus
tcagacagcgtcatcatgacaggct

SEQ ID NO: 20136 - DNA, 25 bp, Mus musculus
agcgtcatcatgacaggctcctaca

SEQ ID NO: 20137 - DNA, 25 bp, Mus musculus
gtcatcatgacaggctcctacaata

SEQ ID NO: 20138 - DNA, 25 bp, Mus musculus
atcatgacaggctcctacaataact

SEQ ID NO: 20139 - DNA, 25 bp, Mus musculus
acaggctcctacaataacttcttca

SEQ ID NO: 20140 - DNA, 25 bp, Mus musculus
ggctcctacaataacttcttcagga

SEQ ID NO: 20141 - DNA, 25 bp, Mus musculus
atgttcgaccgaaacaccaagcgtg

SEQ ID NO: 20142 - DNA, 25 bp, Mus musculus
ttcgaccgaaacaccaagcgtgatg

SEQ ID NO: 20143 - DNA, 25 bp, Mus musculus
tatatcatgaccagagactatctga

SEQ ID NO: 20144 - DNA, 25 bp, Mus musculus
cgaaacaccaagcgtgatgtgaccc

SEQ ID NO: 20145 - DNA, 25 bp, Mus musculus
atcatgaccagagactatctgaccg

SEQ ID NO: 20146 - DNA, 25 bp, Mus musculus
agagactatctgaccgtgaaagtct

SEQ ID NO: 20147 - DNA, 25 bp, Mus musculus
gactatctgaccgtgaaagtctggg

SEQ ID NO: 20148 - DNA, 25 bp, Mus musculus
atggaaaatcgccccattgagacat

SEQ ID NO: 20149 - DNA, 25 bp, Mus musculus
aatcgccccattgagacataccagg

SEQ ID NO: 20150 - DNA, 25 bp, Mus musculus
taccaggttcatgactacctccgca

SEQ ID NO: 20151 - DNA, 25 bp, Mus musculus
agcaagttgtgctccctctatgaaa

SEQ ID NO: 20152 - DNA, 25 bp, Mus musculus
aagacaactacctcaatggaaacag

SEQ ID NO: 20153 - DNA, 25 bp, Mus musculus
actacctcaatggaaacaggtgtat

SEQ ID NO: 20154 - DNA, 25 bp, Mus musculus
tgtcaagttttcatccaggtagagt

SEQ ID NO: 20155 - DNA, 25 bp, Mus musculus
agcgcccttgtagctatagctgcct

SEQ ID NO: 20156 - DNA, 25 bp, Mus musculus
gctatagctgcctagtttgctgttc

SEQ ID NO: 20157 - DNA, 25 bp, Mus musculus
tagtttgctgttctagatctaccaa

SEQ ID NO: 20158 - DNA, 25 bp, Mus musculus
gctgttctagatctaccaaggccta

SEQ ID NO: 20159 - DNA, 25 bp, Mus musculus
ctagatctaccaaggcctaccttct

SEQ ID NO: 20160 - DNA, 25 bp, Mus musculus
tgaatttgacttcctgtcagtcctt

SEQ ID NO: 20161 - DNA, 25 bp, Mus musculus
tgacttcctgtcagtcctttagaaa

SEQ ID NO: 20162 - DNA, 25 bp, Mus musculus
atgccatgttctgaattctgatgcc

SEQ ID NO: 20163 - DNA, 25 bp, Mus musculus
tgttctgaattctgatgccatttct

SEQ ID NO: 20164 - DNA, 25 bp, Mus musculus
ccacattttctcagcagatacacac

SEQ ID NO: 20165 - DNA, 25 bp, Mus musculus
tttctcagcagatacacacttgtct

SEQ ID NO: 20166 - DNA, 25 bp, Mus musculus
agcagatacacacttgtctgttaga

SEQ ID NO: 20167 - DNA, 25 bp, Mus musculus
gattttgatcatctcatcccacaag

SEQ ID NO: 20168 - DNA, 25 bp, Mus musculus
ccacaagcctgaaggcagaaactct

SEQ ID NO: 20169 - DNA, 25 bp, Mus musculus
aggcagaaactctgccttaccttct

SEQ ID NO: 20170 - DNA, 25 bp, Mus musculus
cacgctgttgtctgttgatgctgct

SEQ ID NO: 20171 - DNA, 25 bp, Mus musculus
tgctgctgtcaagttttcatccagg

SEQ ID NO: 20172 - DNA, 25 bp, Mus musculus
gcatcgcacaaatgtttgataagat

SEQ ID NO: 20173 - DNA, 25 bp, Mus musculus
tcctcgtgtatattgtgttgtatca

SEQ ID NO: 20174 - DNA, 25 bp, Mus musculus
ctattctatgcgaggctttggtgaa

SEQ ID NO: 20175 - DNA, 25 bp, Mus musculus
tgaaactctattgctccttgtgtat

SEQ ID NO: 20176 - DNA, 25 bp, Mus musculus
aactctattgctccttgtgtattta

SEQ ID NO: 20177 - DNA, 25 bp, Mus musculus
gctccttgtgtatttacgtgtacac

SEQ ID NO: 20178 - DNA, 25 bp, Mus musculus
cctagttcttcagacaccactacac

SEQ ID NO: 20179 - DNA, 25 bp, Mus musculus
gtatcggccctagctacttgccaat

SEQ ID NO: 20180 - DNA, 25 bp, Mus musculus
tcggccctagctacttgccaatcat

SEQ ID NO: 20181 - DNA, 25 bp, Mus musculus
ctagctacttgccaatcatgttgta

SEQ ID NO: 20182 - DNA, 25 bp, Mus musculus
gctacttgccaatcatgttgtacta

SEQ ID NO: 20183 - DNA, 25 bp, Mus musculus
acttgccaatcatgttgtactatgc

SEQ ID NO: 20184 - DNA, 25 bp, Mus musculus
tgttgtatcagctcaatgcttccta

SEQ ID NO: 20185 - DNA, 25 bp, Mus musculus
tgtatcagctcaatgcttcctatcg

SEQ ID NO: 20186 - DNA, 25 bp, Mus musculus
agctcaatgcttcctatcggctctt

SEQ ID NO: 20187 - DNA, 25 bp, Mus musculus
tcaatgcttcctatcggctctttat

SEQ ID NO: 20188 - DNA, 25 bp, Mus musculus
atgcttcctatcggctctttatgac

SEQ ID NO: 20189 - DNA, 25 bp, Mus musculus
atcggctctttatgactattctatg

SEQ ID NO: 20190 - DNA, 25 bp, Mus musculus
ggctctttatgactattctatgcga

SEQ ID NO: 20191 - DNA, 25 bp, Mus musculus
ttatgactattctatgcgaggcttt

SEQ ID NO: 20192 - DNA, 25 bp, Mus musculus
tgaactcttattctacagactgttt

SEQ ID NO: 20193 - DNA, 25 bp, Mus musculus
cttattctacagactgtttggcaag

SEQ ID NO: 20194 - DNA, 25 bp, Mus musculus
gctcttttacttgacagtagaggtt

SEQ ID NO: 20195 - DNA, 25 bp, Mus musculus
tactcgtagaaacacacttgtagcc

SEQ ID NO: 20196 - DNA, 25 bp, Mus musculus
cacacttgtagcccgggaagactgg

SEQ ID NO: 20197 - DNA, 25 bp, Mus musculus
gttctattctatacccacagtgacc

SEQ ID NO: 20198 - DNA, 25 bp, Mus musculus
ttctatacccacagtgaccacctgc

SEQ ID NO: 20199 - DNA, 25 bp, Mus musculus
acccacagtgaccacctgcttcatt

SEQ ID NO: 20200 - DNA, 25 bp, Mus musculus
cacctgcttcatttatagggttagg

SEQ ID NO: 20201 - DNA, 25 bp, Mus musculus
caaggcctgggcttggcatcaaatg

SEQ ID NO: 20202 - DNA, 25 bp, Mus musculus
catttgagcaatctgcaaggactat

SEQ ID NO: 20203 - DNA, 25 bp, Mus musculus
aatgccctttctatgggtcagataa

SEQ ID NO: 20204 - DNA, 25 bp, Mus musculus
tggcaagccctgcttctaactgtgt

SEQ ID NO: 20205 - DNA, 25 bp, Mus musculus
gccctgcttctaactgtgtgggaag

SEQ ID NO: 20206 - DNA, 25 bp, Mus musculus
cttctaactgtgtgggaagtaatca

SEQ ID NO: 20207 - DNA, 25 bp, Mus musculus
tgtggcctctgtaggctgctcacag

SEQ ID NO: 20208 - DNA, 25 bp, Mus musculus
aggctgctcacagcatggaggcacc

SEQ ID NO: 20209 - DNA, 25 bp, Mus musculus
ctcacagcatggaggcaccacatgc

SEQ ID NO: 20210 - DNA, 25 bp, Mus musculus
aggcaccacatgctggtcttgggta

SEQ ID NO: 20211 - DNA, 25 bp, Mus musculus
atgtgtcttggctgctcagtatggg

SEQ ID NO: 20212 - DNA, 25 bp, Mus musculus
ctccccaagggctcactaagccaga

SEQ ID NO: 20213 - DNA, 25 bp, Mus musculus
tccccaagggctcactaagccagag

SEQ ID NO: 20214 - DNA, 25 bp, Mus musculus
cactaagccagaggccaaagtgccc

SEQ ID NO: 20215 - DNA, 25 bp, Mus musculus
acccaagttctcatgccctccgagg

SEQ ID NO: 20216 - DNA, 25 bp, Mus musculus
caagttctcatgccctccgagggct

SEQ ID NO: 20217 - DNA, 25 bp, Mus musculus
aagttctcatgccctccgagggctg

SEQ ID NO: 20218 - DNA, 25 bp, Mus musculus
ccccaagggctcactaagccagagg

SEQ ID NO: 20219 - DNA, 25 bp, Mus musculus
aagggctcactaagccagaggccaa

SEQ ID NO: 20220 - DNA, 25 bp, Mus musculus
agggctcactaagccagaggccaaa

SEQ ID NO: 20221 - DNA, 25 bp, Mus musculus
gggctcactaagccagaggccaaag

SEQ ID NO: 20222 - DNA, 25 bp, Mus musculus
ggctcactaagccagaggccaaagt

SEQ ID NO: 20223 - DNA, 25 bp, Mus musculus
gctcactaagccagaggccaaagtg

SEQ ID NO: 20224 - DNA, 25 bp, Mus musculus
ctcactaagccagaggccaaagtgc

SEQ ID NO: 20225 - DNA, 25 bp, Mus musculus
tcactaagccagaggccaaagtgcc

SEQ ID NO: 20226 - DNA, 25 bp, Mus musculus
ggcctctaggcccttggcctgcctc

SEQ ID NO: 20227 - DNA, 25 bp, Mus musculus
ctgcctccccaagggctcactaagc

SEQ ID NO: 20228 - DNA, 25 bp, Mus musculus
gctcactaagccagaggccaaagtg

SEQ ID NO: 20229 - DNA, 25 bp, Mus musculus
tcactaagccagaggccaaagtgcc

SEQ ID NO: 20230 - DNA, 25 bp, Mus musculus
cactaagccagaggccaaagtgccc

SEQ ID NO: 20231 - DNA, 25 bp, Mus musculus
taccacccaagttctcatgccctcc

SEQ ID NO: 20232 - DNA, 25 bp, Mus musculus
acccaagttctcatgccctccgagg

SEQ ID NO: 20233 - DNA, 25 bp, Mus musculus
aagttctcatgccctccgagggctg

SEQ ID NO: 20234 - DNA, 25 bp, Mus musculus
atgtacatatttatcaccccttcca

SEQ ID NO: 20235 - DNA, 25 bp, Mus musculus
tgtacatatttatcaccccttccac

SEQ ID NO: 20236 - DNA, 25 bp, Mus musculus
gtacatatttatcaccccttccaca

SEQ ID NO: 20237 - DNA, 25 bp, Mus musculus
catatttatcaccccttccacaaat

SEQ ID NO: 20238 - DNA, 25 bp, Mus musculus
tgcctccccaagggctcactaagcc

SEQ ID NO: 20239 - DNA, 25 bp, Mus musculus
gcctccccaagggctcactaagcca

SEQ ID NO: 20240 - DNA, 25 bp, Mus musculus
ctccccaagggctcactaagccaga

SEQ ID NO: 20241 - DNA, 25 bp, Mus musculus
tccccaagggctcactaagccagag

SEQ ID NO: 20242 - DNA, 25 bp, Mus musculus
ccccaagggctcactaagccagagg

SEQ ID NO: 20243 - DNA, 25 bp, Mus musculus
aagggctcactaagccagaggccaa

SEQ ID NO: 20244 - DNA, 25 bp, Mus musculus
gggctcactaagccagaggccaaag

SEQ ID NO: 20245 - DNA, 25 bp, Mus musculus
ggctcactaagccagaggccaaagt

SEQ ID NO: 20246 - DNA, 25 bp, Mus musculus
atcctgcagctggtagatgtgtttg

SEQ ID NO: 20247 - DNA, 25 bp, Mus musculus
gtgtttgtgacccgcaaagaatact

SEQ ID NO: 20248 - DNA, 25 bp, Mus musculus
tactactcggagcgagacacgagca

SEQ ID NO: 20249 - DNA, 25 bp, Mus musculus
tactcggagcgagacacgagcaacg

SEQ ID NO: 20250 - DNA, 25 bp, Mus musculus
caggtcctggaggctgtggctactt

SEQ ID NO: 20251 - DNA, 25 bp, Mus musculus
gtcctggaggctgtggctacttgca

SEQ ID NO: 20252 - DNA, 25 bp, Mus musculus
tgcactctctcaagattgtgcacag

SEQ ID NO: 20253 - DNA, 25 bp, Mus musculus
actctctcaagattgtgcacaggaa

SEQ ID NO: 20254 - DNA, 25 bp, Mus musculus
ctctcaagattgtgcacaggaacct

SEQ ID NO: 20255 - DNA, 25 bp, Mus musculus
ttgtgcacaggaacctcaagctaga

SEQ ID NO: 20256 - DNA, 25 bp, Mus musculus
tgcacaggaacctcaagctagaaaa

SEQ ID NO: 20257 - DNA, 25 bp, Mus musculus
tgtactacaacaggctaaagaactc

SEQ ID NO: 20258 - DNA, 25 bp, Mus musculus
tttgtgacccgcaaagaatacttca

SEQ ID NO: 20259 - DNA, 25 bp, Mus musculus
gtgacccgcaaagaatacttcatct

SEQ ID NO: 20260 - DNA, 25 bp, Mus musculus
gaatacttcatctttctggagctgg

SEQ ID NO: 20261 - DNA, 25 bp, Mus musculus
atctttctggagctggccacgggga

SEQ ID NO: 20262 - DNA, 25 bp, Mus musculus
tttgactggatcctggaccagggct

SEQ ID NO: 20263 - DNA, 25 bp, Mus musculus
gactggatcctggaccagggctact

SEQ ID NO: 20264 - DNA, 25 bp, Mus musculus
gaccagggctactactcggagcgag

SEQ ID NO: 20265 - DNA, 25 bp, Mus musculus
cagggctactactcggagcgagaca

SEQ ID NO: 20266 - DNA, 25 bp, Mus musculus
ggttccatttttgcctggagattca

SEQ ID NO: 20267 - DNA, 25 bp, Mus musculus
tccatttttgcctggagattcagat

SEQ ID NO: 20268 - DNA, 25 bp, Mus musculus
ggacgacctgctggagctcatccaa

SEQ ID NO: 20269 - DNA, 25 bp, Mus musculus
cctgctggagctcatccaaggcctg

SEQ ID NO: 20270 - DNA, 25 bp, Mus musculus
gctcatccaaggcctgttcttattt

SEQ ID NO: 20271 - DNA, 25 bp, Mus musculus
agcctcacaggcattgaagaccaag

SEQ ID NO: 20272 - DNA, 25 bp, Mus musculus
gctcccgcgaccaaactgtccggtg

SEQ ID NO: 20273 - DNA, 25 bp, Mus musculus
gaatccaaccgtggcaacaaagcgg

SEQ ID NO: 20274 - DNA, 25 bp, Mus musculus
attgcccaagaagctcattttttag

SEQ ID NO: 20275 - DNA, 25 bp, Mus musculus
gttgcagcgcacaatggacagtttc

SEQ ID NO: 20276 - DNA, 25 bp, Mus musculus
aatggacagtttcactgctgaaata

SEQ ID NO: 20277 - DNA, 25 bp, Mus musculus
tttcactgctgaaataaatgatcca

SEQ ID NO: 20278 - DNA, 25 bp, Mus musculus
atttttgcctggagattcagatctt

SEQ ID NO: 20279 - DNA, 25 bp, Mus musculus
agatcttgatcagctaacaaggata

SEQ ID NO: 20280 - DNA, 25 bp, Mus musculus
tgaaactctgggtacaccaactgaa

SEQ ID NO: 20281 - DNA, 25 bp, Mus musculus
gggtacaccaactgaagagcagtgg

SEQ ID NO: 20282 - DNA, 25 bp, Mus musculus
tacaccaactgaagagcagtggcct

SEQ ID NO: 20283 - DNA, 25 bp, Mus musculus
catgtgtagtcttcccgattatgtg

SEQ ID NO: 20284 - DNA, 25 bp, Mus musculus
tcttcccgattatgtgacatttaag

SEQ ID NO: 20285 - DNA, 25 bp, Mus musculus
gcagcacatcttcatcgcggctggg

SEQ ID NO: 20286 - DNA, 25 bp, Mus musculus
tctcgctgtatcgtcaagtctccaa

SEQ ID NO: 20287 - DNA, 25 bp, Mus musculus
cgctgtatcgtcaagtctccaatat

SEQ ID NO: 20288 - DNA, 25 bp, Mus musculus
gcaatttcgcgagcgagctttaaga

SEQ ID NO: 20289 - DNA, 25 bp, Mus musculus
cgtagcctctttgactacatgagcc

SEQ ID NO: 20290 - DNA, 25 bp, Mus musculus
agcctctttgactacatgagccacg

SEQ ID NO: 20291 - DNA, 25 bp, Mus musculus
ctctttgactacatgagccacggct

SEQ ID NO: 20292 - DNA, 25 bp, Mus musculus
gactacatgagccacggctaactcg

SEQ ID NO: 20293 - DNA, 25 bp, Mus musculus
tacatgagccacggctaactcgcgc

SEQ ID NO: 20294 - DNA, 25 bp, Mus musculus
taactcgcgccttctggaactggtg

SEQ ID NO: 20295 - DNA, 25 bp, Mus musculus
gcgccttctggaactggtgccttta

SEQ ID NO: 20296 - DNA, 25 bp, Mus musculus
tctggaactggtgcctttagtcccg

SEQ ID NO: 20297 - DNA, 25 bp, Mus musculus
ggtgcctttagtcccgcgaagcaat

SEQ ID NO: 20298 - DNA, 25 bp, Mus musculus
tgtatcgtcaagtctccaatattga

SEQ ID NO: 20299 - DNA, 25 bp, Mus musculus
atcgtcaagtctccaatattgaggc

SEQ ID NO: 20300 - DNA, 25 bp, Mus musculus
aagtctccaatattgaggcgcttac

SEQ ID NO: 20301 - DNA, 25 bp, Mus musculus
tctccaatattgaggcgcttacccg

SEQ ID NO: 20302 - DNA, 25 bp, Mus musculus
atattgaggcgcttacccgagttcg

SEQ ID NO: 20303 - DNA, 25 bp, Mus musculus
cgcttacccgagttcgcagctggag

SEQ ID NO: 20304 - DNA, 25 bp, Mus musculus
cccgagttcgcagctggagacgatg

SEQ ID NO: 20305 - DNA, 25 bp, Mus musculus
ttcgcagctggagacgatgcggtgt

SEQ ID NO: 20306 - DNA, 25 bp, Mus musculus
acatggtcaccctggccactgaggc

SEQ ID NO: 20307 - DNA, 25 bp, Mus musculus
ctgaggctctggcagcgacagcggt

SEQ ID NO: 20308 - DNA, 25 bp, Mus musculus
atgttcggatccacacagcccaagc

SEQ ID NO: 20309 - DNA, 25 bp, Mus musculus
ggatccacacagcccaagcactggt

SEQ ID NO: 20310 - DNA, 25 bp, Mus musculus
acacagcccaagcactggtcatgtt

SEQ ID NO: 20311 - DNA, 25 bp, Mus musculus
tcatgttccagacggatgcggactt

SEQ ID NO: 20312 - DNA, 25 bp, Mus musculus
cggatgcggacttctaccagcagta

SEQ ID NO: 20313 - DNA, 25 bp, Mus musculus
cggacttctaccagcagtatgggcc

SEQ ID NO: 20314 - DNA, 25 bp, Mus musculus
agatgctgcaggctggagagctcgt

SEQ ID NO: 20315 - DNA, 25 bp, Mus musculus
ggatggcaccctaggactcagaagg

SEQ ID NO: 20316 - DNA, 25 bp, Mus musculus
ctgccccattccctagagaataaat

SEQ ID NO: 20317 - DNA, 25 bp, Mus musculus
cattccctagagaataaatgattat

SEQ ID NO: 20318 - DNA, 25 bp, Mus musculus
ctctggcagcgacagcggtcactca

SEQ ID NO: 20319 - DNA, 25 bp, Mus musculus
cagcgacagcggtcactcagctcac

SEQ ID NO: 20320 - DNA, 25 bp, Mus musculus
tcactcagctcacagtggtaccagt

SEQ ID NO: 20321 - DNA, 25 bp, Mus musculus
ccgcagtgacagctgacgagacgga

SEQ ID NO: 20322 - DNA, 25 bp, Mus musculus
gtgattcctgtggggacaagttcct

SEQ ID NO: 20323 - DNA, 25 bp, Mus musculus
agttcctggatgccaatagcctagc

SEQ ID NO: 20324 - DNA, 25 bp, Mus musculus
ccaatagcctagcccagcatgttcg

SEQ ID NO: 20325 - DNA, 25 bp, Mus musculus
gcctagcccagcatgttcggatcca

SEQ ID NO: 20326 - DNA, 25 bp, Mus musculus
atctcactccgttgttcttggcact

SEQ ID NO: 20327 - DNA, 25 bp, Mus musculus
ctccgttgttcttggcacttttgat

SEQ ID NO: 20328 - DNA, 25 bp, Mus musculus
accacaggcactagctggactcctt

SEQ ID NO: 20329 - DNA, 25 bp, Mus musculus
ggcactagctggactcctttctcta

SEQ ID NO: 20330 - DNA, 25 bp, Mus musculus
actcctttctctatccctagacaat

SEQ ID NO: 20331 - DNA, 25 bp, Mus musculus
ttctctatccctagacaattattct

SEQ ID NO: 20332 - DNA, 25 bp, Mus musculus
taattccttgggctttataagagca

SEQ ID NO: 20333 - DNA, 25 bp, Mus musculus
cagccccattggacaagaatgcagg

SEQ ID NO: 20334 - DNA, 25 bp, Mus musculus
attgcagccaagaccttaaacaggt

SEQ ID NO: 20335 - DNA, 25 bp, Mus musculus
tcccagccaggctacagtggcctgt

SEQ ID NO: 20336 - DNA, 25 bp, Mus musculus
ccaggctacagtggcctgtcctgag

SEQ ID NO: 20337 - DNA, 25 bp, Mus musculus
tacagtggcctgtcctgagttccag

SEQ ID NO: 20338 - DNA, 25 bp, Mus musculus
tgttcttggcacttttgatcctaag

SEQ ID NO: 20339 - DNA, 25 bp, Mus musculus
tggcacttttgatcctaagccttag

SEQ ID NO: 20340 - DNA, 25 bp, Mus musculus
tcctaagccttaggaagctgctgaa

SEQ ID NO: 20341 - DNA, 25 bp, Mus musculus
gctgccattatcacccaggaagtca

SEQ ID NO: 20342 - DNA, 25 bp, Mus musculus
attatcacccaggaagtcagcgatg

SEQ ID NO: 20343 - DNA, 25 bp, Mus musculus
gtctcaatacaaccttggggcctca

SEQ ID NO: 20344 - DNA, 25 bp, Mus musculus
atacaaccttggggcctcaatcaat

SEQ ID NO: 20345 - DNA, 25 bp, Mus musculus
ggcctcaatcaatcagagtagcagc

SEQ ID NO: 20346 - DNA, 25 bp, Mus musculus
ggcctcctacatcaagcaacagcct

SEQ ID NO: 20347 - DNA, 25 bp, Mus musculus
ctacatcaagcaacagcctctgtcc

SEQ ID NO: 20348 - DNA, 25 bp, Mus musculus
tttcaatgccatggcctcttcttct

SEQ ID NO: 20349 - DNA, 25 bp, Mus musculus
tgccatggcctcttcttctatgcat

SEQ ID NO: 20350 - DNA, 25 bp, Mus musculus
ggcctcttcttctatgcatacaaca

SEQ ID NO: 20351 - DNA, 25 bp, Mus musculus
ttcttctatgcatacaacaggcgga

SEQ ID NO: 20352 - DNA, 25 bp, Mus musculus
aggatcttactatcaccagcaggtc

SEQ ID NO: 20353 - DNA, 25 bp, Mus musculus
cacctaccaagacatcaagccgtgt

SEQ ID NO: 20354 - DNA, 25 bp, Mus musculus
ccaagacatcaagccgtgtgtgatg

SEQ ID NO: 20355 - DNA, 25 bp, Mus musculus
catcaagccgtgtgtgatgtgaggt

SEQ ID NO: 20356 - DNA, 25 bp, Mus musculus
cgccacaaactgctttactctggag

SEQ ID NO: 20357 - DNA, 25 bp, Mus musculus
ccaacacagactgggagcagcgtct

SEQ ID NO: 20358 - DNA, 25 bp, Mus musculus
ggagcagccataccttcaccaaaac

SEQ ID NO: 20359 - DNA, 25 bp, Mus musculus
cagtcacaacgggccggcagaactg

SEQ ID NO: 20360 - DNA, 25 bp, Mus musculus
agaactgcaaggcatccctcggtat

SEQ ID NO: 20361 - DNA, 25 bp, Mus musculus
catccctcggtatcactcacagtcg

SEQ ID NO: 20362 - DNA, 25 bp, Mus musculus
tcggtatcactcacagtcgcccagc

SEQ ID NO: 20363 - DNA, 25 bp, Mus musculus
tcactcacagtcgcccagcatgtgt

SEQ ID NO: 20364 - DNA, 25 bp, Mus musculus
acagtcgcccagcatgtgtgacaga

SEQ ID NO: 20365 - DNA, 25 bp, Mus musculus
gtttgtcttctctttcaatgccatg

SEQ ID NO: 20366 - DNA, 25 bp, Mus musculus
atgcttcactggaaaacattgccca

SEQ ID NO: 20367 - DNA, 25 bp, Mus musculus
gatttccccatttgtttgcagaaca

SEQ ID NO: 20368 - DNA, 25 bp, Mus musculus
ccatagctcttctgaatagtaaagc

SEQ ID NO: 20369 - DNA, 25 bp, Mus musculus
catgagttccaatcagtgttcactc

SEQ ID NO: 20370 - DNA, 25 bp, Mus musculus
cttagcttcaccttgggcacgattt

SEQ ID NO: 20371 - DNA, 25 bp, Mus musculus
tcagtggcaggccagaggattcatg

SEQ ID NO: 20372 - DNA, 25 bp, Mus musculus
attcatgctttcccttctcctgatc

SEQ ID NO: 20373 - DNA, 25 bp, Mus musculus
ccttctcctgatccagaagatcacc

SEQ ID NO: 20374 - DNA, 25 bp, Mus musculus
cctgatccagaagatcaccatggca

SEQ ID NO: 20375 - DNA, 25 bp, Mus musculus
gatcaccatggcaaaggcttatagt

SEQ ID NO: 20376 - DNA, 25 bp, Mus musculus
agtgtcttcaacatcgtgcaaatat

SEQ ID NO: 20377 - DNA, 25 bp, Mus musculus
ttcaacatcgtgcaaatatgacagc

SEQ ID NO: 20378 - DNA, 25 bp, Mus musculus
atatcaaacacatttcttcagttac

SEQ ID NO: 20379 - DNA, 25 bp, Mus musculus
aacacatttcttcagttactggtgg

SEQ ID NO: 20380 - DNA, 25 bp, Mus musculus
ggccagtcgctgcagtcacttacta

SEQ ID NO: 20381 - DNA, 25 bp, Mus musculus
tcgctgcagtcacttactatcgcat

SEQ ID NO: 20382 - DNA, 25 bp, Mus musculus
attatttgcagaatctctttcttga

SEQ ID NO: 20383 - DNA, 25 bp, Mus musculus
atctctttcttgatactgcagccaa

SEQ ID NO: 20384 - DNA, 25 bp, Mus musculus
atactgcagccaatgatgccatagc

SEQ ID NO: 20385 - DNA, 25 bp, Mus musculus
cagccaatgatgccatagctcttct

SEQ ID NO: 20386 - DNA, 25 bp, Mus musculus
tactgcctcctgtttacaatcagca

SEQ ID NO: 20387 - DNA, 25 bp, Mus musculus
ctcctgtttacaatcagcagaacga

SEQ ID NO: 20388 - DNA, 25 bp, Mus musculus
tgatcccggactctgcaaacgtctt

SEQ ID NO: 20389 - DNA, 25 bp, Mus musculus
acgtcttttacgccatgaatagcca

SEQ ID NO: 20390 - DNA, 25 bp, Mus musculus
agttgcgcagtcggaccagcctgac

SEQ ID NO: 20391 - DNA, 25 bp, Mus musculus
ggaccagcctgactttgcccaggac

SEQ ID NO: 20392 - DNA, 25 bp, Mus musculus
gcctgactttgcccaggacagctaa

SEQ ID NO: 20393 - DNA, 25 bp, Mus musculus
ctttgcccaggacagctaagcgggg

SEQ ID NO: 20394 - DNA, 25 bp, Mus musculus
gacagtacactcctactgcccaagg

SEQ ID NO: 20395 - DNA, 25 bp, Mus musculus
ctactgcccaaggcagagtgaggct

SEQ ID NO: 20396 - DNA, 25 bp, Mus musculus
aaagccatggcgacgccaaccacca

SEQ ID NO: 20397 - DNA, 25 bp, Mus musculus
agaattcagctgtgcagagagcact

SEQ ID NO: 20398 - DNA, 25 bp, Mus musculus
tttacaatcagcagaacgaagacac

SEQ ID NO: 20399 - DNA, 25 bp, Mus musculus
agaacgaagacacctgcatcatccg

SEQ ID NO: 20400 - DNA, 25 bp, Mus musculus
aagacacctgcatcatccgcatcag

SEQ ID NO: 20401 - DNA, 25 bp, Mus musculus
cctgcatcatccgcatcagtgtaga

SEQ ID NO: 20402 - DNA, 25 bp, Mus musculus
tcatccgcatcagtgtagaagacaa

SEQ ID NO: 20403 - DNA, 25 bp, Mus musculus
aagacaacaatggccacatgtacaa

SEQ ID NO: 20404 - DNA, 25 bp, Mus musculus
tgcaggtcatctcggaggacaaaga

SEQ ID NO: 20405 - DNA, 25 bp, Mus musculus
aactagtgatcccggactctgcaaa

SEQ ID NO: 20406 - DNA, 25 bp, Mus musculus
gctcggacagctgggattcagagaa

SEQ ID NO: 20407 - DNA, 25 bp, Mus musculus
acacctgcaccagaaacatacgaag

SEQ ID NO: 20408 - DNA, 25 bp, Mus musculus
ccagctaggccagtgaagggagcat

SEQ ID NO: 20409 - DNA, 25 bp, Mus musculus
tactgatttcttgtatcccaggatt

SEQ ID NO: 20410 - DNA, 25 bp, Mus musculus
gattcctgttgctttacccacaaca

SEQ ID NO: 20411 - DNA, 25 bp, Mus musculus
tcctgttgctttacccacaacagac

SEQ ID NO: 20412 - DNA, 25 bp, Mus musculus
tttacccacaacagacaagtaattg

SEQ ID NO: 20413 - DNA, 25 bp, Mus musculus
cttcctccattcttaactctgcatt

SEQ ID NO: 20414 - DNA, 25 bp, Mus musculus
cctccattcttaactctgcattctg

SEQ ID NO: 20415 - DNA, 25 bp, Mus musculus
ttcttaactctgcattctggcttct

SEQ ID NO: 20416 - DNA, 25 bp, Mus musculus
ttaactctgcattctggcttctgta

SEQ ID NO: 20417 - DNA, 25 bp, Mus musculus
cattctggcttctgtatgtagtatt

SEQ ID NO: 20418 - DNA, 25 bp, Mus musculus
tattacagccagagtcaaggggagt

SEQ ID NO: 20419 - DNA, 25 bp, Mus musculus
tacagccagagtcaaggggagtcag

SEQ ID NO: 20420 - DNA, 25 bp, Mus musculus
ctccaagattcttacgaagcctacg

SEQ ID NO: 20421 - DNA, 25 bp, Mus musculus
gattcttacgaagcctacggacaag

SEQ ID NO: 20422 - DNA, 25 bp, Mus musculus
tcttacgaagcctacggacaagatg

SEQ ID NO: 20423 - DNA, 25 bp, Mus musculus
accaggccatcactgaaggctcctc

SEQ ID NO: 20424 - DNA, 25 bp, Mus musculus
aaggctcctccagctaggccagtga

SEQ ID NO: 20425 - DNA, 25 bp, Mus musculus
cctccagctaggccagtgaagggag

SEQ ID NO: 20426 - DNA, 25 bp, Mus musculus
cactccacagcaggaagtgacctct

SEQ ID NO: 20427 - DNA, 25 bp, Mus musculus
ggaagtgacctctgcccctgcttgg

SEQ ID NO: 20428 - DNA, 25 bp, Mus musculus
ggaaccgcagctttcactgagacac

SEQ ID NO: 20429 - DNA, 25 bp, Mus musculus
gaaccgcagctttcactgagacact

SEQ ID NO: 20430 - DNA, 25 bp, Mus musculus
gcagctttcactgagacacttgaag

SEQ ID NO: 20431 - DNA, 25 bp, Mus musculus
cagctttcactgagacacttgaagt

SEQ ID NO: 20432 - DNA, 25 bp, Mus musculus
gctttcactgagacacttgaagtga

SEQ ID NO: 20433 - DNA, 25 bp, Mus musculus
ctttcactgagacacttgaagtgac

SEQ ID NO: 20434 - DNA, 25 bp, Mus musculus
ttcactgagacacttgaagtgacca

SEQ ID NO: 20435 - DNA, 25 bp, Mus musculus
tcactgagacacttgaagtgaccat

SEQ ID NO: 20436 - DNA, 25 bp, Mus musculus
cttgaagtgaccattcctccttggg

SEQ ID NO: 20437 - DNA, 25 bp, Mus musculus
ttgaagtgaccattcctccttgggg

SEQ ID NO: 20438 - DNA, 25 bp, Mus musculus
agtgacctctgcccctgcttggtag

SEQ ID NO: 20439 - DNA, 25 bp, Mus musculus
ctgcccctgcttggtagcgggaact

SEQ ID NO: 20440 - DNA, 25 bp, Mus musculus
tgcccctgcttggtagcgggaactg

SEQ ID NO: 20441 - DNA, 25 bp, Mus musculus
ctgcttggtagcgggaactggagtc

SEQ ID NO: 20442 - DNA, 25 bp, Mus musculus
tgcttggtagcgggaactggagtcc

SEQ ID NO: 20443 - DNA, 25 bp, Mus musculus
tcaatcacccagactggacagcagg

SEQ ID NO: 20444 - DNA, 25 bp, Mus musculus
aatcacccagactggacagcagggg

SEQ ID NO: 20445 - DNA, 25 bp, Mus musculus
cagggccagtgggccaggtgtcaac

SEQ ID NO: 20446 - DNA, 25 bp, Mus musculus
tcgtgttggctcctgctctgatgtt

SEQ ID NO: 20447 - DNA, 25 bp, Mus musculus
tggctcctgctctgatgttgttgtg

SEQ ID NO: 20448 - DNA, 25 bp, Mus musculus
tgttccttccaggattatccaccac

SEQ ID NO: 20449 - DNA, 25 bp, Mus musculus
accccactgatgaacaccctggctt

SEQ ID NO: 20450 - DNA, 25 bp, Mus musculus
tcctctccaccaatctgattcctaa

SEQ ID NO: 20451 - DNA, 25 bp, Mus musculus
atctgattcctaacaggggcttgtc

SEQ ID NO: 20452 - DNA, 25 bp, Mus musculus
ttcctaacaggggcttgtcctggtg

SEQ ID NO: 20453 - DNA, 25 bp, Mus musculus
gacacccttcctttctgtgagcgac

SEQ ID NO: 20454 - DNA, 25 bp, Mus musculus
gagcgaccagaggcccgatggagcc

SEQ ID NO: 20455 - DNA, 25 bp, Mus musculus
ctttccaagtgccaaagagcccaga

SEQ ID NO: 20456 - DNA, 25 bp, Mus musculus
aagtgccaaagagcccagaaggact

SEQ ID NO: 20457 - DNA, 25 bp, Mus musculus
tctaagaccctcaagtggaaacact

SEQ ID NO: 20458 - DNA, 25 bp, Mus musculus
ggatcatgcatcgaaggtgaagctg

SEQ ID NO: 20459 - DNA, 25 bp, Mus musculus
caatttgcaaccccagggacatgca

SEQ ID NO: 20460 - DNA, 25 bp, Mus musculus
gaagctgccgtggacagcaaaagac

SEQ ID NO: 20461 - DNA, 25 bp, Mus musculus
gacagcaaaagacccaggagctgaa

SEQ ID NO: 20462 - DNA, 25 bp, Mus musculus
tcaagtggccaaacatcgcctactc

SEQ ID NO: 20463 - DNA, 25 bp, Mus musculus
acatcgcctactcttcttcaaacac

SEQ ID NO: 20464 - DNA, 25 bp, Mus musculus
caaacaccggctacagtgcatgacc

SEQ ID NO: 20465 - DNA, 25 bp, Mus musculus
acagtgcatgaccgccgagtgacgt

SEQ ID NO: 20466 - DNA, 25 bp, Mus musculus
ttgggccttcacactgtcaggctgg

SEQ ID NO: 20467 - DNA, 25 bp, Mus musculus
gatgctgaccttgtgttactgagca

SEQ ID NO: 20468 - DNA, 25 bp, Mus musculus
ttgtacagctcacatgtttacactc

SEQ ID NO: 20469 - DNA, 25 bp, Mus musculus
tagcaaatgttccttactggttctg

SEQ ID NO: 20470 - DNA, 25 bp, Mus musculus
atgttccttactggttctgcactgc

SEQ ID NO: 20471 - DNA, 25 bp, Mus musculus
ggttctgcactgcttctgtctgtct

SEQ ID NO: 20472 - DNA, 25 bp, Mus musculus
tctgtcttaatgctggcgttaagat

SEQ ID NO: 20473 - DNA, 25 bp, Mus musculus
aatgacatcattgcatcatttttta

SEQ ID NO: 20474 - DNA, 25 bp, Mus musculus
tcatctccattaaaacttgccttaa

SEQ ID NO: 20475 - DNA, 25 bp, Mus musculus
aaacttgccttaagcttccagattg

SEQ ID NO: 20476 - DNA, 25 bp, Mus musculus
agcttccagattgctttgccgttag

SEQ ID NO: 20477 - DNA, 25 bp, Mus musculus
cagattgctttgccgttagctttac

SEQ ID NO: 20478 - DNA, 25 bp, Mus musculus
gctttgccgttagctttactgtata

SEQ ID NO: 20479 - DNA, 25 bp, Mus musculus
catgtttacactctcagtgccctga

SEQ ID NO: 20480 - DNA, 25 bp, Mus musculus
taacatctcggtggtacattttctc

SEQ ID NO: 20481 - DNA, 25 bp, Mus musculus
ggtacattttctctgttgcttctcg

SEQ ID NO: 20482 - DNA, 25 bp, Mus musculus
ttttctctgttgcttctcgccaaga

SEQ ID NO: 20483 - DNA, 25 bp, Mus musculus
cttctcgccaagagcttccagtccg

SEQ ID NO: 20484 - DNA, 25 bp, Mus musculus
gccaagagcttccagtccggcagtc

SEQ ID NO: 20485 - DNA, 25 bp, Mus musculus
agcttccagtccggcagtcagtaag

SEQ ID NO: 20486 - DNA, 25 bp, Mus musculus
cagtccggcagtcagtaagatcaca

SEQ ID NO: 20487 - DNA, 25 bp, Mus musculus
tgataaacacctcacgcctcactct

SEQ ID NO: 20488 - DNA, 25 bp, Mus musculus
tcactcttcacagtgcgcagacaga

SEQ ID NO: 20489 - DNA, 25 bp, Mus musculus
ttatcttctaagtggaacttctagc

SEQ ID NO: 20490 - DNA, 25 bp, Mus musculus
ttctagcctgcactctgatgtcatg

SEQ ID NO: 20491 - DNA, 25 bp, Mus musculus
cctgcactctgatgtcatgtgttcc

SEQ ID NO: 20492 - DNA, 25 bp, Mus musculus
tgtcatgtgttccctctgtctttca

SEQ ID NO: 20493 - DNA, 25 bp, Mus musculus
cctctgtctttcaaactctcaggtt

SEQ ID NO: 20494 - DNA, 25 bp, Mus musculus
tctttcaaactctcaggtttcctct

SEQ ID NO: 20495 - DNA, 25 bp, Mus musculus
tcaggtttcctctgggccactgctt

SEQ ID NO: 20496 - DNA, 25 bp, Mus musculus
ttcctctgggccactgcttttccct

SEQ ID NO: 20497 - DNA, 25 bp, Mus musculus
tttccctgggaagccttgctggaga

SEQ ID NO: 20498 - DNA, 25 bp, Mus musculus
acttattgctgattttaatgggttg

SEQ ID NO: 20499 - DNA, 25 bp, Mus musculus
gctttaaccatctgatatccatagt

SEQ ID NO: 20500 - DNA, 25 bp, Mus musculus
accatctgatatccatagtagacat

SEQ ID NO: 20501 - DNA, 25 bp, Mus musculus
tactatcctagttaacatagttacg

SEQ ID NO: 20502 - DNA, 25 bp, Mus musculus
agttacgttcagcacttgtctcatt

SEQ ID NO: 20503 - DNA, 25 bp, Mus musculus
cacttgtctcatttaatgtaaagat

SEQ ID NO: 20504 - DNA, 25 bp, Mus musculus
cacaatcccactgtgcgggtgctat

SEQ ID NO: 20505 - DNA, 25 bp, Mus musculus
ttgttgctcttacaaatcccttcag

SEQ ID NO: 20506 - DNA, 25 bp, Mus musculus
ctcttacaaatcccttcagaaatgt

SEQ ID NO: 20507 - DNA, 25 bp, Mus musculus
gcccgccagagacaagtgcgccggc

SEQ ID NO: 20508 - DNA, 25 bp, Mus musculus
cccgccagagacaagtgcgccggct

SEQ ID NO: 20509 - DNA, 25 bp, Mus musculus
cgagacctgcagacgcgaagcgcgc

SEQ ID NO: 20510 - DNA, 25 bp, Mus musculus
gagacctgcagacgcgaagcgcgcg

SEQ ID NO: 20511 - DNA, 25 bp, Mus musculus
agacctgcagacgcgaagcgcgcgc

SEQ ID NO: 20512 - DNA, 25 bp, Mus musculus
gacctgcagacgcgaagcgcgcgcg

SEQ ID NO: 20513 - DNA, 25 bp, Mus musculus
cctgcagacgcgaagcgcgcgcgtt

SEQ ID NO: 20514 - DNA, 25 bp, Mus musculus
cgcgttccgacgggctagcagccgg

SEQ ID NO: 20515 - DNA, 25 bp, Mus musculus
ttccgacgggctagcagccgggagc

SEQ ID NO: 20516 - DNA, 25 bp, Mus musculus
cgggtatgctgcgggtcctgcactg

SEQ ID NO: 20517 - DNA, 25 bp, Mus musculus
ggtatgctgcgggtcctgcactgag

SEQ ID NO: 20518 - DNA, 25 bp, Mus musculus
agagacaagtgcgccggcttcgcgc

SEQ ID NO: 20519 - DNA, 25 bp, Mus musculus
cgcccgtgggagacgacggactgca

SEQ ID NO: 20520 - DNA, 25 bp, Mus musculus
actgcaggacggacagacggacgga

SEQ ID NO: 20521 - DNA, 25 bp, Mus musculus
acggacgcacgcactgctggtagct

SEQ ID NO: 20522 - DNA, 25 bp, Mus musculus
gcacgcactgctggtagctgggccg

SEQ ID NO: 20523 - DNA, 25 bp, Mus musculus
cacgcactgctggtagctgggccga

SEQ ID NO: 20524 - DNA, 25 bp, Mus musculus
gccgagacctgcagacgcgaagcgc

SEQ ID NO: 20525 - DNA, 25 bp, Mus musculus
ccgagacctgcagacgcgaagcgcg

SEQ ID NO: 20526 - DNA, 25 bp, Mus musculus
ttcggagcttgcaccatcgtgtttt

SEQ ID NO: 20527 - DNA, 25 bp, Mus musculus
tcagatcttaccgtctatggattcg

SEQ ID NO: 20528 - DNA, 25 bp, Mus musculus
atttgtgccgtaattatgtaccatg

SEQ ID NO: 20529 - DNA, 25 bp, Mus musculus
ttaatctgctttagttccacatgac

SEQ ID NO: 20530 - DNA, 25 bp, Mus musculus
tgctttagttccacatgacagttaa

SEQ ID NO: 20531 - DNA, 25 bp, Mus musculus
agttccacatgacagttaagcccca

SEQ ID NO: 20532 - DNA, 25 bp, Mus musculus
acatgacagttaagccccagaaatg

SEQ ID NO: 20533 - DNA, 25 bp, Mus musculus
cagttaagccccagaaatgagatcc

SEQ ID NO: 20534 - DNA, 25 bp, Mus musculus
gagatccgagcagccacattccacg

SEQ ID NO: 20535 - DNA, 25 bp, Mus musculus
cgagcagccacattccacgtctgtt

SEQ ID NO: 20536 - DNA, 25 bp, Mus musculus
gccacattccacgtctgtttcaaaa

SEQ ID NO: 20537 - DNA, 25 bp, Mus musculus
ttccacgtctgtttcaaaatgaatt

SEQ ID NO: 20538 - DNA, 25 bp, Mus musculus
atggcttttcttacccagattgtgt

SEQ ID NO: 20539 - DNA, 25 bp, Mus musculus
tttcttacccagattgtgtacatag

SEQ ID NO: 20540 - DNA, 25 bp, Mus musculus
atttagctacagcttttaacggcag

SEQ ID NO: 20541 - DNA, 25 bp, Mus musculus
ctacagcttttaacggcagtgtcat

SEQ ID NO: 20542 - DNA, 25 bp, Mus musculus
acggcagtgtcatcccctttgcact

SEQ ID NO: 20543 - DNA, 25 bp, Mus musculus
tcccctttgcactgtaatgaggaaa

SEQ ID NO: 20544 - DNA, 25 bp, Mus musculus
gttgccaaattgctgcatatttgtg

SEQ ID NO: 20545 - DNA, 25 bp, Mus musculus
aaattgctgcatatttgtgccgtaa

SEQ ID NO: 20546 - DNA, 25 bp, Mus musculus
gcacgacacagtcagcttcaaacac

SEQ ID NO: 20547 - DNA, 25 bp, Mus musculus
cacgacacagtcagcttcaaacaca

SEQ ID NO: 20548 - DNA, 25 bp, Mus musculus
aaacccggataatgcagtgaatgtg

SEQ ID NO: 20549 - DNA, 25 bp, Mus musculus
aatcaatctaataaagccatttgtt

SEQ ID NO: 20550 - DNA, 25 bp, Mus musculus
atcaatctaataaagccatttgtta

SEQ ID NO: 20551 - DNA, 25 bp, Mus musculus
acgacacagtcagcttcaaacacat

SEQ ID NO: 20552 - DNA, 25 bp, Mus musculus
cgacacagtcagcttcaaacacata

SEQ ID NO: 20553 - DNA, 25 bp, Mus musculus
gacacagtcagcttcaaacacataa

SEQ ID NO: 20554 - DNA, 25 bp, Mus musculus
acacagtcagcttcaaacacataaa

SEQ ID NO: 20555 - DNA, 25 bp, Mus musculus
cacagtcagcttcaaacacataaaa

SEQ ID NO: 20556 - DNA, 25 bp, Mus musculus
acagtcagcttcaaacacataaaag

SEQ ID NO: 20557 - DNA, 25 bp, Mus musculus
cagtcagcttcaaacacataaaaga

SEQ ID NO: 20558 - DNA, 25 bp, Mus musculus
gtcagcttcaaacacataaaagaat

SEQ ID NO: 20559 - DNA, 25 bp, Mus musculus
gcacgacacagtcagcttcaaacac

SEQ ID NO: 20560 - DNA, 25 bp, Mus musculus
cacgacacagtcagcttcaaacaca

SEQ ID NO: 20561 - DNA, 25 bp, Mus musculus
gtcagcttcaaacacataaaagaat

SEQ ID NO: 20562 - DNA, 25 bp, Mus musculus
tcagcttcaaacacataaaagaata

SEQ ID NO: 20563 - DNA, 25 bp, Mus musculus
cagcttcaaacacataaaagaatac

SEQ ID NO: 20564 - DNA, 25 bp, Mus musculus
agcttcaaacacataaaagaataca

SEQ ID NO: 20565 - DNA, 25 bp, Mus musculus
gaaaaacccggataatgcagtgaat

SEQ ID NO: 20566 - DNA, 25 bp, Mus musculus
aaaaacccggataatgcagtgaatg

SEQ ID NO: 20567 - DNA, 25 bp, Mus musculus
aaaacccggataatgcagtgaatgt

SEQ ID NO: 20568 - DNA, 25 bp, Mus musculus
aaacccggataatgcagtgaatgtg

SEQ ID NO: 20569 - DNA, 25 bp, Mus musculus
aatcaatctaataaagccatttgtt

SEQ ID NO: 20570 - DNA, 25 bp, Mus musculus
atcaatctaataaagccatttgtta

SEQ ID NO: 20571 - DNA, 25 bp, Mus musculus
acgacacagtcagcttcaaacacat

SEQ ID NO: 20572 - DNA, 25 bp, Mus musculus
cgacacagtcagcttcaaacacata

SEQ ID NO: 20573 - DNA, 25 bp, Mus musculus
gacacagtcagcttcaaacacataa

SEQ ID NO: 20574 - DNA, 25 bp, Mus musculus
acacagtcagcttcaaacacataaa

SEQ ID NO: 20575 - DNA, 25 bp, Mus musculus
cacagtcagcttcaaacacataaaa

SEQ ID NO: 20576 - DNA, 25 bp, Mus musculus
acagtcagcttcaaacacataaaag

SEQ ID NO: 20577 - DNA, 25 bp, Mus musculus
cagtcagcttcaaacacataaaaga

SEQ ID NO: 20578 - DNA, 25 bp, Mus musculus
agtcagcttcaaacacataaaagaa

SEQ ID NO: 20579 - DNA, 25 bp, Mus musculus
gtcatcgccctgcgttagtattgca

SEQ ID NO: 20580 - DNA, 25 bp, Mus musculus
catcgccctgcgttagtattgcaca

SEQ ID NO: 20581 - DNA, 25 bp, Mus musculus
tgtagacgacaccgcaggaaggtgc

SEQ ID NO: 20582 - DNA, 25 bp, Mus musculus
tagacgacaccgcaggaaggtgcag

SEQ ID NO: 20583 - DNA, 25 bp, Mus musculus
cgacaccgcaggaaggtgcagctgc

SEQ ID NO: 20584 - DNA, 25 bp, Mus musculus
tgcagctgcagctgctacggatgaa

SEQ ID NO: 20585 - DNA, 25 bp, Mus musculus
gctgcagctgctacggatgaagacg

SEQ ID NO: 20586 - DNA, 25 bp, Mus musculus
tgcagctgctacggatgaagacgat

SEQ ID NO: 20587 - DNA, 25 bp, Mus musculus
acgatattcagctcattggatctga

SEQ ID NO: 20588 - DNA, 25 bp, Mus musculus
gatattcagctcattggatctgatg

SEQ ID NO: 20589 - DNA, 25 bp, Mus musculus
tattcagctcattggatctgatgat

SEQ ID NO: 20590 - DNA, 25 bp, Mus musculus
cagctcattggatctgatgatgacg

SEQ ID NO: 20591 - DNA, 25 bp, Mus musculus
cgttagtattgcacatcaggtcgta

SEQ ID NO: 20592 - DNA, 25 bp, Mus musculus
agtattgcacatcaggtcgtatgag

SEQ ID NO: 20593 - DNA, 25 bp, Mus musculus
tattgcacatcaggtcgtatgagaa

SEQ ID NO: 20594 - DNA, 25 bp, Mus musculus
gcacatcaggtcgtatgagaacgag

SEQ ID NO: 20595 - DNA, 25 bp, Mus musculus
taagtattgccctaggagtgtagac

SEQ ID NO: 20596 - DNA, 25 bp, Mus musculus
tattgccctaggagtgtagacgaca

SEQ ID NO: 20597 - DNA, 25 bp, Mus musculus
ttgccctaggagtgtagacgacacc

SEQ ID NO: 20598 - DNA, 25 bp, Mus musculus
agtgtagacgacaccgcaggaaggt

SEQ ID NO: 20599 - DNA, 25 bp, Mus musculus
atttcctcactgcctggtaaaatca

SEQ ID NO: 20600 - DNA, 25 bp, Mus musculus
tcactgcctggtaaaatcaatcaca

SEQ ID NO: 20601 - DNA, 25 bp, Mus musculus
tattgcctccggtgctgagaaatag

SEQ ID NO: 20602 - DNA, 25 bp, Mus musculus
ttctttggcatgcaggcctatttta

SEQ ID NO: 20603 - DNA, 25 bp, Mus musculus
gcttcaaaacagccaatcagcacct

SEQ ID NO: 20604 - DNA, 25 bp, Mus musculus
ccaatcagcacctgaggctaggaat

SEQ ID NO: 20605 - DNA, 25 bp, Mus musculus
atgaactgtagcctttgtctgttaa

SEQ ID NO: 20606 - DNA, 25 bp, Mus musculus
ctttgtctgttaagtctggatgctt

SEQ ID NO: 20607 - DNA, 25 bp, Mus musculus
agtctggatgcttttcagtatctta

SEQ ID NO: 20608 - DNA, 25 bp, Mus musculus
tccctgttttcttaggtaatgtgtg

SEQ ID NO: 20609 - DNA, 25 bp, Mus musculus
aatgttctgcatcactggatggtta

SEQ ID NO: 20610 - DNA, 25 bp, Mus musculus
ctgcatcactggatggttagcaaga

SEQ ID NO: 20611 - DNA, 25 bp, Mus musculus
agaactcctcacatttctatttatt

SEQ ID NO: 20612 - DNA, 25 bp, Mus musculus
aatgcccatcaagagaaatcaacag

SEQ ID NO: 20613 - DNA, 25 bp, Mus musculus
agtgtttactcagttactgttgtgg

SEQ ID NO: 20614 - DNA, 25 bp, Mus musculus
tactcagttactgttgtggcatttt

SEQ ID NO: 20615 - DNA, 25 bp, Mus musculus
tcctgtttactattagactggttat

SEQ ID NO: 20616 - DNA, 25 bp, Mus musculus
tggttattcattattcctcaaattg

SEQ ID NO: 20617 - DNA, 25 bp, Mus musculus
attcctcaaattgctgaatattgcc

SEQ ID NO: 20618 - DNA, 25 bp, Mus musculus
gctgaatattgcctccggtgctgag

SEQ ID NO: 20619 - DNA, 25 bp, Mus musculus
tgaacatcagacaattcctcattgg

SEQ ID NO: 20620 - DNA, 25 bp, Mus musculus
aacatcagacaattcctcattggat

SEQ ID NO: 20621 - DNA, 25 bp, Mus musculus
ctcctggctgtgggaaaacctatgg

SEQ ID NO: 20622 - DNA, 25 bp, Mus musculus
gaatgcaggcacttcatctccatca

SEQ ID NO: 20623 - DNA, 25 bp, Mus musculus
atgcaggcacttcatctccatcaag

SEQ ID NO: 20624 - DNA, 25 bp, Mus musculus
gcaggcacttcatctccatcaaggg

SEQ ID NO: 20625 - DNA, 25 bp, Mus musculus
gccccctgtgtatcttctgatgagt

SEQ ID NO: 20626 - DNA, 25 bp, Mus musculus
cccctgtgtatcttctgatgagtta

SEQ ID NO: 20627 - DNA, 25 bp, Mus musculus
cctgtgtatcttctgatgagttaga

SEQ ID NO: 20628 - DNA, 25 bp, Mus musculus
tgtgtatcttctgatgagttagatt

SEQ ID NO: 20629 - DNA, 25 bp, Mus musculus
tgtatcttctgatgagttagattca

SEQ ID NO: 20630 - DNA, 25 bp, Mus musculus
gccaaggctcgaggtggtatattgg

SEQ ID NO: 20631 - DNA, 25 bp, Mus musculus
tcagacaattcctcattggatgatc

SEQ ID NO: 20632 - DNA, 25 bp, Mus musculus
agacaattcctcattggatgatctc

SEQ ID NO: 20633 - DNA, 25 bp, Mus musculus
acaattcctcattggatgatctcaa

SEQ ID NO: 20634 - DNA, 25 bp, Mus musculus
aattcctcattggatgatctcaaag

SEQ ID NO: 20635 - DNA, 25 bp, Mus musculus
tgatctcaaagggtcttttcatgac

SEQ ID NO: 20636 - DNA, 25 bp, Mus musculus
gggtcttttcatgactcctggctgt

SEQ ID NO: 20637 - DNA, 25 bp, Mus musculus
atgactcctggctgtgggaaaacct

SEQ ID NO: 20638 - DNA, 25 bp, Mus musculus
gactcctggctgtgggaaaacctat

SEQ ID NO: 20639 - DNA, 25 bp, Mus musculus
caggaggacccttgccactggccaa

SEQ ID NO: 20640 - DNA, 25 bp, Mus musculus
aggacccttgccactggccaagagg

SEQ ID NO: 20641 - DNA, 25 bp, Mus musculus
gatttgcctgcgatggtaatgtagt

SEQ ID NO: 20642 - DNA, 25 bp, Mus musculus
agttcctgatagagattgggctgga

SEQ ID NO: 20643 - DNA, 25 bp, Mus musculus
atcagctgaagggttcatggtttta

SEQ ID NO: 20644 - DNA, 25 bp, Mus musculus
gttttaagtgcctgtgggtcctgtg

SEQ ID NO: 20645 - DNA, 25 bp, Mus musculus
ttttaagtgcctgtgggtcctgtga

SEQ ID NO: 20646 - DNA, 25 bp, Mus musculus
tgcctgtgggtcctgtgagctttaa

SEQ ID NO: 20647 - DNA, 25 bp, Mus musculus
ggtcctgtgagctttaagtgagggt

SEQ ID NO: 20648 - DNA, 25 bp, Mus musculus
ttgccactggccaagaggtcgatgg

SEQ ID NO: 20649 - DNA, 25 bp, Mus musculus
tgccactggccaagaggtcgatggt

SEQ ID NO: 20650 - DNA, 25 bp, Mus musculus
gccactggccaagaggtcgatggtg

SEQ ID NO: 20651 - DNA, 25 bp, Mus musculus
ccactggccaagaggtcgatggtga

SEQ ID NO: 20652 - DNA, 25 bp, Mus musculus
cactggccaagaggtcgatggtgat

SEQ ID NO: 20653 - DNA, 25 bp, Mus musculus
actggccaagaggtcgatggtgatt

SEQ ID NO: 20654 - DNA, 25 bp, Mus musculus
tggccaagaggtcgatggtgattac

SEQ ID NO: 20655 - DNA, 25 bp, Mus musculus
agatttgcctgcgatggtaatgtag

SEQ ID NO: 20656 - DNA, 25 bp, Mus musculus
gcgcctgtctactctagtggaacat

SEQ ID NO: 20657 - DNA, 25 bp, Mus musculus
gtctactctagtggaacataggcgc

SEQ ID NO: 20658 - DNA, 25 bp, Mus musculus
cacgccttccagtgcacccagtgtg

SEQ ID NO: 20659 - DNA, 25 bp, Mus musculus
tttcctgcgacatctgcgcacgcac

SEQ ID NO: 20660 - DNA, 25 bp, Mus musculus
gcgacatctgcgcacgcactctcag

SEQ ID NO: 20661 - DNA, 25 bp, Mus musculus
catctgcgcacgcactctcaggaga

SEQ ID NO: 20662 - DNA, 25 bp, Mus musculus
tctgcgcacgcactctcaggagaag

SEQ ID NO: 20663 - DNA, 25 bp, Mus musculus
cgcactctcaggagaagcgctttag

SEQ ID NO: 20664 - DNA, 25 bp, Mus musculus
cactctcaggagaagcgctttagct

SEQ ID NO: 20665 - DNA, 25 bp, Mus musculus
agaagcgctttagctgtggccagtg

SEQ ID NO: 20666 - DNA, 25 bp, Mus musculus
aagcgctttagctgtggccagtgtg

SEQ ID NO: 20667 - DNA, 25 bp, Mus musculus
tttagctgtggccagtgtggcaaga

SEQ ID NO: 20668 - DNA, 25 bp, Mus musculus
aacataggcgcacacacacgggtga

SEQ ID NO: 20669 - DNA, 25 bp, Mus musculus
tgagaagccatttccatgtacccag

SEQ ID NO: 20670 - DNA, 25 bp, Mus musculus
agtgcaccagagtgtgcactctggc

SEQ ID NO: 20671 - DNA, 25 bp, Mus musculus
agagtgtgcactctggcgagcacgc

SEQ ID NO: 20672 - DNA, 25 bp, Mus musculus
agtgtgcactctggcgagcacgcct

SEQ ID NO: 20673 - DNA, 25 bp, Mus musculus
tgcactctggcgagcacgccttcca

SEQ ID NO: 20674 - DNA, 25 bp, Mus musculus
ctctggcgagcacgccttccagtgc

SEQ ID NO: 20675 - DNA, 25 bp, Mus musculus
ctggcgagcacgccttccagtgcac

SEQ ID NO: 20676 - DNA, 25 bp, Mus musculus
tacccggtcagcagggattggtgtc

SEQ ID NO: 20677 - DNA, 25 bp, Mus musculus
cccggtcagcagggattggtgtcct

SEQ ID NO: 20678 - DNA, 25 bp, Mus musculus
gtgccctgaaggggttccactgctg

SEQ ID NO: 20679 - DNA, 25 bp, Mus musculus
aaggggttccactgctgctttgcac

SEQ ID NO: 20680 - DNA, 25 bp, Mus musculus
ttccactgctgctttgcactgtggt

SEQ ID NO: 20681 - DNA, 25 bp, Mus musculus
ccactgctgctttgcactgtggtag

SEQ ID NO: 20682 - DNA, 25 bp, Mus musculus
actgctgctttgcactgtggtagtg

SEQ ID NO: 20683 - DNA, 25 bp, Mus musculus
tgctgctttgcactgtggtagtgaa

SEQ ID NO: 20684 - DNA, 25 bp, Mus musculus
gctttgcactgtggtagtgaatatg

SEQ ID NO: 20685 - DNA, 25 bp, Mus musculus
tagtgaatatgcccaactttggagc

SEQ ID NO: 20686 - DNA, 25 bp, Mus musculus
gtgaatatgcccaactttggagcgg

SEQ ID NO: 20687 - DNA, 25 bp, Mus musculus
atatgcccaactttggagcggtatt

SEQ ID NO: 20688 - DNA, 25 bp, Mus musculus
gtactgcttcacctacctgggcagc

SEQ ID NO: 20689 - DNA, 25 bp, Mus musculus
tatgcccaactttggagcggtattt

SEQ ID NO: 20690 - DNA, 25 bp, Mus musculus
actgcttcacctacctgggcagctt

SEQ ID NO: 20691 - DNA, 25 bp, Mus musculus
cttcacctacctgggcagcttcctg

SEQ ID NO: 20692 - DNA, 25 bp, Mus musculus
gcagcttcctgggcatcgtcctgtg

SEQ ID NO: 20693 - DNA, 25 bp, Mus musculus
agcttcctgggcatcgtcctgtgcc

SEQ ID NO: 20694 - DNA, 25 bp, Mus musculus
gcatcgtcctgtgccctgaaggggt

SEQ ID NO: 20695 - DNA, 25 bp, Mus musculus
tcctgtgccctgaaggggttccact

SEQ ID NO: 20696 - DNA, 25 bp, Mus musculus
ctgtgccctgaaggggttccactgc

SEQ ID NO: 20697 - DNA, 25 bp, Mus musculus
acgagcggctgcacctgctgctcat

SEQ ID NO: 20698 - DNA, 25 bp, Mus musculus
cagatgtcacctatgtcaaaaaggt

SEQ ID NO: 20699 - DNA, 25 bp, Mus musculus
tcctcacagtgcctttgcgcatggt

SEQ ID NO: 20700 - DNA, 25 bp, Mus musculus
tcacagtgcctttgcgcatggtggt

SEQ ID NO: 20701 - DNA, 25 bp, Mus musculus
cagtgcctttgcgcatggtggtact

SEQ ID NO: 20702 - DNA, 25 bp, Mus musculus
tggtacttacccgaatcttcactga

SEQ ID NO: 20703 - DNA, 25 bp, Mus musculus
gaatcttcactgagcgagaaatgaa

SEQ ID NO: 20704 - DNA, 25 bp, Mus musculus
tcttcactgagcgagaaatgaaatg

SEQ ID NO: 20705 - DNA, 25 bp, Mus musculus
acgagatgcccatgcctgtgtagct

SEQ ID NO: 20706 - DNA, 25 bp, Mus musculus
agatgcccatgcctgtgtagctgct

SEQ ID NO: 20707 - DNA, 25 bp, Mus musculus
cttctccctatcctgcagtaaagtg

SEQ ID NO: 20708 - DNA, 25 bp, Mus musculus
ctccctatcctgcagtaaagtgctt

SEQ ID NO: 20709 - DNA, 25 bp, Mus musculus
atgtcacctatgtcaaaaaggttcg

SEQ ID NO: 20710 - DNA, 25 bp, Mus musculus
ccatgcggatgcacctgttcactgc

SEQ ID NO: 20711 - DNA, 25 bp, Mus musculus
ggatgcacctgttcactgccttgca

SEQ ID NO: 20712 - DNA, 25 bp, Mus musculus
acctgttcactgccttgcagttgct

SEQ ID NO: 20713 - DNA, 25 bp, Mus musculus
tcactgccttgcagttgctctgcct

SEQ ID NO: 20714 - DNA, 25 bp, Mus musculus
ctgccttgcagttgctctgcctggc

SEQ ID NO: 20715 - DNA, 25 bp, Mus musculus
tgctctgcctggccctgctttgggc

SEQ ID NO: 20716 - DNA, 25 bp, Mus musculus
ccctgctttgggcagtcatgtccac

SEQ ID NO: 20717 - DNA, 25 bp, Mus musculus
tcggcacaggctgttcccggaagtt

SEQ ID NO: 20718 - DNA, 25 bp, Mus musculus
ggaagttcagcctcaagacggtgct

SEQ ID NO: 20719 - DNA, 25 bp, Mus musculus
gccgcatcgagtacatacactccaa

SEQ ID NO: 20720 - DNA, 25 bp, Mus musculus
catcgagtacatacactccaagaac

SEQ ID NO: 20721 - DNA, 25 bp, Mus musculus
tcgagtacatacactccaagaactt

SEQ ID NO: 20722 - DNA, 25 bp, Mus musculus
caagaacttcatccaccgggatgtg

SEQ ID NO: 20723 - DNA, 25 bp, Mus musculus
cttcatccaccgggatgtgaagccc

SEQ ID NO: 20724 - DNA, 25 bp, Mus musculus
tcggcctggccaagaagtaccgcga

SEQ ID NO: 20725 - DNA, 25 bp, Mus musculus
cctggccaagaagtaccgcgatgcc

SEQ ID NO: 20726 - DNA, 25 bp, Mus musculus
agaagtaccgcgatgcccgcacaca

SEQ ID NO: 20727 - DNA, 25 bp, Mus musculus
acaagaacctgaccggcactgcccg

SEQ ID NO: 20728 - DNA, 25 bp, Mus musculus
gaacctgaccggcactgcccgctat

SEQ ID NO: 20729 - DNA, 25 bp, Mus musculus
tcagcctcaagacggtgctgttgct

SEQ ID NO: 20730 - DNA, 25 bp, Mus musculus
cctcaagacggtgctgttgctggcc

SEQ ID NO: 20731 - DNA, 25 bp, Mus musculus
tcaagacggtgctgttgctggccga

SEQ ID NO: 20732 - DNA, 25 bp, Mus musculus
cgaccagatgatcagccgcatcgag

SEQ ID NO: 20733 - DNA, 25 bp, Mus musculus
accagatgatcagccgcatcgagta

SEQ ID NO: 20734 - DNA, 25 bp, Mus musculus
gatgatcagccgcatcgagtacata

SEQ ID NO: 20735 - DNA, 25 bp, Mus musculus
tgatcagccgcatcgagtacataca

SEQ ID NO: 20736 - DNA, 25 bp, Mus musculus
cagccgcatcgagtacatacactcc

SEQ ID NO: 20737 - DNA, 25 bp, Mus musculus
ggtgcaaagaccccatgcctcgggg

SEQ ID NO: 20738 - DNA, 25 bp, Mus musculus
aagaccccatgcctcggggcacagg

SEQ ID NO: 20739 - DNA, 25 bp, Mus musculus
atgccataccagtaacctggagcag

SEQ ID NO: 20740 - DNA, 25 bp, Mus musculus
ccataccagtaacctggagcagagt

SEQ ID NO: 20741 - DNA, 25 bp, Mus musculus
taccagtaacctggagcagagtcag

SEQ ID NO: 20742 - DNA, 25 bp, Mus musculus
tcagtcttcccatagaagcgcacaa

SEQ ID NO: 20743 - DNA, 25 bp, Mus musculus
gtcttcccatagaagcgcacaatcc

SEQ ID NO: 20744 - DNA, 25 bp, Mus musculus
ccatagaagcgcacaatcccctgct

SEQ ID NO: 20745 - DNA, 25 bp, Mus musculus
tagaagcgcacaatcccctgcttct

SEQ ID NO: 20746 - DNA, 25 bp, Mus musculus
aagcgcacaatcccctgcttctggc

SEQ ID NO: 20747 - DNA, 25 bp, Mus musculus
ccctgcttctggcctgccacaagga

SEQ ID NO: 20748 - DNA, 25 bp, Mus musculus
cctgccacaaggacttggtctccaa

SEQ ID NO: 20749 - DNA, 25 bp, Mus musculus
ccatgcctcggggcacaggtaaagt

SEQ ID NO: 20750 - DNA, 25 bp, Mus musculus
ctgccacaaggacttggtctccaac

SEQ ID NO: 20751 - DNA, 25 bp, Mus musculus
taccggacgccgaacacagagccgt

SEQ ID NO: 20752 - DNA, 25 bp, Mus musculus
acgccgaacacagagccgtcatgtt

SEQ ID NO: 20753 - DNA, 25 bp, Mus musculus
ccgaacacagagccgtcatgtttgc

SEQ ID NO: 20754 - DNA, 25 bp, Mus musculus
aacacagagccgtcatgtttgcctg

SEQ ID NO: 20755 - DNA, 25 bp, Mus musculus
tggtccagctcgatgccataccagt

SEQ ID NO: 20756 - DNA, 25 bp, Mus musculus
tccagctcgatgccataccagtaac

SEQ ID NO: 20757 - DNA, 25 bp, Mus musculus
agctcgatgccataccagtaacctg

SEQ ID NO: 20758 - DNA, 25 bp, Mus musculus
gaggatctgcgtcttccagtatttg

SEQ ID NO: 20759 - DNA, 25 bp, Mus musculus
gatctgcgtcttccagtatttgagg

SEQ ID NO: 20760 - DNA, 25 bp, Mus musculus
agttaccatctggtacaggaatgag

SEQ ID NO: 20761 - DNA, 25 bp, Mus musculus
agttaccatctggtacgaggaatga

SEQ ID NO: 20762 - DNA, 25 bp, Mus musculus
taccatctggtacgaggaatgagga

SEQ ID NO: 20763 - DNA, 25 bp, Mus musculus
agatgtgtcttccagtgacttagga

SEQ ID NO: 20764 - DNA, 25 bp, Mus musculus
gtcttccagtgacttaggaggtacg

SEQ ID NO: 20765 - DNA, 25 bp, Mus musculus
ttccagtgacttaggaggtacgatc

SEQ ID NO: 20766 - DNA, 25 bp, Mus musculus
aggtacgatctcttataggtatgag

SEQ ID NO: 20767 - DNA, 25 bp, Mus musculus
tacgatctcttataggtatgaggat

SEQ ID NO: 20768 - DNA, 25 bp, Mus musculus
gatctcttataggtatgaggatctg

SEQ ID NO: 20769 - DNA, 25 bp, Mus musculus
ggatgtgtccctggtattgaggatc

SEQ ID NO: 20770 - DNA, 25 bp, Mus musculus
cgtcttccagtatttgaggaggtga

SEQ ID NO: 20771 - DNA, 25 bp, Mus musculus
gatgtgtccctggtattgaggatcc

SEQ ID NO: 20772 - DNA, 25 bp, Mus musculus
ttgaggccttcgttccagtgcctga

SEQ ID NO: 20773 - DNA, 25 bp, Mus musculus
aggccttcgttccagtgcctgagga

SEQ ID NO: 20774 - DNA, 25 bp, Mus musculus
agcctgagtcttctagtgtctggga

SEQ ID NO: 20775 - DNA, 25 bp, Mus musculus
ctgagtcttctagtgtctgggaagt

SEQ ID NO: 20776 - DNA, 25 bp, Mus musculus
tctgtgtccatcagtatctgaggag

SEQ ID NO: 20777 - DNA, 25 bp, Mus musculus
gtgtccatcagtatctgaggaggtg

SEQ ID NO: 20778 - DNA, 25 bp, Mus musculus
taggactgtccatgtctgaggagtt

SEQ ID NO: 20779 - DNA, 25 bp, Mus musculus
cattaagaactgcatctgtgccaga

SEQ ID NO: 20780 - DNA, 25 bp, Mus musculus
gaactgcatctgtgccagagattta

SEQ ID NO: 20781 - DNA, 25 bp, Mus musculus
ctcctctatgatggccgctcagcat

SEQ ID NO: 20782 - DNA, 25 bp, Mus musculus
tatgatggccgctcagcatcccgct

SEQ ID NO: 20783 - DNA, 25 bp, Mus musculus
gatggccgctcagcatcccgctggc

SEQ ID NO: 20784 - DNA, 25 bp, Mus musculus
tcagcatcccgctggctgttcagaa

SEQ ID NO: 20785 - DNA, 25 bp, Mus musculus
gcatcccgctggctgttcagaaagg

SEQ ID NO: 20786 - DNA, 25 bp, Mus musculus
tcccgctggctgttcagaaaggctt

SEQ ID NO: 20787 - DNA, 25 bp, Mus musculus
aaggctttctcatataactcctgta

SEQ ID NO: 20788 - DNA, 25 bp, Mus musculus
gctttctcatataactcctgtactt

SEQ ID NO: 20789 - DNA, 25 bp, Mus musculus
ttctcatataactcctgtacttaaa

SEQ ID NO: 20790 - DNA, 25 bp, Mus musculus
tataactcctgtacttaaacaggca

SEQ ID NO: 20791 - DNA, 25 bp, Mus musculus
ctgcatctgtgccagagatttactg

SEQ ID NO: 20792 - DNA, 25 bp, Mus musculus
catctgtgccagagatttactgtta

SEQ ID NO: 20793 - DNA, 25 bp, Mus musculus
ataacagcctaggggcagctcctcc

SEQ ID NO: 20794 - DNA, 25 bp, Mus musculus
acagcctaggggcagctcctccagg

SEQ ID NO: 20795 - DNA, 25 bp, Mus musculus
atgaatgtccattggctcctctatg

SEQ ID NO: 20796 - DNA, 25 bp, Mus musculus
aatgtccattggctcctctatgatg

SEQ ID NO: 20797 - DNA, 25 bp, Mus musculus
cattggctcctctatgatggccgct

SEQ ID NO: 20798 - DNA, 25 bp, Mus musculus
tggctcctctatgatggccgctcag

SEQ ID NO: 20799 - DNA, 25 bp, Mus musculus
ttccttcaaggagatgctctgctgg

SEQ ID NO: 20800 - DNA, 25 bp, Mus musculus
ctgctggtgtaccgtgtcttcagaa

SEQ ID NO: 20801 - DNA, 25 bp, Mus musculus
tttgttctgtactttgtgcagtggc

SEQ ID NO: 20802 - DNA, 25 bp, Mus musculus
agcttcttcctgttccctggagctt

SEQ ID NO: 20803 - DNA, 25 bp, Mus musculus
ggagcttcattctctctgcggagcc

SEQ ID NO: 20804 - DNA, 25 bp, Mus musculus
tcattctctctgcggagccgctacc

SEQ ID NO: 20805 - DNA, 25 bp, Mus musculus
tctgctgggcacagcctactgggcc

SEQ ID NO: 20806 - DNA, 25 bp, Mus musculus
gtcgtggccaacgtgctaggcttgc

SEQ ID NO: 20807 - DNA, 25 bp, Mus musculus
gccaacgtgctaggcttgctgctgg

SEQ ID NO: 20808 - DNA, 25 bp, Mus musculus
tacatcttggctcaggctgcactgg

SEQ ID NO: 20809 - DNA, 25 bp, Mus musculus
ggttcccaggctgaagagcaagccc

SEQ ID NO: 20810 - DNA, 25 bp, Mus musculus
atggacttcaagacactcacggagg

SEQ ID NO: 20811 - DNA, 25 bp, Mus musculus
gtgtaccgtgtcttcagaagagaag

SEQ ID NO: 20812 - DNA, 25 bp, Mus musculus
agagaagccaaacgcacgaccaaga

SEQ ID NO: 20813 - DNA, 25 bp, Mus musculus
gccaaacgcacgaccaagatcttgc

SEQ ID NO: 20814 - DNA, 25 bp, Mus musculus
cgcacgaccaagatcttgcatgggc

SEQ ID NO: 20815 - DNA, 25 bp, Mus musculus
accaagatcttgcatgggctgctgc

SEQ ID NO: 20816 - DNA, 25 bp, Mus musculus
ttcgccttcatcatcgccctggtgg

SEQ ID NO: 20817 - DNA, 25 bp, Mus musculus
gactaccacaagaagaagggctatg

SEQ ID NO: 20818 - DNA, 25 bp, Mus musculus
ggctatgcagacctgtacagcttgc

SEQ ID NO: 20819 - DNA, 25 bp, Mus musculus
ttctggatctgctccaattgctctc

SEQ ID NO: 20820 - DNA, 25 bp, Mus musculus
atctgctccaattgctctctcttat

SEQ ID NO: 20821 - DNA, 25 bp, Mus musculus
agttgtttcttcttctgcactaata

SEQ ID NO: 20822 - DNA, 25 bp, Mus musculus
ttcttctgcactaataattccaaca

SEQ ID NO: 20823 - DNA, 25 bp, Mus musculus
ttctgcactaataattccaacatga

SEQ ID NO: 20824 - DNA, 25 bp, Mus musculus
acattggccaaatcaaggttatctt

SEQ ID NO: 20825 - DNA, 25 bp, Mus musculus
ttatcttgatcagttcctagtagat

SEQ ID NO: 20826 - DNA, 25 bp, Mus musculus
tcagttcctagtagatcttgaaata

SEQ ID NO: 20827 - DNA, 25 bp, Mus musculus
aatatttgccacctatgcccattgg

SEQ ID NO: 20828 - DNA, 25 bp, Mus musculus
tgccacctatgcccattggtgctac

SEQ ID NO: 20829 - DNA, 25 bp, Mus musculus
ctactcactgagtggtccaatttga

SEQ ID NO: 20830 - DNA, 25 bp, Mus musculus
ctcactgagtggtccaatttgaacc

SEQ ID NO: 20831 - DNA, 25 bp, Mus musculus
tccaattgctctctcttatttctcc

SEQ ID NO: 20832 - DNA, 25 bp, Mus musculus
tgctctctcttatttctccttgcaa

SEQ ID NO: 20833 - DNA, 25 bp, Mus musculus
tctctcttatttctccttgcaacct

SEQ ID NO: 20834 - DNA, 25 bp, Mus musculus
tttctccttgcaaccttgaggaatt

SEQ ID NO: 20835 - DNA, 25 bp, Mus musculus
ctccttgcaaccttgaggaattcca

SEQ ID NO: 20836 - DNA, 25 bp, Mus musculus
aggatctgtagctgagctgcatgtg

SEQ ID NO: 20837 - DNA, 25 bp, Mus musculus
gcttccagttgtttcttcttctgca

SEQ ID NO: 20838 - DNA, 25 bp, Mus musculus
tccagttgtttcttcttctgcacta

SEQ ID NO: 20839 - DNA, 25 bp, Mus musculus
gccaagctggcagcaggagacgata

SEQ ID NO: 20840 - DNA, 25 bp, Mus musculus
caagctggcagcaggagacgatatg

SEQ ID NO: 20841 - DNA, 25 bp, Mus musculus
tgacaggactgagctgtcgaatgag

SEQ ID NO: 20842 - DNA, 25 bp, Mus musculus
acgttgtaggagcccgtagtcatcg

SEQ ID NO: 20843 - DNA, 25 bp, Mus musculus
cccgtagtcatcgtgaggtcgtctc

SEQ ID NO: 20844 - DNA, 25 bp, Mus musculus
ccgtagtcatcgtgaggtcgtctca

SEQ ID NO: 20845 - DNA, 25 bp, Mus musculus
cgtagtcatcgtgaggtcgtctcaa

SEQ ID NO: 20846 - DNA, 25 bp, Mus musculus
gtagtcatcgtgaggtcgtctcaag

SEQ ID NO: 20847 - DNA, 25 bp, Mus musculus
agtcatcgtgaggtcgtctcaagta

SEQ ID NO: 20848 - DNA, 25 bp, Mus musculus
gtcatcgtgaggtcgtctcaagtat

SEQ ID NO: 20849 - DNA, 25 bp, Mus musculus
tcatcgtgaggtcgtctcaagtatt

SEQ ID NO: 20850 - DNA, 25 bp, Mus musculus
catcgtgaggtcgtctcaagtattg

SEQ ID NO: 20851 - DNA, 25 bp, Mus musculus
atatgatgcatggcagcctgcatga

SEQ ID NO: 20852 - DNA, 25 bp, Mus musculus
atgatgcatggcagcctgcatgaag

SEQ ID NO: 20853 - DNA, 25 bp, Mus musculus
tgatgcatggcagcctgcatgaagt

SEQ ID NO: 20854 - DNA, 25 bp, Mus musculus
tgaagtctgtcactgacaggactga

SEQ ID NO: 20855 - DNA, 25 bp, Mus musculus
gaagtctgtcactgacaggactgag

SEQ ID NO: 20856 - DNA, 25 bp, Mus musculus
aagtctgtcactgacaggactgagc

SEQ ID NO: 20857 - DNA, 25 bp, Mus musculus
agtctgtcactgacaggactgagct

SEQ ID NO: 20858 - DNA, 25 bp, Mus musculus
ctgacaggactgagctgtcgaatga

SEQ ID NO: 20859 - DNA, 25 bp, Mus musculus
cccaacacatgatgagcacctcatg

SEQ ID NO: 20860 - DNA, 25 bp, Mus musculus
tgagcacctcatgcatggtacacac

SEQ ID NO: 20861 - DNA, 25 bp, Mus musculus
actaaaaagatcccagcagcttctg

SEQ ID NO: 20862 - DNA, 25 bp, Mus musculus
aagatcccagcagcttctgtttact

SEQ ID NO: 20863 - DNA, 25 bp, Mus musculus
catcaccggcatatcattgtactcg

SEQ ID NO: 20864 - DNA, 25 bp, Mus musculus
cggcatatcattgtactcggcaggg

SEQ ID NO: 20865 - DNA, 25 bp, Mus musculus
ggcaccatgtggtcatttgcccact

SEQ ID NO: 20866 - DNA, 25 bp, Mus musculus
atgtggtcatttgcccactctggat

SEQ ID NO: 20867 - DNA, 25 bp, Mus musculus
tcatttgcccactctggatagccct

SEQ ID NO: 20868 - DNA, 25 bp, Mus musculus
gcccactctggatagccctacaggg

SEQ ID NO: 20869 - DNA, 25 bp, Mus musculus
tagccctacagggtagatcttagtg

SEQ ID NO: 20870 - DNA, 25 bp, Mus musculus
cttagtggctctagtaggccagtag

SEQ ID NO: 20871 - DNA, 25 bp, Mus musculus
cgacctggccaagatcctggaggag

SEQ ID NO: 20872 - DNA, 25 bp, Mus musculus
ttagtggctctagtaggccagtaga

SEQ ID NO: 20873 - DNA, 25 bp, Mus musculus
ttcggtttttaccatcatctgcacc

SEQ ID NO: 20874 - DNA, 25 bp, Mus musculus
ttttaccatcatctgcaccatcggc

SEQ ID NO: 20875 - DNA, 25 bp, Mus musculus
catcctcatgtcagccccaaacttt

SEQ ID NO: 20876 - DNA, 25 bp, Mus musculus
catgtcagccccaaactttgtggag

SEQ ID NO: 20877 - DNA, 25 bp, Mus musculus
ggggtcctaactctacattgtgata

SEQ ID NO: 20878 - DNA, 25 bp, Mus musculus
tctgaggtatccctgtagctgtcgg

SEQ ID NO: 20879 - DNA, 25 bp, Mus musculus
gtatccctgtagctgtcggtcttga

SEQ ID NO: 20880 - DNA, 25 bp, Mus musculus
gtcatcagtgctgcatgacagcaag

SEQ ID NO: 20881 - DNA, 25 bp, Mus musculus
agtgctgcatgacagcaaggagttt

SEQ ID NO: 20882 - DNA, 25 bp, Mus musculus
gctgtgatgccttctacaattgtct

SEQ ID NO: 20883 - DNA, 25 bp, Mus musculus
atgccttctacaattgtctcaggtc

SEQ ID NO: 20884 - DNA, 25 bp, Mus musculus
tctacaattgtctcaggtctttatc

SEQ ID NO: 20885 - DNA, 25 bp, Mus musculus
attgtctcaggtctttatccacatc

SEQ ID NO: 20886 - DNA, 25 bp, Mus musculus
tggtatctttcatcctggcttacag

SEQ ID NO: 20887 - DNA, 25 bp, Mus musculus
ctttcatcctggcttacagaaccct

SEQ ID NO: 20888 - DNA, 25 bp, Mus musculus
tcctggcttacagaaccctcttctc

SEQ ID NO: 20889 - DNA, 25 bp, Mus musculus
cttacagaaccctcttctctcaaga

SEQ ID NO: 20890 - DNA, 25 bp, Mus musculus
caaacacatacagtttctggagtta

SEQ ID NO: 20891 - DNA, 25 bp, Mus musculus
atgtgtatccattcttgagtaaaaa

SEQ ID NO: 20892 - DNA, 25 bp, Mus musculus
gatgtttgaccctgggcactttcta

SEQ ID NO: 20893 - DNA, 25 bp, Mus musculus
tgaccctgggcactttctaaatgcg

SEQ ID NO: 20894 - DNA, 25 bp, Mus musculus
aagtgactacttcatgcctttttca

SEQ ID NO: 20895 - DNA, 25 bp, Mus musculus
ctacttcatgcctttttcaacagga

SEQ ID NO: 20896 - DNA, 25 bp, Mus musculus
ccgcatggagctgtttctaatcctg

SEQ ID NO: 20897 - DNA, 25 bp, Mus musculus
cttcaaactgaaatctctggtccac

SEQ ID NO: 20898 - DNA, 25 bp, Mus musculus
ctgcttcattcctctctaaagagat

SEQ ID NO: 20899 - DNA, 25 bp, Mus musculus
gcccctgctgtgatgccttctacaa

SEQ ID NO: 20900 - DNA, 25 bp, Mus musculus
gaagctgaaacctcatgaggagcct

SEQ ID NO: 20901 - DNA, 25 bp, Mus musculus
acctcatgaggagcctctccgttct

SEQ ID NO: 20902 - DNA, 25 bp, Mus musculus
gctccaagctctgttttatctgctg

SEQ ID NO: 20903 - DNA, 25 bp, Mus musculus
tctgttttatctgctggacagagct

SEQ ID NO: 20904 - DNA, 25 bp, Mus musculus
tctgctggacagagctgtggacagc

SEQ ID NO: 20905 - DNA, 25 bp, Mus musculus
gttcatctatgacatgtgcgggtct

SEQ ID NO: 20906 - DNA, 25 bp, Mus musculus
catctatgacatgtgcgggtctaat

SEQ ID NO: 20907 - DNA, 25 bp, Mus musculus
tgacatgtgcgggtctaattatgcc

SEQ ID NO: 20908 - DNA, 25 bp, Mus musculus
gtctaattatgccaactttgagcta

SEQ ID NO: 20909 - DNA, 25 bp, Mus musculus
taattatgccaactttgagctagat

SEQ ID NO: 20910 - DNA, 25 bp, Mus musculus
ttatgccaactttgagctagatctt

SEQ ID NO: 20911 - DNA, 25 bp, Mus musculus
caactttgagctagatcttggcaag

SEQ ID NO: 20912 - DNA, 25 bp, Mus musculus
gcctctccgttctgagatcctcagt

SEQ ID NO: 20913 - DNA, 25 bp, Mus musculus
gaaagtcctaaacctgctgaagatt

SEQ ID NO: 20914 - DNA, 25 bp, Mus musculus
ccgttctgagatcctcagtgggaag

SEQ ID NO: 20915 - DNA, 25 bp, Mus musculus
tcgagacccaactggagcctccatt

SEQ ID NO: 20916 - DNA, 25 bp, Mus musculus
agacccaactggagcctccattgcc

SEQ ID NO: 20917 - DNA, 25 bp, Mus musculus
tgcccagcacgtggtgctccaagct

SEQ ID NO: 20918 - DNA, 25 bp, Mus musculus
ccagcacgtggtgctccaagctctg

SEQ ID NO: 20919 - DNA, 25 bp, Mus musculus
cgtggtgctccaagctctgttttat

SEQ ID NO: 20920 - DNA, 25 bp, Mus musculus
ggtgctccaagctctgttttatctg

SEQ ID NO: 20921 - DNA, 25 bp, Mus musculus
caactgtaccagtaactgacaagat

SEQ ID NO: 20922 - DNA, 25 bp, Mus musculus
taactgacaagatccacaaagccta

SEQ ID NO: 20923 - DNA, 25 bp, Mus musculus
aggctgtcctcagggacttctatga

SEQ ID NO: 20924 - DNA, 25 bp, Mus musculus
tcctcagggacttctatgagtccat

SEQ ID NO: 20925 - DNA, 25 bp, Mus musculus
gggacttctatgagtccatgtttcc

SEQ ID NO: 20926 - DNA, 25 bp, Mus musculus
gctttctgacatgcatgagctccaa

SEQ ID NO: 20927 - DNA, 25 bp, Mus musculus
tgacatgcatgagctccaagatgct

SEQ ID NO: 20928 - DNA, 25 bp, Mus musculus
gcatgagctccaagatgctgttagc

SEQ ID NO: 20929 - DNA, 25 bp, Mus musculus
aatatctaagtcagctgcagccctg

SEQ ID NO: 20930 - DNA, 25 bp, Mus musculus
ggaagctctcagacgcgcgggacgt

SEQ ID NO: 20931 - DNA, 25 bp, Mus musculus
ctgaaagactgcactctgtcaagag

SEQ ID NO: 20932 - DNA, 25 bp, Mus musculus
gactgcactctgtcaagagagacga

SEQ ID NO: 20933 - DNA, 25 bp, Mus musculus
acaagatccacaaagcctataagac

SEQ ID NO: 20934 - DNA, 25 bp, Mus musculus
tccacaaagcctataagacaagaac

SEQ ID NO: 20935 - DNA, 25 bp, Mus musculus
atacaaaccaagtgtttctcatgtg

SEQ ID NO: 20936 - DNA, 25 bp, Mus musculus
accaagtgtttctcatgtggttggc

SEQ ID NO: 20937 - DNA, 25 bp, Mus musculus
tgtttctcatgtggttggccagttg

SEQ ID NO: 20938 - DNA, 25 bp, Mus musculus
tcatgtggttggccagttggatgac

SEQ ID NO: 20939 - DNA, 25 bp, Mus musculus
aattgaccacaaccataaagatgcc

SEQ ID NO: 20940 - DNA, 25 bp, Mus musculus
ccataaagatgccccggacagtgaa

SEQ ID NO: 20941 - DNA, 25 bp, Mus musculus
ggttccaagagggctccgcacttct

SEQ ID NO: 20942 - DNA, 25 bp, Mus musculus
gacctggagcgccacagcatctcac

SEQ ID NO: 20943 - DNA, 25 bp, Mus musculus
ttgcggcgccattgtaacatccatg

SEQ ID NO: 20944 - DNA, 25 bp, Mus musculus
cggcgccattgtaacatccatgctg

SEQ ID NO: 20945 - DNA, 25 bp, Mus musculus
cgccattgtaacatccatgctggcc

SEQ ID NO: 20946 - DNA, 25 bp, Mus musculus
cattgtaacatccatgctggcctta

SEQ ID NO: 20947 - DNA, 25 bp, Mus musculus
tgtaacatccatgctggccttaggc

SEQ ID NO: 20948 - DNA, 25 bp, Mus musculus
atccatgctggccttaggcctgtcc

SEQ ID NO: 20949 - DNA, 25 bp, Mus musculus
catgctggccttaggcctgtccgtt

SEQ ID NO: 20950 - DNA, 25 bp, Mus musculus
aggcctgtccgttgtgtgctctgcc

SEQ ID NO: 20951 - DNA, 25 bp, Mus musculus
cctgtccgttgtgtgctctgccctc

SEQ ID NO: 20952 - DNA, 25 bp, Mus musculus
caccgcatccactctggtgagcgac

SEQ ID NO: 20953 - DNA, 25 bp, Mus musculus
cgccacagcatctcacactcagaat

SEQ ID NO: 20954 - DNA, 25 bp, Mus musculus
cacagcatctcacactcagaattga

SEQ ID NO: 20955 - DNA, 25 bp, Mus musculus
agcatctcacactcagaattgaagc

SEQ ID NO: 20956 - DNA, 25 bp, Mus musculus
gaattgaagccacacgtgtgcaaag

SEQ ID NO: 20957 - DNA, 25 bp, Mus musculus
aagccacacgtgtgcaaagattgcg

SEQ ID NO: 20958 - DNA, 25 bp, Mus musculus
ttcaaacggtccagccacttgcggc

SEQ ID NO: 20959 - DNA, 25 bp, Mus musculus
tccagccacttgcggcgccattgta

SEQ ID NO: 20960 - DNA, 25 bp, Mus musculus
cacttgcggcgccattgtaacatcc

SEQ ID NO: 20961 - DNA, 25 bp, Mus musculus
ggctacgcccagtcgtgcaggtata

SEQ ID NO: 20962 - DNA, 25 bp, Mus musculus
tacgcccagtcgtgcaggtataaac

SEQ ID NO: 20963 - DNA, 25 bp, Mus musculus
tctcctgagttctttctgtgagtcc

SEQ ID NO: 20964 - DNA, 25 bp, Mus musculus
cctgagttctttctgtgagtcctgg

SEQ ID NO: 20965 - DNA, 25 bp, Mus musculus
ttctttctgtgagtcctggcgggtc

SEQ ID NO: 20966 - DNA, 25 bp, Mus musculus
cggccttgacctgtttgacttgagc

SEQ ID NO: 20967 - DNA, 25 bp, Mus musculus
ccttgacctgtttgacttgagctag

SEQ ID NO: 20968 - DNA, 25 bp, Mus musculus
tgacctgtttgacttgagctagagg

SEQ ID NO: 20969 - DNA, 25 bp, Mus musculus
cctgtttgacttgagctagagggag

SEQ ID NO: 20970 - DNA, 25 bp, Mus musculus
gcagcctcttagacttgggcagagt

SEQ ID NO: 20971 - DNA, 25 bp, Mus musculus
gcctcttagacttgggcagagttag

SEQ ID NO: 20972 - DNA, 25 bp, Mus musculus
caagctggaaggccgcgaggcttat

SEQ ID NO: 20973 - DNA, 25 bp, Mus musculus
aaacgcgtccagcagaaacatcacc

SEQ ID NO: 20974 - DNA, 25 bp, Mus musculus
cgcgtccagcagaaacatcacctgg

SEQ ID NO: 20975 - DNA, 25 bp, Mus musculus
aagacgcagctcattcagcaggtgg

SEQ ID NO: 20976 - DNA, 25 bp, Mus musculus
acgcagctcattcagcaggtggagc

SEQ ID NO: 20977 - DNA, 25 bp, Mus musculus
ctcattcagcaggtggagcagctta

SEQ ID NO: 20978 - DNA, 25 bp, Mus musculus
attcagcaggtggagcagcttaagc

SEQ ID NO: 20979 - DNA, 25 bp, Mus musculus
agagacgcctacaaggtcaagtgcg

SEQ ID NO: 20980 - DNA, 25 bp, Mus musculus
gagaaactcgccaactccggcttca

SEQ ID NO: 20981 - DNA, 25 bp, Mus musculus
attgaatcctatctcatcctctagt

SEQ ID NO: 20982 - DNA, 25 bp, Mus musculus
gaatcctatctcatcctctagttta

SEQ ID NO: 20983 - DNA, 25 bp, Mus musculus
acatcttcagcagccatggtcaaag

SEQ ID NO: 20984 - DNA, 25 bp, Mus musculus
tcagcagccatggtcaaagctggag

SEQ ID NO: 20985 - DNA, 25 bp, Mus musculus
gcagtctctggcaccattctagctg

SEQ ID NO: 20986 - DNA, 25 bp, Mus musculus
gtctctggcaccattctagctggtt

SEQ ID NO: 20987 - DNA, 25 bp, Mus musculus
gggctcatcctgttaacacagagtg

SEQ ID NO: 20988 - DNA, 25 bp, Mus musculus
ttaacacagagtgccctgggctctg

SEQ ID NO: 20989 - DNA, 25 bp, Mus musculus
acacagagtgccctgggctctgcaa

SEQ ID NO: 20990 - DNA, 25 bp, Mus musculus
tctgcaacatctgcacttggagcac

SEQ ID NO: 20991 - DNA, 25 bp, Mus musculus
gcaacatctgcacttggagcactga

SEQ ID NO: 20992 - DNA, 25 bp, Mus musculus
acatctgcacttggagcactgaagg

SEQ ID NO: 20993 - DNA, 25 bp, Mus musculus
ctcatcctctagtttatttacatca

SEQ ID NO: 20994 - DNA, 25 bp, Mus musculus
atcctctagtttatttacatcattg

SEQ ID NO: 20995 - DNA, 25 bp, Mus musculus
taactggtcctcatggcgttttcgg

SEQ ID NO: 20996 - DNA, 25 bp, Mus musculus
ctggtcctcatggcgttttcgggca

SEQ ID NO: 20997 - DNA, 25 bp, Mus musculus
acactggtggcttccattgtctcca

SEQ ID NO: 20998 - DNA, 25 bp, Mus musculus
ctggtggcttccattgtctccaaga

SEQ ID NO: 20999 - DNA, 25 bp, Mus musculus
gtggcttccattgtctccaagatga

SEQ ID NO: 21000 - DNA, 25 bp, Mus musculus
atgacatcttcagcagccatggtca

SEQ ID NO: 21001 - DNA, 25 bp, Mus musculus
ggcaacaatggcctttaataggcac

SEQ ID NO: 21002 - DNA, 25 bp, Mus musculus
tccccatatacaggcaaatcaacgg

SEQ ID NO: 21003 - DNA, 25 bp, Mus musculus
ccgcagcacaattcctgccaacaaa

SEQ ID NO: 21004 - DNA, 25 bp, Mus musculus
cgcagcacaattcctgccaacaaac

SEQ ID NO: 21005 - DNA, 25 bp, Mus musculus
gcagcacaattcctgccaacaaaca

SEQ ID NO: 21006 - DNA, 25 bp, Mus musculus
cagcacaattcctgccaacaaacaa

SEQ ID NO: 21007 - DNA, 25 bp, Mus musculus
agcacaattcctgccaacaaacaat

SEQ ID NO: 21008 - DNA, 25 bp, Mus musculus
gcacaattcctgccaacaaacaata

SEQ ID NO: 21009 - DNA, 25 bp, Mus musculus
cacaattcctgccaacaaacaataa

SEQ ID NO: 21010 - DNA, 25 bp, Mus musculus
ccccatatacaggcaaatcaacggg

SEQ ID NO: 21011 - DNA, 25 bp, Mus musculus
ctcaggcccagaaccgcagcacaat

SEQ ID NO: 21012 - DNA, 25 bp, Mus musculus
tcaggcccagaaccgcagcacaatt

SEQ ID NO: 21013 - DNA, 25 bp, Mus musculus
cagaaccgcagcacaattcctgcca

SEQ ID NO: 21014 - DNA, 25 bp, Mus musculus
agaaccgcagcacaattcctgccaa

SEQ ID NO: 21015 - DNA, 25 bp, Mus musculus
gaaccgcagcacaattcctgccaac

SEQ ID NO: 21016 - DNA, 25 bp, Mus musculus
aaccgcagcacaattcctgccaaca

SEQ ID NO: 21017 - DNA, 25 bp, Mus musculus
accgcagcacaattcctgccaacaa

SEQ ID NO: 21018 - DNA, 25 bp, Mus musculus
aatcaagagcagcgcggccaggagc

SEQ ID NO: 21019 - DNA, 25 bp, Mus musculus
ccaggacgtcctgcacccgggactg

SEQ ID NO: 21020 - DNA, 25 bp, Mus musculus
cctttcgttcatgtagcaggaaccg

SEQ ID NO: 21021 - DNA, 25 bp, Mus musculus
tgcgtagagcagcccacggttttgt

SEQ ID NO: 21022 - DNA, 25 bp, Mus musculus
gtagagcagcccacggttttgtgga

SEQ ID NO: 21023 - DNA, 25 bp, Mus musculus
gagcagcccacggttttgtggaaat

SEQ ID NO: 21024 - DNA, 25 bp, Mus musculus
tgagaacactctgtaccatgtgcaa

SEQ ID NO: 21025 - DNA, 25 bp, Mus musculus
tctgtaccatgtgcaaggagtacgc

SEQ ID NO: 21026 - DNA, 25 bp, Mus musculus
atgtttaatctctactcgctctcag

SEQ ID NO: 21027 - DNA, 25 bp, Mus musculus
tttaatctctactcgctctcagtgc

SEQ ID NO: 21028 - DNA, 25 bp, Mus musculus
aatctctactcgctctcagtgcaaa

SEQ ID NO: 21029 - DNA, 25 bp, Mus musculus
ctctactcgctctcagtgcaaaaca

SEQ ID NO: 21030 - DNA, 25 bp, Mus musculus
gcggccaatgcgaacgacttcttcg

SEQ ID NO: 21031 - DNA, 25 bp, Mus musculus
gccaatgcgaacgacttcttcgcca

SEQ ID NO: 21032 - DNA, 25 bp, Mus musculus
gcgaacgacttcttcgccaagcgca

SEQ ID NO: 21033 - DNA, 25 bp, Mus musculus
ttcttcgccaagcgcaagagaactg

SEQ ID NO: 21034 - DNA, 25 bp, Mus musculus
ccgcgcaaacgtctgagatgagtta

SEQ ID NO: 21035 - DNA, 25 bp, Mus musculus
catctgggcagcggacgatggaaga

SEQ ID NO: 21036 - DNA, 25 bp, Mus musculus
cttcggctgggacctttcgttcatg

SEQ ID NO: 21037 - DNA, 25 bp, Mus musculus
ctgggacctttcgttcatgtagcag

SEQ ID NO: 21038 - DNA, 25 bp, Mus musculus
taaggcgcacagcttcctgcaggct

SEQ ID NO: 21039 - DNA, 25 bp, Mus musculus
aaggcgcacagcttcctgcaggctg

SEQ ID NO: 21040 - DNA, 25 bp, Mus musculus
gctgccccgaaaggtcgggaagctg

SEQ ID NO: 21041 - DNA, 25 bp, Mus musculus
aagctgagctacgcagactttgtat

SEQ ID NO: 21042 - DNA, 25 bp, Mus musculus
gctgagctacgcagactttgtatgg

SEQ ID NO: 21043 - DNA, 25 bp, Mus musculus
ctgagctacgcagactttgtatggt

SEQ ID NO: 21044 - DNA, 25 bp, Mus musculus
gagctacgcagactttgtatggttc

SEQ ID NO: 21045 - DNA, 25 bp, Mus musculus
agctacgcagactttgtatggttcc

SEQ ID NO: 21046 - DNA, 25 bp, Mus musculus
ctacgcagactttgtatggttcctg

SEQ ID NO: 21047 - DNA, 25 bp, Mus musculus
tacgcagactttgtatggttcctgc

SEQ ID NO: 21048 - DNA, 25 bp, Mus musculus
cagactttgtatggttcctgctctc

SEQ ID NO: 21049 - DNA, 25 bp, Mus musculus
agactttgtatggttcctgctctcc

SEQ ID NO: 21050 - DNA, 25 bp, Mus musculus
ggcgcacagcttcctgcaggctgtg

SEQ ID NO: 21051 - DNA, 25 bp, Mus musculus
gacgtcgttcttctcttatgagcat

SEQ ID NO: 21052 - DNA, 25 bp, Mus musculus
acgtcgttcttctcttatgagcatt

SEQ ID NO: 21053 - DNA, 25 bp, Mus musculus
gtcgttcttctcttatgagcatttc

SEQ ID NO: 21054 - DNA, 25 bp, Mus musculus
cttctcttatgagcatttctatgtc

SEQ ID NO: 21055 - DNA, 25 bp, Mus musculus
ttctcttatgagcatttctatgtca

SEQ ID NO: 21056 - DNA, 25 bp, Mus musculus
ctcttatgagcatttctatgtcatc

SEQ ID NO: 21057 - DNA, 25 bp, Mus musculus
gcatttctatgtcatctactgcaag

SEQ ID NO: 21058 - DNA, 25 bp, Mus musculus
gatctctcaagtccaggataacagg

SEQ ID NO: 21059 - DNA, 25 bp, Mus musculus
ctctcaagtccaggataacaggttc

SEQ ID NO: 21060 - DNA, 25 bp, Mus musculus
aagcccgatgatctgtgatgtcctt

SEQ ID NO: 21061 - DNA, 25 bp, Mus musculus
tgatgtccttcgcaatgtaggaaat

SEQ ID NO: 21062 - DNA, 25 bp, Mus musculus
tgtccttcgcaatgtaggaaatttc

SEQ ID NO: 21063 - DNA, 25 bp, Mus musculus
tttcatgaacagcatggtgatgctg

SEQ ID NO: 21064 - DNA, 25 bp, Mus musculus
ccgtcttctcatcaaagattttgat

SEQ ID NO: 21065 - DNA, 25 bp, Mus musculus
tcttctcatcaaagattttgattcc

SEQ ID NO: 21066 - DNA, 25 bp, Mus musculus
agattttgattcctccaaaggagat

SEQ ID NO: 21067 - DNA, 25 bp, Mus musculus
ttttgattcctccaaaggagatggt

SEQ ID NO: 21068 - DNA, 25 bp, Mus musculus
tgattcctccaaaggagatggttaa

SEQ ID NO: 21069 - DNA, 25 bp, Mus musculus
tgtgttctcccttggaacgtgcgcc

SEQ ID NO: 21070 - DNA, 25 bp, Mus musculus
cagccgcctgggctgttttgatggc

SEQ ID NO: 21071 - DNA, 25 bp, Mus musculus
aacacccttgagcttcatcatggaa

SEQ ID NO: 21072 - DNA, 25 bp, Mus musculus
ccgcctgggctgttttgatggccac

SEQ ID NO: 21073 - DNA, 25 bp, Mus musculus
ttttgatggccacaaatctgtgatt

SEQ ID NO: 21074 - DNA, 25 bp, Mus musculus
tgatggccacaaatctgtgattccc

SEQ ID NO: 21075 - DNA, 25 bp, Mus musculus
atctgtgattcccttccttcccgca

SEQ ID NO: 21076 - DNA, 25 bp, Mus musculus
cgcaaacgtatccgaaagcccgatg

SEQ ID NO: 21077 - DNA, 25 bp, Mus musculus
atccgaaagcccgatgatctgtgat

SEQ ID NO: 21078 - DNA, 25 bp, Mus musculus
cgaaagcccgatgatctgtgatgtc

SEQ ID NO: 21079 - DNA, 25 bp, Mus musculus
gaaccccactgaggcggagctgcag

SEQ ID NO: 21080 - DNA, 25 bp, Mus musculus
ccactgaggcggagctgcaggacat

SEQ ID NO: 21081 - DNA, 25 bp, Mus musculus
gtacccggttctagcaaacagcaat

SEQ ID NO: 21082 - DNA, 25 bp, Mus musculus
acccggttctagcaaacagcaattg

SEQ ID NO: 21083 - DNA, 25 bp, Mus musculus
cccggttctagcaaacagcaattga

SEQ ID NO: 21084 - DNA, 25 bp, Mus musculus
ttctagcaaacagcaattgattgac

SEQ ID NO: 21085 - DNA, 25 bp, Mus musculus
atctgataaagcaccaaaagatttg

SEQ ID NO: 21086 - DNA, 25 bp, Mus musculus
gatttgtcccaagctgcatgactgc

SEQ ID NO: 21087 - DNA, 25 bp, Mus musculus
tttgtcccaagctgcatgactgctc

SEQ ID NO: 21088 - DNA, 25 bp, Mus musculus
gtcccaagctgcatgactgctcccg

SEQ ID NO: 21089 - DNA, 25 bp, Mus musculus
tcccaagctgcatgactgctcccgg

SEQ ID NO: 21090 - DNA, 25 bp, Mus musculus
ccaagctgcatgactgctcccggaa

SEQ ID NO: 21091 - DNA, 25 bp, Mus musculus
cactgaggcggagctgcaggacatg

SEQ ID NO: 21092 - DNA, 25 bp, Mus musculus
aagctgcatgactgctcccggaatt

SEQ ID NO: 21093 - DNA, 25 bp, Mus musculus
tgaccatgatggccagaaagatgaa

SEQ ID NO: 21094 - DNA, 25 bp, Mus musculus
agatgatccgagaggccgacattga

SEQ ID NO: 21095 - DNA, 25 bp, Mus musculus
agctgccatgcccgttctcctgatc

SEQ ID NO: 21096 - DNA, 25 bp, Mus musculus
gctgccatgcccgttctcctgatct

SEQ ID NO: 21097 - DNA, 25 bp, Mus musculus
tgccatgcccgttctcctgatctct

SEQ ID NO: 21098 - DNA, 25 bp, Mus musculus
gccatgcccgttctcctgatctctt

SEQ ID NO: 21099 - DNA, 25 bp, Mus musculus
tgcgtacccggttctagcaaacagc

SEQ ID NO: 21100 - DNA, 25 bp, Mus musculus
actttattcactcagaagggccaag

SEQ ID NO: 21101 - DNA, 25 bp, Mus musculus
ctttattcactcagaagggccaagg

SEQ ID NO: 21102 - DNA, 25 bp, Mus musculus
acaattcaggtgccagtcccaagtg

SEQ ID NO: 21103 - DNA, 25 bp, Mus musculus
aattcaggtgccagtcccaagtgcc

SEQ ID NO: 21104 - DNA, 25 bp, Mus musculus
attcaggtgccagtcccaagtgccc

SEQ ID NO: 21105 - DNA, 25 bp, Mus musculus
ttcaggtgccagtcccaagtgcccc

SEQ ID NO: 21106 - DNA, 25 bp, Mus musculus
aggtgccagtcccaagtgcccctcg

SEQ ID NO: 21107 - DNA, 25 bp, Mus musculus
ctgtggcactggcgggtagcttgaa

SEQ ID NO: 21108 - DNA, 25 bp, Mus musculus
tggcactggcgggtagcttgaagtc

SEQ ID NO: 21109 - DNA, 25 bp, Mus musculus
gcactggcgggtagcttgaagtctc

SEQ ID NO: 21110 - DNA, 25 bp, Mus musculus
ctcggccgcagcccgcgcagatgta

SEQ ID NO: 21111 - DNA, 25 bp, Mus musculus
cgcagcccgcgcagatgtagaggcg

SEQ ID NO: 21112 - DNA, 25 bp, Mus musculus
tttattcactcagaagggccaaggg

SEQ ID NO: 21113 - DNA, 25 bp, Mus musculus
cactcagaagggccaagggaatgta

SEQ ID NO: 21114 - DNA, 25 bp, Mus musculus
gaccccggtatggcattccctatct

SEQ ID NO: 21115 - DNA, 25 bp, Mus musculus
ggtatggcattccctatctcccagt

SEQ ID NO: 21116 - DNA, 25 bp, Mus musculus
gtatggcattccctatctcccagtc

SEQ ID NO: 21117 - DNA, 25 bp, Mus musculus
tatggcattccctatctcccagtcc

SEQ ID NO: 21118 - DNA, 25 bp, Mus musculus
ccaggtgcaggcatggaaggaacaa

SEQ ID NO: 21119 - DNA, 25 bp, Mus musculus
gaacaattcaggtgccagtcccaag

SEQ ID NO: 21120 - DNA, 25 bp, Mus musculus
ttaatacactgtttgggctggccag

SEQ ID NO: 21121 - DNA, 25 bp, Mus musculus
tggccagtttctcatgcatgcagct

SEQ ID NO: 21122 - DNA, 25 bp, Mus musculus
taggacagtcctcatcaagtgcccc

SEQ ID NO: 21123 - DNA, 25 bp, Mus musculus
catcaagtgccccagtcccatggtg

SEQ ID NO: 21124 - DNA, 25 bp, Mus musculus
cagtcccatggtgacagtgactccc

SEQ ID NO: 21125 - DNA, 25 bp, Mus musculus
gcgagcccgagtgtgatggttcatt

SEQ ID NO: 21126 - DNA, 25 bp, Mus musculus
acctagtgaaccatgactcggagcc

SEQ ID NO: 21127 - DNA, 25 bp, Mus musculus
tgaaccatgactcggagccagagag

SEQ ID NO: 21128 - DNA, 25 bp, Mus musculus
cttgagcacaccatcaacattgctg

SEQ ID NO: 21129 - DNA, 25 bp, Mus musculus
cacaccatcaacattgctgttcagg

SEQ ID NO: 21130 - DNA, 25 bp, Mus musculus
atcaacattgctgttcaggaaatga

SEQ ID NO: 21131 - DNA, 25 bp, Mus musculus
acgtccattccaagttgtaaatgct

SEQ ID NO: 21132 - DNA, 25 bp, Mus musculus
catgcatgcagcttgatgattgagc

SEQ ID NO: 21133 - DNA, 25 bp, Mus musculus
attgagcacagtcaggcattgtatt

SEQ ID NO: 21134 - DNA, 25 bp, Mus musculus
aattcaaaatctcagatggcttcta

SEQ ID NO: 21135 - DNA, 25 bp, Mus musculus
aaatctcagatggcttctagttcaa

SEQ ID NO: 21136 - DNA, 25 bp, Mus musculus
agttcaatctgttcagataaattgt

SEQ ID NO: 21137 - DNA, 25 bp, Mus musculus
aaattgtcagcagccagtttactgc

SEQ ID NO: 21138 - DNA, 25 bp, Mus musculus
aactctgagacacagccccagaagt

SEQ ID NO: 21139 - DNA, 25 bp, Mus musculus
gagacacagccccagaagtaggaca

SEQ ID NO: 21140 - DNA, 25 bp, Mus musculus
tgcctcgacattttacttgccttta

SEQ ID NO: 21141 - DNA, 25 bp, Mus musculus
cctttcaaaatcacttatgagccga

SEQ ID NO: 21142 - DNA, 25 bp, Mus musculus
aaaggtgctcactctggcaaaatcg

SEQ ID NO: 21143 - DNA, 25 bp, Mus musculus
aaggcatctattcagacccagattt

SEQ ID NO: 21144 - DNA, 25 bp, Mus musculus
tctttacatatgtccccaagcacta

SEQ ID NO: 21145 - DNA, 25 bp, Mus musculus
catatgtccccaagcactaaatgtt

SEQ ID NO: 21146 - DNA, 25 bp, Mus musculus
tccccaagcactaaatgttaactga

SEQ ID NO: 21147 - DNA, 25 bp, Mus musculus
taactgatcttaagctggagatcag

SEQ ID NO: 21148 - DNA, 25 bp, Mus musculus
aacatctgtgtgcccagacatctcc

SEQ ID NO: 21149 - DNA, 25 bp, Mus musculus
cccagacatctccatgacaagctca

SEQ ID NO: 21150 - DNA, 25 bp, Mus musculus
catctccatgacaagctcagcttta

SEQ ID NO: 21151 - DNA, 25 bp, Mus musculus
catgacaagctcagctttagggtca

SEQ ID NO: 21152 - DNA, 25 bp, Mus musculus
tcagcaaccatcatccagcgtgcat

SEQ ID NO: 21153 - DNA, 25 bp, Mus musculus
aagacagcagctcagcgttgctgcg

SEQ ID NO: 21154 - DNA, 25 bp, Mus musculus
accatcatccagcgtgcatataaaa

SEQ ID NO: 21155 - DNA, 25 bp, Mus musculus
atccagcgtgcatataaaagctacc

SEQ ID NO: 21156 - DNA, 25 bp, Mus musculus
gtatcagatactcctgctatagatg

SEQ ID NO: 21157 - DNA, 25 bp, Mus musculus
gatactcctgctatagatgaccgca

SEQ ID NO: 21158 - DNA, 25 bp, Mus musculus
cctgctatagatgaccgcagagatg

SEQ ID NO: 21159 - DNA, 25 bp, Mus musculus
gatcttacttctaaaggtgctcact

SEQ ID NO: 21160 - DNA, 25 bp, Mus musculus
acttctaaaggtgctcactctggca

SEQ ID NO: 21161 - DNA, 25 bp, Mus musculus
ccgcactccagattcactcatgcag

SEQ ID NO: 21162 - DNA, 25 bp, Mus musculus
cgcactccagattcactcatgcagt

SEQ ID NO: 21163 - DNA, 25 bp, Mus musculus
acgtttcactcgctcacgtttcaca

SEQ ID NO: 21164 - DNA, 25 bp, Mus musculus
ccatgtcgacacccgaaaccagaag

SEQ ID NO: 21165 - DNA, 25 bp, Mus musculus
tgtcgacacccgaaaccagaagctg

SEQ ID NO: 21166 - DNA, 25 bp, Mus musculus
acacccgaaaccagaagctgcacac

SEQ ID NO: 21167 - DNA, 25 bp, Mus musculus
cacccgaaaccagaagctgcacaca

SEQ ID NO: 21168 - DNA, 25 bp, Mus musculus
cccgaaaccagaagctgcacacacg

SEQ ID NO: 21169 - DNA, 25 bp, Mus musculus
ccgaaaccagaagctgcacacacgc

SEQ ID NO: 21170 - DNA, 25 bp, Mus musculus
agaagctgcacacacgcgactcgac

SEQ ID NO: 21171 - DNA, 25 bp, Mus musculus
gaagctgcacacacgcgactcgaca

SEQ ID NO: 21172 - DNA, 25 bp, Mus musculus
agctgcacacacgcgactcgacaca

SEQ ID NO: 21173 - DNA, 25 bp, Mus musculus
cactccagattcactcatgcagttt

SEQ ID NO: 21174 - DNA, 25 bp, Mus musculus
ccagattcactcatgcagtttgcaa

SEQ ID NO: 21175 - DNA, 25 bp, Mus musculus
agattcactcatgcagtttgcaaac

SEQ ID NO: 21176 - DNA, 25 bp, Mus musculus
ttcactcatgcagtttgcaaacaac

SEQ ID NO: 21177 - DNA, 25 bp, Mus musculus
tcactcatgcagtttgcaaacaacc

SEQ ID NO: 21178 - DNA, 25 bp, Mus musculus
actcatgcagtttgcaaacaaccgt

SEQ ID NO: 21179 - DNA, 25 bp, Mus musculus
tgcaaacaaccgtcaacgtcctgag

SEQ ID NO: 21180 - DNA, 25 bp, Mus musculus
gcaaacaaccgtcaacgtcctgagc

SEQ ID NO: 21181 - DNA, 25 bp, Mus musculus
gaccgagcacgaatgaccgtggacg

SEQ ID NO: 21182 - DNA, 25 bp, Mus musculus
gcgccgactgactgcagggacgcga

SEQ ID NO: 21183 - DNA, 25 bp, Mus musculus
tgcgcctcctagtggacttgagcaa

SEQ ID NO: 21184 - DNA, 25 bp, Mus musculus
gcctcctagtggacttgagcaaggg

SEQ ID NO: 21185 - DNA, 25 bp, Mus musculus
acttgagcaagggtgtcgcggacgc

SEQ ID NO: 21186 - DNA, 25 bp, Mus musculus
tcgcggacgccgcattctatccgca

SEQ ID NO: 21187 - DNA, 25 bp, Mus musculus
ccgcattctatccgcaccgtggcgg

SEQ ID NO: 21188 - DNA, 25 bp, Mus musculus
cgaggactctaagggccgcggactg

SEQ ID NO: 21189 - DNA, 25 bp, Mus musculus
gctgctcccggagttggaaagcggt

SEQ ID NO: 21190 - DNA, 25 bp, Mus musculus
gcccagatgccccaagacttgacac

SEQ ID NO: 21191 - DNA, 25 bp, Mus musculus
cagatgccccaagacttgacacggc

SEQ ID NO: 21192 - DNA, 25 bp, Mus musculus
gacttgacacggctctccacacttc

SEQ ID NO: 21193 - DNA, 25 bp, Mus musculus
actgactgcagggacgcgatgcgcc

SEQ ID NO: 21194 - DNA, 25 bp, Mus musculus
gactgcagggacgcgatgcgcccca

SEQ ID NO: 21195 - DNA, 25 bp, Mus musculus
atgcgccccagacggacaggacgcc

SEQ ID NO: 21196 - DNA, 25 bp, Mus musculus
cggacaggacgccgcgattttgcct

SEQ ID NO: 21197 - DNA, 25 bp, Mus musculus
ggacgccgcgattttgccttcaatt

SEQ ID NO: 21198 - DNA, 25 bp, Mus musculus
tttgccttcaattcctggtgaagtc

SEQ ID NO: 21199 - DNA, 25 bp, Mus musculus
gccttcaattcctggtgaagtccga

SEQ ID NO: 21200 - DNA, 25 bp, Mus musculus
ttcaattcctggtgaagtccgagcc

SEQ ID NO: 21201 - DNA, 25 bp, Mus musculus
acacagtcatgtgcacagaacaagg

SEQ ID NO: 21202 - DNA, 25 bp, Mus musculus
actggacccgattgccagaatgcct

SEQ ID NO: 21203 - DNA, 25 bp, Mus musculus
acaagctggacggcccagaagaagc

SEQ ID NO: 21204 - DNA, 25 bp, Mus musculus
gaacttggtccttcttgccgacctg

SEQ ID NO: 21205 - DNA, 25 bp, Mus musculus
cttggtccttcttgccgacctgtag

SEQ ID NO: 21206 - DNA, 25 bp, Mus musculus
ggtccttcttgccgacctgtagaga

SEQ ID NO: 21207 - DNA, 25 bp, Mus musculus
atgcatcagaactgacaccgtgctg

SEQ ID NO: 21208 - DNA, 25 bp, Mus musculus
tgacaccgtgctgaagtcgtttcca

SEQ ID NO: 21209 - DNA, 25 bp, Mus musculus
caccgtgctgaagtcgtttccagaa

SEQ ID NO: 21210 - DNA, 25 bp, Mus musculus
cgtgctgaagtcgtttccagaatca

SEQ ID NO: 21211 - DNA, 25 bp, Mus musculus
gtcgtttccagaatcaaaattgaat

SEQ ID NO: 21212 - DNA, 25 bp, Mus musculus
tgtcttaggaatccatctgaaatag

SEQ ID NO: 21213 - DNA, 25 bp, Mus musculus
ggacccgattgccagaatgcctgga

SEQ ID NO: 21214 - DNA, 25 bp, Mus musculus
cccgattgccagaatgcctggaagt

SEQ ID NO: 21215 - DNA, 25 bp, Mus musculus
tgccagaatgcctggaagtaaaatg

SEQ ID NO: 21216 - DNA, 25 bp, Mus musculus
atcctgcaaagccggtgcttctata

SEQ ID NO: 21217 - DNA, 25 bp, Mus musculus
ctgcaaagccggtgcttctatataa

SEQ ID NO: 21218 - DNA, 25 bp, Mus musculus
aagccacatttggttgccatgagac

SEQ ID NO: 21219 - DNA, 25 bp, Mus musculus
ccacatttggttgccatgagacata

SEQ ID NO: 21220 - DNA, 25 bp, Mus musculus
catacaagctggacggcccagaaga

SEQ ID NO: 21221 - DNA, 25 bp, Mus musculus
acccgcatgcacgcaatgggctggc

SEQ ID NO: 21222 - DNA, 25 bp, Mus musculus
atgcacgcaatgggctggctctcaa

SEQ ID NO: 21223 - DNA, 25 bp, Mus musculus
ttcgggatccctttgagtgtaacat

SEQ ID NO: 21224 - DNA, 25 bp, Mus musculus
gttatcacagccaggacaggtacga

SEQ ID NO: 21225 - DNA, 25 bp, Mus musculus
acagccaggacaggtacgagttctc

SEQ ID NO: 21226 - DNA, 25 bp, Mus musculus
ggtacgagttctcatcccatatcac

SEQ ID NO: 21227 - DNA, 25 bp, Mus musculus
gggagcatcgttaccacctgagcta

SEQ ID NO: 21228 - DNA, 25 bp, Mus musculus
agccaggccccactgaagcacaaag

SEQ ID NO: 21229 - DNA, 25 bp, Mus musculus
tggacccacagcggacaatgtggga

SEQ ID NO: 21230 - DNA, 25 bp, Mus musculus
tttgcaggcagcatttgttctttta

SEQ ID NO: 21231 - DNA, 25 bp, Mus musculus
tggcgtttgatttgcgttggaagat

SEQ ID NO: 21232 - DNA, 25 bp, Mus musculus
caggaacattcacaacatccatcct

SEQ ID NO: 21233 - DNA, 25 bp, Mus musculus
cctcagagaactcgcaggatgcctt

SEQ ID NO: 21234 - DNA, 25 bp, Mus musculus
agaactcgcaggatgccttccgtgt

SEQ ID NO: 21235 - DNA, 25 bp, Mus musculus
tccgtgtggtcagcacgagtggcga

SEQ ID NO: 21236 - DNA, 25 bp, Mus musculus
tggtcagcacgagtggcgagcagct

SEQ ID NO: 21237 - DNA, 25 bp, Mus musculus
tgctcttcctggatcacgtcatgta

SEQ ID NO: 21238 - DNA, 25 bp, Mus musculus
tcctggatcacgtcatgtataccat

SEQ ID NO: 21239 - DNA, 25 bp, Mus musculus
atcacgtcatgtataccattcacat

SEQ ID NO: 21240 - DNA, 25 bp, Mus musculus
tcatgtataccattcacatgggctg

SEQ ID NO: 21241 - DNA, 25 bp, Mus musculus
acagttgtctgaggcccaaagtatt

SEQ ID NO: 21242 - DNA, 25 bp, Mus musculus
tgaatgccgcaatctatacaagtat

SEQ ID NO: 21243 - DNA, 25 bp, Mus musculus
gcagctcattcgggtgtactgtaag

SEQ ID NO: 21244 - DNA, 25 bp, Mus musculus
ttcagtggtgtgcgctcagggactt

SEQ ID NO: 21245 - DNA, 25 bp, Mus musculus
tcaccaagccacaggatggtgacat

SEQ ID NO: 21246 - DNA, 25 bp, Mus musculus
gtgacattatagctccactcataac

SEQ ID NO: 21247 - DNA, 25 bp, Mus musculus
ttatagctccactcataacacctct

SEQ ID NO: 21248 - DNA, 25 bp, Mus musculus
ctccactcataacacctctgaaatg

SEQ ID NO: 21249 - DNA, 25 bp, Mus musculus
tcataacacctctgaaatggaataa

SEQ ID NO: 21250 - DNA, 25 bp, Mus musculus
ataagacttcatcttgcctccaaga

SEQ ID NO: 21251 - DNA, 25 bp, Mus musculus
cttcatcttgcctccaagaagtatc

SEQ ID NO: 21252 - DNA, 25 bp, Mus musculus
cttgcctccaagaagtatccaaagt

SEQ ID NO: 21253 - DNA, 25 bp, Mus musculus
tgagacccagccaaagcgtgagaag

SEQ ID NO: 21254 - DNA, 25 bp, Mus musculus
tgaacggcttccccaagaagttgct

SEQ ID NO: 21255 - DNA, 25 bp, Mus musculus
tgaaaaagccccggatgttgaactg

SEQ ID NO: 21256 - DNA, 25 bp, Mus musculus
caagaatccaatcgatcgtgttcac

SEQ ID NO: 21257 - DNA, 25 bp, Mus musculus
tccaatcgatcgtgttcacttctat

SEQ ID NO: 21258 - DNA, 25 bp, Mus musculus
cgatcgtgttcacttctattgtaag

SEQ ID NO: 21259 - DNA, 25 bp, Mus musculus
cagcaagcaagcggtcaggatcaat

SEQ ID NO: 21260 - DNA, 25 bp, Mus musculus
gtcacaactgctgccagagaaattt

SEQ ID NO: 21261 - DNA, 25 bp, Mus musculus
ggactccagtgccacgttcgaaaag

SEQ ID NO: 21262 - DNA, 25 bp, Mus musculus
cagtgccacgttcgaaaaggaatct

SEQ ID NO: 21263 - DNA, 25 bp, Mus musculus
gaatgacattctcagtcacccagag

SEQ ID NO: 21264 - DNA, 25 bp, Mus musculus
cattctcagtcacccagagccatct

SEQ ID NO: 21265 - DNA, 25 bp, Mus musculus
cagtcacccagagccatctggccta

SEQ ID NO: 21266 - DNA, 25 bp, Mus musculus
caatactatcttaatgtccctatct

SEQ ID NO: 21267 - DNA, 25 bp, Mus musculus
tatcttaatgtccctatctgtggtg

SEQ ID NO: 21268 - DNA, 25 bp, Mus musculus
gcacttgctgtgaccttcccagtag

SEQ ID NO: 21269 - DNA, 25 bp, Mus musculus
gctgtgaccttcccagtagtccctc

SEQ ID NO: 21270 - DNA, 25 bp, Mus musculus
ccatgacagaaaacactcccatgag

SEQ ID NO: 21271 - DNA, 25 bp, Mus musculus
cagaaaacactcccatgagtctcga

SEQ ID NO: 21272 - DNA, 25 bp, Mus musculus
gaataaatgtcactccagaacacat

SEQ ID NO: 21273 - DNA, 25 bp, Mus musculus
tttctacgccctggtgacttcacgt

SEQ ID NO: 21274 - DNA, 25 bp, Mus musculus
tgggctgtttacacactccaggaat

SEQ ID NO: 21275 - DNA, 25 bp, Mus musculus
gtttacacactccaggaatctaggg

SEQ ID NO: 21276 - DNA, 25 bp, Mus musculus
tgtctccttcctggagaggctatta

SEQ ID NO: 21277 - DNA, 25 bp, Mus musculus
cttcctggagaggctattaggagcc

SEQ ID NO: 21278 - DNA, 25 bp, Mus musculus
aggagccttgttgctggggtgcata

SEQ ID NO: 21279 - DNA, 25 bp, Mus musculus
tctccgttctgtcccccattcaagg

SEQ ID NO: 21280 - DNA, 25 bp, Mus musculus
cccccattcaaggaatgacattctc

SEQ ID NO: 21281 - DNA, 25 bp, Mus musculus
gtaatacatgtcttctgatacccta

SEQ ID NO: 21282 - DNA, 25 bp, Mus musculus
tacatgtcttctgataccctacaca

SEQ ID NO: 21283 - DNA, 25 bp, Mus musculus
agttattcacagacgtatgtctttc

SEQ ID NO: 21284 - DNA, 25 bp, Mus musculus
ttattcacagacgtatgtctttcta

SEQ ID NO: 21285 - DNA, 25 bp, Mus musculus
acgtatgtctttctaatcaggttct

SEQ ID NO: 21286 - DNA, 25 bp, Mus musculus
atgtctttctaatcaggttctcaat

SEQ ID NO: 21287 - DNA, 25 bp, Mus musculus
gtctttctaatcaggttctcaatgc

SEQ ID NO: 21288 - DNA, 25 bp, Mus musculus
ctttctaatcaggttctcaatgctc

SEQ ID NO: 21289 - DNA, 25 bp, Mus musculus
ttctaatcaggttctcaatgctctc

SEQ ID NO: 21290 - DNA, 25 bp, Mus musculus
aatcaggttctcaatgctctctcca

SEQ ID NO: 21291 - DNA, 25 bp, Mus musculus
tcaggttctcaatgctctctccaag

SEQ ID NO: 21292 - DNA, 25 bp, Mus musculus
gttctcaatgctctctccaagctca

SEQ ID NO: 21293 - DNA, 25 bp, Mus musculus
tgtcttctgataccctacacagcac

SEQ ID NO: 21294 - DNA, 25 bp, Mus musculus
tctcaatgctctctccaagctcatt

SEQ ID NO: 21295 - DNA, 25 bp, Mus musculus
tcttctgataccctacacagcacac

SEQ ID NO: 21296 - DNA, 25 bp, Mus musculus
ctccttcccatcggaatatgtatca

SEQ ID NO: 21297 - DNA, 25 bp, Mus musculus
ggactcattgatactgccaggctct

SEQ ID NO: 21298 - DNA, 25 bp, Mus musculus
actcattgatactgccaggctctga

SEQ ID NO: 21299 - DNA, 25 bp, Mus musculus
tcattgatactgccaggctctgagg

SEQ ID NO: 21300 - DNA, 25 bp, Mus musculus
actgccaggctctgaggactatgac

SEQ ID NO: 21301 - DNA, 25 bp, Mus musculus
tgccaggctctgaggactatgacag

SEQ ID NO: 21302 - DNA, 25 bp, Mus musculus
cgagcgacatcaagccggaagagaa

SEQ ID NO: 21303 - DNA, 25 bp, Mus musculus
gcgacatcaagccggaagagaatga

SEQ ID NO: 21304 - DNA, 25 bp, Mus musculus
tgatccgtatatgccagctgcacgc

SEQ ID NO: 21305 - DNA, 25 bp, Mus musculus
tccgtatatgccagctgcacgctca

SEQ ID NO: 21306 - DNA, 25 bp, Mus musculus
gtatatgccagctgcacgctcaagt

SEQ ID NO: 21307 - DNA, 25 bp, Mus musculus
tatgccagctgcacgctcaagtcgg

SEQ ID NO: 21308 - DNA, 25 bp, Mus musculus
gccagctgcacgctcaagtcggatg

SEQ ID NO: 21309 - DNA, 25 bp, Mus musculus
agctgcacgctcaagtcggatgagg

SEQ ID NO: 21310 - DNA, 25 bp, Mus musculus
tgcacgctcaagtcggatgaggctc

SEQ ID NO: 21311 - DNA, 25 bp, Mus musculus
acgctcaagtcggatgaggctcata

SEQ ID NO: 21312 - DNA, 25 bp, Mus musculus
atgaggctcatacaaggtggtgatg

SEQ ID NO: 21313 - DNA, 25 bp, Mus musculus
aggctcatacaaggtggtgatgctg

SEQ ID NO: 21314 - DNA, 25 bp, Mus musculus
gcatcagcactggacgcagaagact

SEQ ID NO: 21315 - DNA, 25 bp, Mus musculus
tcagcactggacgcagaagactacc

SEQ ID NO: 21316 - DNA, 25 bp, Mus musculus
gaagactaccagtagcacctgaatg

SEQ ID NO: 21317 - DNA, 25 bp, Mus musculus
gactaccagtagcacctgaatgtcc

SEQ ID NO: 21318 - DNA, 25 bp, Mus musculus
taccagtagcacctgaatgtccacc

SEQ ID NO: 21319 - DNA, 25 bp, Mus musculus
cgccaccagtagtacagatgaggtg

SEQ ID NO: 21320 - DNA, 25 bp, Mus musculus
ccttccaagagctgatccgtatatg

SEQ ID NO: 21321 - DNA, 25 bp, Mus musculus
tccaagagctgatccgtatatgcca

SEQ ID NO: 21322 - DNA, 25 bp, Mus musculus
agatagccacagccttgccagatga

SEQ ID NO: 21323 - DNA, 25 bp, Mus musculus
tagccacagccttgccagatgacat

SEQ ID NO: 21324 - DNA, 25 bp, Mus musculus
aaggagcttctgaccgctgggacaa

SEQ ID NO: 21325 - DNA, 25 bp, Mus musculus
ctgaccgctgggacaaaatagccaa

SEQ ID NO: 21326 - DNA, 25 bp, Mus musculus
tagccaaatgtgtcccgtctaagag

SEQ ID NO: 21327 - DNA, 25 bp, Mus musculus
cgatcaatgaccatcattttccaaa

SEQ ID NO: 21328 - DNA, 25 bp, Mus musculus
ttccaaacaagtactcgagaaatct

SEQ ID NO: 21329 - DNA, 25 bp, Mus musculus
actcgagaaatctcatgcagaaact

SEQ ID NO: 21330 - DNA, 25 bp, Mus musculus
gaaatctcatgcagaaacttatatt

SEQ ID NO: 21331 - DNA, 25 bp, Mus musculus
tttgtacctcagtatttctaaacat

SEQ ID NO: 21332 - DNA, 25 bp, Mus musculus
gtacctcagtatttctaaacatcat

SEQ ID NO: 21333 - DNA, 25 bp, Mus musculus
cctcagtatttctaaacatcatgtg

SEQ ID NO: 21334 - DNA, 25 bp, Mus musculus
ccacagccttgccagatgacatcat

SEQ ID NO: 21335 - DNA, 25 bp, Mus musculus
atttctaaacatcatgtgccttagt

SEQ ID NO: 21336 - DNA, 25 bp, Mus musculus
tgccagatgacatcatcacgcagcg

SEQ ID NO: 21337 - DNA, 25 bp, Mus musculus
cagatgacatcatcacgcagcggga

SEQ ID NO: 21338 - DNA, 25 bp, Mus musculus
agtcagcgaccacagaagcccgacc

SEQ ID NO: 21339 - DNA, 25 bp, Mus musculus
ccacagaagcccgacctcggaggcg

SEQ ID NO: 21340 - DNA, 25 bp, Mus musculus
acgattccagtgacgaagagaaaca

SEQ ID NO: 21341 - DNA, 25 bp, Mus musculus
tggcattacagcaataccctaaagg

SEQ ID NO: 21342 - DNA, 25 bp, Mus musculus
tacagcaataccctaaaggagcttc

SEQ ID NO: 21343 - DNA, 25 bp, Mus musculus
cctttctgcactttttgcaagacag

SEQ ID NO: 21344 - DNA, 25 bp, Mus musculus
ttctgcactttttgcaagacagtgg

SEQ ID NO: 21345 - DNA, 25 bp, Mus musculus
ttactatagctatctagatgccctt

SEQ ID NO: 21346 - DNA, 25 bp, Mus musculus
tagctatctagatgccctttaacat

SEQ ID NO: 21347 - DNA, 25 bp, Mus musculus
tgccctttaacattgtgacaaatag

SEQ ID NO: 21348 - DNA, 25 bp, Mus musculus
ttataaagcctgtgtgtgcgggacc

SEQ ID NO: 21349 - DNA, 25 bp, Mus musculus
taaagcctgtgtgtgcgggacctga

SEQ ID NO: 21350 - DNA, 25 bp, Mus musculus
agcctgtgtgtgcgggacctgatcc

SEQ ID NO: 21351 - DNA, 25 bp, Mus musculus
ctgtgtgtgcgggacctgatcctct

SEQ ID NO: 21352 - DNA, 25 bp, Mus musculus
cgggacctgatcctctaagatacat

SEQ ID NO: 21353 - DNA, 25 bp, Mus musculus
ctgatcctctaagatacatggtgta

SEQ ID NO: 21354 - DNA, 25 bp, Mus musculus
atcctctaagatacatggtgtagct

SEQ ID NO: 21355 - DNA, 25 bp, Mus musculus
actttttgcaagacagtggtcaaca

SEQ ID NO: 21356 - DNA, 25 bp, Mus musculus
attcttcaggcaactttcaatccct

SEQ ID NO: 21357 - DNA, 25 bp, Mus musculus
caggcaactttcaatcccttactat

SEQ ID NO: 21358 - DNA, 25 bp, Mus musculus
gcaactttcaatcccttactatagc

SEQ ID NO: 21359 - DNA, 25 bp, Mus musculus
actttcaatcccttactatagctat

SEQ ID NO: 21360 - DNA, 25 bp, Mus musculus
ttcaatcccttactatagctatcta

SEQ ID NO: 21361 - DNA, 25 bp, Mus musculus
aatcccttactatagctatctagat

SEQ ID NO: 21362 - DNA, 25 bp, Mus musculus
cccttactatagctatctagatgcc

SEQ ID NO: 21363 - DNA, 25 bp, Mus musculus
catatgctgcaggtggatcccatga

SEQ ID NO: 21364 - DNA, 25 bp, Mus musculus
atgctgcaggtggatcccatgaaga

SEQ ID NO: 21365 - DNA, 25 bp, Mus musculus
ccatcttatagttcaaccatgatcg

SEQ ID NO: 21366 - DNA, 25 bp, Mus musculus
tcttatagttcaaccatgatcgatg

SEQ ID NO: 21367 - DNA, 25 bp, Mus musculus
tatagttcaaccatgatcgatgacg

SEQ ID NO: 21368 - DNA, 25 bp, Mus musculus
agttcaaccatgatcgatgacgaag

SEQ ID NO: 21369 - DNA, 25 bp, Mus musculus
gaggtcctcagctgcctgtacaaca

SEQ ID NO: 21370 - DNA, 25 bp, Mus musculus
gtcctcagctgcctgtacaacagaa

SEQ ID NO: 21371 - DNA, 25 bp, Mus musculus
ctcagctgcctgtacaacagaaacc

SEQ ID NO: 21372 - DNA, 25 bp, Mus musculus
agctgcctgtacaacagaaaccacc

SEQ ID NO: 21373 - DNA, 25 bp, Mus musculus
taccacctcatcatagacaacagga

SEQ ID NO: 21374 - DNA, 25 bp, Mus musculus
ctcatcatagacaacaggagaataa

SEQ ID NO: 21375 - DNA, 25 bp, Mus musculus
gatcccatgaagagggccgcaataa

SEQ ID NO: 21376 - DNA, 25 bp, Mus musculus
gaccttccgaagtatctctttcctg

SEQ ID NO: 21377 - DNA, 25 bp, Mus musculus
cttccgaagtatctctttcctgagg

SEQ ID NO: 21378 - DNA, 25 bp, Mus musculus
aagtatctctttcctgaggacccat

SEQ ID NO: 21379 - DNA, 25 bp, Mus musculus
ctctttcctgaggacccatcttata

SEQ ID NO: 21380 - DNA, 25 bp, Mus musculus
tttcctgaggacccatcttatagtt

SEQ ID NO: 21381 - DNA, 25 bp, Mus musculus
cctgaggacccatcttatagttcaa

SEQ ID NO: 21382 - DNA, 25 bp, Mus musculus
gaggacccatcttatagttcaacca

SEQ ID NO: 21383 - DNA, 25 bp, Mus musculus
ccattactaatagacttcagagagt

SEQ ID NO: 21384 - DNA, 25 bp, Mus musculus
tgataattccatcttatgttcttca

SEQ ID NO: 21385 - DNA, 25 bp, Mus musculus
tgaaacttgctctcattaaagttct

SEQ ID NO: 21386 - DNA, 25 bp, Mus musculus
ttgctctcattaaagttctgcagaa

SEQ ID NO: 21387 - DNA, 25 bp, Mus musculus
aagttctgcagaacttctccttcca

SEQ ID NO: 21388 - DNA, 25 bp, Mus musculus
gcagagaactacttcttcaaccagt

SEQ ID NO: 21389 - DNA, 25 bp, Mus musculus
aggttgtgccacgggatgcagtcat

SEQ ID NO: 21390 - DNA, 25 bp, Mus musculus
cagtcataactggagcgtgattttc

SEQ ID NO: 21391 - DNA, 25 bp, Mus musculus
gattttcccttgaggagttctgctg

SEQ ID NO: 21392 - DNA, 25 bp, Mus musculus
cccttgaggagttctgctgagttct

SEQ ID NO: 21393 - DNA, 25 bp, Mus musculus
attgaacactttagtctcatcatga

SEQ ID NO: 21394 - DNA, 25 bp, Mus musculus
cactttagtctcatcatgaataaaa

SEQ ID NO: 21395 - DNA, 25 bp, Mus musculus
ttccatcttatgttcttcaccatga

SEQ ID NO: 21396 - DNA, 25 bp, Mus musculus
cttatgttcttcaccatgacccaca

SEQ ID NO: 21397 - DNA, 25 bp, Mus musculus
accatgacccacagcactggccaga

SEQ ID NO: 21398 - DNA, 25 bp, Mus musculus
acccacagcactggccagagcctga

SEQ ID NO: 21399 - DNA, 25 bp, Mus musculus
agcactggccagagcctgaagaatt

SEQ ID NO: 21400 - DNA, 25 bp, Mus musculus
atctgccctttgggaatggacccag

SEQ ID NO: 21401 - DNA, 25 bp, Mus musculus
gacccaggaactgcattggcatgag

SEQ ID NO: 21402 - DNA, 25 bp, Mus musculus
ggtttgctctcatgaatatgaaact

SEQ ID NO: 21403 - DNA, 25 bp, Mus musculus
gcagagaactacttcttcaaccagt

SEQ ID NO: 21404 - DNA, 25 bp, Mus musculus
cagagaactacttcttcaaccagta

SEQ ID NO: 21405 - DNA, 25 bp, Mus musculus
gattttcccttgaggagttctgctg

SEQ ID NO: 21406 - DNA, 25 bp, Mus musculus
attttcccttgaggagttctgctga

SEQ ID NO: 21407 - DNA, 25 bp, Mus musculus
ttcccttgaggagttctgctgagtt

SEQ ID NO: 21408 - DNA, 25 bp, Mus musculus
acattgaacactttagtctcatcat

SEQ ID NO: 21409 - DNA, 25 bp, Mus musculus
attgaacactttagtctcatcatga

SEQ ID NO: 21410 - DNA, 25 bp, Mus musculus
gaacactttagtctcatcatgaata

SEQ ID NO: 21411 - DNA, 25 bp, Mus musculus
aacactttagtctcatcatgaataa

SEQ ID NO: 21412 - DNA, 25 bp, Mus musculus
tgattgattttgatgcctggttaaa

SEQ ID NO: 21413 - DNA, 25 bp, Mus musculus
gcagagaactacttcttcaaccagt

SEQ ID NO: 21414 - DNA, 25 bp, Mus musculus
cagagaactacttcttcaaccagta

SEQ ID NO: 21415 - DNA, 25 bp, Mus musculus
tttagtctcatcatgaataaaaatc

SEQ ID NO: 21416 - DNA, 25 bp, Mus musculus
ttagtctcatcatgaataaaaatca

SEQ ID NO: 21417 - DNA, 25 bp, Mus musculus
tgattgattttgatgcctggttaaa

SEQ ID NO: 21418 - DNA, 25 bp, Mus musculus
gattttcccttgaggagttctgctg

SEQ ID NO: 21419 - DNA, 25 bp, Mus musculus
attttcccttgaggagttctgctga

SEQ ID NO: 21420 - DNA, 25 bp, Mus musculus
ttcccttgaggagttctgctgagtt

SEQ ID NO: 21421 - DNA, 25 bp, Mus musculus
acattgaacactttagtctcatcat

SEQ ID NO: 21422 - DNA, 25 bp, Mus musculus
cattgaacactttagtctcatcatg

SEQ ID NO: 21423 - DNA, 25 bp, Mus musculus
attgaacactttagtctcatcatga

SEQ ID NO: 21424 - DNA, 25 bp, Mus musculus
gaacactttagtctcatcatgaata

SEQ ID NO: 21425 - DNA, 25 bp, Mus musculus
aacactttagtctcatcatgaataa

SEQ ID NO: 21426 - DNA, 25 bp, Mus musculus
aggacttcctgtctgtatcagatat

SEQ ID NO: 21427 - DNA, 25 bp, Mus musculus
ttattgactacttcaggaaaatgcc

SEQ ID NO: 21428 - DNA, 25 bp, Mus musculus
gtgaccttagcaaatcgccgagcac

SEQ ID NO: 21429 - DNA, 25 bp, Mus musculus
ttagcaaatcgccgagcacttagga

SEQ ID NO: 21430 - DNA, 25 bp, Mus musculus
actcgggcccagagttctgccctgc

SEQ ID NO: 21431 - DNA, 25 bp, Mus musculus
atcatgttcacatttgaagtctaag

SEQ ID NO: 21432 - DNA, 25 bp, Mus musculus
agattttgaacatccatcccaaaat

SEQ ID NO: 21433 - DNA, 25 bp, Mus musculus
tgaacatccatcccaaaatacagta

SEQ ID NO: 21434 - DNA, 25 bp, Mus musculus
tccatcccaaaatacagtacttgat

SEQ ID NO: 21435 - DNA, 25 bp, Mus musculus
tactgaaactggtcatttttgatat

SEQ ID NO: 21436 - DNA, 25 bp, Mus musculus
ataatgaatcttttgtcaggccgag

SEQ ID NO: 21437 - DNA, 25 bp, Mus musculus
ttgtcaggccgaggcatgttctgtt

SEQ ID NO: 21438 - DNA, 25 bp, Mus musculus
actacttcaggaaaatgccgctgtt

SEQ ID NO: 21439 - DNA, 25 bp, Mus musculus
gataccagtgcacactaacacacgc

SEQ ID NO: 21440 - DNA, 25 bp, Mus musculus
agtgcacactaacacacgctgcagg

SEQ ID NO: 21441 - DNA, 25 bp, Mus musculus
cactaacacacgctgcaggctgtct

SEQ ID NO: 21442 - DNA, 25 bp, Mus musculus
ctgcaggctgtctgtagcaagttag

SEQ ID NO: 21443 - DNA, 25 bp, Mus musculus
gcctttctgacttggtggtcactgc

SEQ ID NO: 21444 - DNA, 25 bp, Mus musculus
ctgacttggtggtcactgcggcgaa

SEQ ID NO: 21445 - DNA, 25 bp, Mus musculus
aatcacgtgaccttagcaaatcgcc

SEQ ID NO: 21446 - DNA, 25 bp, Mus musculus
gctatcatataccagtacatagaag

SEQ ID NO: 21447 - DNA, 25 bp, Mus musculus
tcagacccatcatcaagcaaaacca

SEQ ID NO: 21448 - DNA, 25 bp, Mus musculus
tccttttcctccagctggattttga

SEQ ID NO: 21449 - DNA, 25 bp, Mus musculus
cttggttcctctgcctcttgtagcc

SEQ ID NO: 21450 - DNA, 25 bp, Mus musculus
tcctctgcctcttgtagccactggc

SEQ ID NO: 21451 - DNA, 25 bp, Mus musculus
gcctcttgtagccactggcagcgtg

SEQ ID NO: 21452 - DNA, 25 bp, Mus musculus
tgtagccactggcagcgtgccgact

SEQ ID NO: 21453 - DNA, 25 bp, Mus musculus
gccgactgctgcacttgtgaggcca

SEQ ID NO: 21454 - DNA, 25 bp, Mus musculus
tgctgcacttgtgaggccacgtgtg

SEQ ID NO: 21455 - DNA, 25 bp, Mus musculus
agcctagtgaacctggctagaatgc

SEQ ID NO: 21456 - DNA, 25 bp, Mus musculus
tttgaaacagcctttgaatacctat

SEQ ID NO: 21457 - DNA, 25 bp, Mus musculus
acagcctttgaatacctatgacaat

SEQ ID NO: 21458 - DNA, 25 bp, Mus musculus
aagcaggtcatctccaagatcagga

SEQ ID NO: 21459 - DNA, 25 bp, Mus musculus
gtcatctccaagatcaggacacaga

SEQ ID NO: 21460 - DNA, 25 bp, Mus musculus
atcaggacacagaaccttcccaact

SEQ ID NO: 21461 - DNA, 25 bp, Mus musculus
tactcgcccatttacctgtcattta

SEQ ID NO: 21462 - DNA, 25 bp, Mus musculus
tacctgtcatttatcatgctcttgg

SEQ ID NO: 21463 - DNA, 25 bp, Mus musculus
atcatgctcttggctgccctgagct

SEQ ID NO: 21464 - DNA, 25 bp, Mus musculus
ctgagctggcagtacctgagcaccc

SEQ ID NO: 21465 - DNA, 25 bp, Mus musculus
tggcagtacctgagcaccctgtccc

SEQ ID NO: 21466 - DNA, 25 bp, Mus musculus
ctagactgatcgatcctccggaact

SEQ ID NO: 21467 - DNA, 25 bp, Mus musculus
tgatcgatcctccggaactagacac

SEQ ID NO: 21468 - DNA, 25 bp, Mus musculus
ctgcactctgatcacggccattcac

SEQ ID NO: 21469 - DNA, 25 bp, Mus musculus
tctgatcacggccattcacacatgc

SEQ ID NO: 21470 - DNA, 25 bp, Mus musculus
cacggccattcacacatgcacatgg

SEQ ID NO: 21471 - DNA, 25 bp, Mus musculus
cattcacacatgcacatggacacgg

SEQ ID NO: 21472 - DNA, 25 bp, Mus musculus
cacatgcacatggacacggccatga

SEQ ID NO: 21473 - DNA, 25 bp, Mus musculus
cacatggacacggccatgatcacgg

SEQ ID NO: 21474 - DNA, 25 bp, Mus musculus
gacacggccatgatcacggtcaagc

SEQ ID NO: 21475 - DNA, 25 bp, Mus musculus
gccatgatcacggtcaagcacggct

SEQ ID NO: 21476 - DNA, 25 bp, Mus musculus
atcacggtcaagcacggcttcacgg

SEQ ID NO: 21477 - DNA, 25 bp, Mus musculus
gtatttctccatgtgttggcagaac

SEQ ID NO: 21478 - DNA, 25 bp, Mus musculus
atcctccggaactagacacaacatg

SEQ ID NO: 21479 - DNA, 25 bp, Mus musculus
tagacacaacatgctgacaccagtt

SEQ ID NO: 21480 - DNA, 25 bp, Mus musculus
caacatgctgacaccagtttccgtc

SEQ ID NO: 21481 - DNA, 25 bp, Mus musculus
tggtatctgtgccttcagccacgcc

SEQ ID NO: 21482 - DNA, 25 bp, Mus musculus
ccatggccatgggcttctcaaggac

SEQ ID NO: 21483 - DNA, 25 bp, Mus musculus
ccatgggcttctcaaggactgcact

SEQ ID NO: 21484 - DNA, 25 bp, Mus musculus
gcttctcaaggactgcactctgatc

SEQ ID NO: 21485 - DNA, 25 bp, Mus musculus
caaggactgcactctgatcacggcc

SEQ ID NO: 21486 - DNA, 25 bp, Mus musculus
cacatgggcaccaatgtcattgttg

SEQ ID NO: 21487 - DNA, 25 bp, Mus musculus
ggcaccaatgtcattgttgctaaca

SEQ ID NO: 21488 - DNA, 25 bp, Mus musculus
caagaagccatctagcaagctgctg

SEQ ID NO: 21489 - DNA, 25 bp, Mus musculus
gctggctcataccctcagaagagca

SEQ ID NO: 21490 - DNA, 25 bp, Mus musculus
gagtaacctagtcatggcaaagaag

SEQ ID NO: 21491 - DNA, 25 bp, Mus musculus
gggaccagtcccagagcagctacag

SEQ ID NO: 21492 - DNA, 25 bp, Mus musculus
agtcccagagcagctacagaaaggg

SEQ ID NO: 21493 - DNA, 25 bp, Mus musculus
aggactgtcttccactgcctggact

SEQ ID NO: 21494 - DNA, 25 bp, Mus musculus
cactgcctggactcctctcaagttg

SEQ ID NO: 21495 - DNA, 25 bp, Mus musculus
ctggactcctctcaagttgaagtca

SEQ ID NO: 21496 - DNA, 25 bp, Mus musculus
tcctctcaagttgaagtcatcgtct

SEQ ID NO: 21497 - DNA, 25 bp, Mus musculus
atcgtcttcatcttcctccgtatct

SEQ ID NO: 21498 - DNA, 25 bp, Mus musculus
attgttgctaacacgatgccctctc

SEQ ID NO: 21499 - DNA, 25 bp, Mus musculus
cacctcagcaatggacagatgtgtg

SEQ ID NO: 21500 - DNA, 25 bp, Mus musculus
ccaccaagtggctcgggatctgaat

SEQ ID NO: 21501 - DNA, 25 bp, Mus musculus
tctgaatcctacaagctcctgccag

SEQ ID NO: 21502 - DNA, 25 bp, Mus musculus
aagctcctgccaggagccatcacca

SEQ ID NO: 21503 - DNA, 25 bp, Mus musculus
cagccaacgatcaccaagcaagaag

SEQ ID NO: 21504 - DNA, 25 bp, Mus musculus
acgatcaccaagcaagaagccatct

SEQ ID NO: 21505 - DNA, 25 bp, Mus musculus
accaagcaagaagccatctagcaag

SEQ ID NO: 21506 - DNA, 25 bp, Mus musculus
cgctgatcatcagcgttgagaaacc

SEQ ID NO: 21507 - DNA, 25 bp, Mus musculus
atgaccagctcactgtaccgctaga

SEQ ID NO: 21508 - DNA, 25 bp, Mus musculus
tctctgtccatagtactttcatggt

SEQ ID NO: 21509 - DNA, 25 bp, Mus musculus
tccatagtactttcatggtgcgctg

SEQ ID NO: 21510 - DNA, 25 bp, Mus musculus
tgcgctgtgtgctattccgtcgtga

SEQ ID NO: 21511 - DNA, 25 bp, Mus musculus
gtgtgctattccgtcgtgatattat

SEQ ID NO: 21512 - DNA, 25 bp, Mus musculus
tattccgtcgtgatattattccctg

SEQ ID NO: 21513 - DNA, 25 bp, Mus musculus
tcgccaccatcaggaccaactgcag

SEQ ID NO: 21514 - DNA, 25 bp, Mus musculus
ccatcaggaccaactgcagatgcta

SEQ ID NO: 21515 - DNA, 25 bp, Mus musculus
actgcagatgctagtctgtagactc

SEQ ID NO: 21516 - DNA, 25 bp, Mus musculus
agtctgtagactcctgctccactgg

SEQ ID NO: 21517 - DNA, 25 bp, Mus musculus
cctgctccactggattcaagattag

SEQ ID NO: 21518 - DNA, 25 bp, Mus musculus
agctcactgtaccgctagatccaca

SEQ ID NO: 21519 - DNA, 25 bp, Mus musculus
tttatgatcatcacactgtcgtacg

SEQ ID NO: 21520 - DNA, 25 bp, Mus musculus
ctgtaccgctagatccacattggct

SEQ ID NO: 21521 - DNA, 25 bp, Mus musculus
cgctagatccacattggctgctgtg

SEQ ID NO: 21522 - DNA, 25 bp, Mus musculus
atccacattggctgctgtgaaccat

SEQ ID NO: 21523 - DNA, 25 bp, Mus musculus
attggctgctgtgaaccatgctaac

SEQ ID NO: 21524 - DNA, 25 bp, Mus musculus
tgctgtgaaccatgctaacgcagat

SEQ ID NO: 21525 - DNA, 25 bp, Mus musculus
gaaccatgctaacgcagatttcgtg

SEQ ID NO: 21526 - DNA, 25 bp, Mus musculus
gatgtgtctctgtccatagtacttt

SEQ ID NO: 21527 - DNA, 25 bp, Mus musculus
aactctaatgcatgcaagaacccat

SEQ ID NO: 21528 - DNA, 25 bp, Mus musculus
aatgcatgcaagaacccattaggtt

SEQ ID NO: 21529 - DNA, 25 bp, Mus musculus
tgttctttcttcctggtagtgccaa

SEQ ID NO: 21530 - DNA, 25 bp, Mus musculus
ttgagacccgtggatccttctgcgg

SEQ ID NO: 21531 - DNA, 25 bp, Mus musculus
tctgcggaccctaattacacaaagt

SEQ ID NO: 21532 - DNA, 25 bp, Mus musculus
gaccctaattacacaaagtggagct

SEQ ID NO: 21533 - DNA, 25 bp, Mus musculus
ttctttctaaacttgaactctgact

SEQ ID NO: 21534 - DNA, 25 bp, Mus musculus
ctaaacttgaactctgactttgcta

SEQ ID NO: 21535 - DNA, 25 bp, Mus musculus
ttgaactctgactttgctagacata

SEQ ID NO: 21536 - DNA, 25 bp, Mus musculus
tctgactttgctagacatagaaggc

SEQ ID NO: 21537 - DNA, 25 bp, Mus musculus
tatctaaaatccaattgtatccact

SEQ ID NO: 21538 - DNA, 25 bp, Mus musculus
aaatccaattgtatccactgacaca

SEQ ID NO: 21539 - DNA, 25 bp, Mus musculus
acctgtactgccttctgtttgagtg

SEQ ID NO: 21540 - DNA, 25 bp, Mus musculus
actgccttctgtttgagtgcaaaac

SEQ ID NO: 21541 - DNA, 25 bp, Mus musculus
ctgtactagccaaatacgctgaaag

SEQ ID NO: 21542 - DNA, 25 bp, Mus musculus
tagccaaatacgctgaaagtgtgtg

SEQ ID NO: 21543 - DNA, 25 bp, Mus musculus
tcaatgtcctgtatccatgctcgtc

SEQ ID NO: 21544 - DNA, 25 bp, Mus musculus
tcctgtatccatgctcgtcatgtgg

SEQ ID NO: 21545 - DNA, 25 bp, Mus musculus
gctcgtcatgtggattcttaactga

SEQ ID NO: 21546 - DNA, 25 bp, Mus musculus
ccgtctcaaatgtttctttaatctg

SEQ ID NO: 21547 - DNA, 25 bp, Mus musculus
tttaccatgggcacactctcaccac

SEQ ID NO: 21548 - DNA, 25 bp, Mus musculus
tcaccaccaagatcaagttctctga

SEQ ID NO: 21549 - DNA, 25 bp, Mus musculus
aggaccactgcagcattgccagcag

SEQ ID NO: 21550 - DNA, 25 bp, Mus musculus
actgcagcattgccagcaggtgctg

SEQ ID NO: 21551 - DNA, 25 bp, Mus musculus
gcattgccagcaggtgctgtccacc

SEQ ID NO: 21552 - DNA, 25 bp, Mus musculus
gtccacctgtggaatgccatgaact

SEQ ID NO: 21553 - DNA, 25 bp, Mus musculus
atgaactgggttctctgggagctgt

SEQ ID NO: 21554 - DNA, 25 bp, Mus musculus
ctctgggagctgtctactgtaaagc

SEQ ID NO: 21555 - DNA, 25 bp, Mus musculus
tctactgtaaagccttcttggtctc

SEQ ID NO: 21556 - DNA, 25 bp, Mus musculus
gtaaagccttcttggtctcacagcc

SEQ ID NO: 21557 - DNA, 25 bp, Mus musculus
tggtctcacagcctggagcctggat

SEQ ID NO: 21558 - DNA, 25 bp, Mus musculus
gacaaaaccaagccattaatgatat

SEQ ID NO: 21559 - DNA, 25 bp, Mus musculus
tcaagttctctgacgtcctgcacac

SEQ ID NO: 21560 - DNA, 25 bp, Mus musculus
tctctgacgtcctgcacaccatcaa

SEQ ID NO: 21561 - DNA, 25 bp, Mus musculus
atgctttcgtagcctcagagtaccc

SEQ ID NO: 21562 - DNA, 25 bp, Mus musculus
tcgtagcctcagagtacccagtcat

SEQ ID NO: 21563 - DNA, 25 bp, Mus musculus
cctcagagtacccagtcatcctgtc

SEQ ID NO: 21564 - DNA, 25 bp, Mus musculus
agtacccagtcatcctgtccatcga

SEQ ID NO: 21565 - DNA, 25 bp, Mus musculus
tcctgtccatcgaggaccactgcag

SEQ ID NO: 21566 - DNA, 25 bp, Mus musculus
ccatcgaggaccactgcagcattgc

SEQ ID NO: 21567 - DNA, 25 bp, Mus musculus
gttcccaacaaactcataaagtcat

SEQ ID NO: 21568 - DNA, 25 bp, Mus musculus
ggcctcatatttgggtcacatcgtt

SEQ ID NO: 21569 - DNA, 25 bp, Mus musculus
gtctgcatggtcacgaaggagtgct

SEQ ID NO: 21570 - DNA, 25 bp, Mus musculus
tgcatggtcacgaaggagtgctcta

SEQ ID NO: 21571 - DNA, 25 bp, Mus musculus
gattaacttacacactgttatagca

SEQ ID NO: 21572 - DNA, 25 bp, Mus musculus
taacttacacactgttatagcaatg

SEQ ID NO: 21573 - DNA, 25 bp, Mus musculus
gcaatttaacagacctcaagaatct

SEQ ID NO: 21574 - DNA, 25 bp, Mus musculus
taacagacctcaagaatctgaggaa

SEQ ID NO: 21575 - DNA, 25 bp, Mus musculus
cagacctcaagaatctgaggaatca

SEQ ID NO: 21576 - DNA, 25 bp, Mus musculus
aagtggcaattccactgtctgataa

SEQ ID NO: 21577 - DNA, 25 bp, Mus musculus
caattccactgtctgataagggctt

SEQ ID NO: 21578 - DNA, 25 bp, Mus musculus
ttccactgtctgataagggcttctg

SEQ ID NO: 21579 - DNA, 25 bp, Mus musculus
ctcatatttgggtcacatcgttaaa

SEQ ID NO: 21580 - DNA, 25 bp, Mus musculus
agatactgttctccaaaggagagcc

SEQ ID NO: 21581 - DNA, 25 bp, Mus musculus
tgttctccaaaggagagccagggtt

SEQ ID NO: 21582 - DNA, 25 bp, Mus musculus
cctgttactcaggcgagtggagagc

SEQ ID NO: 21583 - DNA, 25 bp, Mus musculus
tggaagctccagactgcagccttgc

SEQ ID NO: 21584 - DNA, 25 bp, Mus musculus
aagctccagactgcagccttgcaga

SEQ ID NO: 21585 - DNA, 25 bp, Mus musculus
actgcagccttgcagagtaactcgg

SEQ ID NO: 21586 - DNA, 25 bp, Mus musculus
attgtctgcatggtcacgaaggagt

SEQ ID NO: 21587 - DNA, 25 bp, Mus musculus
aacattgtcaacgtgtggcctagtg

SEQ ID NO: 21588 - DNA, 25 bp, Mus musculus
attgtcaacgtgtggcctagtggtc

SEQ ID NO: 21589 - DNA, 25 bp, Mus musculus
caaggcgctgtcaaggctgtggcat

SEQ ID NO: 21590 - DNA, 25 bp, Mus musculus
tggtgtccctggcagtccaatatcc

SEQ ID NO: 21591 - DNA, 25 bp, Mus musculus
tgtccctggcagtccaatatcctgg

SEQ ID NO: 21592 - DNA, 25 bp, Mus musculus
ccctggcagtccaatatcctggcaa

SEQ ID NO: 21593 - DNA, 25 bp, Mus musculus
cagtccaatatcctggcaacaggag

SEQ ID NO: 21594 - DNA, 25 bp, Mus musculus
tccaatatcctggcaacaggaggag

SEQ ID NO: 21595 - DNA, 25 bp, Mus musculus
ggaaccagtgaccggcacattcgca

SEQ ID NO: 21596 - DNA, 25 bp, Mus musculus
accagtgaccggcacattcgcattt

SEQ ID NO: 21597 - DNA, 25 bp, Mus musculus
gaccggcacattcgcatttggaacg

SEQ ID NO: 21598 - DNA, 25 bp, Mus musculus
cggcacattcgcatttggaacgtct

SEQ ID NO: 21599 - DNA, 25 bp, Mus musculus
gtcaacgtgtggcctagtggtcctg

SEQ ID NO: 21600 - DNA, 25 bp, Mus musculus
gtgtggcctagtggtcctggagaaa

SEQ ID NO: 21601 - DNA, 25 bp, Mus musculus
cctagtggtcctggagaaagtggat

SEQ ID NO: 21602 - DNA, 25 bp, Mus musculus
ctgcaaacattcactcaacatcaag

SEQ ID NO: 21603 - DNA, 25 bp, Mus musculus
caaacattcactcaacatcaaggcg

SEQ ID NO: 21604 - DNA, 25 bp, Mus musculus
ttcactcaacatcaaggcgctgtca

SEQ ID NO: 21605 - DNA, 25 bp, Mus musculus
actcaacatcaaggcgctgtcaagg

SEQ ID NO: 21606 - DNA, 25 bp, Mus musculus
caacatcaaggcgctgtcaaggctg

SEQ ID NO: 21607 - DNA, 25 bp, Mus musculus
ccttgcacattatcatttgttgaaa

SEQ ID NO: 21608 - DNA, 25 bp, Mus musculus
aattttgacaacagaccactcattt

SEQ ID NO: 21609 - DNA, 25 bp, Mus musculus
aggaagactccactaagttcagtgt

SEQ ID NO: 21610 - DNA, 25 bp, Mus musculus
actccactaagttcagtgttctgag

SEQ ID NO: 21611 - DNA, 25 bp, Mus musculus
tcagtgttctgagcctttacttttg

SEQ ID NO: 21612 - DNA, 25 bp, Mus musculus
ttctgagcctttacttttgcataaa

SEQ ID NO: 21613 - DNA, 25 bp, Mus musculus
tactttccttatttatcaatcaaag

SEQ ID NO: 21614 - DNA, 25 bp, Mus musculus
attcatcaaatcacccctgttttca

SEQ ID NO: 21615 - DNA, 25 bp, Mus musculus
caaatcacccctgttttcaatcgat

SEQ ID NO: 21616 - DNA, 25 bp, Mus musculus
acccctgttttcaatcgatcgctgt

SEQ ID NO: 21617 - DNA, 25 bp, Mus musculus
gttttcaatcgatcgctgtcagact

SEQ ID NO: 21618 - DNA, 25 bp, Mus musculus
aatcgatcgctgtcagactatattg

SEQ ID NO: 21619 - DNA, 25 bp, Mus musculus
gacaacagaccactcattttacatg

SEQ ID NO: 21620 - DNA, 25 bp, Mus musculus
agaccactcattttacatggagagt

SEQ ID NO: 21621 - DNA, 25 bp, Mus musculus
agtgagacatctattgctgggtctg

SEQ ID NO: 21622 - DNA, 25 bp, Mus musculus
acatctattgctgggtctgtacttc

SEQ ID NO: 21623 - DNA, 25 bp, Mus musculus
taccctaagtgtactccaagagaca

SEQ ID NO: 21624 - DNA, 25 bp, Mus musculus
aagtgtactccaagagacaggaggc

SEQ ID NO: 21625 - DNA, 25 bp, Mus musculus
ctgtcctttcaggaagcattacgga

SEQ ID NO: 21626 - DNA, 25 bp, Mus musculus
atgaatctcgcataaaacaatttta

SEQ ID NO: 21627 - DNA, 25 bp, Mus musculus
gtgtcacaaagccagatcaagagaa

SEQ ID NO: 21628 - DNA, 25 bp, Mus musculus
atacactgtttacagcctgcgaagg

SEQ ID NO: 21629 - DNA, 25 bp, Mus musculus
ggctactttttgcgttggtcaatga

SEQ ID NO: 21630 - DNA, 25 bp, Mus musculus
taatcattattgcaatcaagggtga

SEQ ID NO: 21631 - DNA, 25 bp, Mus musculus
tcagaaaaccacatagaacattttc

SEQ ID NO: 21632 - DNA, 25 bp, Mus musculus
tgcctccatttctttccctagattc

SEQ ID NO: 21633 - DNA, 25 bp, Mus musculus
tttccctagattctaagtagatgtg

SEQ ID NO: 21634 - DNA, 25 bp, Mus musculus
agatgtgtacccatgtgaatataga

SEQ ID NO: 21635 - DNA, 25 bp, Mus musculus
aaattcaggcgcacatgctcacagt

SEQ ID NO: 21636 - DNA, 25 bp, Mus musculus
aggcgcacatgctcacagtcacaaa

SEQ ID NO: 21637 - DNA, 25 bp, Mus musculus
acatgctcacagtcacaaacacaaa

SEQ ID NO: 21638 - DNA, 25 bp, Mus musculus
tcacagtcacaaacacaaacaggat

SEQ ID NO: 21639 - DNA, 25 bp, Mus musculus
tgtttacagcctgcgaaggtgactc

SEQ ID NO: 21640 - DNA, 25 bp, Mus musculus
gtgactcactcgtgttaataagact

SEQ ID NO: 21641 - DNA, 25 bp, Mus musculus
gtctatgccaaactctttttatcaa

SEQ ID NO: 21642 - DNA, 25 bp, Mus musculus
ttatcaaatattctcaaggcagcac

SEQ ID NO: 21643 - DNA, 25 bp, Mus musculus
aatattctcaaggcagcacagccac

SEQ ID NO: 21644 - DNA, 25 bp, Mus musculus
gcagcacagccactagctctgatcc

SEQ ID NO: 21645 - DNA, 25 bp, Mus musculus
gcatttacacatggctactttttgc

SEQ ID NO: 21646 - DNA, 25 bp, Mus musculus
acacatggctactttttgcgttggt

SEQ ID NO: 21647 - DNA, 25 bp, Mus musculus
agcgatacgtcgagcatcatagagt

SEQ ID NO: 21648 - DNA, 25 bp, Mus musculus
gatacgtcgagcatcatagagtacc

SEQ ID NO: 21649 - DNA, 25 bp, Mus musculus
actgtatatcactgagtcgtctcaa

SEQ ID NO: 21650 - DNA, 25 bp, Mus musculus
gtatatcactgagtcgtctcaagtg

SEQ ID NO: 21651 - DNA, 25 bp, Mus musculus
acagcatactctgatctccgaatgc

SEQ ID NO: 21652 - DNA, 25 bp, Mus musculus
gcatactctgatctccgaatgctct

SEQ ID NO: 21653 - DNA, 25 bp, Mus musculus
gatctccgaatgctctcgacacata

SEQ ID NO: 21654 - DNA, 25 bp, Mus musculus
ctccgaatgctctcgacacatacag

SEQ ID NO: 21655 - DNA, 25 bp, Mus musculus
cgaatgctctcgacacatacagcag

SEQ ID NO: 21656 - DNA, 25 bp, Mus musculus
ctctcgacacatacagcagagacgc

SEQ ID NO: 21657 - DNA, 25 bp, Mus musculus
tcgacacatacagcagagacgctaa

SEQ ID NO: 21658 - DNA, 25 bp, Mus musculus
acacatacagcagagacgctaacat

SEQ ID NO: 21659 - DNA, 25 bp, Mus musculus
tccgacacaatgtcagagtcacagc

SEQ ID NO: 21660 - DNA, 25 bp, Mus musculus
tcagagtcacagcctgatgcatggc

SEQ ID NO: 21661 - DNA, 25 bp, Mus musculus
gagtcacagcctgatgcatggcgcc

SEQ ID NO: 21662 - DNA, 25 bp, Mus musculus
tggcgccagactgtcgaaggagctg

SEQ ID NO: 21663 - DNA, 25 bp, Mus musculus
catctatgacgcctagatggacgtg

SEQ ID NO: 21664 - DNA, 25 bp, Mus musculus
tgacgcctagatggacgtgatctcg

SEQ ID NO: 21665 - DNA, 25 bp, Mus musculus
ggacgtgatctcgagcggcgtgaaa

SEQ ID NO: 21666 - DNA, 25 bp, Mus musculus
cgtgatctcgagcggcgtgaaactg

SEQ ID NO: 21667 - DNA, 25 bp, Mus musculus
tctcagtttgcagctgctctagaac

SEQ ID NO: 21668 - DNA, 25 bp, Mus musculus
cagtttgcagctgctctagaacccc

SEQ ID NO: 21669 - DNA, 25 bp, Mus musculus
cccatcactactacattaaaacgca

SEQ ID NO: 21670 - DNA, 25 bp, Mus musculus
tcagctgttatcattcagcgagctt

SEQ ID NO: 21671 - DNA, 25 bp, Mus musculus
gttatcattcagcgagcttataggc

SEQ ID NO: 21672 - DNA, 25 bp, Mus musculus
atcattcagcgagcttataggcgcc

SEQ ID NO: 21673 - DNA, 25 bp, Mus musculus
cgagcttataggcgccaccttttga

SEQ ID NO: 21674 - DNA, 25 bp, Mus musculus
gcttataggcgccaccttttgaagc

SEQ ID NO: 21675 - DNA, 25 bp, Mus musculus
tataggcgccaccttttgaagcgaa

SEQ ID NO: 21676 - DNA, 25 bp, Mus musculus
caagcttcattcacatacaataaga

SEQ ID NO: 21677 - DNA, 25 bp, Mus musculus
gcttcattcacatacaataagaaca

SEQ ID NO: 21678 - DNA, 25 bp, Mus musculus
actgacctgacaatgtccacagcag

SEQ ID NO: 21679 - DNA, 25 bp, Mus musculus
cctctcaatttgccacaaccaaaca

SEQ ID NO: 21680 - DNA, 25 bp, Mus musculus
ttgccacaaccaaacaaacttcagc

SEQ ID NO: 21681 - DNA, 25 bp, Mus musculus
ccacaaccaaacaaacttcagctca

SEQ ID NO: 21682 - DNA, 25 bp, Mus musculus
atggatgctcttcgaatccagatgg

SEQ ID NO: 21683 - DNA, 25 bp, Mus musculus
cttcgaatccagatggaagagcggt

SEQ ID NO: 21684 - DNA, 25 bp, Mus musculus
gtctcttatcagcccatcactacta

SEQ ID NO: 21685 - DNA, 25 bp, Mus musculus
tcttatcagcccatcactactacat

SEQ ID NO: 21686 - DNA, 25 bp, Mus musculus
cagcccatcactactacattaaaac

SEQ ID NO: 21687 - DNA, 25 bp, Mus musculus
aaattatcttcaggttgatatcaca

SEQ ID NO: 21688 - DNA, 25 bp, Mus musculus
ttatcttcaggttgatatcacaatc

SEQ ID NO: 21689 - DNA, 25 bp, Mus musculus
acactcacaacttcacatccaaatt

SEQ ID NO: 21690 - DNA, 25 bp, Mus musculus
acaacttcacatccaaattatgatt

SEQ ID NO: 21691 - DNA, 25 bp, Mus musculus
acttcacatccaaattatgatttgc

SEQ ID NO: 21692 - DNA, 25 bp, Mus musculus
tcacatccaaattatgatttgcaat

SEQ ID NO: 21693 - DNA, 25 bp, Mus musculus
tttgaaatcatgcttctttagattg

SEQ ID NO: 21694 - DNA, 25 bp, Mus musculus
atcatgcttctttagattgttctaa

SEQ ID NO: 21695 - DNA, 25 bp, Mus musculus
tcttttcctcaaaatcagagaggat

SEQ ID NO: 21696 - DNA, 25 bp, Mus musculus
atttgtgtttcttacagaagcagac

SEQ ID NO: 21697 - DNA, 25 bp, Mus musculus
ttttacgccaggcgtggtggcacac

SEQ ID NO: 21698 - DNA, 25 bp, Mus musculus
tacgccaggcgtggtggcacacgct

SEQ ID NO: 21699 - DNA, 25 bp, Mus musculus
tgatatcacaatcacttttcttact

SEQ ID NO: 21700 - DNA, 25 bp, Mus musculus
tatcacaatcacttttcttactttc

SEQ ID NO: 21701 - DNA, 25 bp, Mus musculus
cacaatcacttttcttactttctgt

SEQ ID NO: 21702 - DNA, 25 bp, Mus musculus
ttttcttactttctgtccacagcag

SEQ ID NO: 21703 - DNA, 25 bp, Mus musculus
tcttactttctgtccacagcagttt

SEQ ID NO: 21704 - DNA, 25 bp, Mus musculus
tactttctgtccacagcagtttttc

SEQ ID NO: 21705 - DNA, 25 bp, Mus musculus
gggcaaaatacactcacaacttcac

SEQ ID NO: 21706 - DNA, 25 bp, Mus musculus
aatacactcacaacttcacatccaa

SEQ ID NO: 21707 - DNA, 25 bp, Mus musculus
ttgcttgcctggctaaaatccttca

SEQ ID NO: 21708 - DNA, 25 bp, Mus musculus
gcctggctaaaatccttcattcacc

SEQ ID NO: 21709 - DNA, 25 bp, Mus musculus
caagaaaagcacaccacaattctcc

SEQ ID NO: 21710 - DNA, 25 bp, Mus musculus
cacaccacaattctccctatttaat

SEQ ID NO: 21711 - DNA, 25 bp, Mus musculus
ttggatttcctttatactgtgaagt

SEQ ID NO: 21712 - DNA, 25 bp, Mus musculus
ttcctttatactgtgaagttacatg

SEQ ID NO: 21713 - DNA, 25 bp, Mus musculus
ggtcaaacctgtaggtgcagaaaag

SEQ ID NO: 21714 - DNA, 25 bp, Mus musculus
agcaaatgcattctatcgttattat

SEQ ID NO: 21715 - DNA, 25 bp, Mus musculus
taatattgtattgctgctgtgcgtg

SEQ ID NO: 21716 - DNA, 25 bp, Mus musculus
tattgtattgctgctgtgcgtggaa

SEQ ID NO: 21717 - DNA, 25 bp, Mus musculus
tgtattgctgctgtgcgtggaaaaa

SEQ ID NO: 21718 - DNA, 25 bp, Mus musculus
attgctgctgtgcgtggaaaaagat

SEQ ID NO: 21719 - DNA, 25 bp, Mus musculus
tggctaaaatccttcattcaccttt

SEQ ID NO: 21720 - DNA, 25 bp, Mus musculus
ctaaaatccttcattcacctttgag

SEQ ID NO: 21721 - DNA, 25 bp, Mus musculus
ttcattcacctttgagtttccatat

SEQ ID NO: 21722 - DNA, 25 bp, Mus musculus
cacctttgagtttccatatccctgc

SEQ ID NO: 21723 - DNA, 25 bp, Mus musculus
ctttgagtttccatatccctgctgt

SEQ ID NO: 21724 - DNA, 25 bp, Mus musculus
gtttccatatccctgctgttaacaa

SEQ ID NO: 21725 - DNA, 25 bp, Mus musculus
tccatatccctgctgttaacaaata

SEQ ID NO: 21726 - DNA, 25 bp, Mus musculus
atatccctgctgttaacaaataatg

SEQ ID NO: 21727 - DNA, 25 bp, Mus musculus
cagctgccgacagtccgacagtccg

SEQ ID NO: 21728 - DNA, 25 bp, Mus musculus
ctgccgacagtccgacagtccgggg

SEQ ID NO: 21729 - DNA, 25 bp, Mus musculus
ttgagacactgagggcccaagccaa

SEQ ID NO: 21730 - DNA, 25 bp, Mus musculus
agacactgagggcccaagccaaaga

SEQ ID NO: 21731 - DNA, 25 bp, Mus musculus
cactgagggcccaagccaaagacct

SEQ ID NO: 21732 - DNA, 25 bp, Mus musculus
tgagggcccaagccaaagacctggg

SEQ ID NO: 21733 - DNA, 25 bp, Mus musculus
gtgggttcctggccaagaagcaaag

SEQ ID NO: 21734 - DNA, 25 bp, Mus musculus
ggttcctggccaagaagcaaaggag

SEQ ID NO: 21735 - DNA, 25 bp, Mus musculus
tccaggcctcttcccaggagcaatt

SEQ ID NO: 21736 - DNA, 25 bp, Mus musculus
aggcctcttcccaggagcaattgtt

SEQ ID NO: 21737 - DNA, 25 bp, Mus musculus
cctcttcccaggagcaattgttgcc

SEQ ID NO: 21738 - DNA, 25 bp, Mus musculus
ttcctgggggccactcgcttgtctt

SEQ ID NO: 21739 - DNA, 25 bp, Mus musculus
catagcatagctgctttgatggtct

SEQ ID NO: 21740 - DNA, 25 bp, Mus musculus
agcatagctgctttgatggtcttgt

SEQ ID NO: 21741 - DNA, 25 bp, Mus musculus
atagctgctttgatggtcttgtctc

SEQ ID NO: 21742 - DNA, 25 bp, Mus musculus
agactgggattccaggggatcaact

SEQ ID NO: 21743 - DNA, 25 bp, Mus musculus
ttccaggggatcaactccttgagac

SEQ ID NO: 21744 - DNA, 25 bp, Mus musculus
gggatcaactccttgagacactgag

SEQ ID NO: 21745 - DNA, 25 bp, Mus musculus
aactccttgagacactgagggccca

SEQ ID NO: 21746 - DNA, 25 bp, Mus musculus
tccttgagacactgagggcccaagc

SEQ ID NO: 21747 - DNA, 25 bp, Mus musculus
tttcctgtccctggagggccataga

SEQ ID NO: 21748 - DNA, 25 bp, Mus musculus
ttcctgtccctggagggccatagag

SEQ ID NO: 21749 - DNA, 25 bp, Mus musculus
ttcactgatgaacttctgaatggta

SEQ ID NO: 21750 - DNA, 25 bp, Mus musculus
aaatgagatcggccagggtctgtgg

SEQ ID NO: 21751 - DNA, 25 bp, Mus musculus
aatgagatcggccagggtctgtggc

SEQ ID NO: 21752 - DNA, 25 bp, Mus musculus
atgagatcggccagggtctgtggcc

SEQ ID NO: 21753 - DNA, 25 bp, Mus musculus
tctgtggccggtacttctcaaccca

SEQ ID NO: 21754 - DNA, 25 bp, Mus musculus
ctgtggccggtacttctcaacccag

SEQ ID NO: 21755 - DNA, 25 bp, Mus musculus
gccggtacttctcaacccagggcag

SEQ ID NO: 21756 - DNA, 25 bp, Mus musculus
caggcggtcttcactgatgaacttc

SEQ ID NO: 21757 - DNA, 25 bp, Mus musculus
aggcggtcttcactgatgaacttct

SEQ ID NO: 21758 - DNA, 25 bp, Mus musculus
gcggtcttcactgatgaacttctga

SEQ ID NO: 21759 - DNA, 25 bp, Mus musculus
cggtcttcactgatgaacttctgaa

SEQ ID NO: 21760 - DNA, 25 bp, Mus musculus
ggtcttcactgatgaacttctgaat

SEQ ID NO: 21761 - DNA, 25 bp, Mus musculus
gtcttcactgatgaacttctgaatg

SEQ ID NO: 21762 - DNA, 25 bp, Mus musculus
tcttcactgatgaacttctgaatgg

SEQ ID NO: 21763 - DNA, 25 bp, Mus musculus
cttcactgatgaacttctgaatggt

SEQ ID NO: 21764 - DNA, 25 bp, Mus musculus
ggcctctccagcaacaatagcactc

SEQ ID NO: 21765 - DNA, 25 bp, Mus musculus
agcaacaatagcactctgagcgtgg

SEQ ID NO: 21766 - DNA, 25 bp, Mus musculus
actgcagagtcacctgcagatggcg

SEQ ID NO: 21767 - DNA, 25 bp, Mus musculus
gcagagtcacctgcagatggcgagg

SEQ ID NO: 21768 - DNA, 25 bp, Mus musculus
gaggttttcgctatccagctgacat

SEQ ID NO: 21769 - DNA, 25 bp, Mus musculus
ttcgctatccagctgacatcttcct

SEQ ID NO: 21770 - DNA, 25 bp, Mus musculus
atccagctgacatcttcctgagcct

SEQ ID NO: 21771 - DNA, 25 bp, Mus musculus
cagctgacatcttcctgagcctata

SEQ ID NO: 21772 - DNA, 25 bp, Mus musculus
ctgacatcttcctgagcctataccc

SEQ ID NO: 21773 - DNA, 25 bp, Mus musculus
gggcctcgcaagcacagaggtggac

SEQ ID NO: 21774 - DNA, 25 bp, Mus musculus
tcgctctctatttattcaactccag

SEQ ID NO: 21775 - DNA, 25 bp, Mus musculus
tctatttattcaactccaggggcgt

SEQ ID NO: 21776 - DNA, 25 bp, Mus musculus
tgtgcagcgaccaatgcgcatgggc

SEQ ID NO: 21777 - DNA, 25 bp, Mus musculus
gcgaccaatgcgcatgggcgccacg

SEQ ID NO: 21778 - DNA, 25 bp, Mus musculus
gtgcaatccaccgcttgcaagaagg

SEQ ID NO: 21779 - DNA, 25 bp, Mus musculus
tacaacgtgcaggaggctgagagct

SEQ ID NO: 21780 - DNA, 25 bp, Mus musculus
aacgtgcaggaggctgagagctcag

SEQ ID NO: 21781 - DNA, 25 bp, Mus musculus
gagaccccaggcactgcagagtcac

SEQ ID NO: 21782 - DNA, 25 bp, Mus musculus
accccaggcactgcagagtcacctg

SEQ ID NO: 21783 - DNA, 25 bp, Mus musculus
ccaggcactgcagagtcacctgcag

SEQ ID NO: 21784 - DNA, 25 bp, Mus musculus
aggggtcgccatgatccgattcatc

SEQ ID NO: 21785 - DNA, 25 bp, Mus musculus
gggtcgccatgatccgattcatcct

SEQ ID NO: 21786 - DNA, 25 bp, Mus musculus
cgcctggccaagtggtacatgcagt

SEQ ID NO: 21787 - DNA, 25 bp, Mus musculus
acatgcagttcgatgacgacgagaa

SEQ ID NO: 21788 - DNA, 25 bp, Mus musculus
tggagtcccggaatttcagaatcac

SEQ ID NO: 21789 - DNA, 25 bp, Mus musculus
gaatttcagaatcacctaccacggt

SEQ ID NO: 21790 - DNA, 25 bp, Mus musculus
tggctcctacttctcaatctccggg

SEQ ID NO: 21791 - DNA, 25 bp, Mus musculus
gaaggtcaccgccacaaatctggcc

SEQ ID NO: 21792 - DNA, 25 bp, Mus musculus
caccgccacaaatctggccaatttc

SEQ ID NO: 21793 - DNA, 25 bp, Mus musculus
ccgccacaaatctggccaatttcag

SEQ ID NO: 21794 - DNA, 25 bp, Mus musculus
gccacaaatctggccaatttcaggg

SEQ ID NO: 21795 - DNA, 25 bp, Mus musculus
cacaaatctggccaatttcagggca

SEQ ID NO: 21796 - DNA, 25 bp, Mus musculus
gtcgccatgatccgattcatcctta

SEQ ID NO: 21797 - DNA, 25 bp, Mus musculus
caaatctggccaatttcagggcaat

SEQ ID NO: 21798 - DNA, 25 bp, Mus musculus
ccatgatccgattcatccttatcca

SEQ ID NO: 21799 - DNA, 25 bp, Mus musculus
atgatccgattcatccttatccaga

SEQ ID NO: 21800 - DNA, 25 bp, Mus musculus
gatccgattcatccttatccagaac

SEQ ID NO: 21801 - DNA, 25 bp, Mus musculus
atccttatccagaaccgggcaggca

SEQ ID NO: 21802 - DNA, 25 bp, Mus musculus
ccttatccagaaccgggcaggcaag

SEQ ID NO: 21803 - DNA, 25 bp, Mus musculus
gcaagacgcgcctggccaagtggta

SEQ ID NO: 21804 - DNA, 25 bp, Mus musculus
cgcgcctggccaagtggtacatgca

SEQ ID NO: 21805 - DNA, 25 bp, Mus musculus
accatcaggagtgccgagcacacca

SEQ ID NO: 21806 - DNA, 25 bp, Mus musculus
catcaggagtgccgagcacaccaac

SEQ ID NO: 21807 - DNA, 25 bp, Mus musculus
aacttcaatatcagctaccgacgct

SEQ ID NO: 21808 - DNA, 25 bp, Mus musculus
acgctacgcttgcctctacttctgc

SEQ ID NO: 21809 - DNA, 25 bp, Mus musculus
gctacgcttgcctctacttctgcat

SEQ ID NO: 21810 - DNA, 25 bp, Mus musculus
cttgcctctacttctgcatctgcgt

SEQ ID NO: 21811 - DNA, 25 bp, Mus musculus
cctctacttctgcatctgcgtggat

SEQ ID NO: 21812 - DNA, 25 bp, Mus musculus
tacttctgcatctgcgtggatgtca

SEQ ID NO: 21813 - DNA, 25 bp, Mus musculus
cttctgcatctgcgtggatgtcaac

SEQ ID NO: 21814 - DNA, 25 bp, Mus musculus
tgcatctgcgtggatgtcaacgaca

SEQ ID NO: 21815 - DNA, 25 bp, Mus musculus
aactagccgatctctaaggcatcca

SEQ ID NO: 21816 - DNA, 25 bp, Mus musculus
ctagccgatctctaaggcatccaca

SEQ ID NO: 21817 - DNA, 25 bp, Mus musculus
gagtgccgagcacaccaacgatgtg

SEQ ID NO: 21818 - DNA, 25 bp, Mus musculus
agccgatctctaaggcatccacaac

SEQ ID NO: 21819 - DNA, 25 bp, Mus musculus
gtgccgagcacaccaacgatgtgga

SEQ ID NO: 21820 - DNA, 25 bp, Mus musculus
cgagcacaccaacgatgtggagttc

SEQ ID NO: 21821 - DNA, 25 bp, Mus musculus
cacaccaacgatgtggagttcccga

SEQ ID NO: 21822 - DNA, 25 bp, Mus musculus
gtggagttcccgaacttcaatatca

SEQ ID NO: 21823 - DNA, 25 bp, Mus musculus
ggagttcccgaacttcaatatcagc

SEQ ID NO: 21824 - DNA, 25 bp, Mus musculus
agttcccgaacttcaatatcagcta

SEQ ID NO: 21825 - DNA, 25 bp, Mus musculus
cccgaacttcaatatcagctaccga

SEQ ID NO: 21826 - DNA, 25 bp, Mus musculus
agactcgctcaacggtggaaatggc

SEQ ID NO: 21827 - DNA, 25 bp, Mus musculus
atggctccggcgaaaggtccgagag

SEQ ID NO: 21828 - DNA, 25 bp, Mus musculus
gcagagaccccaaagagtgtagccc

SEQ ID NO: 21829 - DNA, 25 bp, Mus musculus
aagagtgtagccccttatgactgga

SEQ ID NO: 21830 - DNA, 25 bp, Mus musculus
gagtgtagccccttatgactggagc

SEQ ID NO: 21831 - DNA, 25 bp, Mus musculus
gtagccccttatgactggagctgta

SEQ ID NO: 21832 - DNA, 25 bp, Mus musculus
ccccttatgactggagctgtagaga

SEQ ID NO: 21833 - DNA, 25 bp, Mus musculus
ccttatgactggagctgtagagaga

SEQ ID NO: 21834 - DNA, 25 bp, Mus musculus
atgactggagctgtagagagagttt

SEQ ID NO: 21835 - DNA, 25 bp, Mus musculus
agttttgcgcatccctgcgaaattc

SEQ ID NO: 21836 - DNA, 25 bp, Mus musculus
ttttgcgcatccctgcgaaattcta

SEQ ID NO: 21837 - DNA, 25 bp, Mus musculus
gcgcatccctgcgaaattctataac

SEQ ID NO: 21838 - DNA, 25 bp, Mus musculus
agactacatggaatctctctcaagc

SEQ ID NO: 21839 - DNA, 25 bp, Mus musculus
gcatccctgcgaaattctataacta

SEQ ID NO: 21840 - DNA, 25 bp, Mus musculus
tacatggaatctctctcaagcgaac

SEQ ID NO: 21841 - DNA, 25 bp, Mus musculus
catggaatctctctcaagcgaactt

SEQ ID NO: 21842 - DNA, 25 bp, Mus musculus
tggaatctctctcaagcgaacttgt

SEQ ID NO: 21843 - DNA, 25 bp, Mus musculus
gaatctctctcaagcgaacttgtgg

SEQ ID NO: 21844 - DNA, 25 bp, Mus musculus
ctctctcaagcgaacttgtggagca

SEQ ID NO: 21845 - DNA, 25 bp, Mus musculus
ctctcaagcgaacttgtggagcaga

SEQ ID NO: 21846 - DNA, 25 bp, Mus musculus
ctcaagcgaacttgtggagcagaga

SEQ ID NO: 21847 - DNA, 25 bp, Mus musculus
ctgttgtcggacttcactgagaaca

SEQ ID NO: 21848 - DNA, 25 bp, Mus musculus
agctcagcaaacatcctgttctacc

SEQ ID NO: 21849 - DNA, 25 bp, Mus musculus
ttgatttaagctttcctgttgagtg

SEQ ID NO: 21850 - DNA, 25 bp, Mus musculus
taagctttcctgttgagtgacaaag

SEQ ID NO: 21851 - DNA, 25 bp, Mus musculus
aattttgatgtcactgctgttataa

SEQ ID NO: 21852 - DNA, 25 bp, Mus musculus
gatgtcactgctgttataaatgcag

SEQ ID NO: 21853 - DNA, 25 bp, Mus musculus
gaaattcattctctaggaagtcaac

SEQ ID NO: 21854 - DNA, 25 bp, Mus musculus
cattctctaggaagtcaactcatgc

SEQ ID NO: 21855 - DNA, 25 bp, Mus musculus
acaagttgctgtctcgtgattgctt

SEQ ID NO: 21856 - DNA, 25 bp, Mus musculus
tgctgtctcgtgattgcttaatgga

SEQ ID NO: 21857 - DNA, 25 bp, Mus musculus
actctttatttggaccatgaagttg

SEQ ID NO: 21858 - DNA, 25 bp, Mus musculus
tatttggaccatgaagttgaatgcc

SEQ ID NO: 21859 - DNA, 25 bp, Mus musculus
gcaaacatcctgttctacccagtcc

SEQ ID NO: 21860 - DNA, 25 bp, Mus musculus
ccagtccagtgccagtaaacagact

SEQ ID NO: 21861 - DNA, 25 bp, Mus musculus
cagtaaacagactgacctttgtgga

SEQ ID NO: 21862 - DNA, 25 bp, Mus musculus
tgacctttgtggacagttgtgagga

SEQ ID NO: 21863 - DNA, 25 bp, Mus musculus
ttcacgagggaacctctgaagaagt

SEQ ID NO: 21864 - DNA, 25 bp, Mus musculus
ttatgaggtttgggctgcagatgtg

SEQ ID NO: 21865 - DNA, 25 bp, Mus musculus
gatgacagagccctttgtggaaagt

SEQ ID NO: 21866 - DNA, 25 bp, Mus musculus
agagccctttgtggaaagtgtcaga

SEQ ID NO: 21867 - DNA, 25 bp, Mus musculus
caagccatctttgataacaccacta

SEQ ID NO: 21868 - DNA, 25 bp, Mus musculus
gataacaccactagtctgactgatg

SEQ ID NO: 21869 - DNA, 25 bp, Mus musculus
cccactagccttcagaactctatct

SEQ ID NO: 21870 - DNA, 25 bp, Mus musculus
agccttcagaactctatctcagcat

SEQ ID NO: 21871 - DNA, 25 bp, Mus musculus
cagaactctatctcagcatgagctc

SEQ ID NO: 21872 - DNA, 25 bp, Mus musculus
tctatctcagcatgagctctgcatt

SEQ ID NO: 21873 - DNA, 25 bp, Mus musculus
tgagctctgcatttgagcacacagg

SEQ ID NO: 21874 - DNA, 25 bp, Mus musculus
ctgcatttgagcacacagggtcatg

SEQ ID NO: 21875 - DNA, 25 bp, Mus musculus
ttgagcacacagggtcatgcagttt

SEQ ID NO: 21876 - DNA, 25 bp, Mus musculus
atctgaagcccacagtgattcttca

SEQ ID NO: 21877 - DNA, 25 bp, Mus musculus
agcccacagtgattcttcagaacat

SEQ ID NO: 21878 - DNA, 25 bp, Mus musculus
cataaagaccgctgaatgaatggtc

SEQ ID NO: 21879 - DNA, 25 bp, Mus musculus
accactagtctgactgatgaacacc

SEQ ID NO: 21880 - DNA, 25 bp, Mus musculus
atggtcggtccatgaccagtaggag

SEQ ID NO: 21881 - DNA, 25 bp, Mus musculus
ctgggcttcactgagtctcagatcg

SEQ ID NO: 21882 - DNA, 25 bp, Mus musculus
taccaaatgcttcagaagtggctga

SEQ ID NO: 21883 - DNA, 25 bp, Mus musculus
ttggcccaggcacttcaccaatgtt

SEQ ID NO: 21884 - DNA, 25 bp, Mus musculus
cttcaccaatgttgcaggatagacc

SEQ ID NO: 21885 - DNA, 25 bp, Mus musculus
aaccacttgattcgtgccagccaga

SEQ ID NO: 21886 - DNA, 25 bp, Mus musculus
ttgattcgtgccagccagagctaag

SEQ ID NO: 21887 - DNA, 25 bp, Mus musculus
cgtgccagccagagctaagcctggg

SEQ ID NO: 21888 - DNA, 25 bp, Mus musculus
ggagcccagtggcaatattgccaac

SEQ ID NO: 21889 - DNA, 25 bp, Mus musculus
tgccaacaagactacctactttgag

SEQ ID NO: 21890 - DNA, 25 bp, Mus musculus
cagcacctatcgctgtagctatcag

SEQ ID NO: 21891 - DNA, 25 bp, Mus musculus
cacctatcgctgtagctatcagccc

SEQ ID NO: 21892 - DNA, 25 bp, Mus musculus
ctatcgctgtagctatcagcccacc

SEQ ID NO: 21893 - DNA, 25 bp, Mus musculus
tagctatcagcccaccatggagggt

SEQ ID NO: 21894 - DNA, 25 bp, Mus musculus
tgtccatacagtacatgtcaccttc

SEQ ID NO: 21895 - DNA, 25 bp, Mus musculus
ccatacagtacatgtcaccttcgcc

SEQ ID NO: 21896 - DNA, 25 bp, Mus musculus
tagcccctacactgtcactgttggc

SEQ ID NO: 21897 - DNA, 25 bp, Mus musculus
cccctacactgtcactgttggccaa

SEQ ID NO: 21898 - DNA, 25 bp, Mus musculus
cactgttggccaagcctgtaaccca

SEQ ID NO: 21899 - DNA, 25 bp, Mus musculus
tgttggccaagcctgtaacccagct

SEQ ID NO: 21900 - DNA, 25 bp, Mus musculus
caagactacctactttgagatcttc

SEQ ID NO: 21901 - DNA, 25 bp, Mus musculus
gactacctactttgagatcttcact

SEQ ID NO: 21902 - DNA, 25 bp, Mus musculus
tacctactttgagatcttcactgca

SEQ ID NO: 21903 - DNA, 25 bp, Mus musculus
ctttgagatcttcactgcaggagct

SEQ ID NO: 21904 - DNA, 25 bp, Mus musculus
tgagatcttcactgcaggagctggc

SEQ ID NO: 21905 - DNA, 25 bp, Mus musculus
agttgtcatccaggaccctacagga

SEQ ID NO: 21906 - DNA, 25 bp, Mus musculus
catccaggaccctacaggacagaaa

SEQ ID NO: 21907 - DNA, 25 bp, Mus musculus
ggaccctacaggacagaaaggcaca

SEQ ID NO: 21908 - DNA, 25 bp, Mus musculus
cttccttctgctttacagtcgtcca

SEQ ID NO: 21909 - DNA, 25 bp, Mus musculus
tctgctttacagtcgtccaggcagc

SEQ ID NO: 21910 - DNA, 25 bp, Mus musculus
tatattccaccagattgtacccgaa

SEQ ID NO: 21911 - DNA, 25 bp, Mus musculus
acccgaaggcatgttctgggcagat

SEQ ID NO: 21912 - DNA, 25 bp, Mus musculus
aggcatgttctgggcagatgacata

SEQ ID NO: 21913 - DNA, 25 bp, Mus musculus
ggccaccaaacaagaggccacccat

SEQ ID NO: 21914 - DNA, 25 bp, Mus musculus
tgggccattccccactgtgggcctc

SEQ ID NO: 21915 - DNA, 25 bp, Mus musculus
cactgtgggcctcaaccttgttgct

SEQ ID NO: 21916 - DNA, 25 bp, Mus musculus
gggcctcaaccttgttgctgactga

SEQ ID NO: 21917 - DNA, 25 bp, Mus musculus
tgttgctgactgagatctcgttgca

SEQ ID NO: 21918 - DNA, 25 bp, Mus musculus
agatctcgttgcataagatcccttt

SEQ ID NO: 21919 - DNA, 25 bp, Mus musculus
atgccctccaatccaaggggcaatt

SEQ ID NO: 21920 - DNA, 25 bp, Mus musculus
ttacagtcgtccaggcagctgcagc

SEQ ID NO: 21921 - DNA, 25 bp, Mus musculus
cgacataaacgcccacgatggtcag

SEQ ID NO: 21922 - DNA, 25 bp, Mus musculus
atcggaacagctctggacattccaa

SEQ ID NO: 21923 - DNA, 25 bp, Mus musculus
ctggacattccaaggacttattgct

SEQ ID NO: 21924 - DNA, 25 bp, Mus musculus
attccaaggacttattgcttcagtc

SEQ ID NO: 21925 - DNA, 25 bp, Mus musculus
aggacttattgcttcagtcttccag

SEQ ID NO: 21926 - DNA, 25 bp, Mus musculus
gtacttacaacttatattccaccag

SEQ ID NO: 21927 - DNA, 25 bp, Mus musculus
acaacttatattccaccagattgta

SEQ ID NO: 21928 - DNA, 25 bp, Mus musculus
ttttctctatgaagagagtgaggtg

SEQ ID NO: 21929 - DNA, 25 bp, Mus musculus
aacctgagagacatctctggaggaa

SEQ ID NO: 21930 - DNA, 25 bp, Mus musculus
tgctgagagccaggccacaatcttt

SEQ ID NO: 21931 - DNA, 25 bp, Mus musculus
gagccaggccacaatctttctataa

SEQ ID NO: 21932 - DNA, 25 bp, Mus musculus
cagattctgtcttttcattaagata

SEQ ID NO: 21933 - DNA, 25 bp, Mus musculus
tcattaccaggcatacctcctgcct

SEQ ID NO: 21934 - DNA, 25 bp, Mus musculus
cctgcctctgtgcctcataggcata

SEQ ID NO: 21935 - DNA, 25 bp, Mus musculus
cctcataggcatacacaagccataa

SEQ ID NO: 21936 - DNA, 25 bp, Mus musculus
aggcatacacaagccataagggcat

SEQ ID NO: 21937 - DNA, 25 bp, Mus musculus
acacaagccataagggcatcatgat

SEQ ID NO: 21938 - DNA, 25 bp, Mus musculus
atagactagcgtcaaaccagatgtg

SEQ ID NO: 21939 - DNA, 25 bp, Mus musculus
agatgtggcaactcctggctcttgg

SEQ ID NO: 21940 - DNA, 25 bp, Mus musculus
cttctttataaccatatgataggat

SEQ ID NO: 21941 - DNA, 25 bp, Mus musculus
tcttggcctacgatctgtcttcaag

SEQ ID NO: 21942 - DNA, 25 bp, Mus musculus
ctcttgattcaaacaacacatctga

SEQ ID NO: 21943 - DNA, 25 bp, Mus musculus
attcaaacaacacatctgagaactc

SEQ ID NO: 21944 - DNA, 25 bp, Mus musculus
acaacacatctgagaactcactagg

SEQ ID NO: 21945 - DNA, 25 bp, Mus musculus
agaactcactaggcttcagtgccta

SEQ ID NO: 21946 - DNA, 25 bp, Mus musculus
cactaggcttcagtgcctactaaat

SEQ ID NO: 21947 - DNA, 25 bp, Mus musculus
gcttcagtgcctactaaatgctgag

SEQ ID NO: 21948 - DNA, 25 bp, Mus musculus
gtgcctactaaatgctgagagccag

SEQ ID NO: 21949 - DNA, 25 bp, Mus musculus
ccgcatgggcactctgctgagccgg

SEQ ID NO: 21950 - DNA, 25 bp, Mus musculus
tctgctgagccggctgagcgtgcag

SEQ ID NO: 21951 - DNA, 25 bp, Mus musculus
ccagcactatggatgccgggtccaa

SEQ ID NO: 21952 - DNA, 25 bp, Mus musculus
ctatggatgccgggtccaactgggc

SEQ ID NO: 21953 - DNA, 25 bp, Mus musculus
atgccgggtccaactgggcggatca

SEQ ID NO: 21954 - DNA, 25 bp, Mus musculus
catcatgtctggctacgagttcatc

SEQ ID NO: 21955 - DNA, 25 bp, Mus musculus
catgtctggctacgagttcatccac

SEQ ID NO: 21956 - DNA, 25 bp, Mus musculus
tggctacgagttcatccacaagttg

SEQ ID NO: 21957 - DNA, 25 bp, Mus musculus
cgagttcatccacaagttgactgga

SEQ ID NO: 21958 - DNA, 25 bp, Mus musculus
catccacaagttgactggagaggat

SEQ ID NO: 21959 - DNA, 25 bp, Mus musculus
ccacaagttgactggagaggatgtg

SEQ ID NO: 21960 - DNA, 25 bp, Mus musculus
tggaatcactgtacctctaattaca

SEQ ID NO: 21961 - DNA, 25 bp, Mus musculus
gcgtctcaagagccccgaggcactg

SEQ ID NO: 21962 - DNA, 25 bp, Mus musculus
cactgtacctctaattacaagtaca

SEQ ID NO: 21963 - DNA, 25 bp, Mus musculus
tctcaagagccccgaggcactgagc

SEQ ID NO: 21964 - DNA, 25 bp, Mus musculus
ccaggtgctccaggcctatgacttc

SEQ ID NO: 21965 - DNA, 25 bp, Mus musculus
ggtgctccaggcctatgacttctac

SEQ ID NO: 21966 - DNA, 25 bp, Mus musculus
gctccaggcctatgacttctactac

SEQ ID NO: 21967 - DNA, 25 bp, Mus musculus
ctatgacttctactaccttttccag

SEQ ID NO: 21968 - DNA, 25 bp, Mus musculus
tgacttctactaccttttccagcac

SEQ ID NO: 21969 - DNA, 25 bp, Mus musculus
ctaccttttccagcactatggatgc

SEQ ID NO: 21970 - DNA, 25 bp, Mus musculus
ttcagtcgcagttcccacctgcggt

SEQ ID NO: 21971 - DNA, 25 bp, Mus musculus
ttcatttgtagctccaatctctaca

SEQ ID NO: 21972 - DNA, 25 bp, Mus musculus
ctccaagtccacttgagagtccaca

SEQ ID NO: 21973 - DNA, 25 bp, Mus musculus
gtccacttgagagtccacacggggg

SEQ ID NO: 21974 - DNA, 25 bp, Mus musculus
cagctacagtcccatcagagagtcc

SEQ ID NO: 21975 - DNA, 25 bp, Mus musculus
ctacagtcccatcagagagtccaca

SEQ ID NO: 21976 - DNA, 25 bp, Mus musculus
aatcttataattcatcacagaatcc

SEQ ID NO: 21977 - DNA, 25 bp, Mus musculus
attcatcacagaatccacagcagtg

SEQ ID NO: 21978 - DNA, 25 bp, Mus musculus
catcacagaatccacagcagtggta

SEQ ID NO: 21979 - DNA, 25 bp, Mus musculus
atccacagcagtggtaaaccttaca

SEQ ID NO: 21980 - DNA, 25 bp, Mus musculus
atcaaggagtccactcaggaaaaat

SEQ ID NO: 21981 - DNA, 25 bp, Mus musculus
gagtccactcaggaaaaatgttcta

SEQ ID NO: 21982 - DNA, 25 bp, Mus musculus
atttgtagctccaatctctacatcc

SEQ ID NO: 21983 - DNA, 25 bp, Mus musculus
tgtagctccaatctctacatccatc

SEQ ID NO: 21984 - DNA, 25 bp, Mus musculus
tccaatctctacatccatcagcgag

SEQ ID NO: 21985 - DNA, 25 bp, Mus musculus
aatctctacatccatcagcgagtcc

SEQ ID NO: 21986 - DNA, 25 bp, Mus musculus
aaatgcgtggactgcgggaaagaat

SEQ ID NO: 21987 - DNA, 25 bp, Mus musculus
tcgagtcttcaggcccatcagggca

SEQ ID NO: 21988 - DNA, 25 bp, Mus musculus
cttcaggcccatcagggcattcaca

SEQ ID NO: 21989 - DNA, 25 bp, Mus musculus
tatactctgaattcaaatctccaag

SEQ ID NO: 21990 - DNA, 25 bp, Mus musculus
ccccacgaggacatggccatagact

SEQ ID NO: 21991 - DNA, 25 bp, Mus musculus
atagactacgagaacttctatacct

SEQ ID NO: 21992 - DNA, 25 bp, Mus musculus
gttgcctggcctcacaaacaccaag

SEQ ID NO: 21993 - DNA, 25 bp, Mus musculus
cacaaacaccaagagcccaggtatg

SEQ ID NO: 21994 - DNA, 25 bp, Mus musculus
caccaagagcccaggtatggctctc

SEQ ID NO: 21995 - DNA, 25 bp, Mus musculus
aggatctggccacagggacaggact

SEQ ID NO: 21996 - DNA, 25 bp, Mus musculus
acccccatgcagcgtggctctgatc

SEQ ID NO: 21997 - DNA, 25 bp, Mus musculus
atgcagcgtggctctgatctgaatt

SEQ ID NO: 21998 - DNA, 25 bp, Mus musculus
ctgaattacgccctgcttctctcct

SEQ ID NO: 21999 - DNA, 25 bp, Mus musculus
ctgcttctctcctgcttcatgaggt

SEQ ID NO: 22000 - DNA, 25 bp, Mus musculus
tacagacgtgaaccatctatggaca

SEQ ID NO: 22001 - DNA, 25 bp, Mus musculus
cgtgaaccatctatggacacaaagg

SEQ ID NO: 22002 - DNA, 25 bp, Mus musculus
tacgagaacttctatacctatgccc

SEQ ID NO: 22003 - DNA, 25 bp, Mus musculus
aacttctatacctatgcccagctgc

SEQ ID NO: 22004 - DNA, 25 bp, Mus musculus
tatacctatgcccagctgccggtca

SEQ ID NO: 22005 - DNA, 25 bp, Mus musculus
acccccgatgtcttcatagtgccgt

SEQ ID NO: 22006 - DNA, 25 bp, Mus musculus
gatgtcttcatagtgccgtccgagc

SEQ ID NO: 22007 - DNA, 25 bp, Mus musculus
gtgccgtccgagctgagatactttg

SEQ ID NO: 22008 - DNA, 25 bp, Mus musculus
tgtgtgaatcctgggcggctcacca

SEQ ID NO: 22009 - DNA, 25 bp, Mus musculus
atctgagtcctcagcctggttgcct

SEQ ID NO: 22010 - DNA, 25 bp, Mus musculus
cctgtccgctcatgctactgcttta

SEQ ID NO: 22011 - DNA, 25 bp, Mus musculus
cgctcatgctactgctttactgggc

SEQ ID NO: 22012 - DNA, 25 bp, Mus musculus
cttcccgcagaaggagaggcgccaa

SEQ ID NO: 22013 - DNA, 25 bp, Mus musculus
tgtgttggacgcctttcttcgtggt

SEQ ID NO: 22014 - DNA, 25 bp, Mus musculus
cgcctttcttcgtggtgcacatcac

SEQ ID NO: 22015 - DNA, 25 bp, Mus musculus
ctttcttcgtggtgcacatcacgcg

SEQ ID NO: 22016 - DNA, 25 bp, Mus musculus
tcgtggtgcacatcacgcgggcgct

SEQ ID NO: 22017 - DNA, 25 bp, Mus musculus
tggtcagtgccgtcacctggctagg

SEQ ID NO: 22018 - DNA, 25 bp, Mus musculus
ccatcttcaacgcggagtttcgaag

SEQ ID NO: 22019 - DNA, 25 bp, Mus musculus
tcaacgcggagtttcgaagtgtctt

SEQ ID NO: 22020 - DNA, 25 bp, Mus musculus
ttcgaagtgtcttccgcaagactct

SEQ ID NO: 22021 - DNA, 25 bp, Mus musculus
gtctccgctgctgaaagaaccgctg

SEQ ID NO: 22022 - DNA, 25 bp, Mus musculus
tgctactgctttactgggccacttt

SEQ ID NO: 22023 - DNA, 25 bp, Mus musculus
tactgctttactgggccactttccg

SEQ ID NO: 22024 - DNA, 25 bp, Mus musculus
tgctttactgggccactttccgcgg

SEQ ID NO: 22025 - DNA, 25 bp, Mus musculus
ctcagggtcccttcttcccagactg

SEQ ID NO: 22026 - DNA, 25 bp, Mus musculus
actccagcaggccggagtcagagct

SEQ ID NO: 22027 - DNA, 25 bp, Mus musculus
cggagtcagagctctctcagagacc

SEQ ID NO: 22028 - DNA, 25 bp, Mus musculus
cagagctctctcagagaccctgcag

SEQ ID NO: 22029 - DNA, 25 bp, Mus musculus
cgtcttcccgcagaaggagaggcgc

SEQ ID NO: 22030 - DNA, 25 bp, Mus musculus
tgaagcatctagttgtgaggagttt

SEQ ID NO: 22031 - DNA, 25 bp, Mus musculus
agatctaattcaaatactgtgtgaa

SEQ ID NO: 22032 - DNA, 25 bp, Mus musculus
ggtcttggccaatagcacagaactt

SEQ ID NO: 22033 - DNA, 25 bp, Mus musculus
caatagcacagaacttcccagcaaa

SEQ ID NO: 22034 - DNA, 25 bp, Mus musculus
tagcacagaacttcccagcaaactc

SEQ ID NO: 22035 - DNA, 25 bp, Mus musculus
cacagaacttcccagcaaactccag

SEQ ID NO: 22036 - DNA, 25 bp, Mus musculus
agaacttcccagcaaactccagctt

SEQ ID NO: 22037 - DNA, 25 bp, Mus musculus
acttcccagcaaactccagcttatg

SEQ ID NO: 22038 - DNA, 25 bp, Mus musculus
tcccagcaaactccagcttatggaa

SEQ ID NO: 22039 - DNA, 25 bp, Mus musculus
ggaaaagcaccaatctgacttgaga

SEQ ID NO: 22040 - DNA, 25 bp, Mus musculus
aaagcaccaatctgacttgagaaag

SEQ ID NO: 22041 - DNA, 25 bp, Mus musculus
gcaccaatctgacttgagaaagctg

SEQ ID NO: 22042 - DNA, 25 bp, Mus musculus
tctaattcaaatactgtgtgaaagg

SEQ ID NO: 22043 - DNA, 25 bp, Mus musculus
ggctgatgctggtgctagtgtctgc

SEQ ID NO: 22044 - DNA, 25 bp, Mus musculus
tgctggtgctagtgtctgctccctg

SEQ ID NO: 22045 - DNA, 25 bp, Mus musculus
tgctagtgtctgctccctgcttcta

SEQ ID NO: 22046 - DNA, 25 bp, Mus musculus
taggcctgagtgtttgctgatggtc

SEQ ID NO: 22047 - DNA, 25 bp, Mus musculus
gcctgagtgtttgctgatggtcttg

SEQ ID NO: 22048 - DNA, 25 bp, Mus musculus
gtgtttgctgatggtcttggccaat

SEQ ID NO: 22049 - DNA, 25 bp, Mus musculus
tttgctgatggtcttggccaatagc

SEQ ID NO: 22050 - DNA, 25 bp, Mus musculus
cctgtttgtcaccagcctcgatgcc

SEQ ID NO: 22051 - DNA, 25 bp, Mus musculus
cagcctcgatgccactgtcaaccat

SEQ ID NO: 22052 - DNA, 25 bp, Mus musculus
ctgcaagcaagtccctttcaccaag

SEQ ID NO: 22053 - DNA, 25 bp, Mus musculus
gcaagtccctttcaccaagaccact

SEQ ID NO: 22054 - DNA, 25 bp, Mus musculus
acctcgcctgcaaacgggtctgcgc

SEQ ID NO: 22055 - DNA, 25 bp, Mus musculus
cctgcaaacgggtctgcgccactct

SEQ ID NO: 22056 - DNA, 25 bp, Mus musculus
aacgggtctgcgccactctctcaag

SEQ ID NO: 22057 - DNA, 25 bp, Mus musculus
gccagcaacttcaagaacaactcct

SEQ ID NO: 22058 - DNA, 25 bp, Mus musculus
cactaagccaggccctttcagcagc

SEQ ID NO: 22059 - DNA, 25 bp, Mus musculus
tgctgtccccaggagcctcaggact

SEQ ID NO: 22060 - DNA, 25 bp, Mus musculus
ctcctaggactggctccaaggacac

SEQ ID NO: 22061 - DNA, 25 bp, Mus musculus
gctccaaggacacctccatgggggt

SEQ ID NO: 22062 - DNA, 25 bp, Mus musculus
cgatgccactgtcaaccatgtgtcc

SEQ ID NO: 22063 - DNA, 25 bp, Mus musculus
catccattcctgggcctctggcaat

SEQ ID NO: 22064 - DNA, 25 bp, Mus musculus
caaccatgtgtccctcatcctgagc

SEQ ID NO: 22065 - DNA, 25 bp, Mus musculus
caatcccattctctatggcttcctc

SEQ ID NO: 22066 - DNA, 25 bp, Mus musculus
cattctctatggcttcctctctgac

SEQ ID NO: 22067 - DNA, 25 bp, Mus musculus
ctctttccagcgggttctgtgcctg

SEQ ID NO: 22068 - DNA, 25 bp, Mus musculus
gcgctgctgtctcctggaaacaact

SEQ ID NO: 22069 - DNA, 25 bp, Mus musculus
ctatgccactgctctcaaaagcaga

SEQ ID NO: 22070 - DNA, 25 bp, Mus musculus
ccagcaggagcccgtgcaagcagaa

SEQ ID NO: 22071 - DNA, 25 bp, Mus musculus
agtggaacatctctgtcggaagaga

SEQ ID NO: 22072 - DNA, 25 bp, Mus musculus
tggaacatctctgtcggaagagaga

SEQ ID NO: 22073 - DNA, 25 bp, Mus musculus
agatgcttttgagctgtttgatacc

SEQ ID NO: 22074 - DNA, 25 bp, Mus musculus
ctgtttgataccgacaaagaccaag

SEQ ID NO: 22075 - DNA, 25 bp, Mus musculus
cgacaaagaccaagccatagattat

SEQ ID NO: 22076 - DNA, 25 bp, Mus musculus
gacaaagaccaagccatagattatc

SEQ ID NO: 22077 - DNA, 25 bp, Mus musculus
ccaagccatagattatcatgaatta

SEQ ID NO: 22078 - DNA, 25 bp, Mus musculus
atgagagccttgggctttgatgtga

SEQ ID NO: 22079 - DNA, 25 bp, Mus musculus
gagagccttgggctttgatgtgaaa

SEQ ID NO: 22080 - DNA, 25 bp, Mus musculus
agccttgggctttgatgtgaaaaag

SEQ ID NO: 22081 - DNA, 25 bp, Mus musculus
gccttgggctttgatgtgaaaaagg

SEQ ID NO: 22082 - DNA, 25 bp, Mus musculus
agaagccactggcaagatcacattt

SEQ ID NO: 22083 - DNA, 25 bp, Mus musculus
ggaacatctctgtcggaagagagaa

SEQ ID NO: 22084 - DNA, 25 bp, Mus musculus
gaagccactggcaagatcacatttg

SEQ ID NO: 22085 - DNA, 25 bp, Mus musculus
acatctctgtcggaagagagaatga

SEQ ID NO: 22086 - DNA, 25 bp, Mus musculus
atctctgtcggaagagagaatgagt

SEQ ID NO: 22087 - DNA, 25 bp, Mus musculus
atgagtttagctctgagaggtgagc

SEQ ID NO: 22088 - DNA, 25 bp, Mus musculus
agtttagctctgagaggtgagcttg

SEQ ID NO: 22089 - DNA, 25 bp, Mus musculus
tttagctctgagaggtgagcttgta

SEQ ID NO: 22090 - DNA, 25 bp, Mus musculus
agctctgagaggtgagcttgtagta

SEQ ID NO: 22091 - DNA, 25 bp, Mus musculus
agagctctctgaagaacagaagcaa

SEQ ID NO: 22092 - DNA, 25 bp, Mus musculus
ggacacagctactactacatctcca

SEQ ID NO: 22093 - DNA, 25 bp, Mus musculus
tactacatctccaaacctatctacc

SEQ ID NO: 22094 - DNA, 25 bp, Mus musculus
ctcttcccactggtctgggcagtat

SEQ ID NO: 22095 - DNA, 25 bp, Mus musculus
ccactggtctgggcagtattgctcc

SEQ ID NO: 22096 - DNA, 25 bp, Mus musculus
gcagtattgctcctaccactgctgc

SEQ ID NO: 22097 - DNA, 25 bp, Mus musculus
ctaccactgctgctgctgcaatctc

SEQ ID NO: 22098 - DNA, 25 bp, Mus musculus
ctgctgctgctgcaatctcagtgag

SEQ ID NO: 22099 - DNA, 25 bp, Mus musculus
agacgccaccatgaagcctcaaaag

SEQ ID NO: 22100 - DNA, 25 bp, Mus musculus
agtttaaccagcccaactgtgccat

SEQ ID NO: 22101 - DNA, 25 bp, Mus musculus
cctccacttcagagggatggagaaa

SEQ ID NO: 22102 - DNA, 25 bp, Mus musculus
ggtccttaacctgcagtttctgcct

SEQ ID NO: 22103 - DNA, 25 bp, Mus musculus
taacctgcagtttctgcctttaagc

SEQ ID NO: 22104 - DNA, 25 bp, Mus musculus
atctccaaacctatctaccatcagg

SEQ ID NO: 22105 - DNA, 25 bp, Mus musculus
ggacctggcccattaagaggcctca

SEQ ID NO: 22106 - DNA, 25 bp, Mus musculus
atctaccatcaggaatcccagtgct

SEQ ID NO: 22107 - DNA, 25 bp, Mus musculus
catcaggaatcccagtgcttgaagc

SEQ ID NO: 22108 - DNA, 25 bp, Mus musculus
gaatcccagtgcttgaagctgaagg

SEQ ID NO: 22109 - DNA, 25 bp, Mus musculus
ggcaaaatcactcataatccccagg

SEQ ID NO: 22110 - DNA, 25 bp, Mus musculus
gtcaacccacaggagaagagactcc

SEQ ID NO: 22111 - DNA, 25 bp, Mus musculus
agactccaagcagatgacccggaag

SEQ ID NO: 22112 - DNA, 25 bp, Mus musculus
gttttgcacagcattggttacagtg

SEQ ID NO: 22113 - DNA, 25 bp, Mus musculus
tcttgaaccatcatatgctcttggg

SEQ ID NO: 22114 - DNA, 25 bp, Mus musculus
atcatatgctcttggggatatttct

SEQ ID NO: 22115 - DNA, 25 bp, Mus musculus
ttggtccctacttgtcccgtgtgcg

SEQ ID NO: 22116 - DNA, 25 bp, Mus musculus
tgtcccgtgtgcgtacataggctgg

SEQ ID NO: 22117 - DNA, 25 bp, Mus musculus
tgcgtacataggctggcattggagt

SEQ ID NO: 22118 - DNA, 25 bp, Mus musculus
gtacataggctggcattggagtcag

SEQ ID NO: 22119 - DNA, 25 bp, Mus musculus
tcagtacagtctgctcttcttcatc

SEQ ID NO: 22120 - DNA, 25 bp, Mus musculus
gtacagtctgctcttcttcatcttg

SEQ ID NO: 22121 - DNA, 25 bp, Mus musculus
cagtctgctcttcttcatcttggtc

SEQ ID NO: 22122 - DNA, 25 bp, Mus musculus
gctcttcttcatcttggtccatagc

SEQ ID NO: 22123 - DNA, 25 bp, Mus musculus
cttcttcatcttggtccatagcagt

SEQ ID NO: 22124 - DNA, 25 bp, Mus musculus
cttcatcttggtccatagcagtcac

SEQ ID NO: 22125 - DNA, 25 bp, Mus musculus
atatgctcttggggatatttctgag

SEQ ID NO: 22126 - DNA, 25 bp, Mus musculus
cttggtccatagcagtcaccagtcc

SEQ ID NO: 22127 - DNA, 25 bp, Mus musculus
cgttccatctgggtgctgaatgggt

SEQ ID NO: 22128 - DNA, 25 bp, Mus musculus
aagatgtccactttatgggagtagt

SEQ ID NO: 22129 - DNA, 25 bp, Mus musculus
atgtccactttatgggagtagttgt

SEQ ID NO: 22130 - DNA, 25 bp, Mus musculus
tagttgtttccatgaatctgctctg

SEQ ID NO: 22131 - DNA, 25 bp, Mus musculus
tttccatgaatctgctctgggctca

SEQ ID NO: 22132 - DNA, 25 bp, Mus musculus
atctgctctgggctcatgtatagct

SEQ ID NO: 22133 - DNA, 25 bp, Mus musculus
atgtatagcttggtccctacttgtc

SEQ ID NO: 22134 - DNA, 25 bp, Mus musculus
gttcccgtgcgttgagatttgattt

SEQ ID NO: 22135 - DNA, 25 bp, Mus musculus
acttgcctccgactgtagaccagcc

SEQ ID NO: 22136 - DNA, 25 bp, Mus musculus
ccgctctgcagtcttctgttaagag

SEQ ID NO: 22137 - DNA, 25 bp, Mus musculus
gttggcccagccataactcattccc

SEQ ID NO: 22138 - DNA, 25 bp, Mus musculus
ccagccataactcattcccttagca

SEQ ID NO: 22139 - DNA, 25 bp, Mus musculus
cattcccttagcaagccaaattaga

SEQ ID NO: 22140 - DNA, 25 bp, Mus musculus
aattagaattgccttctgtaaacag

SEQ ID NO: 22141 - DNA, 25 bp, Mus musculus
aacatgtgccaatttgttcctgtat

SEQ ID NO: 22142 - DNA, 25 bp, Mus musculus
taagttccttgttacaccatggtca

SEQ ID NO: 22143 - DNA, 25 bp, Mus musculus
ccttgttacaccatggtcattttct

SEQ ID NO: 22144 - DNA, 25 bp, Mus musculus
tacaccatggtcattttctagtttt

SEQ ID NO: 22145 - DNA, 25 bp, Mus musculus
cccagctcacaataaacgcatcaac

SEQ ID NO: 22146 - DNA, 25 bp, Mus musculus
tagttttacaactacaatcaagtca

SEQ ID NO: 22147 - DNA, 25 bp, Mus musculus
cacaataaacgcatcaacaaacctg

SEQ ID NO: 22148 - DNA, 25 bp, Mus musculus
tacaactacaatcaagtcattctcc

SEQ ID NO: 22149 - DNA, 25 bp, Mus musculus
taggaaactcttacactttgacact

SEQ ID NO: 22150 - DNA, 25 bp, Mus musculus
actcttacactttgacactcactgt

SEQ ID NO: 22151 - DNA, 25 bp, Mus musculus
acactttgacactcactgtgtgcga

SEQ ID NO: 22152 - DNA, 25 bp, Mus musculus
tgtgcgactcatagcatgccgctct

SEQ ID NO: 22153 - DNA, 25 bp, Mus musculus
actcatagcatgccgctctgcagtc

SEQ ID NO: 22154 - DNA, 25 bp, Mus musculus
agcatgccgctctgcagtcttctgt

SEQ ID NO: 22155 - DNA, 25 bp, Mus musculus
atgagcaagtctcttggcaatgtca

SEQ ID NO: 22156 - DNA, 25 bp, Mus musculus
gtttccttgcagggcctctatgacc

SEQ ID NO: 22157 - DNA, 25 bp, Mus musculus
ccagcagggattcccgagtgtggca

SEQ ID NO: 22158 - DNA, 25 bp, Mus musculus
ggcactgatgccctacgctttggac

SEQ ID NO: 22159 - DNA, 25 bp, Mus musculus
ctacgctttggactctgtgcctaca

SEQ ID NO: 22160 - DNA, 25 bp, Mus musculus
ctctgtgcctacacatcccaaggtc

SEQ ID NO: 22161 - DNA, 25 bp, Mus musculus
gacatcaacctggatgtgaacagga

SEQ ID NO: 22162 - DNA, 25 bp, Mus musculus
atcaacctggatgtgaacaggatcc

SEQ ID NO: 22163 - DNA, 25 bp, Mus musculus
atcctggggtaccgtcacttctgca

SEQ ID NO: 22164 - DNA, 25 bp, Mus musculus
taccgtcacttctgcaacaaactct

SEQ ID NO: 22165 - DNA, 25 bp, Mus musculus
cgtcacttctgcaacaaactctgga

SEQ ID NO: 22166 - DNA, 25 bp, Mus musculus
cacttctgcaacaaactctggaatg

SEQ ID NO: 22167 - DNA, 25 bp, Mus musculus
ttgcagggcctctatgaccaactac

SEQ ID NO: 22168 - DNA, 25 bp, Mus musculus
cagggcctctatgaccaactactga

SEQ ID NO: 22169 - DNA, 25 bp, Mus musculus
tatgaccaactactgaacagcaacc

SEQ ID NO: 22170 - DNA, 25 bp, Mus musculus
gaccaactactgaacagcaacctgg

SEQ ID NO: 22171 - DNA, 25 bp, Mus musculus
aacagcaacctggatcccagtgagg

SEQ ID NO: 22172 - DNA, 25 bp, Mus musculus
cagaaggccgactttccagcaggga

SEQ ID NO: 22173 - DNA, 25 bp, Mus musculus
gccgactttccagcagggattcccg

SEQ ID NO: 22174 - DNA, 25 bp, Mus musculus
tttccagcagggattcccgagtgtg

SEQ ID NO: 22175 - DNA, 25 bp, Mus musculus
cgggcctaggcacgatccctaatct

SEQ ID NO: 22176 - DNA, 25 bp, Mus musculus
gcctaggcacgatccctaatctcta

SEQ ID NO: 22177 - DNA, 25 bp, Mus musculus
tctgcacctgtcgcgagaccagctc

SEQ ID NO: 22178 - DNA, 25 bp, Mus musculus
cctgtcgcgagaccagctccggagt

SEQ ID NO: 22179 - DNA, 25 bp, Mus musculus
ccagctccggagtggcctcctgtta

SEQ ID NO: 22180 - DNA, 25 bp, Mus musculus
tggcctcctgttacctctgtttcta

SEQ ID NO: 22181 - DNA, 25 bp, Mus musculus
cctgttacctctgtttctactaatg

SEQ ID NO: 22182 - DNA, 25 bp, Mus musculus
acctctgtttctactaatgatgctg

SEQ ID NO: 22183 - DNA, 25 bp, Mus musculus
tctgtttctactaatgatgctggca

SEQ ID NO: 22184 - DNA, 25 bp, Mus musculus
gtttctactaatgatgctggcagac

SEQ ID NO: 22185 - DNA, 25 bp, Mus musculus
gctggtgcctggtgatttgggtaac

SEQ ID NO: 22186 - DNA, 25 bp, Mus musculus
acactacctttgctccaagaagacg

SEQ ID NO: 22187 - DNA, 25 bp, Mus musculus
taggcacgatccctaatctctaaag

SEQ ID NO: 22188 - DNA, 25 bp, Mus musculus
cctttgctccaagaagacggacagc

SEQ ID NO: 22189 - DNA, 25 bp, Mus musculus
tccctaatctctaaagcagcccctt

SEQ ID NO: 22190 - DNA, 25 bp, Mus musculus
ctaatctctaaagcagccccttgga

SEQ ID NO: 22191 - DNA, 25 bp, Mus musculus
tctaaagcagccccttggacctgcg

SEQ ID NO: 22192 - DNA, 25 bp, Mus musculus
ccttggacctgcgaccacagtctca

SEQ ID NO: 22193 - DNA, 25 bp, Mus musculus
tggacctgcgaccacagtctcacgc

SEQ ID NO: 22194 - DNA, 25 bp, Mus musculus
gaccacagtctcacgccatggatcg

SEQ ID NO: 22195 - DNA, 25 bp, Mus musculus
cacagtctcacgccatggatcgcca

SEQ ID NO: 22196 - DNA, 25 bp, Mus musculus
tgaaagcttgctggacctgctggtt

SEQ ID NO: 22197 - DNA, 25 bp, Mus musculus
aagcttgctggacctgctggttaac

SEQ ID NO: 22198 - DNA, 25 bp, Mus musculus
ctgctggcaggcacagcactgtctg

SEQ ID NO: 22199 - DNA, 25 bp, Mus musculus
ggcacagcactgtctgagatgtgaa

SEQ ID NO: 22200 - DNA, 25 bp, Mus musculus
gtgaatatcgttcctccgatgaccc

SEQ ID NO: 22201 - DNA, 25 bp, Mus musculus
cctccgatgacccttgtatgatttg

SEQ ID NO: 22202 - DNA, 25 bp, Mus musculus
ccgatgacccttgtatgatttggtt

SEQ ID NO: 22203 - DNA, 25 bp, Mus musculus
acccttgtatgatttggttatcaga

SEQ ID NO: 22204 - DNA, 25 bp, Mus musculus
tatcagaagctgtcacttgtgctgt

SEQ ID NO: 22205 - DNA, 25 bp, Mus musculus
aagctgtcacttgtgctgttcgaag

SEQ ID NO: 22206 - DNA, 25 bp, Mus musculus
tcacttgtgctgttcgaaggttgaa

SEQ ID NO: 22207 - DNA, 25 bp, Mus musculus
cgttactgtgccatttggatccttt

SEQ ID NO: 22208 - DNA, 25 bp, Mus musculus
ggacctgctggttaaccttctgaag

SEQ ID NO: 22209 - DNA, 25 bp, Mus musculus
tttggatcctttgtcttctctgccg

SEQ ID NO: 22210 - DNA, 25 bp, Mus musculus
gtttttctaagctggtgcaggtctc

SEQ ID NO: 22211 - DNA, 25 bp, Mus musculus
tttctaagctggtgcaggtctcctg

SEQ ID NO: 22212 - DNA, 25 bp, Mus musculus
tctcctgatgccttatgggaaacct

SEQ ID NO: 22213 - DNA, 25 bp, Mus musculus
gggtacaaactccaggtgagcgaga

SEQ ID NO: 22214 - DNA, 25 bp, Mus musculus
tacaaactccaggtgagcgagaatg

SEQ ID NO: 22215 - DNA, 25 bp, Mus musculus
aatgcaccttctcttggatcctggc

SEQ ID NO: 22216 - DNA, 25 bp, Mus musculus
aagcgcctgctggcaggcacagcac

SEQ ID NO: 22217 - DNA, 25 bp, Mus musculus
cacactgctcatcagcaaggtgcgt

SEQ ID NO: 22218 - DNA, 25 bp, Mus musculus
acactgctcatcagcaaggtgcgtg

SEQ ID NO: 22219 - DNA, 25 bp, Mus musculus
cgacacgcatcatgaacaccttcag

SEQ ID NO: 22220 - DNA, 25 bp, Mus musculus
gacacgcatcatgaacaccttcagc

SEQ ID NO: 22221 - DNA, 25 bp, Mus musculus
tgccttcacccaaagtgtcggacac

SEQ ID NO: 22222 - DNA, 25 bp, Mus musculus
gccttcacccaaagtgtcggacact

SEQ ID NO: 22223 - DNA, 25 bp, Mus musculus
ccttcacccaaagtgtcggacactg

SEQ ID NO: 22224 - DNA, 25 bp, Mus musculus
ttcacccaaagtgtcggacactgtg

SEQ ID NO: 22225 - DNA, 25 bp, Mus musculus
ctgtccatccaccagctagtggaga

SEQ ID NO: 22226 - DNA, 25 bp, Mus musculus
ccatccaccagctagtggagaacac

SEQ ID NO: 22227 - DNA, 25 bp, Mus musculus
catccaccagctagtggagaacaca

SEQ ID NO: 22228 - DNA, 25 bp, Mus musculus
atccaccagctagtggagaacacag

SEQ ID NO: 22229 - DNA, 25 bp, Mus musculus
cactgctcatcagcaaggtgcgtga

SEQ ID NO: 22230 - DNA, 25 bp, Mus musculus
actgctcatcagcaaggtgcgtgag

SEQ ID NO: 22231 - DNA, 25 bp, Mus musculus
tcatcagcaaggtgcgtgaggagta

SEQ ID NO: 22232 - DNA, 25 bp, Mus musculus
atcagcaaggtgcgtgaggagtacc

SEQ ID NO: 22233 - DNA, 25 bp, Mus musculus
tcagcaaggtgcgtgaggagtaccc

SEQ ID NO: 22234 - DNA, 25 bp, Mus musculus
aggagtaccccgacacgcatcatga

SEQ ID NO: 22235 - DNA, 25 bp, Mus musculus
gtaccccgacacgcatcatgaacac

SEQ ID NO: 22236 - DNA, 25 bp, Mus musculus
ccgacacgcatcatgaacaccttca

SEQ ID NO: 22237 - DNA, 25 bp, Mus musculus
gaacgaccacttggtgatgctcacg

SEQ ID NO: 22238 - DNA, 25 bp, Mus musculus
ccacttggtgatgctcacgaacgat

SEQ ID NO: 22239 - DNA, 25 bp, Mus musculus
ctcctggtccccagatgtgtgctgc

SEQ ID NO: 22240 - DNA, 25 bp, Mus musculus
gtccccagatgtgtgctgctgaaat

SEQ ID NO: 22241 - DNA, 25 bp, Mus musculus
cccagatgtgtgctgctgaaatcca

SEQ ID NO: 22242 - DNA, 25 bp, Mus musculus
ggttccaggatgccttctgtggcgc

SEQ ID NO: 22243 - DNA, 25 bp, Mus musculus
aggatgccttctgtggcgcctattt

SEQ ID NO: 22244 - DNA, 25 bp, Mus musculus
ccttctgtggcgcctatttcacttt

SEQ ID NO: 22245 - DNA, 25 bp, Mus musculus
tctgtggcgcctatttcacttttgc

SEQ ID NO: 22246 - DNA, 25 bp, Mus musculus
gtggcgcctatttcacttttgccat

SEQ ID NO: 22247 - DNA, 25 bp, Mus musculus
aaggccacgtgtatggctttggcct

SEQ ID NO: 22248 - DNA, 25 bp, Mus musculus
gctttggcctctccaactatcacca

SEQ ID NO: 22249 - DNA, 25 bp, Mus musculus
gatgctcacgaacgatggcgacctc

SEQ ID NO: 22250 - DNA, 25 bp, Mus musculus
ttggcctctccaactatcaccagct

SEQ ID NO: 22251 - DNA, 25 bp, Mus musculus
cacgaacgatggcgacctctacacc

SEQ ID NO: 22252 - DNA, 25 bp, Mus musculus
cgatggcgacctctacaccttgggt

SEQ ID NO: 22253 - DNA, 25 bp, Mus musculus
tggcgacctctacaccttgggttgt

SEQ ID NO: 22254 - DNA, 25 bp, Mus musculus
tcagctgggccgtgtacctgaatta

SEQ ID NO: 22255 - DNA, 25 bp, Mus musculus
atttgccaaccgaggtggccgtcag

SEQ ID NO: 22256 - DNA, 25 bp, Mus musculus
tcaggccttgggcgactcctggtcc

SEQ ID NO: 22257 - DNA, 25 bp, Mus musculus
cgactcctggtccccagatgtgtgc

SEQ ID NO: 22258 - DNA, 25 bp, Mus musculus
cactgcttcacacaggctatgatga

SEQ ID NO: 22259 - DNA, 25 bp, Mus musculus
ttcacacaggctatgatgagccagc

SEQ ID NO: 22260 - DNA, 25 bp, Mus musculus
acagccaactacctaggctgggcac

SEQ ID NO: 22261 - DNA, 25 bp, Mus musculus
aactacctaggctgggcactcatgc

SEQ ID NO: 22262 - DNA, 25 bp, Mus musculus
ctaggctgggcactcatgcatgcta

SEQ ID NO: 22263 - DNA, 25 bp, Mus musculus
ctcatgcatgctagtcccacaggcc

SEQ ID NO: 22264 - DNA, 25 bp, Mus musculus
tatgaagagcccttcactgctgaga

SEQ ID NO: 22265 - DNA, 25 bp, Mus musculus
gagcccttcactgctgagatctacc

SEQ ID NO: 22266 - DNA, 25 bp, Mus musculus
gagcagcactggccactgtacctgt

SEQ ID NO: 22267 - DNA, 25 bp, Mus musculus
cactggccactgtacctgtgcctta

SEQ ID NO: 22268 - DNA, 25 bp, Mus musculus
tacctgtgccttagaaaccagtcat

SEQ ID NO: 22269 - DNA, 25 bp, Mus musculus
cctcaggcattatgctgtgtgactg

SEQ ID NO: 22270 - DNA, 25 bp, Mus musculus
atgatgagccagcccaagatggagg

SEQ ID NO: 22271 - DNA, 25 bp, Mus musculus
agccagcccaagatggagggcctgg

SEQ ID NO: 22272 - DNA, 25 bp, Mus musculus
ctgtccagcttctatgcactggggt

SEQ ID NO: 22273 - DNA, 25 bp, Mus musculus
agcttctatgcactggggttcactg

SEQ ID NO: 22274 - DNA, 25 bp, Mus musculus
tatgcactggggttcactgggacct

SEQ ID NO: 22275 - DNA, 25 bp, Mus musculus
accacatttcccttcagcgtgctgg

SEQ ID NO: 22276 - DNA, 25 bp, Mus musculus
cccatgtactggggcagtacagcca

SEQ ID NO: 22277 - DNA, 25 bp, Mus musculus
ggcagtacagccaactacctaggct

SEQ ID NO: 22278 - DNA, 25 bp, Mus musculus
cagtttcattgcagagtcctcattt

SEQ ID NO: 22279 - DNA, 25 bp, Mus musculus
tttcattgcagagtcctcatttcta

SEQ ID NO: 22280 - DNA, 25 bp, Mus musculus
atgcatcggattggcagagctggcc

SEQ ID NO: 22281 - DNA, 25 bp, Mus musculus
attggcagagctggccgttttggta

SEQ ID NO: 22282 - DNA, 25 bp, Mus musculus
ggcagagctggccgttttggtacat

SEQ ID NO: 22283 - DNA, 25 bp, Mus musculus
ctgacagtgacctactgttgtagag

SEQ ID NO: 22284 - DNA, 25 bp, Mus musculus
acagtgacctactgttgtagaggag

SEQ ID NO: 22285 - DNA, 25 bp, Mus musculus
ttaccagatcctattcctattggcc

SEQ ID NO: 22286 - DNA, 25 bp, Mus musculus
ccagatcctattcctattggcctga

SEQ ID NO: 22287 - DNA, 25 bp, Mus musculus
gatcctattcctattggcctgatgg

SEQ ID NO: 22288 - DNA, 25 bp, Mus musculus
attcctattggcctgatggaagaat

SEQ ID NO: 22289 - DNA, 25 bp, Mus musculus
cctattggcctgatggaagaatgct

SEQ ID NO: 22290 - DNA, 25 bp, Mus musculus
gtcctcatttctacagacttgacgt

SEQ ID NO: 22291 - DNA, 25 bp, Mus musculus
atttctacagacttgacgtcccgtg

SEQ ID NO: 22292 - DNA, 25 bp, Mus musculus
acagacttgacgtcccgtgggattg

SEQ ID NO: 22293 - DNA, 25 bp, Mus musculus
acgtcccgtgggattgacgcagaga

SEQ ID NO: 22294 - DNA, 25 bp, Mus musculus
tcccgtgggattgacgcagagaagg

SEQ ID NO: 22295 - DNA, 25 bp, Mus musculus
ctcgatgtgccgttagactgggaga

SEQ ID NO: 22296 - DNA, 25 bp, Mus musculus
gatgtgccgttagactgggagactt

SEQ ID NO: 22297 - DNA, 25 bp, Mus musculus
tacatgcatcggattggcagagctg

SEQ ID NO: 22298 - DNA, 25 bp, Mus musculus
aaggtctctcccatgttaatcttgg

SEQ ID NO: 22299 - DNA, 25 bp, Mus musculus
tctcccatgttaatcttggtgctga

SEQ ID NO: 22300 - DNA, 25 bp, Mus musculus
acagatgtgcctggccagtaccttg

SEQ ID NO: 22301 - DNA, 25 bp, Mus musculus
cacctgcaggtgcagctgtcttctg

SEQ ID NO: 22302 - DNA, 25 bp, Mus musculus
caggtgcagctgtcttctgtgaagg

SEQ ID NO: 22303 - DNA, 25 bp, Mus musculus
ggccactacatgctctactgtgatg

SEQ ID NO: 22304 - DNA, 25 bp, Mus musculus
tacatgctctactgtgatggagaga

SEQ ID NO: 22305 - DNA, 25 bp, Mus musculus
aacctggtcatacttgagcagatgg

SEQ ID NO: 22306 - DNA, 25 bp, Mus musculus
agccgcccaagtgagtgagtgccgc

SEQ ID NO: 22307 - DNA, 25 bp, Mus musculus
gtgccgccagcatgtctgtcccatg

SEQ ID NO: 22308 - DNA, 25 bp, Mus musculus
ccagcatgtctgtcccatgggaggt

SEQ ID NO: 22309 - DNA, 25 bp, Mus musculus
ccccagcttctcaataaagagcttc

SEQ ID NO: 22310 - DNA, 25 bp, Mus musculus
atgttaatcttggtgctgaacaatg

SEQ ID NO: 22311 - DNA, 25 bp, Mus musculus
ttctcaataaagagcttcagcagtc

SEQ ID NO: 22312 - DNA, 25 bp, Mus musculus
atcttggtgctgaacaatggggaca

SEQ ID NO: 22313 - DNA, 25 bp, Mus musculus
atagagctttctatcacacatatga

SEQ ID NO: 22314 - DNA, 25 bp, Mus musculus
ctttctatcacacatatgatctatg

SEQ ID NO: 22315 - DNA, 25 bp, Mus musculus
atcacacatatgatctatgatcagt

SEQ ID NO: 22316 - DNA, 25 bp, Mus musculus
atctatgatcagtgtcttgaagtga

SEQ ID NO: 22317 - DNA, 25 bp, Mus musculus
tgtcttgaagtgaccaccatcttgg

SEQ ID NO: 22318 - DNA, 25 bp, Mus musculus
gaagtgaccaccatcttggagaaaa

SEQ ID NO: 22319 - DNA, 25 bp, Mus musculus
atgccgagaacctgctcaggctgtg

SEQ ID NO: 22320 - DNA, 25 bp, Mus musculus
agaacctgctcaggctgtgcaaaga

SEQ ID NO: 22321 - DNA, 25 bp, Mus musculus
tccctgaaatcgtgcaccactatgc

SEQ ID NO: 22322 - DNA, 25 bp, Mus musculus
ctgaaatcgtgcaccactatgccag

SEQ ID NO: 22323 - DNA, 25 bp, Mus musculus
aaatcgtgcaccactatgccagccg

SEQ ID NO: 22324 - DNA, 25 bp, Mus musculus
actatgccagccgcaagctgcccat

SEQ ID NO: 22325 - DNA, 25 bp, Mus musculus
gccgcaagctgcccattaagggagc

SEQ ID NO: 22326 - DNA, 25 bp, Mus musculus
gagcggaacacatgtccctgctcta

SEQ ID NO: 22327 - DNA, 25 bp, Mus musculus
tgtccctgctctaccctgtggccat

SEQ ID NO: 22328 - DNA, 25 bp, Mus musculus
tgctctaccctgtggccatccggac

SEQ ID NO: 22329 - DNA, 25 bp, Mus musculus
accctgtggccatccggactctgta

SEQ ID NO: 22330 - DNA, 25 bp, Mus musculus
tggccatccggactctgtagatgtg

SEQ ID NO: 22331 - DNA, 25 bp, Mus musculus
tgctcaggctgtgcaaagaggccag

SEQ ID NO: 22332 - DNA, 25 bp, Mus musculus
tccggactctgtagatgtgagacca

SEQ ID NO: 22333 - DNA, 25 bp, Mus musculus
aagaggccagctacctggtgcgcaa

SEQ ID NO: 22334 - DNA, 25 bp, Mus musculus
aggccagctacctggtgcgcaacag

SEQ ID NO: 22335 - DNA, 25 bp, Mus musculus
gctacctggtgcgcaacagtgagac

SEQ ID NO: 22336 - DNA, 25 bp, Mus musculus
gcaaaaatgacttctctctctccct

SEQ ID NO: 22337 - DNA, 25 bp, Mus musculus
agagcagtcagggcttcatgcacat

SEQ ID NO: 22338 - DNA, 25 bp, Mus musculus
gcttcatgcacatgaagctgtcccg

SEQ ID NO: 22339 - DNA, 25 bp, Mus musculus
ccttcagcagcgtccctgaaatcgt

SEQ ID NO: 22340 - DNA, 25 bp, Mus musculus
atcggctcggtgacggaatccctgc

SEQ ID NO: 22341 - DNA, 25 bp, Mus musculus
gctcggtgacggaatccctgcaggc

SEQ ID NO: 22342 - DNA, 25 bp, Mus musculus
caccgttctgagcaaactgaggaca

SEQ ID NO: 22343 - DNA, 25 bp, Mus musculus
aactgaggacactgtcatcgcagac

SEQ ID NO: 22344 - DNA, 25 bp, Mus musculus
acactgtcatcgcagacctggtggg

SEQ ID NO: 22345 - DNA, 25 bp, Mus musculus
ctctgcactgggcagatcaatgact

SEQ ID NO: 22346 - DNA, 25 bp, Mus musculus
tctgcactgggcagatcaatgactg

SEQ ID NO: 22347 - DNA, 25 bp, Mus musculus
ctgcactgggcagatcaatgactgg

SEQ ID NO: 22348 - DNA, 25 bp, Mus musculus
atcaatgactggatgccccttgagg

SEQ ID NO: 22349 - DNA, 25 bp, Mus musculus
tcaatgactggatgccccttgagga

SEQ ID NO: 22350 - DNA, 25 bp, Mus musculus
caatgactggatgccccttgaggat

SEQ ID NO: 22351 - DNA, 25 bp, Mus musculus
aatgactggatgccccttgaggatt

SEQ ID NO: 22352 - DNA, 25 bp, Mus musculus
acggaatccctgcaggcgtgtaagc

SEQ ID NO: 22353 - DNA, 25 bp, Mus musculus
cttgaggattcgagcgtgtgagcaa

SEQ ID NO: 22354 - DNA, 25 bp, Mus musculus
cggaatccctgcaggcgtgtaagct

SEQ ID NO: 22355 - DNA, 25 bp, Mus musculus
ggaatccctgcaggcgtgtaagctg

SEQ ID NO: 22356 - DNA, 25 bp, Mus musculus
aatccctgcaggcgtgtaagctggc

SEQ ID NO: 22357 - DNA, 25 bp, Mus musculus
atccctgcaggcgtgtaagctggcc

SEQ ID NO: 22358 - DNA, 25 bp, Mus musculus
tccctgcaggcgtgtaagctggccc

SEQ ID NO: 22359 - DNA, 25 bp, Mus musculus
cctgcaggcgtgtaagctggccctc

SEQ ID NO: 22360 - DNA, 25 bp, Mus musculus
gtcccaccgttctgagcaaactgag

SEQ ID NO: 22361 - DNA, 25 bp, Mus musculus
gtgaacctatggtactccttccagg

SEQ ID NO: 22362 - DNA, 25 bp, Mus musculus
ctatggtactccttccaggatgagg

SEQ ID NO: 22363 - DNA, 25 bp, Mus musculus
tacatctgtgagctggccctggctc

SEQ ID NO: 22364 - DNA, 25 bp, Mus musculus
tacctgcagaggtaccacatcatcc

SEQ ID NO: 22365 - DNA, 25 bp, Mus musculus
cagaggtaccacatcatccacagag

SEQ ID NO: 22366 - DNA, 25 bp, Mus musculus
aggtaccacatcatccacagagaca

SEQ ID NO: 22367 - DNA, 25 bp, Mus musculus
taccacatcatccacagagacatca

SEQ ID NO: 22368 - DNA, 25 bp, Mus musculus
gacatcaagccagacaacatcctac

SEQ ID NO: 22369 - DNA, 25 bp, Mus musculus
atcaagccagacaacatcctactgg

SEQ ID NO: 22370 - DNA, 25 bp, Mus musculus
gacaacatcctactggatgagcatg

SEQ ID NO: 22371 - DNA, 25 bp, Mus musculus
aacatcctactggatgagcatgggc

SEQ ID NO: 22372 - DNA, 25 bp, Mus musculus
atcctactggatgagcatgggcacg

SEQ ID NO: 22373 - DNA, 25 bp, Mus musculus
tactccttccaggatgaggaagaca

SEQ ID NO: 22374 - DNA, 25 bp, Mus musculus
taccacctacagcagaatgtgcact

SEQ ID NO: 22375 - DNA, 25 bp, Mus musculus
cacctacagcagaatgtgcacttca

SEQ ID NO: 22376 - DNA, 25 bp, Mus musculus
cagaatgtgcacttcacagagggga

SEQ ID NO: 22377 - DNA, 25 bp, Mus musculus
aatgtgcacttcacagaggggaccg

SEQ ID NO: 22378 - DNA, 25 bp, Mus musculus
gtgcacttcacagaggggaccgtga

SEQ ID NO: 22379 - DNA, 25 bp, Mus musculus
ttcacagaggggaccgtgaagctgt

SEQ ID NO: 22380 - DNA, 25 bp, Mus musculus
aagctgtacatctgtgagctggccc

SEQ ID NO: 22381 - DNA, 25 bp, Mus musculus
tgctccatttgacgattacattcag

SEQ ID NO: 22382 - DNA, 25 bp, Mus musculus
cattcagatccacattcccagtgtc

SEQ ID NO: 22383 - DNA, 25 bp, Mus musculus
gtctgtccctttacagaagctcaat

SEQ ID NO: 22384 - DNA, 25 bp, Mus musculus
cggttttagttccatgcttcttgct

SEQ ID NO: 22385 - DNA, 25 bp, Mus musculus
catgcttcttgcttatactcagaac

SEQ ID NO: 22386 - DNA, 25 bp, Mus musculus
tcttgcttatactcagaacttctgg

SEQ ID NO: 22387 - DNA, 25 bp, Mus musculus
ttatactcagaacttctgggtccat

SEQ ID NO: 22388 - DNA, 25 bp, Mus musculus
tcagaacttctgggtccatctaagt

SEQ ID NO: 22389 - DNA, 25 bp, Mus musculus
ggtccatctaagtccttcaatactg

SEQ ID NO: 22390 - DNA, 25 bp, Mus musculus
tccttcaatactgatgcttgctcac

SEQ ID NO: 22391 - DNA, 25 bp, Mus musculus
aatactgatgcttgctcacaggaga

SEQ ID NO: 22392 - DNA, 25 bp, Mus musculus
tgaatacccttctggtccttcctcg

SEQ ID NO: 22393 - DNA, 25 bp, Mus musculus
cattcccagtgtccagtctgtcacc

SEQ ID NO: 22394 - DNA, 25 bp, Mus musculus
ccatcactctcagacaatctgggat

SEQ ID NO: 22395 - DNA, 25 bp, Mus musculus
cccattattgccaaatctatgccca

SEQ ID NO: 22396 - DNA, 25 bp, Mus musculus
attgccaaatctatgcccatctgtc

SEQ ID NO: 22397 - DNA, 25 bp, Mus musculus
aaatctatgcccatctgtccgagac

SEQ ID NO: 22398 - DNA, 25 bp, Mus musculus
atctgtccgagactttgattcacac

SEQ ID NO: 22399 - DNA, 25 bp, Mus musculus
acaatagcaccctgtagaaattgtt

SEQ ID NO: 22400 - DNA, 25 bp, Mus musculus
caaatagtccatgtcatttaagagg

SEQ ID NO: 22401 - DNA, 25 bp, Mus musculus
ccatgtgtctgtccctttacagaag

SEQ ID NO: 22402 - DNA, 25 bp, Mus musculus
gtatccccacgacacaatcacttcg

SEQ ID NO: 22403 - DNA, 25 bp, Mus musculus
atccccacgacacaatcacttcggg

SEQ ID NO: 22404 - DNA, 25 bp, Mus musculus
gaattgccctggctacaggctccct

SEQ ID NO: 22405 - DNA, 25 bp, Mus musculus
aattgccctggctacaggctccctg

SEQ ID NO: 22406 - DNA, 25 bp, Mus musculus
attgccctggctacaggctccctgg

SEQ ID NO: 22407 - DNA, 25 bp, Mus musculus
ttgccctggctacaggctccctgga

SEQ ID NO: 22408 - DNA, 25 bp, Mus musculus
tgccctggctacaggctccctggac

SEQ ID NO: 22409 - DNA, 25 bp, Mus musculus
cctggactccttcctccagattttg

SEQ ID NO: 22410 - DNA, 25 bp, Mus musculus
tccccacgacacaatcacttcggga

SEQ ID NO: 22411 - DNA, 25 bp, Mus musculus
ccacgacacaatcacttcgggaaca

SEQ ID NO: 22412 - DNA, 25 bp, Mus musculus
cacgacacaatcacttcgggaacac

SEQ ID NO: 22413 - DNA, 25 bp, Mus musculus
gacacaatcacttcgggaacacccg

SEQ ID NO: 22414 - DNA, 25 bp, Mus musculus
attattgaattgccctggctacagg

SEQ ID NO: 22415 - DNA, 25 bp, Mus musculus
ttattgaattgccctggctacaggc

SEQ ID NO: 22416 - DNA, 25 bp, Mus musculus
tattgaattgccctggctacaggct

SEQ ID NO: 22417 - DNA, 25 bp, Mus musculus
tgaattgccctggctacaggctccc

SEQ ID NO: 22418 - DNA, 25 bp, Mus musculus
cacctgacagggagatgtggccaac

SEQ ID NO: 22419 - DNA, 25 bp, Mus musculus
agatgtggccaacatccttaggctt

SEQ ID NO: 22420 - DNA, 25 bp, Mus musculus
attattgtacacagcagctaggtaa

SEQ ID NO: 22421 - DNA, 25 bp, Mus musculus
atagtatatctcaaaccatcctgcc

SEQ ID NO: 22422 - DNA, 25 bp, Mus musculus
tatctcaaaccatcctgccagatac

SEQ ID NO: 22423 - DNA, 25 bp, Mus musculus
aaaccatcctgccagatactctcat

SEQ ID NO: 22424 - DNA, 25 bp, Mus musculus
tcctgccagatactctcatctgatt

SEQ ID NO: 22425 - DNA, 25 bp, Mus musculus
tcttcccatcaccttgagtcacctg

SEQ ID NO: 22426 - DNA, 25 bp, Mus musculus
catcaccttgagtcacctgtaaatt

SEQ ID NO: 22427 - DNA, 25 bp, Mus musculus
tcacctgtaaattcatttgtcatct

SEQ ID NO: 22428 - DNA, 25 bp, Mus musculus
tcatttgtcatctgaaacggatcaa

SEQ ID NO: 22429 - DNA, 25 bp, Mus musculus
tagcaaaaccacagagcgctttata

SEQ ID NO: 22430 - DNA, 25 bp, Mus musculus
taggcttctcactggcactttagca

SEQ ID NO: 22431 - DNA, 25 bp, Mus musculus
tctcactggcactttagcaagggcc

SEQ ID NO: 22432 - DNA, 25 bp, Mus musculus
tttagcaagggcctcctgcttctcg

SEQ ID NO: 22433 - DNA, 25 bp, Mus musculus
cttctcgagagcattccaggaaatc

SEQ ID NO: 22434 - DNA, 25 bp, Mus musculus
tcttagaggtgctggccccaggtcc

SEQ ID NO: 22435 - DNA, 25 bp, Mus musculus
tggccccaggtccaagagaattaga

SEQ ID NO: 22436 - DNA, 25 bp, Mus musculus
cccatttggtctgcataggccgttt

SEQ ID NO: 22437 - DNA, 25 bp, Mus musculus
tggtctgcataggccgtttaagggt

SEQ ID NO: 22438 - DNA, 25 bp, Mus musculus
ccatggacgtatctcccgcgaggag

SEQ ID NO: 22439 - DNA, 25 bp, Mus musculus
acgtatctcccgcgaggagtctcac

SEQ ID NO: 22440 - DNA, 25 bp, Mus musculus
gaccttcttcactctggatgatggg

SEQ ID NO: 22441 - DNA, 25 bp, Mus musculus
cttcactctggatgatgggaacacc

SEQ ID NO: 22442 - DNA, 25 bp, Mus musculus
caagttctccgatctgatccagctg

SEQ ID NO: 22443 - DNA, 25 bp, Mus musculus
ctccgatctgatccagctggtcgac

SEQ ID NO: 22444 - DNA, 25 bp, Mus musculus
ctgcaagctgaaacaccactgcatc

SEQ ID NO: 22445 - DNA, 25 bp, Mus musculus
gctgaaacaccactgcatccgcgtg

SEQ ID NO: 22446 - DNA, 25 bp, Mus musculus
acaccactgcatccgcgtggcctta

SEQ ID NO: 22447 - DNA, 25 bp, Mus musculus
tccttgcccactcacagaggctgga

SEQ ID NO: 22448 - DNA, 25 bp, Mus musculus
aggcagcgacactggaacggagaag

SEQ ID NO: 22449 - DNA, 25 bp, Mus musculus
gttccttcgggaagctgctgagcca

SEQ ID NO: 22450 - DNA, 25 bp, Mus musculus
ctcccgcgaggagtctcacaggatc

SEQ ID NO: 22451 - DNA, 25 bp, Mus musculus
gtctcacaggatcatcaagcaacaa

SEQ ID NO: 22452 - DNA, 25 bp, Mus musculus
catcaagcaacaaggtctcgtggac

SEQ ID NO: 22453 - DNA, 25 bp, Mus musculus
gcaacaaggtctcgtggacgggctg

SEQ ID NO: 22454 - DNA, 25 bp, Mus musculus
cgggctgttcctccttcgtgacagc

SEQ ID NO: 22455 - DNA, 25 bp, Mus musculus
gttcctccttcgtgacagccagagt

SEQ ID NO: 22456 - DNA, 25 bp, Mus musculus
ccagatcttaccttgcgaggatgat

SEQ ID NO: 22457 - DNA, 25 bp, Mus musculus
cttaccttgcgaggatgatgggcag

SEQ ID NO: 22458 - DNA, 25 bp, Mus musculus
ccttctctagacttgtgtaaacatg

SEQ ID NO: 22459 - DNA, 25 bp, Mus musculus
ttctctagacttgtgtaaacatggg

SEQ ID NO: 22460 - DNA, 25 bp, Mus musculus
aagactggcaaggccaggctgtagt

SEQ ID NO: 22461 - DNA, 25 bp, Mus musculus
gactggcaaggccaggctgtagtaa

SEQ ID NO: 22462 - DNA, 25 bp, Mus musculus
ctggcaaggccaggctgtagtaaca

SEQ ID NO: 22463 - DNA, 25 bp, Mus musculus
tctgtgctaaggttttcaggtttgg

SEQ ID NO: 22464 - DNA, 25 bp, Mus musculus
ggttttcaggtttggcactgccagg

SEQ ID NO: 22465 - DNA, 25 bp, Mus musculus
ttcaggtttggcactgccagggatg

SEQ ID NO: 22466 - DNA, 25 bp, Mus musculus
ggtttggcactgccagggatggcat

SEQ ID NO: 22467 - DNA, 25 bp, Mus musculus
tttggcactgccagggatggcattt

SEQ ID NO: 22468 - DNA, 25 bp, Mus musculus
tggcactgccagggatggcatttag

SEQ ID NO: 22469 - DNA, 25 bp, Mus musculus
gcactgccagggatggcatttagga

SEQ ID NO: 22470 - DNA, 25 bp, Mus musculus
cccttcaccctgttcagtgaactgc

SEQ ID NO: 22471 - DNA, 25 bp, Mus musculus
cctgttcagtgaactgcactttgtg

SEQ ID NO: 22472 - DNA, 25 bp, Mus musculus
tgttcagtgaactgcactttgtggt

SEQ ID NO: 22473 - DNA, 25 bp, Mus musculus
ttcagtgaactgcactttgtggtca

SEQ ID NO: 22474 - DNA, 25 bp, Mus musculus
cagtgaactgcactttgtggtcagt

SEQ ID NO: 22475 - DNA, 25 bp, Mus musculus
gaactgcactttgtggtcagtaaag

SEQ ID NO: 22476 - DNA, 25 bp, Mus musculus
actgcactttgtggtcagtaaagac

SEQ ID NO: 22477 - DNA, 25 bp, Mus musculus
tgcactttgtggtcagtaaagactg

SEQ ID NO: 22478 - DNA, 25 bp, Mus musculus
caatcacttactgaagagccctttc

SEQ ID NO: 22479 - DNA, 25 bp, Mus musculus
cttactgaagagccctttcagtgtt

SEQ ID NO: 22480 - DNA, 25 bp, Mus musculus
ggtttccactcatgagaaggaaaag

SEQ ID NO: 22481 - DNA, 25 bp, Mus musculus
agctgacagcaaacacagagtcaga

SEQ ID NO: 22482 - DNA, 25 bp, Mus musculus
cagcaaacacagagtcagaggttac

SEQ ID NO: 22483 - DNA, 25 bp, Mus musculus
gaccagtctagcaccgtatgtgaaa

SEQ ID NO: 22484 - DNA, 25 bp, Mus musculus
cccatcaaaccaacgtgaatgcctt

SEQ ID NO: 22485 - DNA, 25 bp, Mus musculus
catcaatgggcctcaatccttgaag

SEQ ID NO: 22486 - DNA, 25 bp, Mus musculus
tcaatccttgaagcagaactttctt

SEQ ID NO: 22487 - DNA, 25 bp, Mus musculus
gcagaactttctttcgagaagtaat

SEQ ID NO: 22488 - DNA, 25 bp, Mus musculus
tttatgtcaaggagacctggtttgt

SEQ ID NO: 22489 - DNA, 25 bp, Mus musculus
tcaaggagacctggtttgtgagacc

SEQ ID NO: 22490 - DNA, 25 bp, Mus musculus
ccctttcagtgttcatcccaagaca

SEQ ID NO: 22491 - DNA, 25 bp, Mus musculus
cagtgttcatcccaagacaggtcgg

SEQ ID NO: 22492 - DNA, 25 bp, Mus musculus
tcatcccaagacaggtcggatttct

SEQ ID NO: 22493 - DNA, 25 bp, Mus musculus
gatttctgtgcctatcgattttcat

SEQ ID NO: 22494 - DNA, 25 bp, Mus musculus
tgtgcctatcgattttcataaagtg

SEQ ID NO: 22495 - DNA, 25 bp, Mus musculus
tactgtcccaactataagtgccatc

SEQ ID NO: 22496 - DNA, 25 bp, Mus musculus
tataagtgccatctgccgggaattg

SEQ ID NO: 22497 - DNA, 25 bp, Mus musculus
tgccatctgccgggaattggatatg

SEQ ID NO: 22498 - DNA, 25 bp, Mus musculus
ttctaactaattgctttcatctatc

SEQ ID NO: 22499 - DNA, 25 bp, Mus musculus
ctaattgctttcatctatctataga

SEQ ID NO: 22500 - DNA, 25 bp, Mus musculus
ctgcactgcaatcacatagttccat

SEQ ID NO: 22501 - DNA, 25 bp, Mus musculus
tgcaatcacatagttccatataagt

SEQ ID NO: 22502 - DNA, 25 bp, Mus musculus
cacatagttccatataagttgtcct

SEQ ID NO: 22503 - DNA, 25 bp, Mus musculus
ttagtctcttgtgctgattcactgt

SEQ ID NO: 22504 - DNA, 25 bp, Mus musculus
tcttgtgctgattcactgtataagc

SEQ ID NO: 22505 - DNA, 25 bp, Mus musculus
tataagcatgatcctggtaatgcac

SEQ ID NO: 22506 - DNA, 25 bp, Mus musculus
catgatcctggtaatgcactttgga

SEQ ID NO: 22507 - DNA, 25 bp, Mus musculus
aatgcactttggatgggaagaaaat

SEQ ID NO: 22508 - DNA, 25 bp, Mus musculus
agttcttgcgtgtactttgaagaat

SEQ ID NO: 22509 - DNA, 25 bp, Mus musculus
ctgttaatgccacttcagaagtttg

SEQ ID NO: 22510 - DNA, 25 bp, Mus musculus
atataatgctggacatcttcattct

SEQ ID NO: 22511 - DNA, 25 bp, Mus musculus
tgctggacatcttcattctacatca

SEQ ID NO: 22512 - DNA, 25 bp, Mus musculus
acatcttcattctacatcaacattc

SEQ ID NO: 22513 - DNA, 25 bp, Mus musculus
tcattctacatcaacattcgcttaa

SEQ ID NO: 22514 - DNA, 25 bp, Mus musculus
tacatcaacattcgcttaaatcatt

SEQ ID NO: 22515 - DNA, 25 bp, Mus musculus
atatagctgactgtgaccctgcact

SEQ ID NO: 22516 - DNA, 25 bp, Mus musculus
ctgactgtgaccctgcactgcaatc

SEQ ID NO: 22517 - DNA, 25 bp, Mus musculus
gtgaccctgcactgcaatcacatag

SEQ ID NO: 22518 - DNA, 25 bp, Mus musculus
attctgcagcatcctggtgccgtgt

SEQ ID NO: 22519 - DNA, 25 bp, Mus musculus
cagcatcctggtgccgtgttaactc

SEQ ID NO: 22520 - DNA, 25 bp, Mus musculus
ctgggcagcaccggaacatacatgc

SEQ ID NO: 22521 - DNA, 25 bp, Mus musculus
ggaacatacatgcctgcaacatcag

SEQ ID NO: 22522 - DNA, 25 bp, Mus musculus
tacatgcctgcaacatcagccatgc

SEQ ID NO: 22523 - DNA, 25 bp, Mus musculus
cctgcaacatcagccatgcaaggag

SEQ ID NO: 22524 - DNA, 25 bp, Mus musculus
caaggagcctacttgccacagtata

SEQ ID NO: 22525 - DNA, 25 bp, Mus musculus
gcctacttgccacagtatacacaca

SEQ ID NO: 22526 - DNA, 25 bp, Mus musculus
ttgccacagtatacacacatgcaga

SEQ ID NO: 22527 - DNA, 25 bp, Mus musculus
cagtatacacacatgcagaccgcgg

SEQ ID NO: 22528 - DNA, 25 bp, Mus musculus
acgtctaatgaccattctccatata

SEQ ID NO: 22529 - DNA, 25 bp, Mus musculus
aatgaccattctccatatacctttc

SEQ ID NO: 22530 - DNA, 25 bp, Mus musculus
ccctcaatggaacataccatgtcac

SEQ ID NO: 22531 - DNA, 25 bp, Mus musculus
atggaacataccatgtcactacaac

SEQ ID NO: 22532 - DNA, 25 bp, Mus musculus
atgtcactacaacctgcttccatga

SEQ ID NO: 22533 - DNA, 25 bp, Mus musculus
cctgcttccatgatcagccctctgg

SEQ ID NO: 22534 - DNA, 25 bp, Mus musculus
tccatgatcagccctctggctcagc

SEQ ID NO: 22535 - DNA, 25 bp, Mus musculus
atcagccctctggctcagcagatga

SEQ ID NO: 22536 - DNA, 25 bp, Mus musculus
agtcatctgtcactgggcagcaccg

SEQ ID NO: 22537 - DNA, 25 bp, Mus musculus
ctgtcactgggcagcaccggaacat

SEQ ID NO: 22538 - DNA, 25 bp, Mus musculus
tactcgctgatggagaacggaaaca

SEQ ID NO: 22539 - DNA, 25 bp, Mus musculus
actcgctgatggagaacggaaacat

SEQ ID NO: 22540 - DNA, 25 bp, Mus musculus
tctaatggcatcgacatcgaaaaaa

SEQ ID NO: 22541 - DNA, 25 bp, Mus musculus
acagatcaagcgaactgcccggact

SEQ ID NO: 22542 - DNA, 25 bp, Mus musculus
cacaccaggttatttctttgctttg

SEQ ID NO: 22543 - DNA, 25 bp, Mus musculus
ctttgctttgcgttccctggctcca

SEQ ID NO: 22544 - DNA, 25 bp, Mus musculus
gcctcgtaaggaccaagcaaccatg

SEQ ID NO: 22545 - DNA, 25 bp, Mus musculus
taaggaccaagcaaccatggcaggc

SEQ ID NO: 22546 - DNA, 25 bp, Mus musculus
ggaccaagcaaccatggcaggcact

SEQ ID NO: 22547 - DNA, 25 bp, Mus musculus
gaccaagcaaccatggcaggcacta

SEQ ID NO: 22548 - DNA, 25 bp, Mus musculus
actgtcaccttgctagcccaataat

SEQ ID NO: 22549 - DNA, 25 bp, Mus musculus
tgtcaccttgctagcccaataataa

SEQ ID NO: 22550 - DNA, 25 bp, Mus musculus
tgagtcctgatggaaccatgaacca

SEQ ID NO: 22551 - DNA, 25 bp, Mus musculus
ccaaacagagcaacgtctcagagcc

SEQ ID NO: 22552 - DNA, 25 bp, Mus musculus
gaagtccagttcttcccgttgatgc

SEQ ID NO: 22553 - DNA, 25 bp, Mus musculus
tccagttcttcccgttgatgccacc

SEQ ID NO: 22554 - DNA, 25 bp, Mus musculus
cagttcttcccgttgatgccaccgg

SEQ ID NO: 22555 - DNA, 25 bp, Mus musculus
ttcttcccgttgatgccaccggcac

SEQ ID NO: 22556 - DNA, 25 bp, Mus musculus
gcaccctactggatcctggccactg

SEQ ID NO: 22557 - DNA, 25 bp, Mus musculus
caccctactggatcctggccactga

SEQ ID NO: 22558 - DNA, 25 bp, Mus musculus
tcccgtgtgccattcatcaagattc

SEQ ID NO: 22559 - DNA, 25 bp, Mus musculus
cgtgtgccattcatcaagattcgta

SEQ ID NO: 22560 - DNA, 25 bp, Mus musculus
cagcgacttcgaccacgatgaatgt

SEQ ID NO: 22561 - DNA, 25 bp, Mus musculus
atgtcagtgtcctagctcctgcatc

SEQ ID NO: 22562 - DNA, 25 bp, Mus musculus
tcagtgtcctagctcctgcatcttc

SEQ ID NO: 22563 - DNA, 25 bp, Mus musculus
gtgtcctagctcctgcatcttcgtc

SEQ ID NO: 22564 - DNA, 25 bp, Mus musculus
tagctcctgcatcttcgtcattgac

SEQ ID NO: 22565 - DNA, 25 bp, Mus musculus
cacggccatgcagatcaagactatg

SEQ ID NO: 22566 - DNA, 25 bp, Mus musculus
gaacaagcatacgttctctggagga

SEQ ID NO: 22567 - DNA, 25 bp, Mus musculus
caagcatacgttctctggaggaagt

SEQ ID NO: 22568 - DNA, 25 bp, Mus musculus
tgagtcacacaatcagtttgccggc

SEQ ID NO: 22569 - DNA, 25 bp, Mus musculus
gtcacacaatcagtttgccggcaca

SEQ ID NO: 22570 - DNA, 25 bp, Mus musculus
gtgccattcatcaagattcgtactt

SEQ ID NO: 22571 - DNA, 25 bp, Mus musculus
caatcagtttgccggcacatgtgat

SEQ ID NO: 22572 - DNA, 25 bp, Mus musculus
ttcatcaagattcgtacttcagaat

SEQ ID NO: 22573 - DNA, 25 bp, Mus musculus
ggtcatcctagatattctctgctat

SEQ ID NO: 22574 - DNA, 25 bp, Mus musculus
catcctagatattctctgctatgct

SEQ ID NO: 22575 - DNA, 25 bp, Mus musculus
agatattctctgctatgctcgtact

SEQ ID NO: 22576 - DNA, 25 bp, Mus musculus
tattctctgctatgctcgtacttct

SEQ ID NO: 22577 - DNA, 25 bp, Mus musculus
tctctgctatgctcgtacttcttcc

SEQ ID NO: 22578 - DNA, 25 bp, Mus musculus
gttcagcgacttcgaccacgatgaa

SEQ ID NO: 22579 - DNA, 25 bp, Mus musculus
acaactcagattgggctgcgcttca

SEQ ID NO: 22580 - DNA, 25 bp, Mus musculus
cagattgggctgcgcttcagtaatg

SEQ ID NO: 22581 - DNA, 25 bp, Mus musculus
gtacctccagtttgcacagggactt

SEQ ID NO: 22582 - DNA, 25 bp, Mus musculus
cctccagtttgcacagggacttgat

SEQ ID NO: 22583 - DNA, 25 bp, Mus musculus
ccagtttgcacagggacttgatggg

SEQ ID NO: 22584 - DNA, 25 bp, Mus musculus
gccctgcctacccttggtgctgtca

SEQ ID NO: 22585 - DNA, 25 bp, Mus musculus
ctgcctacccttggtgctgtcataa

SEQ ID NO: 22586 - DNA, 25 bp, Mus musculus
gaagcagcctgtgcctcccagagac

SEQ ID NO: 22587 - DNA, 25 bp, Mus musculus
gcctcccagagactgactcagagag

SEQ ID NO: 22588 - DNA, 25 bp, Mus musculus
tgtgttgtgcacatgcttgcctgca

SEQ ID NO: 22589 - DNA, 25 bp, Mus musculus
gtgtacaagcttggccctgtgccct

SEQ ID NO: 22590 - DNA, 25 bp, Mus musculus
cttggccctgtgccctgtagtgggg

SEQ ID NO: 22591 - DNA, 25 bp, Mus musculus
attgggctgcgcttcagtaatggac

SEQ ID NO: 22592 - DNA, 25 bp, Mus musculus
gggctgcgcttcagtaatggacgtc

SEQ ID NO: 22593 - DNA, 25 bp, Mus musculus
ttcagtaatggacgtcctggtaggg

SEQ ID NO: 22594 - DNA, 25 bp, Mus musculus
taagcctgggttcttcaggccccag

SEQ ID NO: 22595 - DNA, 25 bp, Mus musculus
ccatcctgaagccagctggtacctc

SEQ ID NO: 22596 - DNA, 25 bp, Mus musculus
tgaagccagctggtacctccagttt

SEQ ID NO: 22597 - DNA, 25 bp, Mus musculus
agccagctggtacctccagtttgca

SEQ ID NO: 22598 - DNA, 25 bp, Mus musculus
cagctggtacctccagtttgcacag

SEQ ID NO: 22599 - DNA, 25 bp, Mus musculus
aaggcatgaaccatccttcagttta

SEQ ID NO: 22600 - DNA, 25 bp, Mus musculus
gcatgaaccatccttcagtttactg

SEQ ID NO: 22601 - DNA, 25 bp, Mus musculus
tctaggcaacaggccttgtggagtt

SEQ ID NO: 22602 - DNA, 25 bp, Mus musculus
caggccttgtggagttcttttcata

SEQ ID NO: 22603 - DNA, 25 bp, Mus musculus
tcttttcataccacttttggagctt

SEQ ID NO: 22604 - DNA, 25 bp, Mus musculus
acttttggagcttgactgtccacaa

SEQ ID NO: 22605 - DNA, 25 bp, Mus musculus
gcttgactgtccacaaacacatacc

SEQ ID NO: 22606 - DNA, 25 bp, Mus musculus
accctttagcaccttaattctgcag

SEQ ID NO: 22607 - DNA, 25 bp, Mus musculus
cttaattctgcaggatcttatgcca

SEQ ID NO: 22608 - DNA, 25 bp, Mus musculus
ggatcttatgccacacatagcaacc

SEQ ID NO: 22609 - DNA, 25 bp, Mus musculus
tatgccacacatagcaacccagaac

SEQ ID NO: 22610 - DNA, 25 bp, Mus musculus
agcaacccagaacaagtttacatga

SEQ ID NO: 22611 - DNA, 25 bp, Mus musculus
tgaaccatccttcagtttactgaga

SEQ ID NO: 22612 - DNA, 25 bp, Mus musculus
atccttcagtttactgagatgaagg

SEQ ID NO: 22613 - DNA, 25 bp, Mus musculus
taccaaacatacctcaaatactgcg

SEQ ID NO: 22614 - DNA, 25 bp, Mus musculus
caaacatacctcaaatactgcgttt

SEQ ID NO: 22615 - DNA, 25 bp, Mus musculus
ctcaaatactgcgttttgtcaagga

SEQ ID NO: 22616 - DNA, 25 bp, Mus musculus
tactgcgttttgtcaaggaaagagt

SEQ ID NO: 22617 - DNA, 25 bp, Mus musculus
ctcctccaggaggcaatacacaaaa

SEQ ID NO: 22618 - DNA, 25 bp, Mus musculus
atacacaaaatccagaaagtcactc

SEQ ID NO: 22619 - DNA, 25 bp, Mus musculus
gaagaaccacctgatgtacgctgtg

SEQ ID NO: 22620 - DNA, 25 bp, Mus musculus
cctgatgtacgctgtgagagaggag

SEQ ID NO: 22621 - DNA, 25 bp, Mus musculus
gtcccggctgagccctgaagagcca

SEQ ID NO: 22622 - DNA, 25 bp, Mus musculus
gctgagccctgaagagccagcacct

SEQ ID NO: 22623 - DNA, 25 bp, Mus musculus
gagccctgaagagccagcacctgaa

SEQ ID NO: 22624 - DNA, 25 bp, Mus musculus
ccctgaagagccagcacctgaagcc

SEQ ID NO: 22625 - DNA, 25 bp, Mus musculus
agagccagcacctgaagccccagaa

SEQ ID NO: 22626 - DNA, 25 bp, Mus musculus
gtaagtggctctgtccttagggtgg

SEQ ID NO: 22627 - DNA, 25 bp, Mus musculus
ggcagagccacatcttgttctacct

SEQ ID NO: 22628 - DNA, 25 bp, Mus musculus
agagccacatcttgttctacctagt

SEQ ID NO: 22629 - DNA, 25 bp, Mus musculus
gccacatcttgttctacctagttct

SEQ ID NO: 22630 - DNA, 25 bp, Mus musculus
cacatcttgttctacctagttcttt

SEQ ID NO: 22631 - DNA, 25 bp, Mus musculus
gcagattcgtgagctgcttgagaag

SEQ ID NO: 22632 - DNA, 25 bp, Mus musculus
gattcgtgagctgcttgagaagaac

SEQ ID NO: 22633 - DNA, 25 bp, Mus musculus
tcgtgagctgcttgagaagaactcc

SEQ ID NO: 22634 - DNA, 25 bp, Mus musculus
tgagaagaactcccagctggagcgc

SEQ ID NO: 22635 - DNA, 25 bp, Mus musculus
ctcccagctggagcgcgagaacacc

SEQ ID NO: 22636 - DNA, 25 bp, Mus musculus
gctggcaagccccgagcaactggaa

SEQ ID NO: 22637 - DNA, 25 bp, Mus musculus
ggcaagccccgagcaactggaaaag

SEQ ID NO: 22638 - DNA, 25 bp, Mus musculus
ccagtcccggctgagccctgaagag

SEQ ID NO: 22639 - DNA, 25 bp, Mus musculus
ccaccatcctatgaaagcgtcacca

SEQ ID NO: 22640 - DNA, 25 bp, Mus musculus
tcctatgaaagcgtcaccaggggcc

SEQ ID NO: 22641 - DNA, 25 bp, Mus musculus
ttccttctagagatggcaccaacct

SEQ ID NO: 22642 - DNA, 25 bp, Mus musculus
ctccaccgatgcatgtcactggtca

SEQ ID NO: 22643 - DNA, 25 bp, Mus musculus
cgatgcatgtcactggtcatggtgt

SEQ ID NO: 22644 - DNA, 25 bp, Mus musculus
atgtcactggtcatggtgtcagagc

SEQ ID NO: 22645 - DNA, 25 bp, Mus musculus
cttctgaactttcagaagatgacat

SEQ ID NO: 22646 - DNA, 25 bp, Mus musculus
atgacatcgctttgtgttgtttgtg

SEQ ID NO: 22647 - DNA, 25 bp, Mus musculus
gatttaccaacttctcagaaccagg

SEQ ID NO: 22648 - DNA, 25 bp, Mus musculus
tctcagaaccaggacttccagagac

SEQ ID NO: 22649 - DNA, 25 bp, Mus musculus
gacttccagagacacatggcaagga

SEQ ID NO: 22650 - DNA, 25 bp, Mus musculus
cagttgccggacaatacctgagggt

SEQ ID NO: 22651 - DNA, 25 bp, Mus musculus
gaaagcgtcaccaggggcctgagtg

SEQ ID NO: 22652 - DNA, 25 bp, Mus musculus
gccaacattaacacatctagctcaa

SEQ ID NO: 22653 - DNA, 25 bp, Mus musculus
attaacacatctagctcaatgcaaa

SEQ ID NO: 22654 - DNA, 25 bp, Mus musculus
acatctagctcaatgcaaaatgaag

SEQ ID NO: 22655 - DNA, 25 bp, Mus musculus
cctggacctcagtgaagacactcca

SEQ ID NO: 22656 - DNA, 25 bp, Mus musculus
ttctggtgtgctgaccttttccttc

SEQ ID NO: 22657 - DNA, 25 bp, Mus musculus
tgtgctgaccttttccttctagaga

SEQ ID NO: 22658 - DNA, 25 bp, Mus musculus
gaccttttccttctagagatggcac

SEQ ID NO: 22659 - DNA, 25 bp, Mus musculus
gcgtaacttgtctaaaccattgatt

SEQ ID NO: 22660 - DNA, 25 bp, Mus musculus
cttgtctaaaccattgattggtact

SEQ ID NO: 22661 - DNA, 25 bp, Mus musculus
gaccttcagcaggttggctagtctg

SEQ ID NO: 22662 - DNA, 25 bp, Mus musculus
ccttcagcaggttggctagtctgtc

SEQ ID NO: 22663 - DNA, 25 bp, Mus musculus
ttcagcaggttggctagtctgtctg

SEQ ID NO: 22664 - DNA, 25 bp, Mus musculus
gtctgtctgaaacactgcgattgac

SEQ ID NO: 22665 - DNA, 25 bp, Mus musculus
agattcctgtgcctgaggtaataca

SEQ ID NO: 22666 - DNA, 25 bp, Mus musculus
tcctgtgcctgaggtaatacacagc

SEQ ID NO: 22667 - DNA, 25 bp, Mus musculus
ggtaatacacagcctggtggaccag

SEQ ID NO: 22668 - DNA, 25 bp, Mus musculus
taatacacagcctggtggaccagag

SEQ ID NO: 22669 - DNA, 25 bp, Mus musculus
atacacagcctggtggaccagagga

SEQ ID NO: 22670 - DNA, 25 bp, Mus musculus
acagcctggtggaccagaggaaagg

SEQ ID NO: 22671 - DNA, 25 bp, Mus musculus
tgtctaaaccattgattggtacttg

SEQ ID NO: 22672 - DNA, 25 bp, Mus musculus
ccattgattggtacttgtggaggct

SEQ ID NO: 22673 - DNA, 25 bp, Mus musculus
tgattggtacttgtggaggctgccc

SEQ ID NO: 22674 - DNA, 25 bp, Mus musculus
ggaggctgcccaaaacagaggcaat

SEQ ID NO: 22675 - DNA, 25 bp, Mus musculus
aggctgcccaaaacagaggcaattg

SEQ ID NO: 22676 - DNA, 25 bp, Mus musculus
gctgcccaaaacagaggcaattgga

SEQ ID NO: 22677 - DNA, 25 bp, Mus musculus
gaatgagaccttcagcaggttggct

SEQ ID NO: 22678 - DNA, 25 bp, Mus musculus
gagaccttcagcaggttggctagtc

SEQ ID NO: 22679 - DNA, 25 bp, Mus musculus
tcgacccatagatcccgaatgggtt

SEQ ID NO: 22680 - DNA, 25 bp, Mus musculus
catagatcccgaatgggttacaacg

SEQ ID NO: 22681 - DNA, 25 bp, Mus musculus
gtcctccacgcggtagcgaatactg

SEQ ID NO: 22682 - DNA, 25 bp, Mus musculus
tcctccacgcggtagcgaatactgg

SEQ ID NO: 22683 - DNA, 25 bp, Mus musculus
cctccacgcggtagcgaatactggt

SEQ ID NO: 22684 - DNA, 25 bp, Mus musculus
ctccacgcggtagcgaatactggta

SEQ ID NO: 22685 - DNA, 25 bp, Mus musculus
tccacgcggtagcgaatactggtac

SEQ ID NO: 22686 - DNA, 25 bp, Mus musculus
ccacgcggtagcgaatactggtact

SEQ ID NO: 22687 - DNA, 25 bp, Mus musculus
cacgcggtagcgaatactggtactt

SEQ ID NO: 22688 - DNA, 25 bp, Mus musculus
gtgagacccagcgcacactcagctg

SEQ ID NO: 22689 - DNA, 25 bp, Mus musculus
tgagacccagcgcacactcagctgg

SEQ ID NO: 22690 - DNA, 25 bp, Mus musculus
gagacccagcgcacactcagctggt

SEQ ID NO: 22691 - DNA, 25 bp, Mus musculus
tagatcccgaatgggttacaacgca

SEQ ID NO: 22692 - DNA, 25 bp, Mus musculus
tgggttacaacgcacttggacgaag

SEQ ID NO: 22693 - DNA, 25 bp, Mus musculus
aggtctggttgctgacgtcatccac

SEQ ID NO: 22694 - DNA, 25 bp, Mus musculus
ggtctggttgctgacgtcatccacc

SEQ ID NO: 22695 - DNA, 25 bp, Mus musculus
tctggttgctgacgtcatccaccac

SEQ ID NO: 22696 - DNA, 25 bp, Mus musculus
gtccacgctgtcctccacgcggtag

SEQ ID NO: 22697 - DNA, 25 bp, Mus musculus
ctgtcctccacgcggtagcgaatac

SEQ ID NO: 22698 - DNA, 25 bp, Mus musculus
tgtcctccacgcggtagcgaatact

SEQ ID NO: 22699 - DNA, 25 bp, Mus musculus
tgactatgctgaccaaagccatggc

SEQ ID NO: 22700 - DNA, 25 bp, Mus musculus
tgctgaccaaagccatggccatgga

SEQ ID NO: 22701 - DNA, 25 bp, Mus musculus
gctacctggcctcctagtctgctca

SEQ ID NO: 22702 - DNA, 25 bp, Mus musculus
tggcctcctagtctgctcagttgcc

SEQ ID NO: 22703 - DNA, 25 bp, Mus musculus
cctagtctgctcagttgccgcggac

SEQ ID NO: 22704 - DNA, 25 bp, Mus musculus
ctgctcagttgccgcggacatctga

SEQ ID NO: 22705 - DNA, 25 bp, Mus musculus
agttgccgcggacatctgagtggcc

SEQ ID NO: 22706 - DNA, 25 bp, Mus musculus
agcatttactgatctcgtgactccg

SEQ ID NO: 22707 - DNA, 25 bp, Mus musculus
catgttactgtcgatcccacaacca

SEQ ID NO: 22708 - DNA, 25 bp, Mus musculus
ggcgcagaccttgttctctttgtcc

SEQ ID NO: 22709 - DNA, 25 bp, Mus musculus
gaccttgttctctttgtccactttg

SEQ ID NO: 22710 - DNA, 25 bp, Mus musculus
cactttgttgggctcatttgcctaa

SEQ ID NO: 22711 - DNA, 25 bp, Mus musculus
accccactgtggtgctgactgacat

SEQ ID NO: 22712 - DNA, 25 bp, Mus musculus
ttgggctcatttgcctaaataaacg

SEQ ID NO: 22713 - DNA, 25 bp, Mus musculus
ctgtggtgctgactgacatgggcaa

SEQ ID NO: 22714 - DNA, 25 bp, Mus musculus
tctctgcagaccctgagtttgccag

SEQ ID NO: 22715 - DNA, 25 bp, Mus musculus
cagaccctgagtttgccaggaagct

SEQ ID NO: 22716 - DNA, 25 bp, Mus musculus
ttgccaggaagctcaaggagcgcca

SEQ ID NO: 22717 - DNA, 25 bp, Mus musculus
acgtcgtcaacagcatcctcttcct

SEQ ID NO: 22718 - DNA, 25 bp, Mus musculus
tcaacagcatcctcttcctgctcag

SEQ ID NO: 22719 - DNA, 25 bp, Mus musculus
gcatcctggtggatgctggctacct

SEQ ID NO: 22720 - DNA, 25 bp, Mus musculus
ccaagctggccgtgctcatcaccaa

SEQ ID NO: 22721 - DNA, 25 bp, Mus musculus
caagctggccgtgctcatcaccaac

SEQ ID NO: 22722 - DNA, 25 bp, Mus musculus
cggttcgtcggcgacagtgtgaaga

SEQ ID NO: 22723 - DNA, 25 bp, Mus musculus
ggttcgtcggcgacagtgtgaagaa

SEQ ID NO: 22724 - DNA, 25 bp, Mus musculus
ttcgtcggcgacagtgtgaagaagt

SEQ ID NO: 22725 - DNA, 25 bp, Mus musculus
agaagtggcccaggccctggcaagg

SEQ ID NO: 22726 - DNA, 25 bp, Mus musculus
ggagactacaaggcctttggcgtct

SEQ ID NO: 22727 - DNA, 25 bp, Mus musculus
agactacaaggcctttggcgtctca

SEQ ID NO: 22728 - DNA, 25 bp, Mus musculus
gactacaaggcctttggcgtctcat

SEQ ID NO: 22729 - DNA, 25 bp, Mus musculus
tacaaggcctttggcgtctcatggt

SEQ ID NO: 22730 - DNA, 25 bp, Mus musculus
aaggcctttggcgtctcatggtgga

SEQ ID NO: 22731 - DNA, 25 bp, Mus musculus
ggcctttggcgtctcatggtggaga

SEQ ID NO: 22732 - DNA, 25 bp, Mus musculus
tggccgtgctcatcaccaactccaa

SEQ ID NO: 22733 - DNA, 25 bp, Mus musculus
ggccgtgctcatcaccaactccaat

SEQ ID NO: 22734 - DNA, 25 bp, Mus musculus
ccgtgctcatcaccaactccaatgt

SEQ ID NO: 22735 - DNA, 25 bp, Mus musculus
cgtgctcatcaccaactccaatgtc

SEQ ID NO: 22736 - DNA, 25 bp, Mus musculus
tgctcatcaccaactccaatgtccg

SEQ ID NO: 22737 - DNA, 25 bp, Mus musculus
actccaatgtccgccattccctggg

SEQ ID NO: 22738 - DNA, 25 bp, Mus musculus
atgtccgccattccctgggctccag

SEQ ID NO: 22739 - DNA, 25 bp, Mus musculus
tgggctccagcgagtacccggttcg

SEQ ID NO: 22740 - DNA, 25 bp, Mus musculus
ctgtgtccctcatacgacacgtcct

SEQ ID NO: 22741 - DNA, 25 bp, Mus musculus
tcatacgacacgtcctaagcgggaa

SEQ ID NO: 22742 - DNA, 25 bp, Mus musculus
gcaagcccggaaagccttcgacagg

SEQ ID NO: 22743 - DNA, 25 bp, Mus musculus
cttcgacagggccacgaagctggag

SEQ ID NO: 22744 - DNA, 25 bp, Mus musculus
ggagtgcttctcagccatcgtagag

SEQ ID NO: 22745 - DNA, 25 bp, Mus musculus
gtgcttctcagccatcgtagagggc

SEQ ID NO: 22746 - DNA, 25 bp, Mus musculus
ctcagccatcgtagagggcgacagc

SEQ ID NO: 22747 - DNA, 25 bp, Mus musculus
acgtgtcatcgaagacctctcaggc

SEQ ID NO: 22748 - DNA, 25 bp, Mus musculus
tgtcatcgaagacctctcaggcccc

SEQ ID NO: 22749 - DNA, 25 bp, Mus musculus
gagactctgattcctgccctggctt

SEQ ID NO: 22750 - DNA, 25 bp, Mus musculus
ctgattcctgccctggcttggcctg

SEQ ID NO: 22751 - DNA, 25 bp, Mus musculus
cccttggtctggactgaatagccca

SEQ ID NO: 22752 - DNA, 25 bp, Mus musculus
tacgacacgtcctaagcgggaatat

SEQ ID NO: 22753 - DNA, 25 bp, Mus musculus
gacacgtcctaagcgggaatatgag

SEQ ID NO: 22754 - DNA, 25 bp, Mus musculus
tcaggcgcacaagttcattgaggct

SEQ ID NO: 22755 - DNA, 25 bp, Mus musculus
cattgaggctggccagtacaacagc

SEQ ID NO: 22756 - DNA, 25 bp, Mus musculus
tggccagtacaacagccacctctac

SEQ ID NO: 22757 - DNA, 25 bp, Mus musculus
gcactgcatccttgatgtctcagcc

SEQ ID NO: 22758 - DNA, 25 bp, Mus musculus
catccttgatgtctcagccaatgcc

SEQ ID NO: 22759 - DNA, 25 bp, Mus musculus
ctccctggagaatgtgctagagatc

SEQ ID NO: 22760 - DNA, 25 bp, Mus musculus
agtcgcacccaggatgatctcagca

SEQ ID NO: 22761 - DNA, 25 bp, Mus musculus
agcagcgatcctgaccttgctccta

SEQ ID NO: 22762 - DNA, 25 bp, Mus musculus
atgtcgactcaagatcctaggtccg

SEQ ID NO: 22763 - DNA, 25 bp, Mus musculus
caagatcctaggtccgcacaggagc

SEQ ID NO: 22764 - DNA, 25 bp, Mus musculus
gatcctaggtccgcacaggagctat

SEQ ID NO: 22765 - DNA, 25 bp, Mus musculus
cctaggtccgcacaggagctatagc

SEQ ID NO: 22766 - DNA, 25 bp, Mus musculus
caggagctatagccacccgtgagat

SEQ ID NO: 22767 - DNA, 25 bp, Mus musculus
tagccacccgtgagatagcagatca

SEQ ID NO: 22768 - DNA, 25 bp, Mus musculus
tagcagatcatgtctacacgggccc

SEQ ID NO: 22769 - DNA, 25 bp, Mus musculus
atgtctacacgggcccgatgacccg

SEQ ID NO: 22770 - DNA, 25 bp, Mus musculus
gcccgatgacccggagcgaggagac

SEQ ID NO: 22771 - DNA, 25 bp, Mus musculus
cgatgacccggagcgaggagacaca

SEQ ID NO: 22772 - DNA, 25 bp, Mus musculus
agcgatcctgaccttgctcctactg

SEQ ID NO: 22773 - DNA, 25 bp, Mus musculus
cctgaccttgctcctactggtggat

SEQ ID NO: 22774 - DNA, 25 bp, Mus musculus
gaccttgctcctactggtggatcca

SEQ ID NO: 22775 - DNA, 25 bp, Mus musculus
cctactggtggatccagcagccgcc

SEQ ID NO: 22776 - DNA, 25 bp, Mus musculus
tattgtggatgctgtgctgtagctg

SEQ ID NO: 22777 - DNA, 25 bp, Mus musculus
ggatgctgtgctgtagctgtatcgt

SEQ ID NO: 22778 - DNA, 25 bp, Mus musculus
taatgtccttaaactactctaatgt

SEQ ID NO: 22779 - DNA, 25 bp, Mus musculus
ctaatgtcgactcaagatcctaggt

SEQ ID NO: 22780 - DNA, 25 bp, Mus musculus
gcttctcctcagaggtgctaatccc

SEQ ID NO: 22781 - DNA, 25 bp, Mus musculus
taatcccaatttgaaagatggaact

SEQ ID NO: 22782 - DNA, 25 bp, Mus musculus
gcccttgcacttggctgccaaagaa

SEQ ID NO: 22783 - DNA, 25 bp, Mus musculus
ccttatgaagcacacagcctgcaat

SEQ ID NO: 22784 - DNA, 25 bp, Mus musculus
gaagcacacagcctgcaatgtgggg

SEQ ID NO: 22785 - DNA, 25 bp, Mus musculus
cacagcctgcaatgtggggcatcgg

SEQ ID NO: 22786 - DNA, 25 bp, Mus musculus
cgccttcgacttggccaggttctat

SEQ ID NO: 22787 - DNA, 25 bp, Mus musculus
cgacttggccaggttctatggaaga

SEQ ID NO: 22788 - DNA, 25 bp, Mus musculus
ggtcattagcctgatggaggcaaat

SEQ ID NO: 22789 - DNA, 25 bp, Mus musculus
agccacaagcctgcagtgaatgtgt

SEQ ID NO: 22790 - DNA, 25 bp, Mus musculus
tcactgacctcacactgtccgttag

SEQ ID NO: 22791 - DNA, 25 bp, Mus musculus
cactgtccgttagttggttggctgt

SEQ ID NO: 22792 - DNA, 25 bp, Mus musculus
tggttttgctgtcattcatgatgct

SEQ ID NO: 22793 - DNA, 25 bp, Mus musculus
tgatgctgccagagcaggtttcctg

SEQ ID NO: 22794 - DNA, 25 bp, Mus musculus
agcaggtttcctggacactgtacag

SEQ ID NO: 22795 - DNA, 25 bp, Mus musculus
tttcctggacactgtacaggctttg

SEQ ID NO: 22796 - DNA, 25 bp, Mus musculus
ggacactgtacaggctttgctggag

SEQ ID NO: 22797 - DNA, 25 bp, Mus musculus
tgtacaggctttgctggagttccag

SEQ ID NO: 22798 - DNA, 25 bp, Mus musculus
gctggagttccaggctgatgttaac

SEQ ID NO: 22799 - DNA, 25 bp, Mus musculus
gaacctgcccttgcacttggctgcc

SEQ ID NO: 22800 - DNA, 25 bp, Mus musculus
cacagggacgcttccggtctcactc

SEQ ID NO: 22801 - DNA, 25 bp, Mus musculus
cagaacctcatggacattctgcagg

SEQ ID NO: 22802 - DNA, 25 bp, Mus musculus
cggttcagtttcctctgcactgggg

SEQ ID NO: 22803 - DNA, 25 bp, Mus musculus
agtttcctctgcactggggctgcac

SEQ ID NO: 22804 - DNA, 25 bp, Mus musculus
ctctgcactggggctgcaccagggc

SEQ ID NO: 22805 - DNA, 25 bp, Mus musculus
tttaaagccctagcctcagagtgag

SEQ ID NO: 22806 - DNA, 25 bp, Mus musculus
cccttggaagctggtgaccttggca

SEQ ID NO: 22807 - DNA, 25 bp, Mus musculus
gaagctggtgaccttggcaggctgt

SEQ ID NO: 22808 - DNA, 25 bp, Mus musculus
ggtgaccttggcaggctgtgctcag

SEQ ID NO: 22809 - DNA, 25 bp, Mus musculus
gtgtgagccatctactttgggcatg

SEQ ID NO: 22810 - DNA, 25 bp, Mus musculus
gaaggtttccagtctgttgtacaga

SEQ ID NO: 22811 - DNA, 25 bp, Mus musculus
ttccagtctgttgtacagagtttga

SEQ ID NO: 22812 - DNA, 25 bp, Mus musculus
ctcatggacattctgcaggggcaca

SEQ ID NO: 22813 - DNA, 25 bp, Mus musculus
tccagtctgttgtacagagtttgaa

SEQ ID NO: 22814 - DNA, 25 bp, Mus musculus
gacattctgcaggggcacatgatga

SEQ ID NO: 22815 - DNA, 25 bp, Mus musculus
atgatgatcccaatgtgacccaagg

SEQ ID NO: 22816 - DNA, 25 bp, Mus musculus
atcccaatgtgacccaaggccactg

SEQ ID NO: 22817 - DNA, 25 bp, Mus musculus
atgtgacccaaggccactgtctcca

SEQ ID NO: 22818 - DNA, 25 bp, Mus musculus
tctcttttcacacctgtccattgaa

SEQ ID NO: 22819 - DNA, 25 bp, Mus musculus
ctcctacaggcaacagcatctaaac

SEQ ID NO: 22820 - DNA, 25 bp, Mus musculus
caggcaacagcatctaaacggttca

SEQ ID NO: 22821 - DNA, 25 bp, Mus musculus
tccactctcttgtccgtgctggggt

SEQ ID NO: 22822 - DNA, 25 bp, Mus musculus
cctcctatctgctgattcctgcagc

SEQ ID NO: 22823 - DNA, 25 bp, Mus musculus
cctttgtctccaacgagctagatga

SEQ ID NO: 22824 - DNA, 25 bp, Mus musculus
tctccaacgagctagatgatcccga

SEQ ID NO: 22825 - DNA, 25 bp, Mus musculus
tggccctggctaactggcagagcca

SEQ ID NO: 22826 - DNA, 25 bp, Mus musculus
tgaatctggtctatgacgtgactcc

SEQ ID NO: 22827 - DNA, 25 bp, Mus musculus
cacctgagctcgtggatctggtgat

SEQ ID NO: 22828 - DNA, 25 bp, Mus musculus
agctcgtggatctggtgatcacaga

SEQ ID NO: 22829 - DNA, 25 bp, Mus musculus
gcatgatcccttgcagttctgtgcc

SEQ ID NO: 22830 - DNA, 25 bp, Mus musculus
gcagttctgtgcctgttgttcttcg

SEQ ID NO: 22831 - DNA, 25 bp, Mus musculus
ctgtgcctgttgttcttcgagtcaa

SEQ ID NO: 22832 - DNA, 25 bp, Mus musculus
ctgttgttcttcgagtcaagagcag

SEQ ID NO: 22833 - DNA, 25 bp, Mus musculus
atctgctgattcctgcagcctccta

SEQ ID NO: 22834 - DNA, 25 bp, Mus musculus
atgtgcttccagaggtttctaaggt

SEQ ID NO: 22835 - DNA, 25 bp, Mus musculus
ttccagaggtttctaaggtgctatt

SEQ ID NO: 22836 - DNA, 25 bp, Mus musculus
ctcatgcactcctggccaatggatc

SEQ ID NO: 22837 - DNA, 25 bp, Mus musculus
ctcataacgttccagtactggtctg

SEQ ID NO: 22838 - DNA, 25 bp, Mus musculus
cagtactggtctgctgtgaaacgta

SEQ ID NO: 22839 - DNA, 25 bp, Mus musculus
acaagttctgtgaacgtgtgcagac

SEQ ID NO: 22840 - DNA, 25 bp, Mus musculus
ctgatgcctttgtctccaacgagct

SEQ ID NO: 22841 - DNA, 25 bp, Mus musculus
aagatccctgcctcggggatcagcc

SEQ ID NO: 22842 - DNA, 25 bp, Mus musculus
cctgcctcggggatcagccagattt

SEQ ID NO: 22843 - DNA, 25 bp, Mus musculus
tcctccctggaaatggacctggagg

SEQ ID NO: 22844 - DNA, 25 bp, Mus musculus
atgatgtggccactgtagtatctcc

SEQ ID NO: 22845 - DNA, 25 bp, Mus musculus
tacaaaggcacacccatgcacacac

SEQ ID NO: 22846 - DNA, 25 bp, Mus musculus
cacacacacacatttactgggaagc

SEQ ID NO: 22847 - DNA, 25 bp, Mus musculus
cacacatttactgggaagcaggctt

SEQ ID NO: 22848 - DNA, 25 bp, Mus musculus
tttactgggaagcaggcttgcttcc

SEQ ID NO: 22849 - DNA, 25 bp, Mus musculus
tgcttccaccttacttttgacagaa

SEQ ID NO: 22850 - DNA, 25 bp, Mus musculus
gcattcctattgaaactgttaaaat

SEQ ID NO: 22851 - DNA, 25 bp, Mus musculus
ttaaaatcctcaagcagcaagacaa

SEQ ID NO: 22852 - DNA, 25 bp, Mus musculus
tcctcaagcagcaagacaattaaaa

SEQ ID NO: 22853 - DNA, 25 bp, Mus musculus
aatcattaccaagtagcctgtcaga

SEQ ID NO: 22854 - DNA, 25 bp, Mus musculus
ttttttgagagccagcgcatcctaa

SEQ ID NO: 22855 - DNA, 25 bp, Mus musculus
cagcgcatcctaactggtggcaaag

SEQ ID NO: 22856 - DNA, 25 bp, Mus musculus
atcctaactggtggcaaagatatca

SEQ ID NO: 22857 - DNA, 25 bp, Mus musculus
gaaatcagtcagccagaaacacctc

SEQ ID NO: 22858 - DNA, 25 bp, Mus musculus
ccagaaacacctcagcacaaaccta

SEQ ID NO: 22859 - DNA, 25 bp, Mus musculus
agcacccagaagaccagggatgctg

SEQ ID NO: 22860 - DNA, 25 bp, Mus musculus
gatgctgcatctgcgctggcctccc

SEQ ID NO: 22861 - DNA, 25 bp, Mus musculus
ctgattataactccgacgtttacag

SEQ ID NO: 22862 - DNA, 25 bp, Mus musculus
ataactccgacgtttacagctgact

SEQ ID NO: 22863 - DNA, 25 bp, Mus musculus
gtagatttcaccacaagtcaggagc

SEQ ID NO: 22864 - DNA, 25 bp, Mus musculus
ttcaccacaagtcaggagctggtgg

SEQ ID NO: 22865 - DNA, 25 bp, Mus musculus
cttacagacggcaggcatgcagacg

SEQ ID NO: 22866 - DNA, 25 bp, Mus musculus
aggcatgcagacgccagtgtgctgc

SEQ ID NO: 22867 - DNA, 25 bp, Mus musculus
gtgctgctcttccgatgtgtggact

SEQ ID NO: 22868 - DNA, 25 bp, Mus musculus
ctcttccgatgtgtggactgctgag

SEQ ID NO: 22869 - DNA, 25 bp, Mus musculus
aactagggcccagtcaggtctgcta

SEQ ID NO: 22870 - DNA, 25 bp, Mus musculus
gtcaggtctgctattccacgtgcag

SEQ ID NO: 22871 - DNA, 25 bp, Mus musculus
tctgctattccacgtgcagagttcc

SEQ ID NO: 22872 - DNA, 25 bp, Mus musculus
attccacgtgcagagttcctattat

SEQ ID NO: 22873 - DNA, 25 bp, Mus musculus
gctgactaacactccatgattaatt

SEQ ID NO: 22874 - DNA, 25 bp, Mus musculus
taacactccatgattaattgggcca

SEQ ID NO: 22875 - DNA, 25 bp, Mus musculus
tcagccccatgtctcacctgtggac

SEQ ID NO: 22876 - DNA, 25 bp, Mus musculus
ccatgtctcacctgtggacaatcac

SEQ ID NO: 22877 - DNA, 25 bp, Mus musculus
ctcacctgtggacaatcacttattt

SEQ ID NO: 22878 - DNA, 25 bp, Mus musculus
aatactcaatcaccacatgatgtaa

SEQ ID NO: 22879 - DNA, 25 bp, Mus musculus
atggttcagttttcacaggatacaa

SEQ ID NO: 22880 - DNA, 25 bp, Mus musculus
cagttttcacaggatacaaggcatt

SEQ ID NO: 22881 - DNA, 25 bp, Mus musculus
gaacatgctccgaccatctcggctc

SEQ ID NO: 22882 - DNA, 25 bp, Mus musculus
acgcttcaggaccccagaagagagc

SEQ ID NO: 22883 - DNA, 25 bp, Mus musculus
agctggcttcccaagctactgcgga

SEQ ID NO: 22884 - DNA, 25 bp, Mus musculus
ctggcttcccaagctactgcggagt

SEQ ID NO: 22885 - DNA, 25 bp, Mus musculus
tggcttcccaagctactgcggagtt

SEQ ID NO: 22886 - DNA, 25 bp, Mus musculus
gcttcccaagctactgcggagtttg

SEQ ID NO: 22887 - DNA, 25 bp, Mus musculus
cttcccaagctactgcggagtttga

SEQ ID NO: 22888 - DNA, 25 bp, Mus musculus
tcccaagctactgcggagtttgaga

SEQ ID NO: 22889 - DNA, 25 bp, Mus musculus
cccaagctactgcggagtttgagaa

SEQ ID NO: 22890 - DNA, 25 bp, Mus musculus
caagctactgcggagtttgagaagg

SEQ ID NO: 22891 - DNA, 25 bp, Mus musculus
aagctactgcggagtttgagaaggc

SEQ ID NO: 22892 - DNA, 25 bp, Mus musculus
ctactgcggagtttgagaaggcaat

SEQ ID NO: 22893 - DNA, 25 bp, Mus musculus
gatactgccaaagatgctctcttcg

SEQ ID NO: 22894 - DNA, 25 bp, Mus musculus
atactgccaaagatgctctcttcgc

SEQ ID NO: 22895 - DNA, 25 bp, Mus musculus
actgccaaagatgctctcttcgcct

SEQ ID NO: 22896 - DNA, 25 bp, Mus musculus
ctgccaaagatgctctcttcgcctc

SEQ ID NO: 22897 - DNA, 25 bp, Mus musculus
tttttccaggaactgtttgacagtg

SEQ ID NO: 22898 - DNA, 25 bp, Mus musculus
ttttccaggaactgtttgacagtga

SEQ ID NO: 22899 - DNA, 25 bp, Mus musculus
ttccaggaactgtttgacagtgagc

SEQ ID NO: 22900 - DNA, 25 bp, Mus musculus
aactgtttgacagtgagctggcttc

SEQ ID NO: 22901 - DNA, 25 bp, Mus musculus
atttggcccaagaagggcacagctg

SEQ ID NO: 22902 - DNA, 25 bp, Mus musculus
gtattctggtacaaccttcttcgca

SEQ ID NO: 22903 - DNA, 25 bp, Mus musculus
atgtcccagctcctgtcaggcaggt

SEQ ID NO: 22904 - DNA, 25 bp, Mus musculus
cagctcctgtcaggcaggtcattgg

SEQ ID NO: 22905 - DNA, 25 bp, Mus musculus
ctgtcaggcaggtcattggaggagc

SEQ ID NO: 22906 - DNA, 25 bp, Mus musculus
cctgagcctagtcctgggtgacctg

SEQ ID NO: 22907 - DNA, 25 bp, Mus musculus
cagactctgaccagcttacacctgc

SEQ ID NO: 22908 - DNA, 25 bp, Mus musculus
atggctgcggtagagccagactata

SEQ ID NO: 22909 - DNA, 25 bp, Mus musculus
gagccagactatagcacccggcacg

SEQ ID NO: 22910 - DNA, 25 bp, Mus musculus
gactatagcacccggcacggtcgct

SEQ ID NO: 22911 - DNA, 25 bp, Mus musculus
ggtcgctttgtacctcagatatttc

SEQ ID NO: 22912 - DNA, 25 bp, Mus musculus
tttgtacctcagatatttcaggtag

SEQ ID NO: 22913 - DNA, 25 bp, Mus musculus
tggtacaaccttcttcgcagtgggg

SEQ ID NO: 22914 - DNA, 25 bp, Mus musculus
agacatgcagcctgccctgtgcttg

SEQ ID NO: 22915 - DNA, 25 bp, Mus musculus
tccaacaagtggttccatgagcgag

SEQ ID NO: 22916 - DNA, 25 bp, Mus musculus
aagtggttccatgagcgaggacagg

SEQ ID NO: 22917 - DNA, 25 bp, Mus musculus
gttgattgacgtccttttctctccg

SEQ ID NO: 22918 - DNA, 25 bp, Mus musculus
ccctggcccatagtccaaatcatct

SEQ ID NO: 22919 - DNA, 25 bp, Mus musculus
cccatagtccaaatcatcttcaagt

SEQ ID NO: 22920 - DNA, 25 bp, Mus musculus
atcatcttcaagttcaacatgacag

SEQ ID NO: 22921 - DNA, 25 bp, Mus musculus
ctctcagaagttcttctttggggat

SEQ ID NO: 22922 - DNA, 25 bp, Mus musculus
tcagaagttcttctttggggatgcc

SEQ ID NO: 22923 - DNA, 25 bp, Mus musculus
tatccagcggacaagccctgctcgg

SEQ ID NO: 22924 - DNA, 25 bp, Mus musculus
ttcccaggactgacttttctactcg

SEQ ID NO: 22925 - DNA, 25 bp, Mus musculus
ggactgacttttctactcgtgcatt

SEQ ID NO: 22926 - DNA, 25 bp, Mus musculus
ctgacttttctactcgtgcattcca

SEQ ID NO: 22927 - DNA, 25 bp, Mus musculus
acttttctactcgtgcattccagct

SEQ ID NO: 22928 - DNA, 25 bp, Mus musculus
tctccccatggttggagcagccaaa

SEQ ID NO: 22929 - DNA, 25 bp, Mus musculus
ccccatggttggagcagccaaaaat

SEQ ID NO: 22930 - DNA, 25 bp, Mus musculus
aaatggggcgctgtcctcagaataa

SEQ ID NO: 22931 - DNA, 25 bp, Mus musculus
ggcgctgtcctcagaataaacctgt

SEQ ID NO: 22932 - DNA, 25 bp, Mus musculus
gctgtcctcagaataaacctgttta

SEQ ID NO: 22933 - DNA, 25 bp, Mus musculus
ttttagccatttggccctgctgctg

SEQ ID NO: 22934 - DNA, 25 bp, Mus musculus
tcctcagaataaacctgtttacact

SEQ ID NO: 22935 - DNA, 25 bp, Mus musculus
gaagctgcaggcccaccttcggggg

SEQ ID NO: 22936 - DNA, 25 bp, Mus musculus
ctactttccccgggatggagatgag

SEQ ID NO: 22937 - DNA, 25 bp, Mus musculus
tccccgggatggagatgaggtgcca

SEQ ID NO: 22938 - DNA, 25 bp, Mus musculus
agcccctgagaccgaggaggagcca

SEQ ID NO: 22939 - DNA, 25 bp, Mus musculus
ccggacccagattctctctgtgctg

SEQ ID NO: 22940 - DNA, 25 bp, Mus musculus
gctcagtggcatcgtttctatccag

SEQ ID NO: 22941 - DNA, 25 bp, Mus musculus
ttctatccagcggacaagccctgct

SEQ ID NO: 22942 - DNA, 25 bp, Mus musculus
cttgccttctgactgtcacacctga

SEQ ID NO: 22943 - DNA, 25 bp, Mus musculus
tgccttctgactgtcacacctgaac

SEQ ID NO: 22944 - DNA, 25 bp, Mus musculus
aagaccgcacgcacattggcaatga

SEQ ID NO: 22945 - DNA, 25 bp, Mus musculus
gaccgcacgcacattggcaatgaag

SEQ ID NO: 22946 - DNA, 25 bp, Mus musculus
ccgcacgcacattggcaatgaagca

SEQ ID NO: 22947 - DNA, 25 bp, Mus musculus
gcacgcacattggcaatgaagcacc

SEQ ID NO: 22948 - DNA, 25 bp, Mus musculus
gcaatgaagcaccatacatagtatg

SEQ ID NO: 22949 - DNA, 25 bp, Mus musculus
aatgaagcaccatacatagtatgtt

SEQ ID NO: 22950 - DNA, 25 bp, Mus musculus
aagcaccatacatagtatgttcagg

SEQ ID NO: 22951 - DNA, 25 bp, Mus musculus
aggaatgtcacacgccacgcacatc

SEQ ID NO: 22952 - DNA, 25 bp, Mus musculus
gaatgtcacacgccacgcacatccg

SEQ ID NO: 22953 - DNA, 25 bp, Mus musculus
tcacctggacctccttcaattttgg

SEQ ID NO: 22954 - DNA, 25 bp, Mus musculus
ctgactgtcacacctgaacagaacg

SEQ ID NO: 22955 - DNA, 25 bp, Mus musculus
gtcacacctgaacagaacggacacc

SEQ ID NO: 22956 - DNA, 25 bp, Mus musculus
cacacctgaacagaacggacacctg

SEQ ID NO: 22957 - DNA, 25 bp, Mus musculus
tgaacagaacggacacctgtctcct

SEQ ID NO: 22958 - DNA, 25 bp, Mus musculus
ggacacctgtctcctttgtcctcgg

SEQ ID NO: 22959 - DNA, 25 bp, Mus musculus
tcctcggacacagtttttcacggag

SEQ ID NO: 22960 - DNA, 25 bp, Mus musculus
agaacaaagaccgcacgcacattgg

SEQ ID NO: 22961 - DNA, 25 bp, Mus musculus
caaagaccgcacgcacattggcaat

SEQ ID NO: 22962 - DNA, 25 bp, Mus musculus
ggtggcctcatggcacagaaagagg

SEQ ID NO: 22963 - DNA, 25 bp, Mus musculus
ggcctcatggcacagaaagaggcta

SEQ ID NO: 22964 - DNA, 25 bp, Mus musculus
cagccttggagccttcctggaactc

SEQ ID NO: 22965 - DNA, 25 bp, Mus musculus
ccttggagccttcctggaactcctg

SEQ ID NO: 22966 - DNA, 25 bp, Mus musculus
cttcctggaactcctgaagagtcag

SEQ ID NO: 22967 - DNA, 25 bp, Mus musculus
gaagagtcagcttcccatcagcatt

SEQ ID NO: 22968 - DNA, 25 bp, Mus musculus
gagtcagcttcccatcagcattctt

SEQ ID NO: 22969 - DNA, 25 bp, Mus musculus
gcttcccatcagcattcttgtccat

SEQ ID NO: 22970 - DNA, 25 bp, Mus musculus
tcccatcagcattcttgtccatcat

SEQ ID NO: 22971 - DNA, 25 bp, Mus musculus
catcagcattcttgtccatcatggc

SEQ ID NO: 22972 - DNA, 25 bp, Mus musculus
tcttgtccatcatggcaaagatccg

SEQ ID NO: 22973 - DNA, 25 bp, Mus musculus
tgtccatcatggcaaagatccggtc

SEQ ID NO: 22974 - DNA, 25 bp, Mus musculus
agtggttcccacacatcacagctct

SEQ ID NO: 22975 - DNA, 25 bp, Mus musculus
cacacatcacagctctgggcctgga

SEQ ID NO: 22976 - DNA, 25 bp, Mus musculus
tcacagctctgggcctggactatac

SEQ ID NO: 22977 - DNA, 25 bp, Mus musculus
ctctgggcctggactataccagccc

SEQ ID NO: 22978 - DNA, 25 bp, Mus musculus
gcctggactataccagcccatcgta

SEQ ID NO: 22979 - DNA, 25 bp, Mus musculus
ccagcccatcgtagagggacagcgc

SEQ ID NO: 22980 - DNA, 25 bp, Mus musculus
acagcgcctgcacaatggagggatc

SEQ ID NO: 22981 - DNA, 25 bp, Mus musculus
gcgcctgcacaatggagggatcagc

SEQ ID NO: 22982 - DNA, 25 bp, Mus musculus
gctaatcgctaaccctttgtgcaac

SEQ ID NO: 22983 - DNA, 25 bp, Mus musculus
tttgtgcaactcccgacaactctat

SEQ ID NO: 22984 - DNA, 25 bp, Mus musculus
atcagacacctgccagggtgactcg

SEQ ID NO: 22985 - DNA, 25 bp, Mus musculus
agacacctgccagggtgactcgggg

SEQ ID NO: 22986 - DNA, 25 bp, Mus musculus
gggccctctaacctgtgagaaggat

SEQ ID NO: 22987 - DNA, 25 bp, Mus musculus
ctacgtctacgggattgtaagctgg

SEQ ID NO: 22988 - DNA, 25 bp, Mus musculus
gccaggagtctacactcaagtcacc

SEQ ID NO: 22989 - DNA, 25 bp, Mus musculus
aggagtctacactcaagtcaccaag

SEQ ID NO: 22990 - DNA, 25 bp, Mus musculus
agtctacactcaagtcaccaagttc

SEQ ID NO: 22991 - DNA, 25 bp, Mus musculus
ctacactcaagtcaccaagttcctg

SEQ ID NO: 22992 - DNA, 25 bp, Mus musculus
cactcaagtcaccaagttcctgaat

SEQ ID NO: 22993 - DNA, 25 bp, Mus musculus
tcaagtcaccaagttcctgaattgg

SEQ ID NO: 22994 - DNA, 25 bp, Mus musculus
acaactctatgaccacaccatcgat

SEQ ID NO: 22995 - DNA, 25 bp, Mus musculus
actctatgaccacaccatcgatgac

SEQ ID NO: 22996 - DNA, 25 bp, Mus musculus
ctatgaccacaccatcgatgacagt

SEQ ID NO: 22997 - DNA, 25 bp, Mus musculus
ccacaccatcgatgacagtatgatt

SEQ ID NO: 22998 - DNA, 25 bp, Mus musculus
caccatcgatgacagtatgatttgt

SEQ ID NO: 22999 - DNA, 25 bp, Mus musculus
gaaccttcagaagcccggatcagac

SEQ ID NO: 23000 - DNA, 25 bp, Mus musculus
ccttcagaagcccggatcagacacc

SEQ ID NO: 23001 - DNA, 25 bp, Mus musculus
gaagcccggatcagacacctgccag

SEQ ID NO: 23002 - DNA, 25 bp, Mus musculus
cagtcagaccagtaagcccttctgg

SEQ ID NO: 23003 - DNA, 25 bp, Mus musculus
taagcccttctgggtttgagtgtgt

SEQ ID NO: 23004 - DNA, 25 bp, Mus musculus
tctgctcaaagcctaacacagaagc

SEQ ID NO: 23005 - DNA, 25 bp, Mus musculus
caaagcctaacacagaagcagcttc

SEQ ID NO: 23006 - DNA, 25 bp, Mus musculus
ctaacacagaagcagcttcatccca

SEQ ID NO: 23007 - DNA, 25 bp, Mus musculus
catcccagtgacgatgctggacgta

SEQ ID NO: 23008 - DNA, 25 bp, Mus musculus
agtaaacatccgatgctcagagtta

SEQ ID NO: 23009 - DNA, 25 bp, Mus musculus
catccgatgctcagagttagcataa

SEQ ID NO: 23010 - DNA, 25 bp, Mus musculus
tgcattttcacagaaatcaagatgt

SEQ ID NO: 23011 - DNA, 25 bp, Mus musculus
ttgtatactatatcacttagacaac

SEQ ID NO: 23012 - DNA, 25 bp, Mus musculus
agacaactgtgtttcatttgctgta

SEQ ID NO: 23013 - DNA, 25 bp, Mus musculus
aactattccaataaagctggaggag

SEQ ID NO: 23014 - DNA, 25 bp, Mus musculus
aaccaattctggaagcatctaagct

SEQ ID NO: 23015 - DNA, 25 bp, Mus musculus
aagcatctaagcttccataaataac

SEQ ID NO: 23016 - DNA, 25 bp, Mus musculus
ctttaattcttagcataatgacggc

SEQ ID NO: 23017 - DNA, 25 bp, Mus musculus
gcataatgacggccttggattgtct

SEQ ID NO: 23018 - DNA, 25 bp, Mus musculus
ccttggattgtctgacctcagtagc

SEQ ID NO: 23019 - DNA, 25 bp, Mus musculus
attgtctgacctcagtagctattaa

SEQ ID NO: 23020 - DNA, 25 bp, Mus musculus
taacatctgcatcaggccctcagaa

SEQ ID NO: 23021 - DNA, 25 bp, Mus musculus
ctgcatcaggccctcagaatataca

SEQ ID NO: 23022 - DNA, 25 bp, Mus musculus
atctgtcactcatttgttcactggg

SEQ ID NO: 23023 - DNA, 25 bp, Mus musculus
cactcatttgttcactgggatacag

SEQ ID NO: 23024 - DNA, 25 bp, Mus musculus
agacaacaacacttactgtctccat

SEQ ID NO: 23025 - DNA, 25 bp, Mus musculus
caacacttactgtctccatgagttt

SEQ ID NO: 23026 - DNA, 25 bp, Mus musculus
ttactgtctccatgagtttaagtgc

SEQ ID NO: 23027 - DNA, 25 bp, Mus musculus
taagtgcttcagtgtctctgggaat

SEQ ID NO: 23028 - DNA, 25 bp, Mus musculus
cttcagtgtctctgggaatgctcta

SEQ ID NO: 23029 - DNA, 25 bp, Mus musculus
gaagcttcaaggctgtggtcacggc

SEQ ID NO: 23030 - DNA, 25 bp, Mus musculus
tcacggccgctaccatgcaaagcaa

SEQ ID NO: 23031 - DNA, 25 bp, Mus musculus
cttctaccaagacaacatacatcag

SEQ ID NO: 23032 - DNA, 25 bp, Mus musculus
ccaagacaacatacatcagctacag

SEQ ID NO: 23033 - DNA, 25 bp, Mus musculus
caacatacatcagctacagtgatca

SEQ ID NO: 23034 - DNA, 25 bp, Mus musculus
tttgttcactgggatacagtatcct

SEQ ID NO: 23035 - DNA, 25 bp, Mus musculus
gatacagtatcctcctgatggtcac

SEQ ID NO: 23036 - DNA, 25 bp, Mus musculus
tcctgatggtcacttgtactgttta

SEQ ID NO: 23037 - DNA, 25 bp, Mus musculus
tggtcacttgtactgtttatgccat

SEQ ID NO: 23038 - DNA, 25 bp, Mus musculus
gatttaccatgtacaccacgtgcat

SEQ ID NO: 23039 - DNA, 25 bp, Mus musculus
ccatgtacaccacgtgcatcatttg

SEQ ID NO: 23040 - DNA, 25 bp, Mus musculus
acaccacgtgcatcatttggttagc

SEQ ID NO: 23041 - DNA, 25 bp, Mus musculus
agatgtacatccagacaacaacact

SEQ ID NO: 23042 - DNA, 25 bp, Mus musculus
gcctcgtatcttccatgtcaattgg

SEQ ID NO: 23043 - DNA, 25 bp, Mus musculus
tcgtatcttccatgtcaattggttc

SEQ ID NO: 23044 - DNA, 25 bp, Mus musculus
cagtgcccaagagactcccattggg

SEQ ID NO: 23045 - DNA, 25 bp, Mus musculus
ccaagagactcccattgggctagta

SEQ ID NO: 23046 - DNA, 25 bp, Mus musculus
gactcccattgggctagtaccaaag

SEQ ID NO: 23047 - DNA, 25 bp, Mus musculus
ggacctcagtggcctcagcgcagtg

SEQ ID NO: 23048 - DNA, 25 bp, Mus musculus
cctcagtggcctcagcgcagtggac

SEQ ID NO: 23049 - DNA, 25 bp, Mus musculus
cagtggcctcagcgcagtggacacc

SEQ ID NO: 23050 - DNA, 25 bp, Mus musculus
cctcagcgcagtggacaccagtcag

SEQ ID NO: 23051 - DNA, 25 bp, Mus musculus
ggacaccagtcagctgttctccatc

SEQ ID NO: 23052 - DNA, 25 bp, Mus musculus
ccccaaggacttctgggagcaggag

SEQ ID NO: 23053 - DNA, 25 bp, Mus musculus
caaggacttctgggagcaggaggtt

SEQ ID NO: 23054 - DNA, 25 bp, Mus musculus
tatcttccatgtcaattggttccgg

SEQ ID NO: 23055 - DNA, 25 bp, Mus musculus
caattggttccggagagatgaagca

SEQ ID NO: 23056 - DNA, 25 bp, Mus musculus
tgaagcaggccgcttcctgtggcca

SEQ ID NO: 23057 - DNA, 25 bp, Mus musculus
gtggccaggctttggagagaatgct

SEQ ID NO: 23058 - DNA, 25 bp, Mus musculus
gaatgctcgtgtgctagactggatc

SEQ ID NO: 23059 - DNA, 25 bp, Mus musculus
tgctcgtgtgctagactggatctgc

SEQ ID NO: 23060 - DNA, 25 bp, Mus musculus
gctagactggatctgccgaagatta

SEQ ID NO: 23061 - DNA, 25 bp, Mus musculus
agactggatctgccgaagattagaa

SEQ ID NO: 23062 - DNA, 25 bp, Mus musculus
gcaaatactcaaagcttcaagtgat

SEQ ID NO: 23063 - DNA, 25 bp, Mus musculus
actcaaagcttcaagtgatatatgt

SEQ ID NO: 23064 - DNA, 25 bp, Mus musculus
ctacctgtgacctttcccatgctga

SEQ ID NO: 23065 - DNA, 25 bp, Mus musculus
cctgtgacctttcccatgctgaatt

SEQ ID NO: 23066 - DNA, 25 bp, Mus musculus
gtgacctttcccatgctgaattatt

SEQ ID NO: 23067 - DNA, 25 bp, Mus musculus
ttaaaaccatgcagcttcatcaatt

SEQ ID NO: 23068 - DNA, 25 bp, Mus musculus
aaaccatgcagcttcatcaattttt

SEQ ID NO: 23069 - DNA, 25 bp, Mus musculus
aagttattgcgttgccttagcactt

SEQ ID NO: 23070 - DNA, 25 bp, Mus musculus
ttattgcgttgccttagcacttctt

SEQ ID NO: 23071 - DNA, 25 bp, Mus musculus
ttgcgttgccttagcacttctttct

SEQ ID NO: 23072 - DNA, 25 bp, Mus musculus
tgccttagcacttctttcttctcta

SEQ ID NO: 23073 - DNA, 25 bp, Mus musculus
agcacttctttcttctctaattgta

SEQ ID NO: 23074 - DNA, 25 bp, Mus musculus
tcgttactgcctttggaagaaacag

SEQ ID NO: 23075 - DNA, 25 bp, Mus musculus
gatcaaagttcctgttcaccttatg

SEQ ID NO: 23076 - DNA, 25 bp, Mus musculus
atgtgtaccacgaatttcgtgtagc

SEQ ID NO: 23077 - DNA, 25 bp, Mus musculus
accacgaatttcgtgtagctgtatt

SEQ ID NO: 23078 - DNA, 25 bp, Mus musculus
ttcgtgtagctgtattcagatcgta

SEQ ID NO: 23079 - DNA, 25 bp, Mus musculus
ttttcaaccagcattttactacctg

SEQ ID NO: 23080 - DNA, 25 bp, Mus musculus
tcaaccagcattttactacctgtga

SEQ ID NO: 23081 - DNA, 25 bp, Mus musculus
accagcattttactacctgtgacct

SEQ ID NO: 23082 - DNA, 25 bp, Mus musculus
ccagcgacacgcggccaccgtggag

SEQ ID NO: 23083 - DNA, 25 bp, Mus musculus
agcagccggctcagcatgtcgcggc

SEQ ID NO: 23084 - DNA, 25 bp, Mus musculus
agttcgtcggtgcccagcaggaagc

SEQ ID NO: 23085 - DNA, 25 bp, Mus musculus
tgcccagcaggaagcgggtgctgcc

SEQ ID NO: 23086 - DNA, 25 bp, Mus musculus
agcatgaagtcgcggtattgctcga

SEQ ID NO: 23087 - DNA, 25 bp, Mus musculus
cgcggtattgctcgatcgggtcgtg

SEQ ID NO: 23088 - DNA, 25 bp, Mus musculus
gcggtattgctcgatcgggtcgtgc

SEQ ID NO: 23089 - DNA, 25 bp, Mus musculus
cgcacagcggccggaacagcgaggc

SEQ ID NO: 23090 - DNA, 25 bp, Mus musculus
cacagcggccggaacagcgaggcca

SEQ ID NO: 23091 - DNA, 25 bp, Mus musculus
cgacgatcagcgcgatgaaggccca

SEQ ID NO: 23092 - DNA, 25 bp, Mus musculus
gacgatcagcgcgatgaaggcccac

SEQ ID NO: 23093 - DNA, 25 bp, Mus musculus
acgatcagcgcgatgaaggcccacg

SEQ ID NO: 23094 - DNA, 25 bp, Mus musculus
gcagccggctcagcatgtcgcggcc

SEQ ID NO: 23095 - DNA, 25 bp, Mus musculus
cagccggctcagcatgtcgcggccg

SEQ ID NO: 23096 - DNA, 25 bp, Mus musculus
agccggctcagcatgtcgcggccga

SEQ ID NO: 23097 - DNA, 25 bp, Mus musculus
cggctcagcatgtcgcggccgagtt

SEQ ID NO: 23098 - DNA, 25 bp, Mus musculus
gctcagcatgtcgcggccgagttcg

SEQ ID NO: 23099 - DNA, 25 bp, Mus musculus
tcagcatgtcgcggccgagttcgtc

SEQ ID NO: 23100 - DNA, 25 bp, Mus musculus
cagcatgtcgcggccgagttcgtcg

SEQ ID NO: 23101 - DNA, 25 bp, Mus musculus
agcatgtcgcggccgagttcgtcgg

SEQ ID NO: 23102 - DNA, 25 bp, Mus musculus
aaaggcggctcagcaccttgtatct

SEQ ID NO: 23103 - DNA, 25 bp, Mus musculus
tcagcaccttgtatcttgaagtctt

SEQ ID NO: 23104 - DNA, 25 bp, Mus musculus
aggatggagccttttctgagctagt

SEQ ID NO: 23105 - DNA, 25 bp, Mus musculus
gctaaaacttcctactgtgatgtga

SEQ ID NO: 23106 - DNA, 25 bp, Mus musculus
aattatagccaaagctagtatagca

SEQ ID NO: 23107 - DNA, 25 bp, Mus musculus
atcagtttcattttaactctcaagt

SEQ ID NO: 23108 - DNA, 25 bp, Mus musculus
tcttaggcaccatttgggagagttt

SEQ ID NO: 23109 - DNA, 25 bp, Mus musculus
taggcaccatttgggagagtttctg

SEQ ID NO: 23110 - DNA, 25 bp, Mus musculus
tttatactgttctcacttgttacag

SEQ ID NO: 23111 - DNA, 25 bp, Mus musculus
ctgttctcacttgttacagtcatag

SEQ ID NO: 23112 - DNA, 25 bp, Mus musculus
ttctcacttgttacagtcatagact

SEQ ID NO: 23113 - DNA, 25 bp, Mus musculus
ttatatgacatctggctaaaagcaa

SEQ ID NO: 23114 - DNA, 25 bp, Mus musculus
atcttgaagtcttcagcatgttacg

SEQ ID NO: 23115 - DNA, 25 bp, Mus musculus
ttgaagtcttcagcatgttacgtga

SEQ ID NO: 23116 - DNA, 25 bp, Mus musculus
aagtcttcagcatgttacgtgatga

SEQ ID NO: 23117 - DNA, 25 bp, Mus musculus
gaaagccttactctcccagtgaata

SEQ ID NO: 23118 - DNA, 25 bp, Mus musculus
ctcccagtgaatactctctgcagca

SEQ ID NO: 23119 - DNA, 25 bp, Mus musculus
ccagtgaatactctctgcagcaaac

SEQ ID NO: 23120 - DNA, 25 bp, Mus musculus
actctctgcagcaaaccagagatgg

SEQ ID NO: 23121 - DNA, 25 bp, Mus musculus
ctctgcagcaaaccagagatggcaa

SEQ ID NO: 23122 - DNA, 25 bp, Mus musculus
tggacgtgggccggagatgaactcc

SEQ ID NO: 23123 - DNA, 25 bp, Mus musculus
agatgaactccctgactgggctgcg

SEQ ID NO: 23124 - DNA, 25 bp, Mus musculus
gaccctaaggacatcattggcagag

SEQ ID NO: 23125 - DNA, 25 bp, Mus musculus
aaggacatcattggcagaggagtga

SEQ ID NO: 23126 - DNA, 25 bp, Mus musculus
acatcattggcagaggagtgagctc

SEQ ID NO: 23127 - DNA, 25 bp, Mus musculus
atcattggcagaggagtgagctctg

SEQ ID NO: 23128 - DNA, 25 bp, Mus musculus
agtgagctctgtggtccgccgctgt

SEQ ID NO: 23129 - DNA, 25 bp, Mus musculus
tccgccgctgtgtccatcgagctac

SEQ ID NO: 23130 - DNA, 25 bp, Mus musculus
cgccgctgtgtccatcgagctaccg

SEQ ID NO: 23131 - DNA, 25 bp, Mus musculus
cgggatttcgcggttttatgagatg

SEQ ID NO: 23132 - DNA, 25 bp, Mus musculus
ggatttcgcggttttatgagatgca

SEQ ID NO: 23133 - DNA, 25 bp, Mus musculus
atttcgcggttttatgagatgcaca

SEQ ID NO: 23134 - DNA, 25 bp, Mus musculus
atgaactccctgactgggctgcggc

SEQ ID NO: 23135 - DNA, 25 bp, Mus musculus
gaactccctgactgggctgcggcaa

SEQ ID NO: 23136 - DNA, 25 bp, Mus musculus
actccctgactgggctgcggcaaag

SEQ ID NO: 23137 - DNA, 25 bp, Mus musculus
cctgactgggctgcggcaaagagtt

SEQ ID NO: 23138 - DNA, 25 bp, Mus musculus
agaagtacgaccctaaggacatcat

SEQ ID NO: 23139 - DNA, 25 bp, Mus musculus
aagtacgaccctaaggacatcattg

SEQ ID NO: 23140 - DNA, 25 bp, Mus musculus
gtacgaccctaaggacatcattggc

SEQ ID NO: 23141 - DNA, 25 bp, Mus musculus
acgaccctaaggacatcattggcag

SEQ ID NO: 23142 - DNA, 25 bp, Mus musculus
cataccgtgcactccagggagcact

SEQ ID NO: 23143 - DNA, 25 bp, Mus musculus
gtgcactccagggagcactgatgat

SEQ ID NO: 23144 - DNA, 25 bp, Mus musculus
tatttaacctctcaacatatctggt

SEQ ID NO: 23145 - DNA, 25 bp, Mus musculus
acctctcaacatatctggttcccag

SEQ ID NO: 23146 - DNA, 25 bp, Mus musculus
caacatatctggttcccagacactg

SEQ ID NO: 23147 - DNA, 25 bp, Mus musculus
ttcccagacactgggtaccaaagat

SEQ ID NO: 23148 - DNA, 25 bp, Mus musculus
cgatcattcacaaattcctttacac

SEQ ID NO: 23149 - DNA, 25 bp, Mus musculus
ttcacaaattcctttacacagccga

SEQ ID NO: 23150 - DNA, 25 bp, Mus musculus
aattcctttacacagccgagtacag

SEQ ID NO: 23151 - DNA, 25 bp, Mus musculus
gtgacagctcttacttcagcagcga

SEQ ID NO: 23152 - DNA, 25 bp, Mus musculus
gctcttacttcagcagcgatgaatc

SEQ ID NO: 23153 - DNA, 25 bp, Mus musculus
acttcagcagcgatgaatcggattg

SEQ ID NO: 23154 - DNA, 25 bp, Mus musculus
gattccaggtccctttccagctgct

SEQ ID NO: 23155 - DNA, 25 bp, Mus musculus
ctttccagctgctgacctcacttat

SEQ ID NO: 23156 - DNA, 25 bp, Mus musculus
agctgctgacctcacttatggacat

SEQ ID NO: 23157 - DNA, 25 bp, Mus musculus
ttgacacgctcatgaccaaatggag

SEQ ID NO: 23158 - DNA, 25 bp, Mus musculus
gcaccaaggctggcactgggggatc

SEQ ID NO: 23159 - DNA, 25 bp, Mus musculus
ggggatcctcaggctatcattacct

SEQ ID NO: 23160 - DNA, 25 bp, Mus musculus
cctcaggctatcattacctgcgttc

SEQ ID NO: 23161 - DNA, 25 bp, Mus musculus
attacctgcgttcaactgtgagcga

SEQ ID NO: 23162 - DNA, 25 bp, Mus musculus
aagttgcagtgagctccaggccatg

SEQ ID NO: 23163 - DNA, 25 bp, Mus musculus
gagctccaggccatgggaactggtc

SEQ ID NO: 23164 - DNA, 25 bp, Mus musculus
gctctggtgccagagatgtaactgg

SEQ ID NO: 23165 - DNA, 25 bp, Mus musculus
gatgtaactgggtcccttgtcccag

SEQ ID NO: 23166 - DNA, 25 bp, Mus musculus
acggtgacttccagcgtcagaaggc

SEQ ID NO: 23167 - DNA, 25 bp, Mus musculus
ggtgacttccagcgtcagaaggcct

SEQ ID NO: 23168 - DNA, 25 bp, Mus musculus
tgacttccagcgtcagaaggcctgg

SEQ ID NO: 23169 - DNA, 25 bp, Mus musculus
acttccagcgtcagaaggcctggta

SEQ ID NO: 23170 - DNA, 25 bp, Mus musculus
ccagcgtcagaaggcctggtaggat

SEQ ID NO: 23171 - DNA, 25 bp, Mus musculus
agcgtcagaaggcctggtaggattg

SEQ ID NO: 23172 - DNA, 25 bp, Mus musculus
cgtcagaaggcctggtaggattgac

SEQ ID NO: 23173 - DNA, 25 bp, Mus musculus
ttgacatggcctcagctccttctgt

SEQ ID NO: 23174 - DNA, 25 bp, Mus musculus
tccaggccatgggaactggtccaga

SEQ ID NO: 23175 - DNA, 25 bp, Mus musculus
catggcctcagctccttctgtgact

SEQ ID NO: 23176 - DNA, 25 bp, Mus musculus
ccatgggaactggtccagagagtta

SEQ ID NO: 23177 - DNA, 25 bp, Mus musculus
cttcctcctctatttcttcacctat

SEQ ID NO: 23178 - DNA, 25 bp, Mus musculus
tctatttcttcacctatgctgttgg

SEQ ID NO: 23179 - DNA, 25 bp, Mus musculus
tatttcttcacctatgctgttggca

SEQ ID NO: 23180 - DNA, 25 bp, Mus musculus
tcttcacctatgctgttggcaggag

SEQ ID NO: 23181 - DNA, 25 bp, Mus musculus
ttcacctatgctgttggcaggagtg

SEQ ID NO: 23182 - DNA, 25 bp, Mus musculus
gggctctggtgccagagatgtaact

SEQ ID NO: 23183 - DNA, 25 bp, Mus musculus
tgtccctaagggaatacagagagat

SEQ ID NO: 23184 - DNA, 25 bp, Mus musculus
ctccaccatctgggaacccagtgtt

SEQ ID NO: 23185 - DNA, 25 bp, Mus musculus
ttctcttggggtagagtgctatcaa

SEQ ID NO: 23186 - DNA, 25 bp, Mus musculus
ctatcaatttctgtagacttagatt

SEQ ID NO: 23187 - DNA, 25 bp, Mus musculus
tttctccttccatcatgtgggtacc

SEQ ID NO: 23188 - DNA, 25 bp, Mus musculus
cttccatcatgtgggtaccagagat

SEQ ID NO: 23189 - DNA, 25 bp, Mus musculus
taagtcaacagccatggcagcaagc

SEQ ID NO: 23190 - DNA, 25 bp, Mus musculus
aacagccatggcagcaagcaccttt

SEQ ID NO: 23191 - DNA, 25 bp, Mus musculus
catggcagcaagcacctttacaagc

SEQ ID NO: 23192 - DNA, 25 bp, Mus musculus
agcaagcacctttacaagctgagca

SEQ ID NO: 23193 - DNA, 25 bp, Mus musculus
cacctttacaagctgagcaatcaca

SEQ ID NO: 23194 - DNA, 25 bp, Mus musculus
ctgagcaatcacactggcccctaat

SEQ ID NO: 23195 - DNA, 25 bp, Mus musculus
catctgggaacccagtgttaaatct

SEQ ID NO: 23196 - DNA, 25 bp, Mus musculus
taaatctcatggacctttagcaaag

SEQ ID NO: 23197 - DNA, 25 bp, Mus musculus
tcatggacctttagcaaagacacca

SEQ ID NO: 23198 - DNA, 25 bp, Mus musculus
acctttagcaaagacaccatattca

SEQ ID NO: 23199 - DNA, 25 bp, Mus musculus
gacaccatattcaaaccaacatata

SEQ ID NO: 23200 - DNA, 25 bp, Mus musculus
atattcaaaccaacatatatgtgtt

SEQ ID NO: 23201 - DNA, 25 bp, Mus musculus
acacacacatgcacatggacacaca

SEQ ID NO: 23202 - DNA, 25 bp, Mus musculus
aatggattctcttggggtagagtgc

SEQ ID NO: 23203 - DNA, 25 bp, Mus musculus
agccggctatttgaagggagcgcgc

SEQ ID NO: 23204 - DNA, 25 bp, Mus musculus
atggagcgcttcagagggaagagtt

SEQ ID NO: 23205 - DNA, 25 bp, Mus musculus
tgaagaagtctccacagcagctgcg

SEQ ID NO: 23206 - DNA, 25 bp, Mus musculus
agaagtctccacagcagctgcggct

SEQ ID NO: 23207 - DNA, 25 bp, Mus musculus
gaagtctccacagcagctgcggctc

SEQ ID NO: 23208 - DNA, 25 bp, Mus musculus
tgatggccaaggtgtcggtgctgaa

SEQ ID NO: 23209 - DNA, 25 bp, Mus musculus
gatggccaaggtgtcggtgctgaat

SEQ ID NO: 23210 - DNA, 25 bp, Mus musculus
tggccaaggtgtcggtgctgaatgt

SEQ ID NO: 23211 - DNA, 25 bp, Mus musculus
atgcagtgaggccctgtctgacgac

SEQ ID NO: 23212 - DNA, 25 bp, Mus musculus
gtctgacgacctggagtggaagatc

SEQ ID NO: 23213 - DNA, 25 bp, Mus musculus
tctgacgacctggagtggaagatca

SEQ ID NO: 23214 - DNA, 25 bp, Mus musculus
ctgacgacctggagtggaagatcat

SEQ ID NO: 23215 - DNA, 25 bp, Mus musculus
cccttcttctctgtcgcaagtcact

SEQ ID NO: 23216 - DNA, 25 bp, Mus musculus
ccttcttctctgtcgcaagtcactg

SEQ ID NO: 23217 - DNA, 25 bp, Mus musculus
cttcttctctgtcgcaagtcactgt

SEQ ID NO: 23218 - DNA, 25 bp, Mus musculus
tcttctctgtcgcaagtcactgtga

SEQ ID NO: 23219 - DNA, 25 bp, Mus musculus
ttctctgtcgcaagtcactgtgaag

SEQ ID NO: 23220 - DNA, 25 bp, Mus musculus
ctctgtcgcaagtcactgtgaagaa

SEQ ID NO: 23221 - DNA, 25 bp, Mus musculus
tctgtcgcaagtcactgtgaagaag

SEQ ID NO: 23222 - DNA, 25 bp, Mus musculus
ctgtcgcaagtcactgtgaagaagt

SEQ ID NO: 23223 - DNA, 25 bp, Mus musculus
cctcacctacacttgcaagaaggga

SEQ ID NO: 23224 - DNA, 25 bp, Mus musculus
tgccaagacctttggaaagatgaaa

SEQ ID NO: 23225 - DNA, 25 bp, Mus musculus
ctcatccgcaaaggacaattctata

SEQ ID NO: 23226 - DNA, 25 bp, Mus musculus
atcaaaacatgagcatcgctggagc

SEQ ID NO: 23227 - DNA, 25 bp, Mus musculus
aaccaggcgctgatccttaaaatgg

SEQ ID NO: 23228 - DNA, 25 bp, Mus musculus
gcgaacatgtgcttcactcatcatt

SEQ ID NO: 23229 - DNA, 25 bp, Mus musculus
atgtgcttcactcatcatttcagcc

SEQ ID NO: 23230 - DNA, 25 bp, Mus musculus
ttcactcatcatttcagccaaagtc

SEQ ID NO: 23231 - DNA, 25 bp, Mus musculus
ttcagccaaagtcctgcctttccgt

SEQ ID NO: 23232 - DNA, 25 bp, Mus musculus
tcctatcacctcaagaagaattaga

SEQ ID NO: 23233 - DNA, 25 bp, Mus musculus
attatgggactgccgtctggtcatt

SEQ ID NO: 23234 - DNA, 25 bp, Mus musculus
ggactgccgtctggtcatttggggt

SEQ ID NO: 23235 - DNA, 25 bp, Mus musculus
gatgaaaccacgctatgaaatcaac

SEQ ID NO: 23236 - DNA, 25 bp, Mus musculus
ctatgaaatcaactccttgattaga

SEQ ID NO: 23237 - DNA, 25 bp, Mus musculus
atatcactgcaaagatggtttcatt

SEQ ID NO: 23238 - DNA, 25 bp, Mus musculus
tttcattcagcgacaccttccaact

SEQ ID NO: 23239 - DNA, 25 bp, Mus musculus
tcagcgacaccttccaactatccgg

SEQ ID NO: 23240 - DNA, 25 bp, Mus musculus
aacctgcatgaacccatctgcatac

SEQ ID NO: 23241 - DNA, 25 bp, Mus musculus
catgaacccatctgcataccaaagg

SEQ ID NO: 23242 - DNA, 25 bp, Mus musculus
cccatctgcataccaaaggacttat

SEQ ID NO: 23243 - DNA, 25 bp, Mus musculus
actgaggccgtgactcagcaatgaa

SEQ ID NO: 23244 - DNA, 25 bp, Mus musculus
ctgaggccgtgactcagcaatgaag

SEQ ID NO: 23245 - DNA, 25 bp, Mus musculus
tctatgagctctgtgatgtctattt

SEQ ID NO: 23246 - DNA, 25 bp, Mus musculus
ctatgagctctgtgatgtctatttg

SEQ ID NO: 23247 - DNA, 25 bp, Mus musculus
tatgagctctgtgatgtctatttgg

SEQ ID NO: 23248 - DNA, 25 bp, Mus musculus
atgagctctgtgatgtctatttgga

SEQ ID NO: 23249 - DNA, 25 bp, Mus musculus
agctctgtgatgtctatttggagtg

SEQ ID NO: 23250 - DNA, 25 bp, Mus musculus
gctctgtgatgtctatttggagtgt

SEQ ID NO: 23251 - DNA, 25 bp, Mus musculus
ctctgtgatgtctatttggagtgtc

SEQ ID NO: 23252 - DNA, 25 bp, Mus musculus
tctgtgatgtctatttggagtgtct

SEQ ID NO: 23253 - DNA, 25 bp, Mus musculus
gcccttcatgccctttgtcacagag

SEQ ID NO: 23254 - DNA, 25 bp, Mus musculus
cccttcatgccctttgtcacagagg

SEQ ID NO: 23255 - DNA, 25 bp, Mus musculus
gaggccgtgactcagcaatgaaggc

SEQ ID NO: 23256 - DNA, 25 bp, Mus musculus
agctattccagagactgccccggcg

SEQ ID NO: 23257 - DNA, 25 bp, Mus musculus
aggccgtgactcagcaatgaaggct

SEQ ID NO: 23258 - DNA, 25 bp, Mus musculus
ggccgtgactcagcaatgaaggctt

SEQ ID NO: 23259 - DNA, 25 bp, Mus musculus
gccgtgactcagcaatgaaggcttc

SEQ ID NO: 23260 - DNA, 25 bp, Mus musculus
ccgtgactcagcaatgaaggcttcc

SEQ ID NO: 23261 - DNA, 25 bp, Mus musculus
caatgaaggcttccaggcttacgat

SEQ ID NO: 23262 - DNA, 25 bp, Mus musculus
atgaaggcttccaggcttacgattt

SEQ ID NO: 23263 - DNA, 25 bp, Mus musculus
tgaaggcttccaggcttacgatttc

SEQ ID NO: 23264 - DNA, 25 bp, Mus musculus
ttccaaattcagggacatgcactag

SEQ ID NO: 23265 - DNA, 25 bp, Mus musculus
cagggacatgcactagccaggcttc

SEQ ID NO: 23266 - DNA, 25 bp, Mus musculus
acacatgtggatgctgcaggatcta

SEQ ID NO: 23267 - DNA, 25 bp, Mus musculus
caggcattgctaagggctggtgagc

SEQ ID NO: 23268 - DNA, 25 bp, Mus musculus
ccctgtaggtctccattctcataaa

SEQ ID NO: 23269 - DNA, 25 bp, Mus musculus
tgtaggtctccattctcataaatga

SEQ ID NO: 23270 - DNA, 25 bp, Mus musculus
aggtctccattctcataaatgatga

SEQ ID NO: 23271 - DNA, 25 bp, Mus musculus
agctcagactcagaatttggccctt

SEQ ID NO: 23272 - DNA, 25 bp, Mus musculus
gactcagaatttggcccttttagat

SEQ ID NO: 23273 - DNA, 25 bp, Mus musculus
tcagaatttggcccttttagatcag

SEQ ID NO: 23274 - DNA, 25 bp, Mus musculus
gaatttggcccttttagatcagaga

SEQ ID NO: 23275 - DNA, 25 bp, Mus musculus
acattagggttcctagtggatgtgg

SEQ ID NO: 23276 - DNA, 25 bp, Mus musculus
ggacatgcactagccaggcttctct

SEQ ID NO: 23277 - DNA, 25 bp, Mus musculus
gcactagccaggcttctctgtgtcc

SEQ ID NO: 23278 - DNA, 25 bp, Mus musculus
ctctgtgtcctggggccatttgagg

SEQ ID NO: 23279 - DNA, 25 bp, Mus musculus
ccatttgaggagccacagtgtggaa

SEQ ID NO: 23280 - DNA, 25 bp, Mus musculus
atctccccaaaataaggcagagttg

SEQ ID NO: 23281 - DNA, 25 bp, Mus musculus
gcagtctatgctgtcacacatgtgg

SEQ ID NO: 23282 - DNA, 25 bp, Mus musculus
gtctatgctgtcacacatgtggatg

SEQ ID NO: 23283 - DNA, 25 bp, Mus musculus
gtcacacatgtggatgctgcaggat

SEQ ID NO: 23284 - DNA, 25 bp, Mus musculus
atgcattgctagtgtcacagccttt

SEQ ID NO: 23285 - DNA, 25 bp, Mus musculus
tgctagtgtcacagcctttggttat

SEQ ID NO: 23286 - DNA, 25 bp, Mus musculus
aatttgtgctagcagatttgagcac

SEQ ID NO: 23287 - DNA, 25 bp, Mus musculus
ctagctctgcgtgcctataaactga

SEQ ID NO: 23288 - DNA, 25 bp, Mus musculus
ctgcgtgcctataaactgaatgctg

SEQ ID NO: 23289 - DNA, 25 bp, Mus musculus
aaactgaatgctgcttgtcccattc

SEQ ID NO: 23290 - DNA, 25 bp, Mus musculus
gcttgtcccattccattttatgtca

SEQ ID NO: 23291 - DNA, 25 bp, Mus musculus
ttccaagccggtatcagctactcaa

SEQ ID NO: 23292 - DNA, 25 bp, Mus musculus
ttctcagatattcatcattagacaa

SEQ ID NO: 23293 - DNA, 25 bp, Mus musculus
tttgtagcctactaaaactgctgag

SEQ ID NO: 23294 - DNA, 25 bp, Mus musculus
gcctactaaaactgctgaggctgtt

SEQ ID NO: 23295 - DNA, 25 bp, Mus musculus
tgaacattccacattcaaaagtttt

SEQ ID NO: 23296 - DNA, 25 bp, Mus musculus
tgtcacagcctttggttatgtctag

SEQ ID NO: 23297 - DNA, 25 bp, Mus musculus
tgtctagtagctgtttctgaagtat

SEQ ID NO: 23298 - DNA, 25 bp, Mus musculus
ctcctttcctcaaggagacacttat

SEQ ID NO: 23299 - DNA, 25 bp, Mus musculus
tcctcaaggagacacttatgttcaa

SEQ ID NO: 23300 - DNA, 25 bp, Mus musculus
tgattctttgccttaggtgcataga

SEQ ID NO: 23301 - DNA, 25 bp, Mus musculus
tttgccttaggtgcatagagagtag

SEQ ID NO: 23302 - DNA, 25 bp, Mus musculus
acttagccatatgttctgtgttgga

SEQ ID NO: 23303 - DNA, 25 bp, Mus musculus
ccatatgttctgtgttggaatttgt

SEQ ID NO: 23304 - DNA, 25 bp, Mus musculus
cttcagaggtgctccctgaggagcc

SEQ ID NO: 23305 - DNA, 25 bp, Mus musculus
ccgaaccctgagcctggcactgcag

SEQ ID NO: 23306 - DNA, 25 bp, Mus musculus
cagccctgatggtggagttttatgc

SEQ ID NO: 23307 - DNA, 25 bp, Mus musculus
ctgcaaagaactagctcccgagtac

SEQ ID NO: 23308 - DNA, 25 bp, Mus musculus
ctcccgagtacagcaaggcggctgc

SEQ ID NO: 23309 - DNA, 25 bp, Mus musculus
cgagtacagcaaggcggctgccctg

SEQ ID NO: 23310 - DNA, 25 bp, Mus musculus
tgccctgctggcggctgagtcagct

SEQ ID NO: 23311 - DNA, 25 bp, Mus musculus
ccctgctggcggctgagtcagctgt

SEQ ID NO: 23312 - DNA, 25 bp, Mus musculus
gtcagctgtggtcaccttggccaag

SEQ ID NO: 23313 - DNA, 25 bp, Mus musculus
tgtggtcaccttggccaaggtggat

SEQ ID NO: 23314 - DNA, 25 bp, Mus musculus
tggccctgcggaaccggagctgacc

SEQ ID NO: 23315 - DNA, 25 bp, Mus musculus
cctgcggaaccggagctgaccagag

SEQ ID NO: 23316 - DNA, 25 bp, Mus musculus
gaaccctgagcctggcactgcagga

SEQ ID NO: 23317 - DNA, 25 bp, Mus musculus
cctgagcctggcactgcaggagcat

SEQ ID NO: 23318 - DNA, 25 bp, Mus musculus
tgagcctggcactgcaggagcattc

SEQ ID NO: 23319 - DNA, 25 bp, Mus musculus
agcctggcactgcaggagcattcag

SEQ ID NO: 23320 - DNA, 25 bp, Mus musculus
cctggcactgcaggagcattcagcc

SEQ ID NO: 23321 - DNA, 25 bp, Mus musculus
agcattcagccctgatggtggagtt

SEQ ID NO: 23322 - DNA, 25 bp, Mus musculus
cattcagccctgatggtggagtttt

SEQ ID NO: 23323 - DNA, 25 bp, Mus musculus
ttcagccctgatggtggagttttat

SEQ ID NO: 23324 - DNA, 25 bp, Mus musculus
atttctcatacaaagtgaaaatctt

SEQ ID NO: 23325 - DNA, 25 bp, Mus musculus
taaatgctaaccacagcaagttatt

SEQ ID NO: 23326 - DNA, 25 bp, Mus musculus
atagccttctagcacccaggcatgg

SEQ ID NO: 23327 - DNA, 25 bp, Mus musculus
ttctagcacccaggcatggtaacag

SEQ ID NO: 23328 - DNA, 25 bp, Mus musculus
cacccaggcatggtaacagccagat

SEQ ID NO: 23329 - DNA, 25 bp, Mus musculus
caagtgccactgtgttcccaagagc

SEQ ID NO: 23330 - DNA, 25 bp, Mus musculus
tgttcccaagagcttttcatttcag

SEQ ID NO: 23331 - DNA, 25 bp, Mus musculus
cttttcatttcagctgaagccttgc

SEQ ID NO: 23332 - DNA, 25 bp, Mus musculus
atttcagctgaagccttgccgcaga

SEQ ID NO: 23333 - DNA, 25 bp, Mus musculus
gccttgccgcagaccaagctggaca

SEQ ID NO: 23334 - DNA, 25 bp, Mus musculus
ccgcagaccaagctggacaagtatg

SEQ ID NO: 23335 - DNA, 25 bp, Mus musculus
agggcagacataccacagcacgagt

SEQ ID NO: 23336 - DNA, 25 bp, Mus musculus
ttaacatctctagactggaagctta

SEQ ID NO: 23337 - DNA, 25 bp, Mus musculus
actgatagccaagggacctgagatt

SEQ ID NO: 23338 - DNA, 25 bp, Mus musculus
agccaagggacctgagattgtgatc

SEQ ID NO: 23339 - DNA, 25 bp, Mus musculus
tgtgatctgctttctcaggactctc

SEQ ID NO: 23340 - DNA, 25 bp, Mus musculus
ctgctttctcaggactctccctggg

SEQ ID NO: 23341 - DNA, 25 bp, Mus musculus
tctcaggactctccctgggtttcct

SEQ ID NO: 23342 - DNA, 25 bp, Mus musculus
aagggcctgtcagcctttggttgct

SEQ ID NO: 23343 - DNA, 25 bp, Mus musculus
ctgtcagcctttggttgcttagtcc

SEQ ID NO: 23344 - DNA, 25 bp, Mus musculus
gagacaccttgaactaccatcctgc

SEQ ID NO: 23345 - DNA, 25 bp, Mus musculus
ccttgaactaccatcctgccttctg

SEQ ID NO: 23346 - DNA, 25 bp, Mus musculus
aggatttgcttcaacataggctgcg

SEQ ID NO: 23347 - DNA, 25 bp, Mus musculus
ttcaacataggctgcgtgaacacta

SEQ ID NO: 23348 - DNA, 25 bp, Mus musculus
tgcgtgaacactatcctggaaaact

SEQ ID NO: 23349 - DNA, 25 bp, Mus musculus
actatcctggaaaacttgcaggcag

SEQ ID NO: 23350 - DNA, 25 bp, Mus musculus
aacttgcaggcagccgagcaggcct

SEQ ID NO: 23351 - DNA, 25 bp, Mus musculus
caggcagccgagcaggccttcacca

SEQ ID NO: 23352 - DNA, 25 bp, Mus musculus
gccgagcaggccttcaccaaaagca

SEQ ID NO: 23353 - DNA, 25 bp, Mus musculus
gagcaggccttcaccaaaagcatca

SEQ ID NO: 23354 - DNA, 25 bp, Mus musculus
caggccttcaccaaaagcatcaaca

SEQ ID NO: 23355 - DNA, 25 bp, Mus musculus
ttcaccaaaagcatcaacagagaca

SEQ ID NO: 23356 - DNA, 25 bp, Mus musculus
ctgccttctggtaagcacctaacca

SEQ ID NO: 23357 - DNA, 25 bp, Mus musculus
ccttctggtaagcacctaaccatgt

SEQ ID NO: 23358 - DNA, 25 bp, Mus musculus
ggtaagcacctaaccatgtccctgg

SEQ ID NO: 23359 - DNA, 25 bp, Mus musculus
aagcacctaaccatgtccctggctg

SEQ ID NO: 23360 - DNA, 25 bp, Mus musculus
gctgaggccatcagactctcgaatg

SEQ ID NO: 23361 - DNA, 25 bp, Mus musculus
gccatcagactctcgaatgaagggg

SEQ ID NO: 23362 - DNA, 25 bp, Mus musculus
agactctcgaatgaaggggtgctcg

SEQ ID NO: 23363 - DNA, 25 bp, Mus musculus
gtgctcgcagccgacaagaaggact

SEQ ID NO: 23364 - DNA, 25 bp, Mus musculus
caggagtcccaggtcttgtaggcag

SEQ ID NO: 23365 - DNA, 25 bp, Mus musculus
cttctggccagcaaggacaaaaggg

SEQ ID NO: 23366 - DNA, 25 bp, Mus musculus
gtggctctgggaacatctggctgga

SEQ ID NO: 23367 - DNA, 25 bp, Mus musculus
acatctggctggacaatgtgaattg

SEQ ID NO: 23368 - DNA, 25 bp, Mus musculus
tgaattgtcggggcacagagaacag

SEQ ID NO: 23369 - DNA, 25 bp, Mus musculus
acagtttgtgggactgcagtaagaa

SEQ ID NO: 23370 - DNA, 25 bp, Mus musculus
agaactcctggggcaatcacaattg

SEQ ID NO: 23371 - DNA, 25 bp, Mus musculus
actcctggggcaatcacaattgcgt

SEQ ID NO: 23372 - DNA, 25 bp, Mus musculus
gcaatcacaattgcgtacataatga

SEQ ID NO: 23373 - DNA, 25 bp, Mus musculus
gaaatctgtgggcttgccaactctg

SEQ ID NO: 23374 - DNA, 25 bp, Mus musculus
atctgtgggcttgccaactctgttg

SEQ ID NO: 23375 - DNA, 25 bp, Mus musculus
cttgccaactctgttgaggggaagt

SEQ ID NO: 23376 - DNA, 25 bp, Mus musculus
gcgaatctttccaacgcgtccggat

SEQ ID NO: 23377 - DNA, 25 bp, Mus musculus
ctttccaacgcgtccggatcatggg

SEQ ID NO: 23378 - DNA, 25 bp, Mus musculus
gcaccaacagaggccgagctgaagt

SEQ ID NO: 23379 - DNA, 25 bp, Mus musculus
ccaacagaggccgagctgaagttta

SEQ ID NO: 23380 - DNA, 25 bp, Mus musculus
atgatgcgactgtcttctgtcgcat

SEQ ID NO: 23381 - DNA, 25 bp, Mus musculus
gtcgcatgctcggttactccagagg

SEQ ID NO: 23382 - DNA, 25 bp, Mus musculus
gcatgctcggttactccagagggag

SEQ ID NO: 23383 - DNA, 25 bp, Mus musculus
gttactccagagggagagcacttag

SEQ ID NO: 23384 - DNA, 25 bp, Mus musculus
tcctgaaatctacccagaccctttg

SEQ ID NO: 23385 - DNA, 25 bp, Mus musculus
gaaagcaaagaccaccttctataga

SEQ ID NO: 23386 - DNA, 25 bp, Mus musculus
actgctgagcgttatcagtaaacag

SEQ ID NO: 23387 - DNA, 25 bp, Mus musculus
tatcagtaaacaggcctttgggact

SEQ ID NO: 23388 - DNA, 25 bp, Mus musculus
taaacaggcctttgggactagtgct

SEQ ID NO: 23389 - DNA, 25 bp, Mus musculus
tagtgctcactgaagccccctagta

SEQ ID NO: 23390 - DNA, 25 bp, Mus musculus
tcactgaagccccctagtagctgta

SEQ ID NO: 23391 - DNA, 25 bp, Mus musculus
aagccccctagtagctgtattagtg

SEQ ID NO: 23392 - DNA, 25 bp, Mus musculus
gttcttactgctcacgttcctgggg

SEQ ID NO: 23393 - DNA, 25 bp, Mus musculus
actgctcacgttcctggggattcgt

SEQ ID NO: 23394 - DNA, 25 bp, Mus musculus
tgtagctggggcctgagtttcatca

SEQ ID NO: 23395 - DNA, 25 bp, Mus musculus
ttcatcactttcagagcaacgtctt

SEQ ID NO: 23396 - DNA, 25 bp, Mus musculus
gtatttctacatgccctttggatca

SEQ ID NO: 23397 - DNA, 25 bp, Mus musculus
ctacatgccctttggatcaggagct

SEQ ID NO: 23398 - DNA, 25 bp, Mus musculus
gccctttggatcaggagctacaata

SEQ ID NO: 23399 - DNA, 25 bp, Mus musculus
tctgatgctgtcttactttgaactg

SEQ ID NO: 23400 - DNA, 25 bp, Mus musculus
gctgtcttactttgaactggagctt

SEQ ID NO: 23401 - DNA, 25 bp, Mus musculus
aattttgccaccactaaatgatatt

SEQ ID NO: 23402 - DNA, 25 bp, Mus musculus
gccaccactaaatgatattgagttt

SEQ ID NO: 23403 - DNA, 25 bp, Mus musculus
gtaacgactgctgagcgttatcagt

SEQ ID NO: 23404 - DNA, 25 bp, Mus musculus
cctctacactgctcaagcgatcgct

SEQ ID NO: 23405 - DNA, 25 bp, Mus musculus
ctacactgctcaagcgatcgctgat

SEQ ID NO: 23406 - DNA, 25 bp, Mus musculus
atatgtcagcagtcatccaagctac

SEQ ID NO: 23407 - DNA, 25 bp, Mus musculus
tgtcagcagtcatccaagctacagg

SEQ ID NO: 23408 - DNA, 25 bp, Mus musculus
tcatccaagctacagggtgacgagc

SEQ ID NO: 23409 - DNA, 25 bp, Mus musculus
tccaagctacagggtgacgagcgca

SEQ ID NO: 23410 - DNA, 25 bp, Mus musculus
aacatactgcagttcctgatagaca

SEQ ID NO: 23411 - DNA, 25 bp, Mus musculus
ctgcagttcctgatagacattgcgc

SEQ ID NO: 23412 - DNA, 25 bp, Mus musculus
ttcctgatagacattgcgctggcta

SEQ ID NO: 23413 - DNA, 25 bp, Mus musculus
atagacattgcgctggctagcgacg

SEQ ID NO: 23414 - DNA, 25 bp, Mus musculus
gacattgcgctggctagcgacgatg

SEQ ID NO: 23415 - DNA, 25 bp, Mus musculus
ctcgaggttcacgggtgtgaagtgc

SEQ ID NO: 23416 - DNA, 25 bp, Mus musculus
cactgctcaagcgatcgctgatgat

SEQ ID NO: 23417 - DNA, 25 bp, Mus musculus
gcttgtagctctctgaagcttaagt

SEQ ID NO: 23418 - DNA, 25 bp, Mus musculus
tcaagcgatcgctgatgattacgct

SEQ ID NO: 23419 - DNA, 25 bp, Mus musculus
tagcgatgacttcttgctgcaactg

SEQ ID NO: 23420 - DNA, 25 bp, Mus musculus
tgacttcttgctgcaactggtactg

SEQ ID NO: 23421 - DNA, 25 bp, Mus musculus
cttgctgcaactggtactgtaattg

SEQ ID NO: 23422 - DNA, 25 bp, Mus musculus
gtaattgatgcacccacaatatgtc

SEQ ID NO: 23423 - DNA, 25 bp, Mus musculus
gatgcacccacaatatgtcagcagt

SEQ ID NO: 23424 - DNA, 25 bp, Mus musculus
cccacaatatgtcagcagtcatcca

SEQ ID NO: 23425 - DNA, 25 bp, Mus musculus
atcagcccttgaggcagcccacaaa

SEQ ID NO: 23426 - DNA, 25 bp, Mus musculus
ccttgaggcagcccacaaaggctgg

SEQ ID NO: 23427 - DNA, 25 bp, Mus musculus
tctgatgcactcgggagacagcatt

SEQ ID NO: 23428 - DNA, 25 bp, Mus musculus
cagcattcgaactgttctaaagatg

SEQ ID NO: 23429 - DNA, 25 bp, Mus musculus
gcactctttcctgtgattggctaga

SEQ ID NO: 23430 - DNA, 25 bp, Mus musculus
tttcctgtgattggctagaaacaga

SEQ ID NO: 23431 - DNA, 25 bp, Mus musculus
agctaaccacgtcgtagacttcaga

SEQ ID NO: 23432 - DNA, 25 bp, Mus musculus
ccacgtcgtagacttcagaaatgac

SEQ ID NO: 23433 - DNA, 25 bp, Mus musculus
tccacataaacaattgctgctcatt

SEQ ID NO: 23434 - DNA, 25 bp, Mus musculus
taaacaattgctgctcattgtgcaa

SEQ ID NO: 23435 - DNA, 25 bp, Mus musculus
attgctgctcattgtgcaacatttt

SEQ ID NO: 23436 - DNA, 25 bp, Mus musculus
gctcattgtgcaacattttaacata

SEQ ID NO: 23437 - DNA, 25 bp, Mus musculus
ggaagaaatctccactcgtccattc

SEQ ID NO: 23438 - DNA, 25 bp, Mus musculus
gaaaggcaccgcctttggaggatgg

SEQ ID NO: 23439 - DNA, 25 bp, Mus musculus
caccgcctttggaggatggaagagt

SEQ ID NO: 23440 - DNA, 25 bp, Mus musculus
gagtgtcccaaagctggtgtctgaa

SEQ ID NO: 23441 - DNA, 25 bp, Mus musculus
atttgtgaccggcaatctctccttc

SEQ ID NO: 23442 - DNA, 25 bp, Mus musculus
gaccggcaatctctccttcgaccaa

SEQ ID NO: 23443 - DNA, 25 bp, Mus musculus
ccaagcctttgatctgatgcactcg

SEQ ID NO: 23444 - DNA, 25 bp, Mus musculus
ctttgatctgatgcactcgggagac

SEQ ID NO: 23445 - DNA, 25 bp, Mus musculus
gtgcccactttgaggacatcaccat

SEQ ID NO: 23446 - DNA, 25 bp, Mus musculus
actttgaggacatcaccatgacaga

SEQ ID NO: 23447 - DNA, 25 bp, Mus musculus
tgggaactcccagtctggtccctct

SEQ ID NO: 23448 - DNA, 25 bp, Mus musculus
tgcctgccgacgccttggtctctgc

SEQ ID NO: 23449 - DNA, 25 bp, Mus musculus
aggctgtgagcccagatcttactag

SEQ ID NO: 23450 - DNA, 25 bp, Mus musculus
tgagcccagatcttactagcttcca

SEQ ID NO: 23451 - DNA, 25 bp, Mus musculus
cagatcttactagcttccagcgggc

SEQ ID NO: 23452 - DNA, 25 bp, Mus musculus
ttactagcttccagcgggctttgca

SEQ ID NO: 23453 - DNA, 25 bp, Mus musculus
gcttccagcgggctttgcatcacat

SEQ ID NO: 23454 - DNA, 25 bp, Mus musculus
gagagcttcgcacctacatcatgcc

SEQ ID NO: 23455 - DNA, 25 bp, Mus musculus
tcaaaggcatcttctttgcctgggc

SEQ ID NO: 23456 - DNA, 25 bp, Mus musculus
gcatcttctttgcctgggcccagaa

SEQ ID NO: 23457 - DNA, 25 bp, Mus musculus
aggacatcaccatgacagacttctt

SEQ ID NO: 23458 - DNA, 25 bp, Mus musculus
tcaaccgtcaggagctgggactctg

SEQ ID NO: 23459 - DNA, 25 bp, Mus musculus
tgtatagtcagcatgcctgcctcat

SEQ ID NO: 23460 - DNA, 25 bp, Mus musculus
gtcagcatgcctgcctcattgagga

SEQ ID NO: 23461 - DNA, 25 bp, Mus musculus
atgcctgcctcattgaggacaaggg

SEQ ID NO: 23462 - DNA, 25 bp, Mus musculus
tgaagcgagtcctgcctatcgatgt

SEQ ID NO: 23463 - DNA, 25 bp, Mus musculus
gagtcctgcctatcgatgtgcacaa

SEQ ID NO: 23464 - DNA, 25 bp, Mus musculus
tgcctatcgatgtgcacaagcccca

SEQ ID NO: 23465 - DNA, 25 bp, Mus musculus
ggacaggcccaagatcctcatggac

SEQ ID NO: 23466 - DNA, 25 bp, Mus musculus
acaggcccaagatcctcatggacag

SEQ ID NO: 23467 - DNA, 25 bp, Mus musculus
catcttccactccgaagagatcaag

SEQ ID NO: 23468 - DNA, 25 bp, Mus musculus
ttccactccgaagagatcaaggctc

SEQ ID NO: 23469 - DNA, 25 bp, Mus musculus
ccactccgaagagatcaaggctcca

SEQ ID NO: 23470 - DNA, 25 bp, Mus musculus
gagatcaaggctccagagaaagagg

SEQ ID NO: 23471 - DNA, 25 bp, Mus musculus
gatcaaggctccagagaaagaggaa

SEQ ID NO: 23472 - DNA, 25 bp, Mus musculus
tcaaggctccagagaaagaggaatt

SEQ ID NO: 23473 - DNA, 25 bp, Mus musculus
tcctggcctggcagcacgacctgga

SEQ ID NO: 23474 - DNA, 25 bp, Mus musculus
ctggcctggcagcacgacctggaag

SEQ ID NO: 23475 - DNA, 25 bp, Mus musculus
cctggcagcacgacctggaagcgaa

SEQ ID NO: 23476 - DNA, 25 bp, Mus musculus
agcacgacctggaagcgaatgataa

SEQ ID NO: 23477 - DNA, 25 bp, Mus musculus
gcccaagatcctcatggacagccct

SEQ ID NO: 23478 - DNA, 25 bp, Mus musculus
ccaagatcctcatggacagccctga

SEQ ID NO: 23479 - DNA, 25 bp, Mus musculus
aagatcctcatggacagccctgaag

SEQ ID NO: 23480 - DNA, 25 bp, Mus musculus
ctcatggacagccctgaagacgccg

SEQ ID NO: 23481 - DNA, 25 bp, Mus musculus
catggacagccctgaagacgccgac

SEQ ID NO: 23482 - DNA, 25 bp, Mus musculus
tggacagccctgaagacgccgacat

SEQ ID NO: 23483 - DNA, 25 bp, Mus musculus
aagacgccgacatcttccactccga

SEQ ID NO: 23484 - DNA, 25 bp, Mus musculus
cgccgacatcttccactccgaagag

SEQ ID NO: 23485 - DNA, 25 bp, Mus musculus
atttatacatgcctacaaggaagac

SEQ ID NO: 23486 - DNA, 25 bp, Mus musculus
ttatacatgcctacaaggaagacag

SEQ ID NO: 23487 - DNA, 25 bp, Mus musculus
ggtcccagctgtcttcacctgttct

SEQ ID NO: 23488 - DNA, 25 bp, Mus musculus
tcccagctgtcttcacctgttctta

SEQ ID NO: 23489 - DNA, 25 bp, Mus musculus
cccagctgtcttcacctgttcttac

SEQ ID NO: 23490 - DNA, 25 bp, Mus musculus
cagctgtcttcacctgttcttaccc

SEQ ID NO: 23491 - DNA, 25 bp, Mus musculus
agctgtcttcacctgttcttaccca

SEQ ID NO: 23492 - DNA, 25 bp, Mus musculus
ctgtcttcacctgttcttacccacg

SEQ ID NO: 23493 - DNA, 25 bp, Mus musculus
tgtcttcacctgttcttacccacgt

SEQ ID NO: 23494 - DNA, 25 bp, Mus musculus
cctcctcaataaagaagccagtcag

SEQ ID NO: 23495 - DNA, 25 bp, Mus musculus
ctcctcaataaagaagccagtcagg

SEQ ID NO: 23496 - DNA, 25 bp, Mus musculus
taaagaagccagtcaggcgtggtta

SEQ ID NO: 23497 - DNA, 25 bp, Mus musculus
tatacatgcctacaaggaagacaga

SEQ ID NO: 23498 - DNA, 25 bp, Mus musculus
tacatgcctacaaggaagacagact

SEQ ID NO: 23499 - DNA, 25 bp, Mus musculus
aagacagactcatccagcgccacct

SEQ ID NO: 23500 - DNA, 25 bp, Mus musculus
atggtctcttcactgctgccctcaa

SEQ ID NO: 23501 - DNA, 25 bp, Mus musculus
tggtctcttcactgctgccctcaat

SEQ ID NO: 23502 - DNA, 25 bp, Mus musculus
tcttcactgctgccctcaatccgag

SEQ ID NO: 23503 - DNA, 25 bp, Mus musculus
cttcactgctgccctcaatccgagt

SEQ ID NO: 23504 - DNA, 25 bp, Mus musculus
tgctgccctcaatccgagtgtcctt

SEQ ID NO: 23505 - DNA, 25 bp, Mus musculus
gctgttcacgaacccagacctggag

SEQ ID NO: 23506 - DNA, 25 bp, Mus musculus
ttcaaatctactggagacattaatc

SEQ ID NO: 23507 - DNA, 25 bp, Mus musculus
actctgtgatctgcactacttgaga

SEQ ID NO: 23508 - DNA, 25 bp, Mus musculus
tgatctgcactacttgagaaaaatg

SEQ ID NO: 23509 - DNA, 25 bp, Mus musculus
agctaagttgccccttctggagcaa

SEQ ID NO: 23510 - DNA, 25 bp, Mus musculus
gccccttctggagcaacctaatgtt

SEQ ID NO: 23511 - DNA, 25 bp, Mus musculus
ccttctggagcaacctaatgtttct

SEQ ID NO: 23512 - DNA, 25 bp, Mus musculus
ggagcaacctaatgtttcttgtaat

SEQ ID NO: 23513 - DNA, 25 bp, Mus musculus
tattgatgatcctactaattatcct

SEQ ID NO: 23514 - DNA, 25 bp, Mus musculus
tgatgatcctactaattatcctgct

SEQ ID NO: 23515 - DNA, 25 bp, Mus musculus
tgatcctactaattatcctgctgtt

SEQ ID NO: 23516 - DNA, 25 bp, Mus musculus
tactaattatcctgctgttctttaa

SEQ ID NO: 23517 - DNA, 25 bp, Mus musculus
attaatccagtctacatagaactgg

SEQ ID NO: 23518 - DNA, 25 bp, Mus musculus
aatggtcacttctctcctatgagaa

SEQ ID NO: 23519 - DNA, 25 bp, Mus musculus
ggtcacttctctcctatgagaagct

SEQ ID NO: 23520 - DNA, 25 bp, Mus musculus
ttctctcctatgagaagctggataa

SEQ ID NO: 23521 - DNA, 25 bp, Mus musculus
gccacagggctcaagtgagtcccat

SEQ ID NO: 23522 - DNA, 25 bp, Mus musculus
ctcaagtgagtcccattgtctttcc

SEQ ID NO: 23523 - DNA, 25 bp, Mus musculus
tgagtcccattgtctttccttaata

SEQ ID NO: 23524 - DNA, 25 bp, Mus musculus
ccaaccctgactctgtgatctgcac

SEQ ID NO: 23525 - DNA, 25 bp, Mus musculus
agtgcagccactcctggctgatagc

SEQ ID NO: 23526 - DNA, 25 bp, Mus musculus
acttcctgcctgggagctctgaaga

SEQ ID NO: 23527 - DNA, 25 bp, Mus musculus
agcccttggcctgcagtgtgctcgc

SEQ ID NO: 23528 - DNA, 25 bp, Mus musculus
gagacctctcgaccaggcaggcagc

SEQ ID NO: 23529 - DNA, 25 bp, Mus musculus
tctcgaccaggcaggcagctgaatc

SEQ ID NO: 23530 - DNA, 25 bp, Mus musculus
ctgaatctggatttccagtgaatca

SEQ ID NO: 23531 - DNA, 25 bp, Mus musculus
gagtcagcactccagatacatctct

SEQ ID NO: 23532 - DNA, 25 bp, Mus musculus
gcactccagatacatctctctgctg

SEQ ID NO: 23533 - DNA, 25 bp, Mus musculus
cagatacatctctctgctgacttca

SEQ ID NO: 23534 - DNA, 25 bp, Mus musculus
catctctctgctgacttcatagcct

SEQ ID NO: 23535 - DNA, 25 bp, Mus musculus
tctgctgacttcatagcctatttaa

SEQ ID NO: 23536 - DNA, 25 bp, Mus musculus
tttccaagcatttcttcaaatattt

SEQ ID NO: 23537 - DNA, 25 bp, Mus musculus
tgcctgggagctctgaagatgaacc

SEQ ID NO: 23538 - DNA, 25 bp, Mus musculus
atgaacctgggcctttgcagctcac

SEQ ID NO: 23539 - DNA, 25 bp, Mus musculus
ccctctctgcatcagtcagtgccat

SEQ ID NO: 23540 - DNA, 25 bp, Mus musculus
ctgcatcagtcagtgccatcggatt

SEQ ID NO: 23541 - DNA, 25 bp, Mus musculus
cagtcagtgccatcggatttagctg

SEQ ID NO: 23542 - DNA, 25 bp, Mus musculus
gtgccatcggatttagctgcagaga

SEQ ID NO: 23543 - DNA, 25 bp, Mus musculus
ttagctgcagagaccatgcgtacca

SEQ ID NO: 23544 - DNA, 25 bp, Mus musculus
gcagagaccatgcgtaccacccagg

SEQ ID NO: 23545 - DNA, 25 bp, Mus musculus
tctttctgaggctgctctactcacc

SEQ ID NO: 23546 - DNA, 25 bp, Mus musculus
tgaggctgctctactcaccaggact

SEQ ID NO: 23547 - DNA, 25 bp, Mus musculus
attgagcctcggacacaaggaaggc

SEQ ID NO: 23548 - DNA, 25 bp, Mus musculus
gccctgcctctctgtgttctaaaca

SEQ ID NO: 23549 - DNA, 25 bp, Mus musculus
ggtcccagggtcactcgcaaggata

SEQ ID NO: 23550 - DNA, 25 bp, Mus musculus
actcgcaaggatatcccagggacct

SEQ ID NO: 23551 - DNA, 25 bp, Mus musculus
atcccagggacctcgcaaagctttg

SEQ ID NO: 23552 - DNA, 25 bp, Mus musculus
gggacctcgcaaagctttgtggtgc

SEQ ID NO: 23553 - DNA, 25 bp, Mus musculus
agctttgtggtgctcatccctacct

SEQ ID NO: 23554 - DNA, 25 bp, Mus musculus
gtggtgctcatccctaccttcagag

SEQ ID NO: 23555 - DNA, 25 bp, Mus musculus
cctaccttcagaggccttgagagct

SEQ ID NO: 23556 - DNA, 25 bp, Mus musculus
gtgaagtcgcgcggaggagcaaccc

SEQ ID NO: 23557 - DNA, 25 bp, Mus musculus
tgctctactcaccaggactcacagg

SEQ ID NO: 23558 - DNA, 25 bp, Mus musculus
acttagcctcagacacctcttcaga

SEQ ID NO: 23559 - DNA, 25 bp, Mus musculus
acacctcttcagagcagaaccggac

SEQ ID NO: 23560 - DNA, 25 bp, Mus musculus
cttcagagcagaaccggacactagc

SEQ ID NO: 23561 - DNA, 25 bp, Mus musculus
agcagaaccggacactagcaggcca

SEQ ID NO: 23562 - DNA, 25 bp, Mus musculus
accggacactagcaggccacagtgc

SEQ ID NO: 23563 - DNA, 25 bp, Mus musculus
caggactctgactaccgcctgagca

SEQ ID NO: 23564 - DNA, 25 bp, Mus musculus
ctcccagaggcttcggccattgagc

SEQ ID NO: 23565 - DNA, 25 bp, Mus musculus
atcgatgccaagggtgtccttcgcc

SEQ ID NO: 23566 - DNA, 25 bp, Mus musculus
cagatcacagtcaatgacctacctg

SEQ ID NO: 23567 - DNA, 25 bp, Mus musculus
gaatacttctccaaacacaactgag

SEQ ID NO: 23568 - DNA, 25 bp, Mus musculus
ttctccaaacacaactgagatgggt

SEQ ID NO: 23569 - DNA, 25 bp, Mus musculus
taaacatcggtgagcctgaagcttg

SEQ ID NO: 23570 - DNA, 25 bp, Mus musculus
tcggtgagcctgaagcttggatttc

SEQ ID NO: 23571 - DNA, 25 bp, Mus musculus
aacctggatgtcctgtgctggccca

SEQ ID NO: 23572 - DNA, 25 bp, Mus musculus
ctgtgctggcccagaaaatgctaga

SEQ ID NO: 23573 - DNA, 25 bp, Mus musculus
tgctagattttcctccactctctga

SEQ ID NO: 23574 - DNA, 25 bp, Mus musculus
cattacccacctggaatctggtgaa

SEQ ID NO: 23575 - DNA, 25 bp, Mus musculus
ccacctggaatctggtgaatagtga

SEQ ID NO: 23576 - DNA, 25 bp, Mus musculus
ctagctgggcccaggtctataggaa

SEQ ID NO: 23577 - DNA, 25 bp, Mus musculus
acagtcaatgacctacctgtgggcc

SEQ ID NO: 23578 - DNA, 25 bp, Mus musculus
ctccgcctagtccaggcctttcagt

SEQ ID NO: 23579 - DNA, 25 bp, Mus musculus
caggcctttcagtatacagacgagc

SEQ ID NO: 23580 - DNA, 25 bp, Mus musculus
tatacagacgagcatggggaagtct

SEQ ID NO: 23581 - DNA, 25 bp, Mus musculus
tggaagcccggcagtgacaccatca

SEQ ID NO: 23582 - DNA, 25 bp, Mus musculus
agtgacaccatcaagcccaatgtgg

SEQ ID NO: 23583 - DNA, 25 bp, Mus musculus
accatcaagcccaatgtggatgaca

SEQ ID NO: 23584 - DNA, 25 bp, Mus musculus
aagcccaatgtggatgacagcaagg

SEQ ID NO: 23585 - DNA, 25 bp, Mus musculus
agctgctgtgctgcagagatggaca

SEQ ID NO: 23586 - DNA, 25 bp, Mus musculus
ctgctgtgctgcagagatggacacg

SEQ ID NO: 23587 - DNA, 25 bp, Mus musculus
ctacttcaagtggcggcagaatgac

SEQ ID NO: 23588 - DNA, 25 bp, Mus musculus
acttcaagtggcggcagaatgacat

SEQ ID NO: 23589 - DNA, 25 bp, Mus musculus
accgttcatgcgcatgattgttgtc

SEQ ID NO: 23590 - DNA, 25 bp, Mus musculus
cgttcatgcgcatgattgttgtccg

SEQ ID NO: 23591 - DNA, 25 bp, Mus musculus
gttcatgcgcatgattgttgtccga

SEQ ID NO: 23592 - DNA, 25 bp, Mus musculus
catgattgttgtccgactggatgct

SEQ ID NO: 23593 - DNA, 25 bp, Mus musculus
tgattgttgtccgactggatgctaa

SEQ ID NO: 23594 - DNA, 25 bp, Mus musculus
gattgttgtccgactggatgctaaa

SEQ ID NO: 23595 - DNA, 25 bp, Mus musculus
tgttgtccgactggatgctaaaagt

SEQ ID NO: 23596 - DNA, 25 bp, Mus musculus
ttgtccgactggatgctaaaagtgt

SEQ ID NO: 23597 - DNA, 25 bp, Mus musculus
atggacacggtccgcagcgacgtgc

SEQ ID NO: 23598 - DNA, 25 bp, Mus musculus
ctcccgcagatgttcctacttcaag

SEQ ID NO: 23599 - DNA, 25 bp, Mus musculus
ccgcagatgttcctacttcaagtgg

SEQ ID NO: 23600 - DNA, 25 bp, Mus musculus
gcagatgttcctacttcaagtggcg

SEQ ID NO: 23601 - DNA, 25 bp, Mus musculus
gatgttcctacttcaagtggcggca

SEQ ID NO: 23602 - DNA, 25 bp, Mus musculus
atgttcctacttcaagtggcggcag

SEQ ID NO: 23603 - DNA, 25 bp, Mus musculus
gttcctacttcaagtggcggcagaa

SEQ ID NO: 23604 - DNA, 25 bp, Mus musculus
ttcctacttcaagtggcggcagaat

SEQ ID NO: 23605 - DNA, 25 bp, Mus musculus
ctacagcactcattagagcagagcc

SEQ ID NO: 23606 - DNA, 25 bp, Mus musculus
acagcactcattagagcagagccta

SEQ ID NO: 23607 - DNA, 25 bp, Mus musculus
agctctctagacgtatacaatgact

SEQ ID NO: 23608 - DNA, 25 bp, Mus musculus
ctctctagacgtatacaatgactca

SEQ ID NO: 23609 - DNA, 25 bp, Mus musculus
gtatacaatgactcagttcttggaa

SEQ ID NO: 23610 - DNA, 25 bp, Mus musculus
atacaatgactcagttcttggaacc

SEQ ID NO: 23611 - DNA, 25 bp, Mus musculus
aatgactcagttcttggaaccgaga

SEQ ID NO: 23612 - DNA, 25 bp, Mus musculus
tgactcagttcttggaaccgagagg

SEQ ID NO: 23613 - DNA, 25 bp, Mus musculus
gatccaaaggctcattcagcctgtg

SEQ ID NO: 23614 - DNA, 25 bp, Mus musculus
gtaacatgaaccagatactggatgc

SEQ ID NO: 23615 - DNA, 25 bp, Mus musculus
aaccagatactggatgcagtcagta

SEQ ID NO: 23616 - DNA, 25 bp, Mus musculus
atactggatgcagtcagtatagaca

SEQ ID NO: 23617 - DNA, 25 bp, Mus musculus
ctcattagagcagagcctagcctac

SEQ ID NO: 23618 - DNA, 25 bp, Mus musculus
agagcagagcctagcctactctatc

SEQ ID NO: 23619 - DNA, 25 bp, Mus musculus
agcagagcctagcctactctatccc

SEQ ID NO: 23620 - DNA, 25 bp, Mus musculus
cagagcctagcctactctatcccta

SEQ ID NO: 23621 - DNA, 25 bp, Mus musculus
ccgcttcccaagctctctagacgta

SEQ ID NO: 23622 - DNA, 25 bp, Mus musculus
gcttcccaagctctctagacgtata

SEQ ID NO: 23623 - DNA, 25 bp, Mus musculus
cccaagctctctagacgtatacaat

SEQ ID NO: 23624 - DNA, 25 bp, Mus musculus
caagctctctagacgtatacaatga

SEQ ID NO: 23625 - DNA, 25 bp, Mus musculus
accagagccctctggctaatgctgt

SEQ ID NO: 23626 - DNA, 25 bp, Mus musculus
gccctctggctaatgctgttggtgg

SEQ ID NO: 23627 - DNA, 25 bp, Mus musculus
tgctttgactccagtatcccaaatg

SEQ ID NO: 23628 - DNA, 25 bp, Mus musculus
agtatcccaaatgtgccctggtgct

SEQ ID NO: 23629 - DNA, 25 bp, Mus musculus
ccaaatgtgccctggtgcttcaaac

SEQ ID NO: 23630 - DNA, 25 bp, Mus musculus
gtgccctggtgcttcaaacctctgc

SEQ ID NO: 23631 - DNA, 25 bp, Mus musculus
tggtgcttcaaacctctgcaggaga

SEQ ID NO: 23632 - DNA, 25 bp, Mus musculus
agctgtccaggctccaggaagggag

SEQ ID NO: 23633 - DNA, 25 bp, Mus musculus
caccctggactcctgctgctgatgg

SEQ ID NO: 23634 - DNA, 25 bp, Mus musculus
ggactcctgctgctgatggtggtcc

SEQ ID NO: 23635 - DNA, 25 bp, Mus musculus
ctgctgctgatggtggtccaagggt

SEQ ID NO: 23636 - DNA, 25 bp, Mus musculus
gaataaagacctcacagccaacaca

SEQ ID NO: 23637 - DNA, 25 bp, Mus musculus
gtcctggttgctgggtcctctggga

SEQ ID NO: 23638 - DNA, 25 bp, Mus musculus
caacacaaggctgatctgattgctg

SEQ ID NO: 23639 - DNA, 25 bp, Mus musculus
tacgttggcctgtctccaagccaat

SEQ ID NO: 23640 - DNA, 25 bp, Mus musculus
ggcctgtctccaagccaatgtatgg

SEQ ID NO: 23641 - DNA, 25 bp, Mus musculus
tgtatggtgccggcaaatgtcagag

SEQ ID NO: 23642 - DNA, 25 bp, Mus musculus
tacccctctgtcacatcggagcagt

SEQ ID NO: 23643 - DNA, 25 bp, Mus musculus
tctgtcacatcggagcagtgtaaca

SEQ ID NO: 23644 - DNA, 25 bp, Mus musculus
tgtaacaaccgtggctgctgctttg

SEQ ID NO: 23645 - DNA, 25 bp, Mus musculus
aaccgtggctgctgctttgactcca

SEQ ID NO: 23646 - DNA, 25 bp, Mus musculus
ctctttactccccagtaggagatca

SEQ ID NO: 23647 - DNA, 25 bp, Mus musculus
actccccagtaggagatcatctaag

SEQ ID NO: 23648 - DNA, 25 bp, Mus musculus
actgcctttcagaggtgatttagtt

SEQ ID NO: 23649 - DNA, 25 bp, Mus musculus
acatgcttggtgtacccagagaaac

SEQ ID NO: 23650 - DNA, 25 bp, Mus musculus
tgtggaccttggatactgagagttg

SEQ ID NO: 23651 - DNA, 25 bp, Mus musculus
tttcaatcacagtgttacctggtga

SEQ ID NO: 23652 - DNA, 25 bp, Mus musculus
tacacacatcgaaatcagtgtattt

SEQ ID NO: 23653 - DNA, 25 bp, Mus musculus
tgtatttcaggcagctctagtacaa

SEQ ID NO: 23654 - DNA, 25 bp, Mus musculus
aaatcaaactgacttaccataacat

SEQ ID NO: 23655 - DNA, 25 bp, Mus musculus
ttgcatgtcatacctaaattgtggg

SEQ ID NO: 23656 - DNA, 25 bp, Mus musculus
gaaacgcttctgctgtgtacatgta

SEQ ID NO: 23657 - DNA, 25 bp, Mus musculus
cttctgctgtgtacatgtataaata

SEQ ID NO: 23658 - DNA, 25 bp, Mus musculus
tgaataaaccaataccatcacagat

SEQ ID NO: 23659 - DNA, 25 bp, Mus musculus
taccatcacagatttctgaatctgc

SEQ ID NO: 23660 - DNA, 25 bp, Mus musculus
tttctgaatctgcaacagtaaccag

SEQ ID NO: 23661 - DNA, 25 bp, Mus musculus
aatctgcaacagtaaccagtcatca

SEQ ID NO: 23662 - DNA, 25 bp, Mus musculus
taaccagtcatcattacttaatttg

SEQ ID NO: 23663 - DNA, 25 bp, Mus musculus
gtcatcattacttaatttgtatgct

SEQ ID NO: 23664 - DNA, 25 bp, Mus musculus
gagaccctcaaaatctcctgctcac

SEQ ID NO: 23665 - DNA, 25 bp, Mus musculus
taatcttttgtcactgcctttcaga

SEQ ID NO: 23666 - DNA, 25 bp, Mus musculus
acattgtccagggtattgaaagtgc

SEQ ID NO: 23667 - DNA, 25 bp, Mus musculus
ctgagatcctgcaggctgtgccatt

SEQ ID NO: 23668 - DNA, 25 bp, Mus musculus
tacaccaagtgctgaaaggtggctc

SEQ ID NO: 23669 - DNA, 25 bp, Mus musculus
catattgcctcaatgtgtctttggc

SEQ ID NO: 23670 - DNA, 25 bp, Mus musculus
gcctcaatgtgtctttggctgacgc

SEQ ID NO: 23671 - DNA, 25 bp, Mus musculus
atgtgtctttggctgacgccaacag

SEQ ID NO: 23672 - DNA, 25 bp, Mus musculus
ccaacagcctggcagtggccagcac

SEQ ID NO: 23673 - DNA, 25 bp, Mus musculus
ctcccttgcttgtaggtatcttgct

SEQ ID NO: 23674 - DNA, 25 bp, Mus musculus
taggtatcttgctggtgttggtggc

SEQ ID NO: 23675 - DNA, 25 bp, Mus musculus
tccttgcatctctgatactaggcat

SEQ ID NO: 23676 - DNA, 25 bp, Mus musculus
aatgccacatggtagcactcactgc

SEQ ID NO: 23677 - DNA, 25 bp, Mus musculus
acatggtagcactcactgctgcgcc

SEQ ID NO: 23678 - DNA, 25 bp, Mus musculus
atgcatttgagctgactgtgtcctg

SEQ ID NO: 23679 - DNA, 25 bp, Mus musculus
gctcctcagtggacagcaggtctga

SEQ ID NO: 23680 - DNA, 25 bp, Mus musculus
ttgagctgactgtgtcctgccaagg

SEQ ID NO: 23681 - DNA, 25 bp, Mus musculus
tacccaaggaagcctgtatggacat

SEQ ID NO: 23682 - DNA, 25 bp, Mus musculus
tggacatttcatcaccagggtgcca

SEQ ID NO: 23683 - DNA, 25 bp, Mus musculus
ctgcccagaggctgtgccagtctgt

SEQ ID NO: 23684 - DNA, 25 bp, Mus musculus
agaggctgtgccagtctgttccacc

SEQ ID NO: 23685 - DNA, 25 bp, Mus musculus
tgtgccagtctgttccaccgagccc

SEQ ID NO: 23686 - DNA, 25 bp, Mus musculus
cagactgccagctggttctacacca

SEQ ID NO: 23687 - DNA, 25 bp, Mus musculus
tctctgaggcaagtcaccaggtagc

SEQ ID NO: 23688 - DNA, 25 bp, Mus musculus
aggcaagtcaccaggtagctcatct

SEQ ID NO: 23689 - DNA, 25 bp, Mus musculus
acaattgggtaccgcggtggatgct

SEQ ID NO: 23690 - DNA, 25 bp, Mus musculus
attgggtaccgcggtggatgctgaa

SEQ ID NO: 23691 - DNA, 25 bp, Mus musculus
taccgcggtggatgctgaagtacac

SEQ ID NO: 23692 - DNA, 25 bp, Mus musculus
tgaagtacacggtcatcgtgaacag

SEQ ID NO: 23693 - DNA, 25 bp, Mus musculus
agtacacggtcatcgtgaacagccg

SEQ ID NO: 23694 - DNA, 25 bp, Mus musculus
acacggtcatcgtgaacagccgggg

SEQ ID NO: 23695 - DNA, 25 bp, Mus musculus
cggtcatcgtgaacagccggggtat

SEQ ID NO: 23696 - DNA, 25 bp, Mus musculus
tcatcgtgaacagccggggtatgat

SEQ ID NO: 23697 - DNA, 25 bp, Mus musculus
tcgtgaacagccggggtatgatcta

SEQ ID NO: 23698 - DNA, 25 bp, Mus musculus
tgaacagccggggtatgatctagtc

SEQ ID NO: 23699 - DNA, 25 bp, Mus musculus
caagtcaccaggtagctcatctaga

SEQ ID NO: 23700 - DNA, 25 bp, Mus musculus
gtcaccaggtagctcatctagaaag

SEQ ID NO: 23701 - DNA, 25 bp, Mus musculus
accaggtagctcatctagaaagcat

SEQ ID NO: 23702 - DNA, 25 bp, Mus musculus
tagctcatctagaaagcatacatga

SEQ ID NO: 23703 - DNA, 25 bp, Mus musculus
aaagcatacatgacactgaagccca

SEQ ID NO: 23704 - DNA, 25 bp, Mus musculus
tacatgacactgaagcccacaattg

SEQ ID NO: 23705 - DNA, 25 bp, Mus musculus
atgacactgaagcccacaattgggt

SEQ ID NO: 23706 - DNA, 25 bp, Mus musculus
ctgaagcccacaattgggtaccgcg

SEQ ID NO: 23707 - DNA, 25 bp, Mus musculus
tgtccctggcatcccagagccatgc

SEQ ID NO: 23708 - DNA, 25 bp, Mus musculus
tggcatcccagagccatgctgtgtt

SEQ ID NO: 23709 - DNA, 25 bp, Mus musculus
agaagacagacctgcttcatccctg

SEQ ID NO: 23710 - DNA, 25 bp, Mus musculus
cctgccctgcagagtggcaatcttg

SEQ ID NO: 23711 - DNA, 25 bp, Mus musculus
ggcaatcttggagccagggcttgac

SEQ ID NO: 23712 - DNA, 25 bp, Mus musculus
aatcttggagccagggcttgactcg

SEQ ID NO: 23713 - DNA, 25 bp, Mus musculus
gttccaggtgctagacagagcttac

SEQ ID NO: 23714 - DNA, 25 bp, Mus musculus
cagagcttacaggcagccctgctgg

SEQ ID NO: 23715 - DNA, 25 bp, Mus musculus
agcttacaggcagccctgctgggac

SEQ ID NO: 23716 - DNA, 25 bp, Mus musculus
ttacaggcagccctgctgggaccaa

SEQ ID NO: 23717 - DNA, 25 bp, Mus musculus
gcagccctgctgggaccaagaaaga

SEQ ID NO: 23718 - DNA, 25 bp, Mus musculus
gccctgctgggaccaagaaagatct

SEQ ID NO: 23719 - DNA, 25 bp, Mus musculus
agagccatgctgtgttccagacaag

SEQ ID NO: 23720 - DNA, 25 bp, Mus musculus
ctgtgttccagacaagatgaactcc

SEQ ID NO: 23721 - DNA, 25 bp, Mus musculus
tggagtccttttcctggatgaaaat

SEQ ID NO: 23722 - DNA, 25 bp, Mus musculus
ccccaatatgtccgtagagacctgt

SEQ ID NO: 23723 - DNA, 25 bp, Mus musculus
caatatgtccgtagagacctgtgcc

SEQ ID NO: 23724 - DNA, 25 bp, Mus musculus
tatgtccgtagagacctgtgcctgt

SEQ ID NO: 23725 - DNA, 25 bp, Mus musculus
cgtagagacctgtgcctgtcggtaa

SEQ ID NO: 23726 - DNA, 25 bp, Mus musculus
ctgtgcctgtcggtaagatggcttc

SEQ ID NO: 23727 - DNA, 25 bp, Mus musculus
cagacccaacagggaatgaagtcca

SEQ ID NO: 23728 - DNA, 25 bp, Mus musculus
agacaggcagcttgcttgcacacac

SEQ ID NO: 23729 - DNA, 25 bp, Mus musculus
gaagttcaccttcttccctcttctg

SEQ ID NO: 23730 - DNA, 25 bp, Mus musculus
ggttctcggcctcaacaaattccag

SEQ ID NO: 23731 - DNA, 25 bp, Mus musculus
cggcctcaacaaattccagtcagtc

SEQ ID NO: 23732 - DNA, 25 bp, Mus musculus
ttttagctcccatgggactgttttg

SEQ ID NO: 23733 - DNA, 25 bp, Mus musculus
ctcccatgggactgttttgtacctg

SEQ ID NO: 23734 - DNA, 25 bp, Mus musculus
gtacctgcttctttactagtctgcc

SEQ ID NO: 23735 - DNA, 25 bp, Mus musculus
gcttctttactagtctgccctagtg

SEQ ID NO: 23736 - DNA, 25 bp, Mus musculus
ttactagtctgccctagtgccatcc

SEQ ID NO: 23737 - DNA, 25 bp, Mus musculus
acgcacacatgcacacacatgcaca

SEQ ID NO: 23738 - DNA, 25 bp, Mus musculus
atgcacacacacacaattttaactt

SEQ ID NO: 23739 - DNA, 25 bp, Mus musculus
cacacaccagcagagctcaactaca

SEQ ID NO: 23740 - DNA, 25 bp, Mus musculus
ccagcagagctcaactacaacttcc

SEQ ID NO: 23741 - DNA, 25 bp, Mus musculus
gagctcaactacaacttcctatgac

SEQ ID NO: 23742 - DNA, 25 bp, Mus musculus
aactacaacttcctatgacctgagc

SEQ ID NO: 23743 - DNA, 25 bp, Mus musculus
caaccagatgctgtccccatttgga

SEQ ID NO: 23744 - DNA, 25 bp, Mus musculus
ccctgacttgagcacagctaagatc

SEQ ID NO: 23745 - DNA, 25 bp, Mus musculus
cacagctaagatctctgttagattt

SEQ ID NO: 23746 - DNA, 25 bp, Mus musculus
ttatctgagacctgtttggctttgg

SEQ ID NO: 23747 - DNA, 25 bp, Mus musculus
ttcggcacaggcttcacagtagatt

SEQ ID NO: 23748 - DNA, 25 bp, Mus musculus
cggcacaggcttcacagtagattgc

SEQ ID NO: 23749 - DNA, 25 bp, Mus musculus
atggtggcccctatcacattggtgg

SEQ ID NO: 23750 - DNA, 25 bp, Mus musculus
ggtggcccctatcacattggtggaa

SEQ ID NO: 23751 - DNA, 25 bp, Mus musculus
tggcccctatcacattggtggaagt

SEQ ID NO: 23752 - DNA, 25 bp, Mus musculus
ccctatcacattggtggaagtccct

SEQ ID NO: 23753 - DNA, 25 bp, Mus musculus
taaagccaaggtcacaggtcctcgt

SEQ ID NO: 23754 - DNA, 25 bp, Mus musculus
caaggtcacaggtcctcgtcttgta

SEQ ID NO: 23755 - DNA, 25 bp, Mus musculus
aggtcacaggtcctcgtcttgtaag

SEQ ID NO: 23756 - DNA, 25 bp, Mus musculus
gtcacaggtcctcgtcttgtaagca

SEQ ID NO: 23757 - DNA, 25 bp, Mus musculus
cacaggtcctcgtcttgtaagcaac

SEQ ID NO: 23758 - DNA, 25 bp, Mus musculus
caggtcctcgtcttgtaagcaacca

SEQ ID NO: 23759 - DNA, 25 bp, Mus musculus
acaggcttcacagtagattgcagca

SEQ ID NO: 23760 - DNA, 25 bp, Mus musculus
aatgcaggagctggtgccctttcgg

SEQ ID NO: 23761 - DNA, 25 bp, Mus musculus
tgccctttcggttaccattgatggc

SEQ ID NO: 23762 - DNA, 25 bp, Mus musculus
gccccgaggcgtatcgtgtcaccta

SEQ ID NO: 23763 - DNA, 25 bp, Mus musculus
gcgtatcgtgtcacctataccccca

SEQ ID NO: 23764 - DNA, 25 bp, Mus musculus
gtatcgtgtcacctatacccccatg

SEQ ID NO: 23765 - DNA, 25 bp, Mus musculus
atacccccatggcacctggcagcta

SEQ ID NO: 23766 - DNA, 25 bp, Mus musculus
tctccatcaagtatggtggccccta

SEQ ID NO: 23767 - DNA, 25 bp, Mus musculus
aatatgtaccaactgattttggacg

SEQ ID NO: 23768 - DNA, 25 bp, Mus musculus
atatgtaccaactgattttggacga

SEQ ID NO: 23769 - DNA, 25 bp, Mus musculus
tatggttggcagtggtctgtcgatc

SEQ ID NO: 23770 - DNA, 25 bp, Mus musculus
tggttggcagtggtctgtcgatccg

SEQ ID NO: 23771 - DNA, 25 bp, Mus musculus
cagtggtctgtcgatccgtcattgg

SEQ ID NO: 23772 - DNA, 25 bp, Mus musculus
agtggtctgtcgatccgtcattgga

SEQ ID NO: 23773 - DNA, 25 bp, Mus musculus
gtggtctgtcgatccgtcattggag

SEQ ID NO: 23774 - DNA, 25 bp, Mus musculus
tggtctgtcgatccgtcattggagg

SEQ ID NO: 23775 - DNA, 25 bp, Mus musculus
ggtctgtcgatccgtcattggagga

SEQ ID NO: 23776 - DNA, 25 bp, Mus musculus
gtctgtcgatccgtcattggaggaa

SEQ ID NO: 23777 - DNA, 25 bp, Mus musculus
tctgtcgatccgtcattggaggaat

SEQ ID NO: 23778 - DNA, 25 bp, Mus musculus
ctgtcgatccgtcattggaggaatg

SEQ ID NO: 23779 - DNA, 25 bp, Mus musculus
tatgtaccaactgattttggacgac

SEQ ID NO: 23780 - DNA, 25 bp, Mus musculus
tgtcgatccgtcattggaggaatgt

SEQ ID NO: 23781 - DNA, 25 bp, Mus musculus
atgtaccaactgattttggacgact

SEQ ID NO: 23782 - DNA, 25 bp, Mus musculus
tgtaccaactgattttggacgacta

SEQ ID NO: 23783 - DNA, 25 bp, Mus musculus
gtaccaactgattttggacgactat

SEQ ID NO: 23784 - DNA, 25 bp, Mus musculus
taccaactgattttggacgactatg

SEQ ID NO: 23785 - DNA, 25 bp, Mus musculus
ttctagtatggttggcagtggtctg

SEQ ID NO: 23786 - DNA, 25 bp, Mus musculus
tctagtatggttggcagtggtctgt

SEQ ID NO: 23787 - DNA, 25 bp, Mus musculus
gtatggttggcagtggtctgtcgat

SEQ ID NO: 23788 - DNA, 25 bp, Mus musculus
ttgccaccatgaacttctccggcaa

SEQ ID NO: 23789 - DNA, 25 bp, Mus musculus
ccaccatgaacttctccggcaagta

SEQ ID NO: 23790 - DNA, 25 bp, Mus musculus
gtctgcccgaggacctcatccagaa

SEQ ID NO: 23791 - DNA, 25 bp, Mus musculus
acctcatccagaaagggaaggacat

SEQ ID NO: 23792 - DNA, 25 bp, Mus musculus
aaatcaaactcaccatcacctatgg

SEQ ID NO: 23793 - DNA, 25 bp, Mus musculus
tcaccatcacctatggacccaaagt

SEQ ID NO: 23794 - DNA, 25 bp, Mus musculus
ccatcacctatggacccaaagtggt

SEQ ID NO: 23795 - DNA, 25 bp, Mus musculus
atggacccaaagtggtccgcaatga

SEQ ID NO: 23796 - DNA, 25 bp, Mus musculus
gacccaaagtggtccgcaatgagtt

SEQ ID NO: 23797 - DNA, 25 bp, Mus musculus
aagtcaaggcagtcgtcaagctgga

SEQ ID NO: 23798 - DNA, 25 bp, Mus musculus
tcaaggcagtcgtcaagctggaagg

SEQ ID NO: 23799 - DNA, 25 bp, Mus musculus
cagtcgtcaagctggaaggtgacaa

SEQ ID NO: 23800 - DNA, 25 bp, Mus musculus
tgaacttctccggcaagtaccaatt

SEQ ID NO: 23801 - DNA, 25 bp, Mus musculus
acttctccggcaagtaccaattgca

SEQ ID NO: 23802 - DNA, 25 bp, Mus musculus
tctccggcaagtaccaattgcagag

SEQ ID NO: 23803 - DNA, 25 bp, Mus musculus
agtaccaattgcagagccaggagaa

SEQ ID NO: 23804 - DNA, 25 bp, Mus musculus
accaattgcagagccaggagaactt

SEQ ID NO: 23805 - DNA, 25 bp, Mus musculus
agaactttgagccattcatgaaggc

SEQ ID NO: 23806 - DNA, 25 bp, Mus musculus
ttgagccattcatgaaggcaatagg

SEQ ID NO: 23807 - DNA, 25 bp, Mus musculus
taggtctgcccgaggacctcatcca

SEQ ID NO: 23808 - DNA, 25 bp, Mus musculus
atgtgttcgtgcagcacgggagact

SEQ ID NO: 23809 - DNA, 25 bp, Mus musculus
tcgtgcagcacgggagactagctat

SEQ ID NO: 23810 - DNA, 25 bp, Mus musculus
atctactgaaggcttcctgctgaag

SEQ ID NO: 23811 - DNA, 25 bp, Mus musculus
tgaaggcttcctgctgaagccggtg

SEQ ID NO: 23812 - DNA, 25 bp, Mus musculus
gtacgctgcttgccctgcatgctgt

SEQ ID NO: 23813 - DNA, 25 bp, Mus musculus
tgcttgccctgcatgctgtgcaatg

SEQ ID NO: 23814 - DNA, 25 bp, Mus musculus
ccctgcatgctgtgcaatgagatat

SEQ ID NO: 23815 - DNA, 25 bp, Mus musculus
ggcaatcgcaggacagcagtcccca

SEQ ID NO: 23816 - DNA, 25 bp, Mus musculus
actaaccctgctgggagaagcattc

SEQ ID NO: 23817 - DNA, 25 bp, Mus musculus
tgatgacatatcacgcatgctgggc

SEQ ID NO: 23818 - DNA, 25 bp, Mus musculus
catatcacgcatgctgggctctggg

SEQ ID NO: 23819 - DNA, 25 bp, Mus musculus
caggaaccctttagagcacactggc

SEQ ID NO: 23820 - DNA, 25 bp, Mus musculus
ggagcgctgcatggcagatgagaac

SEQ ID NO: 23821 - DNA, 25 bp, Mus musculus
aatgttcctgcagcgcagaggtcag

SEQ ID NO: 23822 - DNA, 25 bp, Mus musculus
cctgcagcgcagaggtcaggtgatc

SEQ ID NO: 23823 - DNA, 25 bp, Mus musculus
catgaccatagagctcctggacaca

SEQ ID NO: 23824 - DNA, 25 bp, Mus musculus
gctcctggacacagaagaggcacag

SEQ ID NO: 23825 - DNA, 25 bp, Mus musculus
ggctcgctatgtggagcagtatgtg

SEQ ID NO: 23826 - DNA, 25 bp, Mus musculus
tgcatccagctcatctactgaaggc

SEQ ID NO: 23827 - DNA, 25 bp, Mus musculus
cagctcatctactgaaggcttcctg

SEQ ID NO: 23828 - DNA, 25 bp, Mus musculus
aggccgcaggcttcatcgacgagga

SEQ ID NO: 23829 - DNA, 25 bp, Mus musculus
caggcttcatcgacgaggaccacct

SEQ ID NO: 23830 - DNA, 25 bp, Mus musculus
ccaccatgggcgaccgattcacgga

SEQ ID NO: 23831 - DNA, 25 bp, Mus musculus
tgggcgaccgattcacggatgagga

SEQ ID NO: 23832 - DNA, 25 bp, Mus musculus
gcgaccgattcacggatgaggaggt

SEQ ID NO: 23833 - DNA, 25 bp, Mus musculus
agatgtaccgcgaggcacccattga

SEQ ID NO: 23834 - DNA, 25 bp, Mus musculus
tgtaccgcgaggcacccattgataa

SEQ ID NO: 23835 - DNA, 25 bp, Mus musculus
aggcacccattgataagaggggcaa

SEQ ID NO: 23836 - DNA, 25 bp, Mus musculus
agttcactcgcatcctcaagcacgg

SEQ ID NO: 23837 - DNA, 25 bp, Mus musculus
gcatcctcaagcacggcgccaagga

SEQ ID NO: 23838 - DNA, 25 bp, Mus musculus
tcaagcacggcgccaaggacaagga

SEQ ID NO: 23839 - DNA, 25 bp, Mus musculus
agcacggcgccaaggacaaggacga

SEQ ID NO: 23840 - DNA, 25 bp, Mus musculus
gcttcatcgacgaggaccacctgag

SEQ ID NO: 23841 - DNA, 25 bp, Mus musculus
tcatcgacgaggaccacctgaggga

SEQ ID NO: 23842 - DNA, 25 bp, Mus musculus
tcgacgaggaccacctgagggagct

SEQ ID NO: 23843 - DNA, 25 bp, Mus musculus
aggaccacctgagggagctgctcac

SEQ ID NO: 23844 - DNA, 25 bp, Mus musculus
accacctgagggagctgctcaccac

SEQ ID NO: 23845 - DNA, 25 bp, Mus musculus
agctgctcaccaccatgggcgaccg

SEQ ID NO: 23846 - DNA, 25 bp, Mus musculus
tgctcaccaccatgggcgaccgatt

SEQ ID NO: 23847 - DNA, 25 bp, Mus musculus
tcaccaccatgggcgaccgattcac

SEQ ID NO: 23848 - DNA, 25 bp, Mus musculus
aggtggcacccactgacattgaaga

SEQ ID NO: 23849 - DNA, 25 bp, Mus musculus
gtggcacccactgacattgaagaag

SEQ ID NO: 23850 - DNA, 25 bp, Mus musculus
ctacatcctagggtcgacccaacag

SEQ ID NO: 23851 - DNA, 25 bp, Mus musculus
tagggtcgacccaacagttacaatg

SEQ ID NO: 23852 - DNA, 25 bp, Mus musculus
gggtcgacccaacagttacaatgat

SEQ ID NO: 23853 - DNA, 25 bp, Mus musculus
gtcgacccaacagttacaatgatgc

SEQ ID NO: 23854 - DNA, 25 bp, Mus musculus
cgacccaacagttacaatgatgcag

SEQ ID NO: 23855 - DNA, 25 bp, Mus musculus
acccaacagttacaatgatgcaggt

SEQ ID NO: 23856 - DNA, 25 bp, Mus musculus
gggaaaacaccggcgtcacatacag

SEQ ID NO: 23857 - DNA, 25 bp, Mus musculus
acaccggcgtcacatacagtgatgt

SEQ ID NO: 23858 - DNA, 25 bp, Mus musculus
accggcgtcacatacagtgatgtag

SEQ ID NO: 23859 - DNA, 25 bp, Mus musculus
cggcgtcacatacagtgatgtaggt

SEQ ID NO: 23860 - DNA, 25 bp, Mus musculus
ggcacccactgacattgaagaaggg

SEQ ID NO: 23861 - DNA, 25 bp, Mus musculus
cccactgacattgaagaagggatga

SEQ ID NO: 23862 - DNA, 25 bp, Mus musculus
taacagattcacataccactacatc

SEQ ID NO: 23863 - DNA, 25 bp, Mus musculus
acagattcacataccactacatcct

SEQ ID NO: 23864 - DNA, 25 bp, Mus musculus
agattcacataccactacatcctag

SEQ ID NO: 23865 - DNA, 25 bp, Mus musculus
attcacataccactacatcctaggg

SEQ ID NO: 23866 - DNA, 25 bp, Mus musculus
tcacataccactacatcctagggtc

SEQ ID NO: 23867 - DNA, 25 bp, Mus musculus
acataccactacatcctagggtcga

SEQ ID NO: 23868 - DNA, 25 bp, Mus musculus
ttatctatgctgaactggaaaatat

SEQ ID NO: 23869 - DNA, 25 bp, Mus musculus
tcaccattcaatgtgatcctggata

SEQ ID NO: 23870 - DNA, 25 bp, Mus musculus
acaggaaacctcagtctatgaaaat

SEQ ID NO: 23871 - DNA, 25 bp, Mus musculus
ttagactttgcaattagtggacaga

SEQ ID NO: 23872 - DNA, 25 bp, Mus musculus
agtctccacgcagcagctggcctga

SEQ ID NO: 23873 - DNA, 25 bp, Mus musculus
cacgcagcagctggcctgacacaca

SEQ ID NO: 23874 - DNA, 25 bp, Mus musculus
ctatgtcattcattagtgtctagcc

SEQ ID NO: 23875 - DNA, 25 bp, Mus musculus
cattcattagtgtctagccattgtg

SEQ ID NO: 23876 - DNA, 25 bp, Mus musculus
ttagtgtctagccattgtggttcaa

SEQ ID NO: 23877 - DNA, 25 bp, Mus musculus
ggttcaatttgtctacttggctgga

SEQ ID NO: 23878 - DNA, 25 bp, Mus musculus
atttgtctacttggctggactcact

SEQ ID NO: 23879 - DNA, 25 bp, Mus musculus
ctacttggctggactcactgaaata

SEQ ID NO: 23880 - DNA, 25 bp, Mus musculus
ataccatagttggttcaccaaacat

SEQ ID NO: 23881 - DNA, 25 bp, Mus musculus
accctgaggtacccagctgtcagat

SEQ ID NO: 23882 - DNA, 25 bp, Mus musculus
gcagaggcgcacaactcttgcattg

SEQ ID NO: 23883 - DNA, 25 bp, Mus musculus
aactcttgcattgcctctcaagccc

SEQ ID NO: 23884 - DNA, 25 bp, Mus musculus
tgcattgcctctcaagcccagaaga

SEQ ID NO: 23885 - DNA, 25 bp, Mus musculus
gcctctcaagcccagaagatgtgca

SEQ ID NO: 23886 - DNA, 25 bp, Mus musculus
atgtgcacagggccctgaaggtgta

SEQ ID NO: 23887 - DNA, 25 bp, Mus musculus
agttacacaggaaacctcagtctat

SEQ ID NO: 23888 - DNA, 25 bp, Mus musculus
gtaaatacatttcctcacttgattc

SEQ ID NO: 23889 - DNA, 25 bp, Mus musculus
tttcctcacttgattccatctgcaa

SEQ ID NO: 23890 - DNA, 25 bp, Mus musculus
tcctcatacaagcattgttgaaatg

SEQ ID NO: 23891 - DNA, 25 bp, Mus musculus
cttaacctattgtgcaaggacgcaa

SEQ ID NO: 23892 - DNA, 25 bp, Mus musculus
gacgcaaacagacctcatctttgta

SEQ ID NO: 23893 - DNA, 25 bp, Mus musculus
gcaaacagacctcatctttgtaatg

SEQ ID NO: 23894 - DNA, 25 bp, Mus musculus
aacagacctcatctttgtaatgatg

SEQ ID NO: 23895 - DNA, 25 bp, Mus musculus
aactggcaagttctggctaggtgag

SEQ ID NO: 23896 - DNA, 25 bp, Mus musculus
cttccgagctttcttggactgcttg

SEQ ID NO: 23897 - DNA, 25 bp, Mus musculus
agctttcttggactgcttgtccctc

SEQ ID NO: 23898 - DNA, 25 bp, Mus musculus
cgtgagcttttcaaacctttgatgg

SEQ ID NO: 23899 - DNA, 25 bp, Mus musculus
gacctggttgctttttctcttctgc

SEQ ID NO: 23900 - DNA, 25 bp, Mus musculus
ttgattccatctgcaaccctttgcc

SEQ ID NO: 23901 - DNA, 25 bp, Mus musculus
attccatctgcaaccctttgcccat

SEQ ID NO: 23902 - DNA, 25 bp, Mus musculus
gcaaccctttgcccattctattctg

SEQ ID NO: 23903 - DNA, 25 bp, Mus musculus
accctttgcccattctattctgatc

SEQ ID NO: 23904 - DNA, 25 bp, Mus musculus
ctttgcccattctattctgatctta

SEQ ID NO: 23905 - DNA, 25 bp, Mus musculus
ttctattctgatcttattaaagtgg

SEQ ID NO: 23906 - DNA, 25 bp, Mus musculus
ttgaattcctcatacaagcattgtt

SEQ ID NO: 23907 - DNA, 25 bp, Mus musculus
aattcctcatacaagcattgttgaa

SEQ ID NO: 23908 - DNA, 25 bp, Mus musculus
catgctggtggctggaggcatcgta

SEQ ID NO: 23909 - DNA, 25 bp, Mus musculus
gatcttcctcattttcatcgagatc

SEQ ID NO: 23910 - DNA, 25 bp, Mus musculus
agccacatttagggctatcacctcc

SEQ ID NO: 23911 - DNA, 25 bp, Mus musculus
ggcctccagcttcaagagacgtagg

SEQ ID NO: 23912 - DNA, 25 bp, Mus musculus
ctccagcttcaagagacgtaggtcc

SEQ ID NO: 23913 - DNA, 25 bp, Mus musculus
gagacgtaggtcctccaaagacacg

SEQ ID NO: 23914 - DNA, 25 bp, Mus musculus
gtcctccaaagacacgagcaccggg

SEQ ID NO: 23915 - DNA, 25 bp, Mus musculus
gcaaaaccaaaaagacacagtgctg

SEQ ID NO: 23916 - DNA, 25 bp, Mus musculus
agacacagtgctgccgcgacgcgct

SEQ ID NO: 23917 - DNA, 25 bp, Mus musculus
gcagctgtgttcccgtcatagggag

SEQ ID NO: 23918 - DNA, 25 bp, Mus musculus
ttcccgtcatagggagagctgagac

SEQ ID NO: 23919 - DNA, 25 bp, Mus musculus
ccccgcagacagacgcacgggacag

SEQ ID NO: 23920 - DNA, 25 bp, Mus musculus
cttcctcattttcatcgagatcgcc

SEQ ID NO: 23921 - DNA, 25 bp, Mus musculus
cctcattttcatcgagatcgcctac

SEQ ID NO: 23922 - DNA, 25 bp, Mus musculus
catcgagatcgcctacaagcgacac

SEQ ID NO: 23923 - DNA, 25 bp, Mus musculus
cgagatcgcctacaagcgacacaag

SEQ ID NO: 23924 - DNA, 25 bp, Mus musculus
cgcctacaagcgacacaaggatgcc

SEQ ID NO: 23925 - DNA, 25 bp, Mus musculus
acacaaggatgcccgtaggaagcag

SEQ ID NO: 23926 - DNA, 25 bp, Mus musculus
gatgcagctggcttttgcagccgtg

SEQ ID NO: 23927 - DNA, 25 bp, Mus musculus
gctggcttttgcagccgtgaacgtg

SEQ ID NO: 23928 - DNA, 25 bp, Mus musculus
ttgctctacatccttctgcggaatg

SEQ ID NO: 23929 - DNA, 25 bp, Mus musculus
tacatccttctgcggaatggggtga

SEQ ID NO: 23930 - DNA, 25 bp, Mus musculus
gtcaccaactccgcgggctcaggga

SEQ ID NO: 23931 - DNA, 25 bp, Mus musculus
taccagctgtctcgctggtccccag

SEQ ID NO: 23932 - DNA, 25 bp, Mus musculus
tccccagtcatcaaggatgtgatgg

SEQ ID NO: 23933 - DNA, 25 bp, Mus musculus
tcccaggcagctgtcagcgctcgct

SEQ ID NO: 23934 - DNA, 25 bp, Mus musculus
cctaggctcatcgtgtacattgtgg

SEQ ID NO: 23935 - DNA, 25 bp, Mus musculus
ctcataggctcttctcacatcctta

SEQ ID NO: 23936 - DNA, 25 bp, Mus musculus
acccgcttcctcgatgacctcaaga

SEQ ID NO: 23937 - DNA, 25 bp, Mus musculus
ttcctcgatgacctcaagacactgg

SEQ ID NO: 23938 - DNA, 25 bp, Mus musculus
gatgacctcaagacactggatcaga

SEQ ID NO: 23939 - DNA, 25 bp, Mus musculus
ctcaagacactggatcagaagctgg

SEQ ID NO: 23940 - DNA, 25 bp, Mus musculus
atccagcatgccaacgtgcagtcgt

SEQ ID NO: 23941 - DNA, 25 bp, Mus musculus
catgccaacgtgcagtcgtacagca

SEQ ID NO: 23942 - DNA, 25 bp, Mus musculus
aacgtgcagtcgtacagcagcctca

SEQ ID NO: 23943 - DNA, 25 bp, Mus musculus
cagtcgtacagcagcctcatccgga

SEQ ID NO: 23944 - DNA, 25 bp, Mus musculus
agcctcatccggaatctggagcagc

SEQ ID NO: 23945 - DNA, 25 bp, Mus musculus
atccggaatctggagcagctgggcg

SEQ ID NO: 23946 - DNA, 25 bp, Mus musculus
aatctggagcagctgggcggcactg

SEQ ID NO: 23947 - DNA, 25 bp, Mus musculus
gagcagctgggcggcactgtcacca

SEQ ID NO: 23948 - DNA, 25 bp, Mus musculus
cgttctcacatcaatgggacagaga

SEQ ID NO: 23949 - DNA, 25 bp, Mus musculus
ttctcacatcaatgggacagagaga

SEQ ID NO: 23950 - DNA, 25 bp, Mus musculus
aacatcgctatcaccagcttcttag

SEQ ID NO: 23951 - DNA, 25 bp, Mus musculus
catcgctatcaccagcttcttagat

SEQ ID NO: 23952 - DNA, 25 bp, Mus musculus
tatcaccagcttcttagatgtgaat

SEQ ID NO: 23953 - DNA, 25 bp, Mus musculus
atcaccagcttcttagatgtgaatc

SEQ ID NO: 23954 - DNA, 25 bp, Mus musculus
accagcttcttagatgtgaatcggt

SEQ ID NO: 23955 - DNA, 25 bp, Mus musculus
gtgaatcggtccagcatctcgctgg

SEQ ID NO: 23956 - DNA, 25 bp, Mus musculus
gaatcggtccagcatctcgctggcc

SEQ ID NO: 23957 - DNA, 25 bp, Mus musculus
aatggcaatgcatgccatggtcctg

SEQ ID NO: 23958 - DNA, 25 bp, Mus musculus
caatgcatgccatggtcctgtattc

SEQ ID NO: 23959 - DNA, 25 bp, Mus musculus
aatgcatgccatggtcctgtattcc

SEQ ID NO: 23960 - DNA, 25 bp, Mus musculus
tctcacatcaatgggacagagagac

SEQ ID NO: 23961 - DNA, 25 bp, Mus musculus
atgcatgccatggtcctgtattcct

SEQ ID NO: 23962 - DNA, 25 bp, Mus musculus
ctgtgaatgccttgcgagtcaatgt

SEQ ID NO: 23963 - DNA, 25 bp, Mus musculus
ggtgcgcaatctgtcacaaacatcg

SEQ ID NO: 23964 - DNA, 25 bp, Mus musculus
tgcgcaatctgtcacaaacatcgct

SEQ ID NO: 23965 - DNA, 25 bp, Mus musculus
gcgcaatctgtcacaaacatcgcta

SEQ ID NO: 23966 - DNA, 25 bp, Mus musculus
gcaatctgtcacaaacatcgctatc

SEQ ID NO: 23967 - DNA, 25 bp, Mus musculus
caatctgtcacaaacatcgctatca

SEQ ID NO: 23968 - DNA, 25 bp, Mus musculus
atctgtcacaaacatcgctatcacc

SEQ ID NO: 23969 - DNA, 25 bp, Mus musculus
ttcgtaactggagccaccttggtgt

SEQ ID NO: 23970 - DNA, 25 bp, Mus musculus
ggagccaccttggtgttcccattgt

SEQ ID NO: 23971 - DNA, 25 bp, Mus musculus
ttacgtactctgagatgcggtgtgc

SEQ ID NO: 23972 - DNA, 25 bp, Mus musculus
actctgagatgcggtgtgcttatga

SEQ ID NO: 23973 - DNA, 25 bp, Mus musculus
cttatgaagtttcccaggcacataa

SEQ ID NO: 23974 - DNA, 25 bp, Mus musculus
aagtttcccaggcacataaatcctg

SEQ ID NO: 23975 - DNA, 25 bp, Mus musculus
tttcccaggcacataaatcctgtga

SEQ ID NO: 23976 - DNA, 25 bp, Mus musculus
cccaggcacataaatcctgtgaggt

SEQ ID NO: 23977 - DNA, 25 bp, Mus musculus
cacataaatcctgtgaggttattat

SEQ ID NO: 23978 - DNA, 25 bp, Mus musculus
cacccagaaagctcctggatgatat

SEQ ID NO: 23979 - DNA, 25 bp, Mus musculus
acgatcggctacagcaaatgttgct

SEQ ID NO: 23980 - DNA, 25 bp, Mus musculus
atcggctacagcaaatgttgcttgt

SEQ ID NO: 23981 - DNA, 25 bp, Mus musculus
agacttttcagctttctcgatggac

SEQ ID NO: 23982 - DNA, 25 bp, Mus musculus
cttttcagctttctcgatggacacc

SEQ ID NO: 23983 - DNA, 25 bp, Mus musculus
tttctcgatggacaccttttatcaa

SEQ ID NO: 23984 - DNA, 25 bp, Mus musculus
ctcgatggacaccttttatcaaaga

SEQ ID NO: 23985 - DNA, 25 bp, Mus musculus
ggacaccttttatcaaagatatcat

SEQ ID NO: 23986 - DNA, 25 bp, Mus musculus
tgagtgctcgccagaaacccagaac

SEQ ID NO: 23987 - DNA, 25 bp, Mus musculus
gtgctcgccagaaacccagaactaa

SEQ ID NO: 23988 - DNA, 25 bp, Mus musculus
gaattacgtactctgagatgcggtg

SEQ ID NO: 23989 - DNA, 25 bp, Mus musculus
ctggctgctccagtcgactcctggt

SEQ ID NO: 23990 - DNA, 25 bp, Mus musculus
ggctgctccagtcgactcctggtcg

SEQ ID NO: 23991 - DNA, 25 bp, Mus musculus
gtaggagtccttcgtaaggacatga

SEQ ID NO: 23992 - DNA, 25 bp, Mus musculus
gagtccttcgtaaggacatgatatg

SEQ ID NO: 23993 - DNA, 25 bp, Mus musculus
acatgattctgaacctgttgatatc

SEQ ID NO: 23994 - DNA, 25 bp, Mus musculus
attctgaacctgttgatatcatgaa

SEQ ID NO: 23995 - DNA, 25 bp, Mus musculus
tgaagcaatgctcagcgcgagtata

SEQ ID NO: 23996 - DNA, 25 bp, Mus musculus
aatgctcagcgcgagtatattgcta

SEQ ID NO: 23997 - DNA, 25 bp, Mus musculus
atgctcagcgcgagtatattgctat

SEQ ID NO: 23998 - DNA, 25 bp, Mus musculus
tgagttagagctgtctgcaggactt

SEQ ID NO: 23999 - DNA, 25 bp, Mus musculus
agttagagctgtctgcaggacttgt

SEQ ID NO: 24000 - DNA, 25 bp, Mus musculus
tagagctgtctgcaggacttgtgga

SEQ ID NO: 24001 - DNA, 25 bp, Mus musculus
gctgctccagtcgactcctggtcga

SEQ ID NO: 24002 - DNA, 25 bp, Mus musculus
agagctgtctgcaggacttgtggat

SEQ ID NO: 24003 - DNA, 25 bp, Mus musculus
gtcgacagcatcatggctactagtg

SEQ ID NO: 24004 - DNA, 25 bp, Mus musculus
actagtggcactgtgactgacttgt

SEQ ID NO: 24005 - DNA, 25 bp, Mus musculus
ctgtgactgacttgtgtgtatttga

SEQ ID NO: 24006 - DNA, 25 bp, Mus musculus
gtatttgatgtcatggctgatgtag

SEQ ID NO: 24007 - DNA, 25 bp, Mus musculus
gatgtcatggctgatgtaggagtcc

SEQ ID NO: 24008 - DNA, 25 bp, Mus musculus
atgtcatggctgatgtaggagtcct

SEQ ID NO: 24009 - DNA, 25 bp, Mus musculus
atgtaggagtccttcgtaaggacat

SEQ ID NO: 24010 - DNA, 25 bp, Mus musculus
gagtctcctcgttgccactaagcag

SEQ ID NO: 24011 - DNA, 25 bp, Mus musculus
tctcctcgttgccactaagcagcac

SEQ ID NO: 24012 - DNA, 25 bp, Mus musculus
agattttatcaacacaaatttcctg

SEQ ID NO: 24013 - DNA, 25 bp, Mus musculus
ttttatcaacacaaatttcctgagg

SEQ ID NO: 24014 - DNA, 25 bp, Mus musculus
caacacaaatttcctgaggtggaag

SEQ ID NO: 24015 - DNA, 25 bp, Mus musculus
cacaaatttcctgaggtggaagatg

SEQ ID NO: 24016 - DNA, 25 bp, Mus musculus
aaatttcctgaggtggaagatgtag

SEQ ID NO: 24017 - DNA, 25 bp, Mus musculus
ggggcctatgtcagcttgttggaat

SEQ ID NO: 24018 - DNA, 25 bp, Mus musculus
gcctatgtcagcttgttggaatata

SEQ ID NO: 24019 - DNA, 25 bp, Mus musculus
gaattatccagacgacgtatccgtt

SEQ ID NO: 24020 - DNA, 25 bp, Mus musculus
ttatccagacgacgtatccgttcta

SEQ ID NO: 24021 - DNA, 25 bp, Mus musculus
tccagacgacgtatccgttctataa

SEQ ID NO: 24022 - DNA, 25 bp, Mus musculus
cctcgttgccactaagcagcacggc

SEQ ID NO: 24023 - DNA, 25 bp, Mus musculus
ctacttcgggattcacacatccact

SEQ ID NO: 24024 - DNA, 25 bp, Mus musculus
cttcgggattcacacatccacttca

SEQ ID NO: 24025 - DNA, 25 bp, Mus musculus
gattcacacatccacttcagaatgc

SEQ ID NO: 24026 - DNA, 25 bp, Mus musculus
tcacacatccacttcagaatgccgg

SEQ ID NO: 24027 - DNA, 25 bp, Mus musculus
cacttcagaatgccggggctaagtt

SEQ ID NO: 24028 - DNA, 25 bp, Mus musculus
ttcagaatgccggggctaagttgta

SEQ ID NO: 24029 - DNA, 25 bp, Mus musculus
agaatgccggggctaagttgtagat

SEQ ID NO: 24030 - DNA, 25 bp, Mus musculus
acgggctgcactcggcagagcagga

SEQ ID NO: 24031 - DNA, 25 bp, Mus musculus
atgatgaggcggctgacgatacaga

SEQ ID NO: 24032 - DNA, 25 bp, Mus musculus
gctccaacgaccttttccctgtgca

SEQ ID NO: 24033 - DNA, 25 bp, Mus musculus
ttttccctgtgcaccacctggacaa

SEQ ID NO: 24034 - DNA, 25 bp, Mus musculus
accacctggacaacaatgagttctg

SEQ ID NO: 24035 - DNA, 25 bp, Mus musculus
acaatgagttctgccctggggactt

SEQ ID NO: 24036 - DNA, 25 bp, Mus musculus
agcgagtccagagctgcccagaccc

SEQ ID NO: 24037 - DNA, 25 bp, Mus musculus
gctgcccagaccctgctgtctatgg

SEQ ID NO: 24038 - DNA, 25 bp, Mus musculus
cagaccctgctgtctatggtgtggt

SEQ ID NO: 24039 - DNA, 25 bp, Mus musculus
atcatgttggccgtacctgcatggt

SEQ ID NO: 24040 - DNA, 25 bp, Mus musculus
gtacctgcatggtgaagtggttcaa

SEQ ID NO: 24041 - DNA, 25 bp, Mus musculus
ggttcaagctgcgaccaagtgggga

SEQ ID NO: 24042 - DNA, 25 bp, Mus musculus
atacagatgacaccagctctgtgac

SEQ ID NO: 24043 - DNA, 25 bp, Mus musculus
atgacaccagctctgtgacctcctc

SEQ ID NO: 24044 - DNA, 25 bp, Mus musculus
cctcccagagtggcagtggcactgg

SEQ ID NO: 24045 - DNA, 25 bp, Mus musculus
ccttgtccatcaaaaacttgaagcg

SEQ ID NO: 24046 - DNA, 25 bp, Mus musculus
aggtcacccgtgacttcaagcctgg

SEQ ID NO: 24047 - DNA, 25 bp, Mus musculus
acttcaagcctggagacagggtggc

SEQ ID NO: 24048 - DNA, 25 bp, Mus musculus
tgaccacgatgacctcagctgatgt

SEQ ID NO: 24049 - DNA, 25 bp, Mus musculus
cgatgacctcagctgatgtgatgtg

SEQ ID NO: 24050 - DNA, 25 bp, Mus musculus
tggtggcgcccgagtcagtgacagt

SEQ ID NO: 24051 - DNA, 25 bp, Mus musculus
cgcccgagtcagtgacagtcgagga

SEQ ID NO: 24052 - DNA, 25 bp, Mus musculus
acggactcctgacattataatcccg

SEQ ID NO: 24053 - DNA, 25 bp, Mus musculus
gactcctgacattataatcccgggg

SEQ ID NO: 24054 - DNA, 25 bp, Mus musculus
gaccctggaggctggctatcctagc

SEQ ID NO: 24055 - DNA, 25 bp, Mus musculus
ctatcctagcaatctcacctgctct

SEQ ID NO: 24056 - DNA, 25 bp, Mus musculus
tcctagcaatctcacctgctctgtg

SEQ ID NO: 24057 - DNA, 25 bp, Mus musculus
tagcaatctcacctgctctgtgccc

SEQ ID NO: 24058 - DNA, 25 bp, Mus musculus
caatctcacctgctctgtgccctgg

SEQ ID NO: 24059 - DNA, 25 bp, Mus musculus
cacctgctctgtgccctgggcttgt

SEQ ID NO: 24060 - DNA, 25 bp, Mus musculus
ccctactttctcctggatgtcaact

SEQ ID NO: 24061 - DNA, 25 bp, Mus musculus
tactttctcctggatgtcaactgcc

SEQ ID NO: 24062 - DNA, 25 bp, Mus musculus
agggcctatgtgtccatgtgccctg

SEQ ID NO: 24063 - DNA, 25 bp, Mus musculus
aaccacagactcctccgtgctgacg

SEQ ID NO: 24064 - DNA, 25 bp, Mus musculus
gtgtccatgtgccctgcagtgtttt

SEQ ID NO: 24065 - DNA, 25 bp, Mus musculus
tccatgtgccctgcagtgttttcta

SEQ ID NO: 24066 - DNA, 25 bp, Mus musculus
ccattaagctcactttaggacctgt

SEQ ID NO: 24067 - DNA, 25 bp, Mus musculus
tcactttaggacctgtgaccggctc

SEQ ID NO: 24068 - DNA, 25 bp, Mus musculus
ctttaggacctgtgaccggctcctg

SEQ ID NO: 24069 - DNA, 25 bp, Mus musculus
aagggctctatcacggactcctgac

SEQ ID NO: 24070 - DNA, 25 bp, Mus musculus
atcacggactcctgacattataatc

SEQ ID NO: 24071 - DNA, 25 bp, Mus musculus
aggagccccagtcatgaagaggttt

SEQ ID NO: 24072 - DNA, 25 bp, Mus musculus
agccccagtcatgaagaggtttctc

SEQ ID NO: 24073 - DNA, 25 bp, Mus musculus
gacaaccagctggggccactgcttc

SEQ ID NO: 24074 - DNA, 25 bp, Mus musculus
aaccagctggggccactgcttcctg

SEQ ID NO: 24075 - DNA, 25 bp, Mus musculus
ccactgcttcctgaacccaaacaga

SEQ ID NO: 24076 - DNA, 25 bp, Mus musculus
ctgcttcctgaacccaaacagaagc

SEQ ID NO: 24077 - DNA, 25 bp, Mus musculus
gaacccaaacagaagcctgcagctg

SEQ ID NO: 24078 - DNA, 25 bp, Mus musculus
cccaaacagaagcctgcagctgccg

SEQ ID NO: 24079 - DNA, 25 bp, Mus musculus
cagaagcctgcagctgccgaggaaa

SEQ ID NO: 24080 - DNA, 25 bp, Mus musculus
cctgcagctgccgaggaaaagcgtc

SEQ ID NO: 24081 - DNA, 25 bp, Mus musculus
aagcgtccagatgccatgacctggg

SEQ ID NO: 24082 - DNA, 25 bp, Mus musculus
cgtccagatgccatgacctgggtgg

SEQ ID NO: 24083 - DNA, 25 bp, Mus musculus
cctggccacctgtttggtggctgca

SEQ ID NO: 24084 - DNA, 25 bp, Mus musculus
cacctgtttggtggctgcactgctg

SEQ ID NO: 24085 - DNA, 25 bp, Mus musculus
agtccagcacaccaggtccctgtca

SEQ ID NO: 24086 - DNA, 25 bp, Mus musculus
ccagcacaccaggtccctgtcaaga

SEQ ID NO: 24087 - DNA, 25 bp, Mus musculus
caggtccctgtcaagaccaaaggca

SEQ ID NO: 24088 - DNA, 25 bp, Mus musculus
ggcaaacatgtgttccctgaacagg

SEQ ID NO: 24089 - DNA, 25 bp, Mus musculus
ttccctgaacaggaaacagagaagg

SEQ ID NO: 24090 - DNA, 25 bp, Mus musculus
gatactagagccctggagcctcttg

SEQ ID NO: 24091 - DNA, 25 bp, Mus musculus
gcgctccagctacggacttcgtgct

SEQ ID NO: 24092 - DNA, 25 bp, Mus musculus
cgctccagctacggacttcgtgctt

SEQ ID NO: 24093 - DNA, 25 bp, Mus musculus
ccatcagcgcttcatccgacaggtg

SEQ ID NO: 24094 - DNA, 25 bp, Mus musculus
tcagcgcttcatccgacaggtgcgg

SEQ ID NO: 24095 - DNA, 25 bp, Mus musculus
cagcgcttcatccgacaggtgcggc

SEQ ID NO: 24096 - DNA, 25 bp, Mus musculus
gcgcttcatccgacaggtgcggcgt

SEQ ID NO: 24097 - DNA, 25 bp, Mus musculus
cgcttcatccgacaggtgcggcgtg

SEQ ID NO: 24098 - DNA, 25 bp, Mus musculus
ttcatccgacaggtgcggcgtgttc

SEQ ID NO: 24099 - DNA, 25 bp, Mus musculus
acaggtgcggcgtgttctcgctcaa

SEQ ID NO: 24100 - DNA, 25 bp, Mus musculus
tgttctcgctcaactcgcgcttgac

SEQ ID NO: 24101 - DNA, 25 bp, Mus musculus
cgctcaactcgcgcttgacctgagg

SEQ ID NO: 24102 - DNA, 25 bp, Mus musculus
tcaactcgcgcttgacctgagggcc

SEQ ID NO: 24103 - DNA, 25 bp, Mus musculus
tccagctacggacttcgtgcttctg

SEQ ID NO: 24104 - DNA, 25 bp, Mus musculus
caactcgcgcttgacctgagggcca

SEQ ID NO: 24105 - DNA, 25 bp, Mus musculus
cagctacggacttcgtgcttctgca

SEQ ID NO: 24106 - DNA, 25 bp, Mus musculus
cggacttcgtgcttctgcagctcct

SEQ ID NO: 24107 - DNA, 25 bp, Mus musculus
ggacttcgtgcttctgcagctcctc

SEQ ID NO: 24108 - DNA, 25 bp, Mus musculus
cttcgtgcttctgcagctcctccgt

SEQ ID NO: 24109 - DNA, 25 bp, Mus musculus
tcgtgcttctgcagctcctccgttc

SEQ ID NO: 24110 - DNA, 25 bp, Mus musculus
tgcttctgcagctcctccgttctgg

SEQ ID NO: 24111 - DNA, 25 bp, Mus musculus
ccgacagcccgcgcaggttgcggtt

SEQ ID NO: 24112 - DNA, 25 bp, Mus musculus
tcaggcaacattggcgaaggaccca

SEQ ID NO: 24113 - DNA, 25 bp, Mus musculus
cgaaggacccagaaaccgcagagct

SEQ ID NO: 24114 - DNA, 25 bp, Mus musculus
gtacattacatgaaacaccttataa

SEQ ID NO: 24115 - DNA, 25 bp, Mus musculus
ttcattctatgttccttcaggtaat

SEQ ID NO: 24116 - DNA, 25 bp, Mus musculus
cattctatgttccttcaggtaatca

SEQ ID NO: 24117 - DNA, 25 bp, Mus musculus
atgttccttcaggtaatcattacaa

SEQ ID NO: 24118 - DNA, 25 bp, Mus musculus
tacaacattaaaaacctcttgaatg

SEQ ID NO: 24119 - DNA, 25 bp, Mus musculus
tcgtactccttgttaaacatttcat

SEQ ID NO: 24120 - DNA, 25 bp, Mus musculus
ttaaacatttcataatcttgtatgt

SEQ ID NO: 24121 - DNA, 25 bp, Mus musculus
acatttcataatcttgtatgtatct

SEQ ID NO: 24122 - DNA, 25 bp, Mus musculus
gatttttccttgagtgtaaatactg

SEQ ID NO: 24123 - DNA, 25 bp, Mus musculus
tttttccttgagtgtaaatactgtg

SEQ ID NO: 24124 - DNA, 25 bp, Mus musculus
ggacccagaaaccgcagagcttgtc

SEQ ID NO: 24125 - DNA, 25 bp, Mus musculus
aaaccgcagagcttgtccccatgga

SEQ ID NO: 24126 - DNA, 25 bp, Mus musculus
cgcagagcttgtccccatggatctt

SEQ ID NO: 24127 - DNA, 25 bp, Mus musculus
cagagcttgtccccatggatcttat

SEQ ID NO: 24128 - DNA, 25 bp, Mus musculus
gcttgtccccatggatcttataaga

SEQ ID NO: 24129 - DNA, 25 bp, Mus musculus
ttgtccccatggatcttataagacc

SEQ ID NO: 24130 - DNA, 25 bp, Mus musculus
atcttataagaccacgagatacata

SEQ ID NO: 24131 - DNA, 25 bp, Mus musculus
tataagaccacgagatacataccgc

SEQ ID NO: 24132 - DNA, 25 bp, Mus musculus
ccactgctgcccttcagaatgggtt

SEQ ID NO: 24133 - DNA, 25 bp, Mus musculus
ggttctacgcagctccttacagtat

SEQ ID NO: 24134 - DNA, 25 bp, Mus musculus
ctcagttctgacaccagggatggac

SEQ ID NO: 24135 - DNA, 25 bp, Mus musculus
agttctgacaccagggatggaccac

SEQ ID NO: 24136 - DNA, 25 bp, Mus musculus
ccagcctgcctccatgatgggacct

SEQ ID NO: 24137 - DNA, 25 bp, Mus musculus
ctccatgatgggacctcttacccag

SEQ ID NO: 24138 - DNA, 25 bp, Mus musculus
tcttacccagcaactgggtcacctg

SEQ ID NO: 24139 - DNA, 25 bp, Mus musculus
gcaactgggtcacctgtcactcaac

SEQ ID NO: 24140 - DNA, 25 bp, Mus musculus
gggtcacctgtcactcaacagtctg

SEQ ID NO: 24141 - DNA, 25 bp, Mus musculus
cctgtcactcaacagtctgggcacg

SEQ ID NO: 24142 - DNA, 25 bp, Mus musculus
gtcactcaacagtctgggcacgttc

SEQ ID NO: 24143 - DNA, 25 bp, Mus musculus
actcaacagtctgggcacgttcatg

SEQ ID NO: 24144 - DNA, 25 bp, Mus musculus
tctacgcagctccttacagtatcgc

SEQ ID NO: 24145 - DNA, 25 bp, Mus musculus
cagtctgggcacgttcatgccggca

SEQ ID NO: 24146 - DNA, 25 bp, Mus musculus
cttacagtatcgcccacagcaggat

SEQ ID NO: 24147 - DNA, 25 bp, Mus musculus
acagtatcgcccacagcaggatgct

SEQ ID NO: 24148 - DNA, 25 bp, Mus musculus
tgcttgctcaatctgcgctaccccg

SEQ ID NO: 24149 - DNA, 25 bp, Mus musculus
aatctgcgctaccccgtatcttcca

SEQ ID NO: 24150 - DNA, 25 bp, Mus musculus
tcctgtgtcttcctatcagggctca

SEQ ID NO: 24151 - DNA, 25 bp, Mus musculus
tgtgtcttcctatcagggctcagtt

SEQ ID NO: 24152 - DNA, 25 bp, Mus musculus
ttcctatcagggctcagttctgaca

SEQ ID NO: 24153 - DNA, 25 bp, Mus musculus
cctcaacacatagaaattcagtgtg

SEQ ID NO: 24154 - DNA, 25 bp, Mus musculus
caggtacaccaggggccaacagcca

SEQ ID NO: 24155 - DNA, 25 bp, Mus musculus
gtacacactgtggcactcctgtgaa

SEQ ID NO: 24156 - DNA, 25 bp, Mus musculus
actgtggcactcctgtgaaggtcag

SEQ ID NO: 24157 - DNA, 25 bp, Mus musculus
gcactcctgtgaaggtcagaggaca

SEQ ID NO: 24158 - DNA, 25 bp, Mus musculus
ttttgttctctccatctgttagccg

SEQ ID NO: 24159 - DNA, 25 bp, Mus musculus
catctgttagccgttctgaggactg

SEQ ID NO: 24160 - DNA, 25 bp, Mus musculus
ttagccgttctgaggactgaatgca

SEQ ID NO: 24161 - DNA, 25 bp, Mus musculus
agcaaattatctcccctgagtggtc

SEQ ID NO: 24162 - DNA, 25 bp, Mus musculus
ttatctcccctgagtggtctcaaca

SEQ ID NO: 24163 - DNA, 25 bp, Mus musculus
agtggtctcaacagccctatgtcta

SEQ ID NO: 24164 - DNA, 25 bp, Mus musculus
ctcaacagccctatgtctatacgta

SEQ ID NO: 24165 - DNA, 25 bp, Mus musculus
aacaccttgccagcttacatagtat

SEQ ID NO: 24166 - DNA, 25 bp, Mus musculus
ctcagacaagctcagtcatttgtct

SEQ ID NO: 24167 - DNA, 25 bp, Mus musculus
caagctcagtcatttgtctgcctgg

SEQ ID NO: 24168 - DNA, 25 bp, Mus musculus
cagtcatttgtctgcctggcctcca

SEQ ID NO: 24169 - DNA, 25 bp, Mus musculus
gcctccaaaggctataatggcatac

SEQ ID NO: 24170 - DNA, 25 bp, Mus musculus
ggcatacagcagtcccagggcatta

SEQ ID NO: 24171 - DNA, 25 bp, Mus musculus
cagcagtcccagggcattaaaagaa

SEQ ID NO: 24172 - DNA, 25 bp, Mus musculus
ttgtatgtacacactgtggcactcc

SEQ ID NO: 24173 - DNA, 25 bp, Mus musculus
tccaatctgtgctttctggcagccg

SEQ ID NO: 24174 - DNA, 25 bp, Mus musculus
aatctgtgctttctggcagccgggc

SEQ ID NO: 24175 - DNA, 25 bp, Mus musculus
catcggtggctctggctctgaggcc

SEQ ID NO: 24176 - DNA, 25 bp, Mus musculus
ccagctctccaactcttcgtgtgct

SEQ ID NO: 24177 - DNA, 25 bp, Mus musculus
ctccaactcttcgtgtgctggcctg

SEQ ID NO: 24178 - DNA, 25 bp, Mus musculus
caactcttcgtgtgctggcctgcac

SEQ ID NO: 24179 - DNA, 25 bp, Mus musculus
cctgcacctgtcatctgctggggtt

SEQ ID NO: 24180 - DNA, 25 bp, Mus musculus
gcacctgtcatctgctggggttacg

SEQ ID NO: 24181 - DNA, 25 bp, Mus musculus
gtcatctgctggggttacggctgct

SEQ ID NO: 24182 - DNA, 25 bp, Mus musculus
atctgctggggttacggctgctgtg

SEQ ID NO: 24183 - DNA, 25 bp, Mus musculus
gctcctcaggggtcaggccagcaaa

SEQ ID NO: 24184 - DNA, 25 bp, Mus musculus
cctcaggggtcaggccagcaaagaa

SEQ ID NO: 24185 - DNA, 25 bp, Mus musculus
tgctttctggcagccgggcaccaca

SEQ ID NO: 24186 - DNA, 25 bp, Mus musculus
tcctgccttccttcacattgcactg

SEQ ID NO: 24187 - DNA, 25 bp, Mus musculus
cttccttcacattgcactgttcatc

SEQ ID NO: 24188 - DNA, 25 bp, Mus musculus
ccttcacattgcactgttcatcggt

SEQ ID NO: 24189 - DNA, 25 bp, Mus musculus
tcacattgcactgttcatcggtggc

SEQ ID NO: 24190 - DNA, 25 bp, Mus musculus
cattgcactgttcatcggtggctct

SEQ ID NO: 24191 - DNA, 25 bp, Mus musculus
actgttcatcggtggctctggctct

SEQ ID NO: 24192 - DNA, 25 bp, Mus musculus
gttcatcggtggctctggctctgag

SEQ ID NO: 24193 - DNA, 25 bp, Mus musculus
ctgctgcctccagcaaggagctcct

SEQ ID NO: 24194 - DNA, 25 bp, Mus musculus
ctgcctccagcaaggagctccttat

SEQ ID NO: 24195 - DNA, 25 bp, Mus musculus
tcaactgcaagaaggctctggagac

SEQ ID NO: 24196 - DNA, 25 bp, Mus musculus
actgcaagaaggctctggagacttg

SEQ ID NO: 24197 - DNA, 25 bp, Mus musculus
agacttgtggcggtgacctcaagca

SEQ ID NO: 24198 - DNA, 25 bp, Mus musculus
cttgtggcggtgacctcaagcaggc

SEQ ID NO: 24199 - DNA, 25 bp, Mus musculus
gtgacctcaagcaggcagaggactg

SEQ ID NO: 24200 - DNA, 25 bp, Mus musculus
acctcaagcaggcagaggactggct

SEQ ID NO: 24201 - DNA, 25 bp, Mus musculus
aggactggctgcacaaacaggccca

SEQ ID NO: 24202 - DNA, 25 bp, Mus musculus
actggctgcacaaacaggcccagaa

SEQ ID NO: 24203 - DNA, 25 bp, Mus musculus
tgcacaaacaggcccagaaggaagg

SEQ ID NO: 24204 - DNA, 25 bp, Mus musculus
gcaaagccgccaagctccacgggag

SEQ ID NO: 24205 - DNA, 25 bp, Mus musculus
cctccagcaaggagctccttatgaa

SEQ ID NO: 24206 - DNA, 25 bp, Mus musculus
ccagcaaggagctccttatgaaact

SEQ ID NO: 24207 - DNA, 25 bp, Mus musculus
aggagctccttatgaaactgcggcg

SEQ ID NO: 24208 - DNA, 25 bp, Mus musculus
agctccttatgaaactgcggcggaa

SEQ ID NO: 24209 - DNA, 25 bp, Mus musculus
ccggctactcctttgtcaactgcaa

SEQ ID NO: 24210 - DNA, 25 bp, Mus musculus
gctactcctttgtcaactgcaagaa

SEQ ID NO: 24211 - DNA, 25 bp, Mus musculus
actcctttgtcaactgcaagaaggc

SEQ ID NO: 24212 - DNA, 25 bp, Mus musculus
cctttgtcaactgcaagaaggctct

SEQ ID NO: 24213 - DNA, 25 bp, Mus musculus
tacagagacacacagacttccatta

SEQ ID NO: 24214 - DNA, 25 bp, Mus musculus
cagacttccattaccgatagttctg

SEQ ID NO: 24215 - DNA, 25 bp, Mus musculus
atccagcagcagcttgagaaggagc

SEQ ID NO: 24216 - DNA, 25 bp, Mus musculus
aaggagctcaacaccttacgagtca

SEQ ID NO: 24217 - DNA, 25 bp, Mus musculus
agcaccgcacctgctcagttgggga

SEQ ID NO: 24218 - DNA, 25 bp, Mus musculus
tcccagttgccactcaaagtggagt

SEQ ID NO: 24219 - DNA, 25 bp, Mus musculus
ttgccactcaaagtggagttcctgg

SEQ ID NO: 24220 - DNA, 25 bp, Mus musculus
ttcctggagtgtagtgccaagggtg

SEQ ID NO: 24221 - DNA, 25 bp, Mus musculus
actggctctgctgacatccaggact

SEQ ID NO: 24222 - DNA, 25 bp, Mus musculus
tctgctgacatccaggacttggaga

SEQ ID NO: 24223 - DNA, 25 bp, Mus musculus
gacatccaggacttggagaagtggc

SEQ ID NO: 24224 - DNA, 25 bp, Mus musculus
ctggccaagattgcctgaggagcat

SEQ ID NO: 24225 - DNA, 25 bp, Mus musculus
tccattaccgatagttctgccatat

SEQ ID NO: 24226 - DNA, 25 bp, Mus musculus
accgatagttctgccatatacaaag

SEQ ID NO: 24227 - DNA, 25 bp, Mus musculus
agttctgccatatacaaagtcaaca

SEQ ID NO: 24228 - DNA, 25 bp, Mus musculus
aggtttcagctcttagatcgcttta

SEQ ID NO: 24229 - DNA, 25 bp, Mus musculus
cagctcttagatcgctttaagtctt

SEQ ID NO: 24230 - DNA, 25 bp, Mus musculus
ctgtaccaggtcctcatcgacagca

SEQ ID NO: 24231 - DNA, 25 bp, Mus musculus
ctcatcgacagcatggctctgaaga

SEQ ID NO: 24232 - DNA, 25 bp, Mus musculus
atagcctgcaataagcaagatatcg

SEQ ID NO: 24233 - DNA, 25 bp, Mus musculus
actgcccgggcagtgggcagattag

SEQ ID NO: 24234 - DNA, 25 bp, Mus musculus
aggccgtttgtgacgcggcctgcat

SEQ ID NO: 24235 - DNA, 25 bp, Mus musculus
cggcctgcattcacagcagatggcc

SEQ ID NO: 24236 - DNA, 25 bp, Mus musculus
ctgcattcacagcagatggccgagt

SEQ ID NO: 24237 - DNA, 25 bp, Mus musculus
gcattcacagcagatggccgagtca

SEQ ID NO: 24238 - DNA, 25 bp, Mus musculus
cattcacagcagatggccgagtcaa

SEQ ID NO: 24239 - DNA, 25 bp, Mus musculus
attcacagcagatggccgagtcaac

SEQ ID NO: 24240 - DNA, 25 bp, Mus musculus
ttcacagcagatggccgagtcaacg

SEQ ID NO: 24241 - DNA, 25 bp, Mus musculus
tcacagcagatggccgagtcaacgt

SEQ ID NO: 24242 - DNA, 25 bp, Mus musculus
cacagcagatggccgagtcaacgtg

SEQ ID NO: 24243 - DNA, 25 bp, Mus musculus
acagcagatggccgagtcaacgtgg

SEQ ID NO: 24244 - DNA, 25 bp, Mus musculus
gtttgtgacgcggcctgcattcaca

SEQ ID NO: 24245 - DNA, 25 bp, Mus musculus
tttgtgacgcggcctgcattcacag

SEQ ID NO: 24246 - DNA, 25 bp, Mus musculus
ttgtgacgcggcctgcattcacagc

SEQ ID NO: 24247 - DNA, 25 bp, Mus musculus
tgtgacgcggcctgcattcacagca

SEQ ID NO: 24248 - DNA, 25 bp, Mus musculus
tgacgcggcctgcattcacagcaga

SEQ ID NO: 24249 - DNA, 25 bp, Mus musculus
gacgcggcctgcattcacagcagat

SEQ ID NO: 24250 - DNA, 25 bp, Mus musculus
acgcggcctgcattcacagcagatg

SEQ ID NO: 24251 - DNA, 25 bp, Mus musculus
cgcggcctgcattcacagcagatgg

SEQ ID NO: 24252 - DNA, 25 bp, Mus musculus
ggacttcaccagacaggggtatgca

SEQ ID NO: 24253 - DNA, 25 bp, Mus musculus
acttcaccagacaggggtatgcaga

SEQ ID NO: 24254 - DNA, 25 bp, Mus musculus
gtgcagcgcaatggtgctcgtatcg

SEQ ID NO: 24255 - DNA, 25 bp, Mus musculus
gcagcgcaatggtgctcgtatcgcc

SEQ ID NO: 24256 - DNA, 25 bp, Mus musculus
atggtgctcgtatcgcctcagagtg

SEQ ID NO: 24257 - DNA, 25 bp, Mus musculus
ggtgctcgtatcgcctcagagtgag

SEQ ID NO: 24258 - DNA, 25 bp, Mus musculus
tgctcgtatcgcctcagagtgagcc

SEQ ID NO: 24259 - DNA, 25 bp, Mus musculus
ctcgtatcgcctcagagtgagccca

SEQ ID NO: 24260 - DNA, 25 bp, Mus musculus
tatcgcctcagagtgagcccattgc

SEQ ID NO: 24261 - DNA, 25 bp, Mus musculus
gcctcagagtgagcccattgcccga

SEQ ID NO: 24262 - DNA, 25 bp, Mus musculus
gagtgagcccattgcccgatcaagc

SEQ ID NO: 24263 - DNA, 25 bp, Mus musculus
gcccattgcccgatcaagcctgcaa

SEQ ID NO: 24264 - DNA, 25 bp, Mus musculus
ttcaccagacaggggtatgcagagc

SEQ ID NO: 24265 - DNA, 25 bp, Mus musculus
ccattgcccgatcaagcctgcaagc

SEQ ID NO: 24266 - DNA, 25 bp, Mus musculus
gcagctcatgctacgcatggggtga

SEQ ID NO: 24267 - DNA, 25 bp, Mus musculus
ggtgagatccaacaccggtagtgca

SEQ ID NO: 24268 - DNA, 25 bp, Mus musculus
tgagatccaacaccggtagtgcagc

SEQ ID NO: 24269 - DNA, 25 bp, Mus musculus
agatccaacaccggtagtgcagcgc

SEQ ID NO: 24270 - DNA, 25 bp, Mus musculus
aacaccggtagtgcagcgcaatggt

SEQ ID NO: 24271 - DNA, 25 bp, Mus musculus
caccggtagtgcagcgcaatggtgc

SEQ ID NO: 24272 - DNA, 25 bp, Mus musculus
ccggtagtgcagcgcaatggtgctc

SEQ ID NO: 24273 - DNA, 25 bp, Mus musculus
taacacactgaaactgtatctactt

SEQ ID NO: 24274 - DNA, 25 bp, Mus musculus
actgaaactgtatctacttgctgtg

SEQ ID NO: 24275 - DNA, 25 bp, Mus musculus
tggccgttttactgacagtaactgc

SEQ ID NO: 24276 - DNA, 25 bp, Mus musculus
ttttactgacagtaactgccatttc

SEQ ID NO: 24277 - DNA, 25 bp, Mus musculus
atagtcataccttctgatgaggtgg

SEQ ID NO: 24278 - DNA, 25 bp, Mus musculus
ataccttctgatgaggtggagccaa

SEQ ID NO: 24279 - DNA, 25 bp, Mus musculus
gagccaacaccagcaaagtatgatg

SEQ ID NO: 24280 - DNA, 25 bp, Mus musculus
gtagcctctgactagtcctgaaaca

SEQ ID NO: 24281 - DNA, 25 bp, Mus musculus
tctgactagtcctgaaacagaaggc

SEQ ID NO: 24282 - DNA, 25 bp, Mus musculus
ctgcactctaggctgaaccatgcta

SEQ ID NO: 24283 - DNA, 25 bp, Mus musculus
tctaggctgaaccatgctaaaagcc

SEQ ID NO: 24284 - DNA, 25 bp, Mus musculus
catgctaaaagcccatgcttaaata

SEQ ID NO: 24285 - DNA, 25 bp, Mus musculus
atattttgctgctggactttgacct

SEQ ID NO: 24286 - DNA, 25 bp, Mus musculus
tggactttgacctacttgtattatg

SEQ ID NO: 24287 - DNA, 25 bp, Mus musculus
tgcagatacctattcaagatgataa

SEQ ID NO: 24288 - DNA, 25 bp, Mus musculus
ctgctgtctccttaatatgctcctt

SEQ ID NO: 24289 - DNA, 25 bp, Mus musculus
tctccttaatatgctccttaacacg

SEQ ID NO: 24290 - DNA, 25 bp, Mus musculus
gctccttaacacgtatgttgatgta

SEQ ID NO: 24291 - DNA, 25 bp, Mus musculus
taatgtgttctgtggccgttttact

SEQ ID NO: 24292 - DNA, 25 bp, Mus musculus
gttctgtggccgttttactgacagt

SEQ ID NO: 24293 - DNA, 25 bp, Mus musculus
atgttaaattcccagaagaagatga

SEQ ID NO: 24294 - DNA, 25 bp, Mus musculus
tgttaaattcccagaagaagatgag

SEQ ID NO: 24295 - DNA, 25 bp, Mus musculus
cattcagtagccacactgcttgggc

SEQ ID NO: 24296 - DNA, 25 bp, Mus musculus
attcagtagccacactgcttgggca

SEQ ID NO: 24297 - DNA, 25 bp, Mus musculus
ttcagtagccacactgcttgggcag

SEQ ID NO: 24298 - DNA, 25 bp, Mus musculus
tcagtagccacactgcttgggcagg

SEQ ID NO: 24299 - DNA, 25 bp, Mus musculus
agccacactgcttgggcaggctcca

SEQ ID NO: 24300 - DNA, 25 bp, Mus musculus
tgcttgggcaggctccagtagagac

SEQ ID NO: 24301 - DNA, 25 bp, Mus musculus
cttgggcaggctccagtagagacta

SEQ ID NO: 24302 - DNA, 25 bp, Mus musculus
ttgggcaggctccagtagagactac

SEQ ID NO: 24303 - DNA, 25 bp, Mus musculus
tgggcaggctccagtagagactaca

SEQ ID NO: 24304 - DNA, 25 bp, Mus musculus
ttaaattcccagaagaagatgagat

SEQ ID NO: 24305 - DNA, 25 bp, Mus musculus
taaattcccagaagaagatgagata

SEQ ID NO: 24306 - DNA, 25 bp, Mus musculus
ggcatttcattcagtagccacactg

SEQ ID NO: 24307 - DNA, 25 bp, Mus musculus
gcatttcattcagtagccacactgc

SEQ ID NO: 24308 - DNA, 25 bp, Mus musculus
catttcattcagtagccacactgct

SEQ ID NO: 24309 - DNA, 25 bp, Mus musculus
atttcattcagtagccacactgctt

SEQ ID NO: 24310 - DNA, 25 bp, Mus musculus
tttcattcagtagccacactgcttg

SEQ ID NO: 24311 - DNA, 25 bp, Mus musculus
ttcattcagtagccacactgcttgg

SEQ ID NO: 24312 - DNA, 25 bp, Mus musculus
tgtcaggcgacacttccatgtccag

SEQ ID NO: 24313 - DNA, 25 bp, Mus musculus
gcgacacttccatgtccaggttttc

SEQ ID NO: 24314 - DNA, 25 bp, Mus musculus
tcgtagctgagtgcacgctaaagga

SEQ ID NO: 24315 - DNA, 25 bp, Mus musculus
cagctatcaaccagatcctgggcag

SEQ ID NO: 24316 - DNA, 25 bp, Mus musculus
agatcctgggcagaagatggcacgc

SEQ ID NO: 24317 - DNA, 25 bp, Mus musculus
agagacagctacacatgcagcttta

SEQ ID NO: 24318 - DNA, 25 bp, Mus musculus
agctttatccaggctggtcagcgcg

SEQ ID NO: 24319 - DNA, 25 bp, Mus musculus
atccaggctggtcagcgcgagacaa

SEQ ID NO: 24320 - DNA, 25 bp, Mus musculus
agtcgacttcaggtacaggtcccag

SEQ ID NO: 24321 - DNA, 25 bp, Mus musculus
cttcaggtacaggtcccagaatgac

SEQ ID NO: 24322 - DNA, 25 bp, Mus musculus
cagctgcctacatctgaaacatggt

SEQ ID NO: 24323 - DNA, 25 bp, Mus musculus
cctacatctgaaacatggtggtaag

SEQ ID NO: 24324 - DNA, 25 bp, Mus musculus
cttccatgtccaggttttcccatca

SEQ ID NO: 24325 - DNA, 25 bp, Mus musculus
ggccctcttctggagatggaagctt

SEQ ID NO: 24326 - DNA, 25 bp, Mus musculus
ggttttcccatcatatgattcctgg

SEQ ID NO: 24327 - DNA, 25 bp, Mus musculus
caactggcatccctcatccagctat

SEQ ID NO: 24328 - DNA, 25 bp, Mus musculus
cagctattgtaacacctcaggtcaa

SEQ ID NO: 24329 - DNA, 25 bp, Mus musculus
ttgtaacacctcaggtcaaacagga

SEQ ID NO: 24330 - DNA, 25 bp, Mus musculus
cccacacggacagtgacctaatgca

SEQ ID NO: 24331 - DNA, 25 bp, Mus musculus
agcctcaacacgaacagagaaagga

SEQ ID NO: 24332 - DNA, 25 bp, Mus musculus
ctcatattaagaagcctctgaatgc

SEQ ID NO: 24333 - DNA, 25 bp, Mus musculus
tccatatgtggcatcgagaacagag

SEQ ID NO: 24334 - DNA, 25 bp, Mus musculus
catgatctcagaagtcttggaagtc

SEQ ID NO: 24335 - DNA, 25 bp, Mus musculus
gcagatccattggtttctcagtcca

SEQ ID NO: 24336 - DNA, 25 bp, Mus musculus
caagaacgagctccaccaaagagca

SEQ ID NO: 24337 - DNA, 25 bp, Mus musculus
cgagctccaccaaagagcaggaacc

SEQ ID NO: 24338 - DNA, 25 bp, Mus musculus
gcctttttactgttgggcagtctct

SEQ ID NO: 24339 - DNA, 25 bp, Mus musculus
ttaaacctcatgatactgagttggt

SEQ ID NO: 24340 - DNA, 25 bp, Mus musculus
tccctatttcacaagggttcaggat

SEQ ID NO: 24341 - DNA, 25 bp, Mus musculus
tttcacaagggttcaggatagatta

SEQ ID NO: 24342 - DNA, 25 bp, Mus musculus
atggttcctgtcacaagcccaggtc

SEQ ID NO: 24343 - DNA, 25 bp, Mus musculus
acaagcccaggtcacaaacagatta

SEQ ID NO: 24344 - DNA, 25 bp, Mus musculus
tctactgcctaaagaattttggctc

SEQ ID NO: 24345 - DNA, 25 bp, Mus musculus
tggtcacaagccatgcaccttatca

SEQ ID NO: 24346 - DNA, 25 bp, Mus musculus
caagccatgcaccttatcattgata

SEQ ID NO: 24347 - DNA, 25 bp, Mus musculus
atgcaccttatcattgataccctca

SEQ ID NO: 24348 - DNA, 25 bp, Mus musculus
cttatcattgataccctcacttggt

SEQ ID NO: 24349 - DNA, 25 bp, Mus musculus
accctcacttggtctttagatctgt

SEQ ID NO: 24350 - DNA, 25 bp, Mus musculus
acttggtctttagatctgtgtgcct

SEQ ID NO: 24351 - DNA, 25 bp, Mus musculus
tctttagatctgtgtgcctggtttg

SEQ ID NO: 24352 - DNA, 25 bp, Mus musculus
tggtttgcagatccattggtttctc

SEQ ID NO: 24353 - DNA, 25 bp, Mus musculus
ctctacttcatctccaggggctcca

SEQ ID NO: 24354 - DNA, 25 bp, Mus musculus
ttcatctccaggggctccatcgaga

SEQ ID NO: 24355 - DNA, 25 bp, Mus musculus
gacttgctggaggtgttggacatgt

SEQ ID NO: 24356 - DNA, 25 bp, Mus musculus
tatcccgagttctcagatcactttt

SEQ ID NO: 24357 - DNA, 25 bp, Mus musculus
gagttctcagatcacttttggtcta

SEQ ID NO: 24358 - DNA, 25 bp, Mus musculus
tcagatcacttttggtctagcctgg

SEQ ID NO: 24359 - DNA, 25 bp, Mus musculus
cacttttggtctagcctggagatca

SEQ ID NO: 24360 - DNA, 25 bp, Mus musculus
tggtctagcctggagatcaccttca

SEQ ID NO: 24361 - DNA, 25 bp, Mus musculus
agcctggagatcaccttcaaccttc

SEQ ID NO: 24362 - DNA, 25 bp, Mus musculus
gagatcaccttcaaccttcgagata

SEQ ID NO: 24363 - DNA, 25 bp, Mus musculus
aaccttcgagataccaacatgattc

SEQ ID NO: 24364 - DNA, 25 bp, Mus musculus
accaacatgattcctggctccccag

SEQ ID NO: 24365 - DNA, 25 bp, Mus musculus
gacatctttggagagcctctgaacc

SEQ ID NO: 24366 - DNA, 25 bp, Mus musculus
gagcctctgaacctatatgcccgtc

SEQ ID NO: 24367 - DNA, 25 bp, Mus musculus
ctgaacctatatgcccgtcctggaa

SEQ ID NO: 24368 - DNA, 25 bp, Mus musculus
ctatatgcccgtcctggaaagtcca

SEQ ID NO: 24369 - DNA, 25 bp, Mus musculus
ctcacgtactgtgacctgcacaaga

SEQ ID NO: 24370 - DNA, 25 bp, Mus musculus
tactgtgacctgcacaagatccatc

SEQ ID NO: 24371 - DNA, 25 bp, Mus musculus
gacctgcacaagatccatcgtgatg

SEQ ID NO: 24372 - DNA, 25 bp, Mus musculus
atccatcgtgatgacttgctggagg

SEQ ID NO: 24373 - DNA, 25 bp, Mus musculus
atgtagaggcctggttcttcagtaa

SEQ ID NO: 24374 - DNA, 25 bp, Mus musculus
aggcctggttcttcagtaagactga

SEQ ID NO: 24375 - DNA, 25 bp, Mus musculus
tgcagcagatccagggggtcattac

SEQ ID NO: 24376 - DNA, 25 bp, Mus musculus
agcagatccagggggtcattaccgg

SEQ ID NO: 24377 - DNA, 25 bp, Mus musculus
gggtcattaccggtctggagactca

SEQ ID NO: 24378 - DNA, 25 bp, Mus musculus
ttaccggtctggagactcagctgag

SEQ ID NO: 24379 - DNA, 25 bp, Mus musculus
gtgagctccactctcagatggaggc

SEQ ID NO: 24380 - DNA, 25 bp, Mus musculus
acatgctgctggacatcaagactcg

SEQ ID NO: 24381 - DNA, 25 bp, Mus musculus
gcagcagcagcaatttccatatcag

SEQ ID NO: 24382 - DNA, 25 bp, Mus musculus
gcagcaatttccatatcagtgtgga

SEQ ID NO: 24383 - DNA, 25 bp, Mus musculus
gcaatttccatatcagtgtggagga

SEQ ID NO: 24384 - DNA, 25 bp, Mus musculus
atttccatatcagtgtggaggaatc

SEQ ID NO: 24385 - DNA, 25 bp, Mus musculus
tcacagacctgagacggaccctgca

SEQ ID NO: 24386 - DNA, 25 bp, Mus musculus
acctgagacggaccctgcaggggct

SEQ ID NO: 24387 - DNA, 25 bp, Mus musculus
gcatgaaagccgggctggagaactc

SEQ ID NO: 24388 - DNA, 25 bp, Mus musculus
actctctggcagaggtggagtgccg

SEQ ID NO: 24389 - DNA, 25 bp, Mus musculus
tggagtgccgctatgccacacagct

SEQ ID NO: 24390 - DNA, 25 bp, Mus musculus
agtgccgctatgccacacagctgca

SEQ ID NO: 24391 - DNA, 25 bp, Mus musculus
atgccacacagctgcagcagatcca

SEQ ID NO: 24392 - DNA, 25 bp, Mus musculus
ccacacagctgcagcagatccaggg

SEQ ID NO: 24393 - DNA, 25 bp, Mus musculus
ttcttgcagatcggattctcctcat

SEQ ID NO: 24394 - DNA, 25 bp, Mus musculus
cagatcggattctcctcatggacac

SEQ ID NO: 24395 - DNA, 25 bp, Mus musculus
atgagaatttccggcaccttctgca

SEQ ID NO: 24396 - DNA, 25 bp, Mus musculus
ggcaccttctgcaagccccagtaga

SEQ ID NO: 24397 - DNA, 25 bp, Mus musculus
ttctgcaagccccagtagatgatgc

SEQ ID NO: 24398 - DNA, 25 bp, Mus musculus
aagccccagtagatgatgcacaaga

SEQ ID NO: 24399 - DNA, 25 bp, Mus musculus
cacaagagattcttcactccagatt

SEQ ID NO: 24400 - DNA, 25 bp, Mus musculus
agattcttcactccagatttccaat

SEQ ID NO: 24401 - DNA, 25 bp, Mus musculus
ttcactccagatttccaatgccgag

SEQ ID NO: 24402 - DNA, 25 bp, Mus musculus
ccagatttccaatgccgagatacat

SEQ ID NO: 24403 - DNA, 25 bp, Mus musculus
ttccaatgccgagatacattgacac

SEQ ID NO: 24404 - DNA, 25 bp, Mus musculus
tcaacccttcacagactcataataa

SEQ ID NO: 24405 - DNA, 25 bp, Mus musculus
tcctcatggacacgttcttccagat

SEQ ID NO: 24406 - DNA, 25 bp, Mus musculus
cccttcacagactcataataacatg

SEQ ID NO: 24407 - DNA, 25 bp, Mus musculus
tggacacgttcttccagattttgat

SEQ ID NO: 24408 - DNA, 25 bp, Mus musculus
cgttcttccagattttgatttatca

SEQ ID NO: 24409 - DNA, 25 bp, Mus musculus
ttttgatttatcacggtgagactat

SEQ ID NO: 24410 - DNA, 25 bp, Mus musculus
tttatcacggtgagactatagcaca

SEQ ID NO: 24411 - DNA, 25 bp, Mus musculus
agactatagcacagtggcggaagtc

SEQ ID NO: 24412 - DNA, 25 bp, Mus musculus
tagcacagtggcggaagtcaggata

SEQ ID NO: 24413 - DNA, 25 bp, Mus musculus
caggataccaggacatgccagaata

SEQ ID NO: 24414 - DNA, 25 bp, Mus musculus
tggctgcctacgatgaggagagtga

SEQ ID NO: 24415 - DNA, 25 bp, Mus musculus
aggaacaccaccagagcctgcaggc

SEQ ID NO: 24416 - DNA, 25 bp, Mus musculus
agccagagcaggccactaccagtaa

SEQ ID NO: 24417 - DNA, 25 bp, Mus musculus
cctctttgtaccggaagcagagtca

SEQ ID NO: 24418 - DNA, 25 bp, Mus musculus
ctttgtaccggaagcagagtcagat

SEQ ID NO: 24419 - DNA, 25 bp, Mus musculus
tgtaccggaagcagagtcagattca

SEQ ID NO: 24420 - DNA, 25 bp, Mus musculus
agattcagaaccaacaaagctcaga

SEQ ID NO: 24421 - DNA, 25 bp, Mus musculus
ttcagaaccaacaaagctcagactt

SEQ ID NO: 24422 - DNA, 25 bp, Mus musculus
aaagctcagacttggactccgacgt

SEQ ID NO: 24423 - DNA, 25 bp, Mus musculus
gctcagacttggactccgacgttga

SEQ ID NO: 24424 - DNA, 25 bp, Mus musculus
tggactccgacgttgaagactatta

SEQ ID NO: 24425 - DNA, 25 bp, Mus musculus
aagactattaacctcctgctctcct

SEQ ID NO: 24426 - DNA, 25 bp, Mus musculus
tggccccagaccattggctggaccc

SEQ ID NO: 24427 - DNA, 25 bp, Mus musculus
ccccagaccattggctggacccaag

SEQ ID NO: 24428 - DNA, 25 bp, Mus musculus
cagaccattggctggacccaagcat

SEQ ID NO: 24429 - DNA, 25 bp, Mus musculus
accctgctgcacggggcctggtgga

SEQ ID NO: 24430 - DNA, 25 bp, Mus musculus
tcattcgtgtccgtaaagacaagca

SEQ ID NO: 24431 - DNA, 25 bp, Mus musculus
ttcgtgtccgtaaagacaagcagcc

SEQ ID NO: 24432 - DNA, 25 bp, Mus musculus
aagacaagcagccagagcaggccac

SEQ ID NO: 24433 - DNA, 25 bp, Mus musculus
agcagccagagcaggccactaccag

SEQ ID NO: 24434 - DNA, 25 bp, Mus musculus
ccacagtctccactggttcggatcc

SEQ ID NO: 24435 - DNA, 25 bp, Mus musculus
ctggttcggatcccactgtgactta

SEQ ID NO: 24436 - DNA, 25 bp, Mus musculus
gagagctcttctcggcactggccca

SEQ ID NO: 24437 - DNA, 25 bp, Mus musculus
cggcactggcccagccttgacttgt

SEQ ID NO: 24438 - DNA, 25 bp, Mus musculus
tggcccagccttgacttgtcatgat

SEQ ID NO: 24439 - DNA, 25 bp, Mus musculus
agccttgacttgtcatgattcgagg

SEQ ID NO: 24440 - DNA, 25 bp, Mus musculus
tcccccaggtacttgctggagctgg

SEQ ID NO: 24441 - DNA, 25 bp, Mus musculus
gtgagcagcacacacagcctttgta

SEQ ID NO: 24442 - DNA, 25 bp, Mus musculus
agcacacacagcctttgtattcttg

SEQ ID NO: 24443 - DNA, 25 bp, Mus musculus
cacagcctttgtattcttgtagacg

SEQ ID NO: 24444 - DNA, 25 bp, Mus musculus
attcttgtagacgaccgctgttgat

SEQ ID NO: 24445 - DNA, 25 bp, Mus musculus
gtagacgaccgctgttgatgacatt

SEQ ID NO: 24446 - DNA, 25 bp, Mus musculus
tgacttaggatccccgtgactgcag

SEQ ID NO: 24447 - DNA, 25 bp, Mus musculus
aggatccccgtgactgcagtgaatc

SEQ ID NO: 24448 - DNA, 25 bp, Mus musculus
gtgaatctgcccagagactcagcag

SEQ ID NO: 24449 - DNA, 25 bp, Mus musculus
actaactcctgtcacccaatagtca

SEQ ID NO: 24450 - DNA, 25 bp, Mus musculus
tcctgtcacccaatagtcattggct

SEQ ID NO: 24451 - DNA, 25 bp, Mus musculus
cacccaatagtcattggctctgggg

SEQ ID NO: 24452 - DNA, 25 bp, Mus musculus
aaggcacctgctactccacagatcc

SEQ ID NO: 24453 - DNA, 25 bp, Mus musculus
ctctctagccatgagagctcttctc

SEQ ID NO: 24454 - DNA, 25 bp, Mus musculus
attagcaggaacagccgccttcatt

SEQ ID NO: 24455 - DNA, 25 bp, Mus musculus
aggaacagccgccttcattgactgg

SEQ ID NO: 24456 - DNA, 25 bp, Mus musculus
tgcttcccattccgggtaaagctgc

SEQ ID NO: 24457 - DNA, 25 bp, Mus musculus
ttcccattccgggtaaagctgcagc

SEQ ID NO: 24458 - DNA, 25 bp, Mus musculus
ccattccgggtaaagctgcagcaac

SEQ ID NO: 24459 - DNA, 25 bp, Mus musculus
aagctgcagcaacgccccgaaaaag

SEQ ID NO: 24460 - DNA, 25 bp, Mus musculus
ttacattgtaccccgctttagcacg

SEQ ID NO: 24461 - DNA, 25 bp, Mus musculus
ctcgctgcgcccagtgacacgtgct

SEQ ID NO: 24462 - DNA, 25 bp, Mus musculus
gctgcgcccagtgacacgtgctcat

SEQ ID NO: 24463 - DNA, 25 bp, Mus musculus
cccagtgacacgtgctcatatcgac

SEQ ID NO: 24464 - DNA, 25 bp, Mus musculus
agtgacacgtgctcatatcgacaag

SEQ ID NO: 24465 - DNA, 25 bp, Mus musculus
gacacgtgctcatatcgacaagatg

SEQ ID NO: 24466 - DNA, 25 bp, Mus musculus
aacagccgccttcattgactggttg

SEQ ID NO: 24467 - DNA, 25 bp, Mus musculus
gtgctcatatcgacaagatgtgttt

SEQ ID NO: 24468 - DNA, 25 bp, Mus musculus
agccgccttcattgactggttgccc

SEQ ID NO: 24469 - DNA, 25 bp, Mus musculus
gccccagaggcttttccagttatat

SEQ ID NO: 24470 - DNA, 25 bp, Mus musculus
ccagaggcttttccagttatatgtc

SEQ ID NO: 24471 - DNA, 25 bp, Mus musculus
gcttttccagttatatgtcaatcat

SEQ ID NO: 24472 - DNA, 25 bp, Mus musculus
atatgtcaatcatgtcttctgtgct

SEQ ID NO: 24473 - DNA, 25 bp, Mus musculus
tgtcaatcatgtcttctgtgcttgt

SEQ ID NO: 24474 - DNA, 25 bp, Mus musculus
caatcatgtcttctgtgcttgtgtc

SEQ ID NO: 24475 - DNA, 25 bp, Mus musculus
tcggccagattgtcaacacgctgga

SEQ ID NO: 24476 - DNA, 25 bp, Mus musculus
agattgtcaacacgctggacaagat

SEQ ID NO: 24477 - DNA, 25 bp, Mus musculus
ctttcgacgttgtatctcagatgat

SEQ ID NO: 24478 - DNA, 25 bp, Mus musculus
acgttgtatctcagatgatgatgga

SEQ ID NO: 24479 - DNA, 25 bp, Mus musculus
ttctccgcgttggggtcactctagc

SEQ ID NO: 24480 - DNA, 25 bp, Mus musculus
tcctgaacagtatccaggtgatgcg

SEQ ID NO: 24481 - DNA, 25 bp, Mus musculus
tccaggtgatgcgggcccagatgaa

SEQ ID NO: 24482 - DNA, 25 bp, Mus musculus
aggtttgacattcgcctgcctcggt

SEQ ID NO: 24483 - DNA, 25 bp, Mus musculus
ccctgctgctctgtcactgcaggtc

SEQ ID NO: 24484 - DNA, 25 bp, Mus musculus
gtcactgcaggtcagcactgccagg

SEQ ID NO: 24485 - DNA, 25 bp, Mus musculus
cagcactgccaggaggccacagaca

SEQ ID NO: 24486 - DNA, 25 bp, Mus musculus
tgccaggaggccacagacaacagga

SEQ ID NO: 24487 - DNA, 25 bp, Mus musculus
tgatccgaaaccccaacagcctcaa

SEQ ID NO: 24488 - DNA, 25 bp, Mus musculus
aggccacagacaacaggaagaccaa

SEQ ID NO: 24489 - DNA, 25 bp, Mus musculus
aagccatggcacccctgtcctctgg

SEQ ID NO: 24490 - DNA, 25 bp, Mus musculus
cactgctggaccgcacgataccgga

SEQ ID NO: 24491 - DNA, 25 bp, Mus musculus
tggaccgcacgataccggactacac

SEQ ID NO: 24492 - DNA, 25 bp, Mus musculus
gcacgataccggactacaccagctt

SEQ ID NO: 24493 - DNA, 25 bp, Mus musculus
actacaccagctttaacacagtgga

SEQ ID NO: 24494 - DNA, 25 bp, Mus musculus
ttaacacagtggatgagtggctaga

SEQ ID NO: 24495 - DNA, 25 bp, Mus musculus
aggccatcaagatgggccagtacaa

SEQ ID NO: 24496 - DNA, 25 bp, Mus musculus
aatcctattgaactgctcaacctca

SEQ ID NO: 24497 - DNA, 25 bp, Mus musculus
attgaactgctcaacctcaacgaga

SEQ ID NO: 24498 - DNA, 25 bp, Mus musculus
gaatgtccctggcaggctctgctca

SEQ ID NO: 24499 - DNA, 25 bp, Mus musculus
tggcaggctctgctcattaacgaag

SEQ ID NO: 24500 - DNA, 25 bp, Mus musculus
caggctctgctcattaacgaagaca

SEQ ID NO: 24501 - DNA, 25 bp, Mus musculus
ggcaccatcttgaatgagttctaca

SEQ ID NO: 24502 - DNA, 25 bp, Mus musculus
aatgagttctacatcctcactgctg

SEQ ID NO: 24503 - DNA, 25 bp, Mus musculus
gagttctacatcctcactgctgccc

SEQ ID NO: 24504 - DNA, 25 bp, Mus musculus
actgctgcccactgtctccatcagg

SEQ ID NO: 24505 - DNA, 25 bp, Mus musculus
cactgtctccatcaggccaggcgat

SEQ ID NO: 24506 - DNA, 25 bp, Mus musculus
tgtctccatcaggccaggcgattca

SEQ ID NO: 24507 - DNA, 25 bp, Mus musculus
catcaggccaggcgattcaaggtga

SEQ ID NO: 24508 - DNA, 25 bp, Mus musculus
gaactgctcaacctcaacgagacac

SEQ ID NO: 24509 - DNA, 25 bp, Mus musculus
ctgctcaacctcaacgagacacagc

SEQ ID NO: 24510 - DNA, 25 bp, Mus musculus
aacctcaacgagacacagcctgaga

SEQ ID NO: 24511 - DNA, 25 bp, Mus musculus
ctcaacgagacacagcctgagagga

SEQ ID NO: 24512 - DNA, 25 bp, Mus musculus
aacgagacacagcctgagaggagca

SEQ ID NO: 24513 - DNA, 25 bp, Mus musculus
acacagcctgagaggagcagcgatg

SEQ ID NO: 24514 - DNA, 25 bp, Mus musculus
agcagcgatgaccttgttcggattg

SEQ ID NO: 24515 - DNA, 25 bp, Mus musculus
agcgatgaccttgttcggattgtgg

SEQ ID NO: 24516 - DNA, 25 bp, Mus musculus
tactactgcacagcagacaacaact

SEQ ID NO: 24517 - DNA, 25 bp, Mus musculus
tactgcacagcagacaacaactacg

SEQ ID NO: 24518 - DNA, 25 bp, Mus musculus
ctctccatcagtgttcctggggtct

SEQ ID NO: 24519 - DNA, 25 bp, Mus musculus
tccatcagtgttcctggggtcttgc

SEQ ID NO: 24520 - DNA, 25 bp, Mus musculus
gttcctggggtcttgcccttcatcg

SEQ ID NO: 24521 - DNA, 25 bp, Mus musculus
gtcttgcccttcatcggagatgtgg

SEQ ID NO: 24522 - DNA, 25 bp, Mus musculus
ttgcccttcatcggagatgtggcgg

SEQ ID NO: 24523 - DNA, 25 bp, Mus musculus
acaagagagcatctcctccggttct

SEQ ID NO: 24524 - DNA, 25 bp, Mus musculus
cggttctctactggttttatcatga

SEQ ID NO: 24525 - DNA, 25 bp, Mus musculus
ttctctactggttttatcatgaaaa

SEQ ID NO: 24526 - DNA, 25 bp, Mus musculus
atcatgaaaatatcactctggctaa

SEQ ID NO: 24527 - DNA, 25 bp, Mus musculus
atatcactctggctaacacctcggc

SEQ ID NO: 24528 - DNA, 25 bp, Mus musculus
tgcacagcagacaacaactacggcc

SEQ ID NO: 24529 - DNA, 25 bp, Mus musculus
gcagacaacaactacggcctgatcc

SEQ ID NO: 24530 - DNA, 25 bp, Mus musculus
gacaacaactacggcctgatccaga

SEQ ID NO: 24531 - DNA, 25 bp, Mus musculus
tacggcctgatccagagtgcaatcg

SEQ ID NO: 24532 - DNA, 25 bp, Mus musculus
ggcctgatccagagtgcaatcgtga

SEQ ID NO: 24533 - DNA, 25 bp, Mus musculus
gcaatcgtgaacatcaccgtgaaaa

SEQ ID NO: 24534 - DNA, 25 bp, Mus musculus
gtgaacatcaccgtgaaaattccag

SEQ ID NO: 24535 - DNA, 25 bp, Mus musculus
ctcctctccatcagtgttcctgggg

SEQ ID NO: 24536 - DNA, 25 bp, Mus musculus
atcatcacgcagtcatagtgtgttc

SEQ ID NO: 24537 - DNA, 25 bp, Mus musculus
tcatagtgtgttccagctgcagatt

SEQ ID NO: 24538 - DNA, 25 bp, Mus musculus
cagtctgtctacattgggactggtc

SEQ ID NO: 24539 - DNA, 25 bp, Mus musculus
ggtcataatggccctgagcaataag

SEQ ID NO: 24540 - DNA, 25 bp, Mus musculus
cataatggccctgagcaataaggag

SEQ ID NO: 24541 - DNA, 25 bp, Mus musculus
aatggccctgagcaataaggagtcc

SEQ ID NO: 24542 - DNA, 25 bp, Mus musculus
ccacgtgccttaccgaaacagcaag

SEQ ID NO: 24543 - DNA, 25 bp, Mus musculus
gccttaccgaaacagcaagctcacc

SEQ ID NO: 24544 - DNA, 25 bp, Mus musculus
ttaccgaaacagcaagctcacctac

SEQ ID NO: 24545 - DNA, 25 bp, Mus musculus
gctcacctacttgctgcagaactct

SEQ ID NO: 24546 - DNA, 25 bp, Mus musculus
ctacttgctgcagaactctctgggt

SEQ ID NO: 24547 - DNA, 25 bp, Mus musculus
cttgctgcagaactctctgggtggc

SEQ ID NO: 24548 - DNA, 25 bp, Mus musculus
tagtgtgttccagctgcagatttct

SEQ ID NO: 24549 - DNA, 25 bp, Mus musculus
gttccagctgcagatttctggagag

SEQ ID NO: 24550 - DNA, 25 bp, Mus musculus
ccagctgcagatttctggagagcat

SEQ ID NO: 24551 - DNA, 25 bp, Mus musculus
tcccctcaaccttgtggacctagct

SEQ ID NO: 24552 - DNA, 25 bp, Mus musculus
caaccttgtggacctagctgggagt

SEQ ID NO: 24553 - DNA, 25 bp, Mus musculus
ccttgtggacctagctgggagtgag

SEQ ID NO: 24554 - DNA, 25 bp, Mus musculus
tgatcgtcttcgggagacacaggcc

SEQ ID NO: 24555 - DNA, 25 bp, Mus musculus
cagcagtctgtctacattgggactg

SEQ ID NO: 24556 - DNA, 25 bp, Mus musculus
cgtggatccactgggccctcagata

SEQ ID NO: 24557 - DNA, 25 bp, Mus musculus
agatgacttgctctcagaataatat

SEQ ID NO: 24558 - DNA, 25 bp, Mus musculus
acatccagctttctttaaatggact

SEQ ID NO: 24559 - DNA, 25 bp, Mus musculus
atggactctagggcttgaactcagg

SEQ ID NO: 24560 - DNA, 25 bp, Mus musculus
gcttgaactcaggtcctccagcttg

SEQ ID NO: 24561 - DNA, 25 bp, Mus musculus
gtcctccagcttgcaaggcaagcac

SEQ ID NO: 24562 - DNA, 25 bp, Mus musculus
caagcacttttccaattgtgctctc

SEQ ID NO: 24563 - DNA, 25 bp, Mus musculus
cttttccaattgtgctctctctagc

SEQ ID NO: 24564 - DNA, 25 bp, Mus musculus
caattgtgctctctctagccaaata

SEQ ID NO: 24565 - DNA, 25 bp, Mus musculus
tgctctctctagccaaataagtcat

SEQ ID NO: 24566 - DNA, 25 bp, Mus musculus
gtgttttgttctctgaggatgggtt

SEQ ID NO: 24567 - DNA, 25 bp, Mus musculus
tgttctctgaggatgggtttgtgct

SEQ ID NO: 24568 - DNA, 25 bp, Mus musculus
agcctcagatgttcctcaggcacca

SEQ ID NO: 24569 - DNA, 25 bp, Mus musculus
agatgttcctcaggcaccatccatc

SEQ ID NO: 24570 - DNA, 25 bp, Mus musculus
atccatcacctttttacatttgtgg

SEQ ID NO: 24571 - DNA, 25 bp, Mus musculus
tttacatttgtggcagggttcctct

SEQ ID NO: 24572 - DNA, 25 bp, Mus musculus
ttcctctggcctggaacttgccata

SEQ ID NO: 24573 - DNA, 25 bp, Mus musculus
ggaacttgccatataggcaagactg

SEQ ID NO: 24574 - DNA, 25 bp, Mus musculus
accccatgggtctgcttgtctctgc

SEQ ID NO: 24575 - DNA, 25 bp, Mus musculus
gccaccacatccagctttctttaaa

SEQ ID NO: 24576 - DNA, 25 bp, Mus musculus
tgccacttcatccacaacgcggacg

SEQ ID NO: 24577 - DNA, 25 bp, Mus musculus
ccacttcatccacaacgcggacgag

SEQ ID NO: 24578 - DNA, 25 bp, Mus musculus
gcccaagctgcatcacagcctcagt

SEQ ID NO: 24579 - DNA, 25 bp, Mus musculus
cccaagctgcatcacagcctcagtt

SEQ ID NO: 24580 - DNA, 25 bp, Mus musculus
caagctgcatcacagcctcagtttc

SEQ ID NO: 24581 - DNA, 25 bp, Mus musculus
gctgcatcacagcctcagtttctcc

SEQ ID NO: 24582 - DNA, 25 bp, Mus musculus
ctgcatcacagcctcagtttctccg

SEQ ID NO: 24583 - DNA, 25 bp, Mus musculus
gcatcacagcctcagtttctccggc

SEQ ID NO: 24584 - DNA, 25 bp, Mus musculus
catcacagcctcagtttctccggct

SEQ ID NO: 24585 - DNA, 25 bp, Mus musculus
tcacagcctcagtttctccggcttc

SEQ ID NO: 24586 - DNA, 25 bp, Mus musculus
tccggcgctaacaacgccttcgctt

SEQ ID NO: 24587 - DNA, 25 bp, Mus musculus
tactaccgcaaccagcagcagggcc

SEQ ID NO: 24588 - DNA, 25 bp, Mus musculus
cacttcatccacaacgcggacgagc

SEQ ID NO: 24589 - DNA, 25 bp, Mus musculus
cttcatccacaacgcggacgagcgg

SEQ ID NO: 24590 - DNA, 25 bp, Mus musculus
ttcatccacaacgcggacgagcggc

SEQ ID NO: 24591 - DNA, 25 bp, Mus musculus
catccacaacgcggacgagcggcgg

SEQ ID NO: 24592 - DNA, 25 bp, Mus musculus
agcgtttggcgcacgcgacgcgcta

SEQ ID NO: 24593 - DNA, 25 bp, Mus musculus
gcacgcgacgcgctacacctaggct

SEQ ID NO: 24594 - DNA, 25 bp, Mus musculus
cgcgacgcgctacacctaggcttcg

SEQ ID NO: 24595 - DNA, 25 bp, Mus musculus
gctacacctaggcttcgcccgcgag

SEQ ID NO: 24596 - DNA, 25 bp, Mus musculus
gcattgctcttcattacgtaataat

SEQ ID NO: 24597 - DNA, 25 bp, Mus musculus
tggttttgtggtgctcaaaggcctg

SEQ ID NO: 24598 - DNA, 25 bp, Mus musculus
caatgtccatctggtttgcattgtt

SEQ ID NO: 24599 - DNA, 25 bp, Mus musculus
atatatctgttctgcaactcataat

SEQ ID NO: 24600 - DNA, 25 bp, Mus musculus
ctgttctgcaactcataatatggat

SEQ ID NO: 24601 - DNA, 25 bp, Mus musculus
tatggatgtccccaacatcaaactt

SEQ ID NO: 24602 - DNA, 25 bp, Mus musculus
caacatcaaacttaattacttccag

SEQ ID NO: 24603 - DNA, 25 bp, Mus musculus
taattacttccagccgattgtcatc

SEQ ID NO: 24604 - DNA, 25 bp, Mus musculus
cttccagccgattgtcatccagtat

SEQ ID NO: 24605 - DNA, 25 bp, Mus musculus
gccgattgtcatccagtatgggtac

SEQ ID NO: 24606 - DNA, 25 bp, Mus musculus
tgtcatccagtatgggtacctatcc

SEQ ID NO: 24607 - DNA, 25 bp, Mus musculus
cctatccctgttccaggacagtggg

SEQ ID NO: 24608 - DNA, 25 bp, Mus musculus
gctcaaaggcctgccatgtaagatc

SEQ ID NO: 24609 - DNA, 25 bp, Mus musculus
aggcctgccatgtaagatcgtctat

SEQ ID NO: 24610 - DNA, 25 bp, Mus musculus
cgtctatatgtctacttctgttact

SEQ ID NO: 24611 - DNA, 25 bp, Mus musculus
tatgtctacttctgttactggcaat

SEQ ID NO: 24612 - DNA, 25 bp, Mus musculus
tacttctgttactggcaatcattgt

SEQ ID NO: 24613 - DNA, 25 bp, Mus musculus
tgttactggcaatcattgtcatgtc

SEQ ID NO: 24614 - DNA, 25 bp, Mus musculus
tcattgtcatgtcaatgtccatctg

SEQ ID NO: 24615 - DNA, 25 bp, Mus musculus
tcatgtcaatgtccatctggtttgc

SEQ ID NO: 24616 - DNA, 25 bp, Mus musculus
ttcatctaactttcagaaattggag

SEQ ID NO: 24617 - DNA, 25 bp, Mus musculus
aaatgttgcttatcactgcacatca

SEQ ID NO: 24618 - DNA, 25 bp, Mus musculus
attctcccctttgtgttggactgca

SEQ ID NO: 24619 - DNA, 25 bp, Mus musculus
tctcccctttgtgttggactgcaaa

SEQ ID NO: 24620 - DNA, 25 bp, Mus musculus
ccctttgtgttggactgcaaattga

SEQ ID NO: 24621 - DNA, 25 bp, Mus musculus
tttctccttaggcctttcacagtag

SEQ ID NO: 24622 - DNA, 25 bp, Mus musculus
tctccttaggcctttcacagtagac

SEQ ID NO: 24623 - DNA, 25 bp, Mus musculus
tccttaggcctttcacagtagactg

SEQ ID NO: 24624 - DNA, 25 bp, Mus musculus
cttaggcctttcacagtagactgag

SEQ ID NO: 24625 - DNA, 25 bp, Mus musculus
ggcctttcacagtagactgagaagt

SEQ ID NO: 24626 - DNA, 25 bp, Mus musculus
ttctgtgacagtacagaaggaaaac

SEQ ID NO: 24627 - DNA, 25 bp, Mus musculus
aaccaccattttatgtatagcttct

SEQ ID NO: 24628 - DNA, 25 bp, Mus musculus
atgttgcttatcactgcacatcaat

SEQ ID NO: 24629 - DNA, 25 bp, Mus musculus
gttgcttatcactgcacatcaatat

SEQ ID NO: 24630 - DNA, 25 bp, Mus musculus
tgcttatcactgcacatcaatataa

SEQ ID NO: 24631 - DNA, 25 bp, Mus musculus
gtatttattgccaaactatgctttt

SEQ ID NO: 24632 - DNA, 25 bp, Mus musculus
tttgttcatatttatcgggatgaca

SEQ ID NO: 24633 - DNA, 25 bp, Mus musculus
tgttcatatttatcgggatgacaaa

SEQ ID NO: 24634 - DNA, 25 bp, Mus musculus
tgacgtgtctttccttttttcacag

SEQ ID NO: 24635 - DNA, 25 bp, Mus musculus
tattcttcaacacatttttgtaact

SEQ ID NO: 24636 - DNA, 25 bp, Mus musculus
acatggcccctgaaatcttaatgag

SEQ ID NO: 24637 - DNA, 25 bp, Mus musculus
tggcccctgaaatcttaatgagaag

SEQ ID NO: 24638 - DNA, 25 bp, Mus musculus
ctccattcactggggagaatagaaa

SEQ ID NO: 24639 - DNA, 25 bp, Mus musculus
caattgacaaaatcctcaaatgtaa

SEQ ID NO: 24640 - DNA, 25 bp, Mus musculus
ttgacaaaatcctcaaatgtaaact

SEQ ID NO: 24641 - DNA, 25 bp, Mus musculus
cctacctcacacaagaagctcgaga

SEQ ID NO: 24642 - DNA, 25 bp, Mus musculus
acctcacacaagaagctcgagatct

SEQ ID NO: 24643 - DNA, 25 bp, Mus musculus
aagctcgagatctgcttaaaaagct

SEQ ID NO: 24644 - DNA, 25 bp, Mus musculus
gaaatgctgcttctcgtcttggagc

SEQ ID NO: 24645 - DNA, 25 bp, Mus musculus
atgctgcttctcgtcttggagctgg

SEQ ID NO: 24646 - DNA, 25 bp, Mus musculus
ctgcttctcgtcttggagctggccc

SEQ ID NO: 24647 - DNA, 25 bp, Mus musculus
ctcgtcttggagctggccctgggga

SEQ ID NO: 24648 - DNA, 25 bp, Mus musculus
tgagaagcggccacaaccgtgctgt

SEQ ID NO: 24649 - DNA, 25 bp, Mus musculus
gaagcggccacaaccgtgctgtgga

SEQ ID NO: 24650 - DNA, 25 bp, Mus musculus
tgtatgacatgctgactggagcacc

SEQ ID NO: 24651 - DNA, 25 bp, Mus musculus
acatgctgactggagcacctccatt

SEQ ID NO: 24652 - DNA, 25 bp, Mus musculus
tgactggagcacctccattcactgg

SEQ ID NO: 24653 - DNA, 25 bp, Mus musculus
ctggagcacctccattcactgggga

SEQ ID NO: 24654 - DNA, 25 bp, Mus musculus
gagcacctccattcactggggagaa

SEQ ID NO: 24655 - DNA, 25 bp, Mus musculus
cacctccattcactggggagaatag

SEQ ID NO: 24656 - DNA, 25 bp, Mus musculus
tttattcttacatcactaaagcttt

SEQ ID NO: 24657 - DNA, 25 bp, Mus musculus
cttacatcactaaagctttggaaca

SEQ ID NO: 24658 - DNA, 25 bp, Mus musculus
tatttcctctggaagctcagctaca

SEQ ID NO: 24659 - DNA, 25 bp, Mus musculus
ctctggaagctcagctacattcact

SEQ ID NO: 24660 - DNA, 25 bp, Mus musculus
aagctcagctacattcacttcaaac

SEQ ID NO: 24661 - DNA, 25 bp, Mus musculus
ttcaaaccggtcctgaacatcatta

SEQ ID NO: 24662 - DNA, 25 bp, Mus musculus
ccggtcctgaacatcattaaggatt

SEQ ID NO: 24663 - DNA, 25 bp, Mus musculus
tttggcatcattttcatccgataca

SEQ ID NO: 24664 - DNA, 25 bp, Mus musculus
atcattttcatccgatacaaaagtg

SEQ ID NO: 24665 - DNA, 25 bp, Mus musculus
ttcatccgatacaaaagtgactgcc

SEQ ID NO: 24666 - DNA, 25 bp, Mus musculus
gactgccaggcccttggtaccaaag

SEQ ID NO: 24667 - DNA, 25 bp, Mus musculus
cttggtaccaaagcgaccagcacga

SEQ ID NO: 24668 - DNA, 25 bp, Mus musculus
catcgatttgtcacctagaaagagg

SEQ ID NO: 24669 - DNA, 25 bp, Mus musculus
accaaagcgaccagcacgagccact

SEQ ID NO: 24670 - DNA, 25 bp, Mus musculus
tttgtcacctagaaagaggttctga

SEQ ID NO: 24671 - DNA, 25 bp, Mus musculus
agagtggccatgttgccctggctac

SEQ ID NO: 24672 - DNA, 25 bp, Mus musculus
ttgccctggctacacatacggttac

SEQ ID NO: 24673 - DNA, 25 bp, Mus musculus
tggctacacatacggttaccggctc

SEQ ID NO: 24674 - DNA, 25 bp, Mus musculus
cacatacggttaccggctctgctca

SEQ ID NO: 24675 - DNA, 25 bp, Mus musculus
cggttaccggctctgctcaatgtat

SEQ ID NO: 24676 - DNA, 25 bp, Mus musculus
gatatctatttcctctggaagctca

SEQ ID NO: 24677 - DNA, 25 bp, Mus musculus
tctctcacagaggcacccagagcag

SEQ ID NO: 24678 - DNA, 25 bp, Mus musculus
ctcacagaggcacccagagcagaca

SEQ ID NO: 24679 - DNA, 25 bp, Mus musculus
tgcgacactacatcaatctcatcac

SEQ ID NO: 24680 - DNA, 25 bp, Mus musculus
gacactacatcaatctcatcaccag

SEQ ID NO: 24681 - DNA, 25 bp, Mus musculus
acatcaatctcatcaccagacagag

SEQ ID NO: 24682 - DNA, 25 bp, Mus musculus
tcaatctcatcaccagacagagata

SEQ ID NO: 24683 - DNA, 25 bp, Mus musculus
atctcatcaccagacagagatatgg

SEQ ID NO: 24684 - DNA, 25 bp, Mus musculus
tcatcaccagacagagatatggcaa

SEQ ID NO: 24685 - DNA, 25 bp, Mus musculus
gcaagagatccagccctgagacact

SEQ ID NO: 24686 - DNA, 25 bp, Mus musculus
agagatccagccctgagacactgat

SEQ ID NO: 24687 - DNA, 25 bp, Mus musculus
ccagccctgagacactgatttcaga

SEQ ID NO: 24688 - DNA, 25 bp, Mus musculus
gccctgagacactgatttcagacct

SEQ ID NO: 24689 - DNA, 25 bp, Mus musculus
ctctgctcgtgtgtttgggcattct

SEQ ID NO: 24690 - DNA, 25 bp, Mus musculus
agacactgatttcagacctcttaat

SEQ ID NO: 24691 - DNA, 25 bp, Mus musculus
tcgtgtgtttgggcattctggctga

SEQ ID NO: 24692 - DNA, 25 bp, Mus musculus
acgcgccacgagaggacatggccag

SEQ ID NO: 24693 - DNA, 25 bp, Mus musculus
acatggccagatactactccgctct

SEQ ID NO: 24694 - DNA, 25 bp, Mus musculus
tggccagatactactccgctctgcg

SEQ ID NO: 24695 - DNA, 25 bp, Mus musculus
gatactactccgctctgcgacacta

SEQ ID NO: 24696 - DNA, 25 bp, Mus musculus
actccgctctgcgacactacatcaa

SEQ ID NO: 24697 - DNA, 25 bp, Mus musculus
ctctgcgacactacatcaatctcat

SEQ ID NO: 24698 - DNA, 25 bp, Mus musculus
ggatgacctggaactcctgatcctt

SEQ ID NO: 24699 - DNA, 25 bp, Mus musculus
tccatctccgtttcccggatgctgc

SEQ ID NO: 24700 - DNA, 25 bp, Mus musculus
ctgtcttgctggcaagtgctttacc

SEQ ID NO: 24701 - DNA, 25 bp, Mus musculus
caagtgctttacctgcggagccatc

SEQ ID NO: 24702 - DNA, 25 bp, Mus musculus
ctttacctgcggagccatcttgctg

SEQ ID NO: 24703 - DNA, 25 bp, Mus musculus
tactaagtgctaagccctacagtgg

SEQ ID NO: 24704 - DNA, 25 bp, Mus musculus
gtgctaagccctacagtggcctggg

SEQ ID NO: 24705 - DNA, 25 bp, Mus musculus
tctgctcatcactcttactggggaa

SEQ ID NO: 24706 - DNA, 25 bp, Mus musculus
catcactcttactggggaagcttct

SEQ ID NO: 24707 - DNA, 25 bp, Mus musculus
agcttctactctgcagccctgcaag

SEQ ID NO: 24708 - DNA, 25 bp, Mus musculus
tactctgcagccctgcaagccatgc

SEQ ID NO: 24709 - DNA, 25 bp, Mus musculus
gcagccctgcaagccatgcattcca

SEQ ID NO: 24710 - DNA, 25 bp, Mus musculus
atgctgctggggttacaggagtgca

SEQ ID NO: 24711 - DNA, 25 bp, Mus musculus
cagccctgcaagccatgcattccaa

SEQ ID NO: 24712 - DNA, 25 bp, Mus musculus
gagtgcaccgacacgcatgcaggca

SEQ ID NO: 24713 - DNA, 25 bp, Mus musculus
acgcatgcaggcatgcacaggtccc

SEQ ID NO: 24714 - DNA, 25 bp, Mus musculus
catgtgcacacctgtattgtgtgta

SEQ ID NO: 24715 - DNA, 25 bp, Mus musculus
atctctgtgtgtcacagtgctcatg

SEQ ID NO: 24716 - DNA, 25 bp, Mus musculus
cacagtgctcatgtggaggttcaag

SEQ ID NO: 24717 - DNA, 25 bp, Mus musculus
ccttgtggatcccagtgagagaaat

SEQ ID NO: 24718 - DNA, 25 bp, Mus musculus
ttctatctgtcttgctggcaagtgc

SEQ ID NO: 24719 - DNA, 25 bp, Mus musculus
ggaccctgacaagaggctgggagta

SEQ ID NO: 24720 - DNA, 25 bp, Mus musculus
caagactatcaactggtccctcctg

SEQ ID NO: 24721 - DNA, 25 bp, Mus musculus
cttccatggcttctcctttgtgaat

SEQ ID NO: 24722 - DNA, 25 bp, Mus musculus
ctcctttgtgaatcccaagtttgag

SEQ ID NO: 24723 - DNA, 25 bp, Mus musculus
tgccctggtttgctccgcattgccc

SEQ ID NO: 24724 - DNA, 25 bp, Mus musculus
ggtttgctccgcattgcccgtggag

SEQ ID NO: 24725 - DNA, 25 bp, Mus musculus
ctccgcattgcccgtggagaacagt

SEQ ID NO: 24726 - DNA, 25 bp, Mus musculus
ctcacagtacttcctctgtgaactg

SEQ ID NO: 24727 - DNA, 25 bp, Mus musculus
gtacttcctctgtgaactgtttgtg

SEQ ID NO: 24728 - DNA, 25 bp, Mus musculus
gaatttgccttccctttgccatcag

SEQ ID NO: 24729 - DNA, 25 bp, Mus musculus
gccttccctttgccatcagagggaa

SEQ ID NO: 24730 - DNA, 25 bp, Mus musculus
aaatcctgtgtttcattacttgaat

SEQ ID NO: 24731 - DNA, 25 bp, Mus musculus
agtgaaatccccttcagactacagc

SEQ ID NO: 24732 - DNA, 25 bp, Mus musculus
ttcagactacagcaactttgaccca

SEQ ID NO: 24733 - DNA, 25 bp, Mus musculus
ctacagcaactttgacccagagttc

SEQ ID NO: 24734 - DNA, 25 bp, Mus musculus
tgagaaacctcagctttccttcagt

SEQ ID NO: 24735 - DNA, 25 bp, Mus musculus
gctttccttcagtgacaagaacctc

SEQ ID NO: 24736 - DNA, 25 bp, Mus musculus
gaacctcatcgactctatggaccag

SEQ ID NO: 24737 - DNA, 25 bp, Mus musculus
ctctatggaccaggaagccttccat

SEQ ID NO: 24738 - DNA, 25 bp, Mus musculus
ggaagccttccatggcttctccttt

SEQ ID NO: 24739 - DNA, 25 bp, Mus musculus
tctatcattccaataccaaatccaa

SEQ ID NO: 24740 - DNA, 25 bp, Mus musculus
aatccaacttgaacatgcccggact

SEQ ID NO: 24741 - DNA, 25 bp, Mus musculus
ttctccaactgctgcatacttttga

SEQ ID NO: 24742 - DNA, 25 bp, Mus musculus
aactgctgcatacttttgacaagga

SEQ ID NO: 24743 - DNA, 25 bp, Mus musculus
tagttttgtcttccgatctacattg

SEQ ID NO: 24744 - DNA, 25 bp, Mus musculus
tgtcttccgatctacattgatgacc

SEQ ID NO: 24745 - DNA, 25 bp, Mus musculus
ccgatctacattgatgacctaagcc

SEQ ID NO: 24746 - DNA, 25 bp, Mus musculus
tacattgatgacctaagccaggtaa

SEQ ID NO: 24747 - DNA, 25 bp, Mus musculus
gatgacctaagccaggtaaataagc

SEQ ID NO: 24748 - DNA, 25 bp, Mus musculus
ctgttatgcactgtggtttcagatg

SEQ ID NO: 24749 - DNA, 25 bp, Mus musculus
tgcactgtggtttcagatgtgcaat

SEQ ID NO: 24750 - DNA, 25 bp, Mus musculus
attcccaagtatgcctttaagcaga

SEQ ID NO: 24751 - DNA, 25 bp, Mus musculus
acatgcccggacttacaaaatgcca

SEQ ID NO: 24752 - DNA, 25 bp, Mus musculus
gaccaggattcccttgaattgtgtt

SEQ ID NO: 24753 - DNA, 25 bp, Mus musculus
gattcccttgaattgtgtttcgatg

SEQ ID NO: 24754 - DNA, 25 bp, Mus musculus
gatgcaatacacacgtaaagatcac

SEQ ID NO: 24755 - DNA, 25 bp, Mus musculus
agatcaccttgtatgctctttgcct

SEQ ID NO: 24756 - DNA, 25 bp, Mus musculus
ccttgtatgctctttgccttcttaa

SEQ ID NO: 24757 - DNA, 25 bp, Mus musculus
cattattgtgtcggaggaagaggaa

SEQ ID NO: 24758 - DNA, 25 bp, Mus musculus
ccaaagttctccaactgctgcatac

SEQ ID NO: 24759 - DNA, 25 bp, Mus musculus
ccactggctcctctgcaaaggcaga

SEQ ID NO: 24760 - DNA, 25 bp, Mus musculus
agtgcattttgctaccaggatgtgg

SEQ ID NO: 24761 - DNA, 25 bp, Mus musculus
catctttctgtgtcactatgggaaa

SEQ ID NO: 24762 - DNA, 25 bp, Mus musculus
agtgtctccctacatgttgctctgt

SEQ ID NO: 24763 - DNA, 25 bp, Mus musculus
tgttgagagcccatgaacagggcat

SEQ ID NO: 24764 - DNA, 25 bp, Mus musculus
gagcccatgaacagggcatgcatga

SEQ ID NO: 24765 - DNA, 25 bp, Mus musculus
agggcatgcatgactctttggcaac

SEQ ID NO: 24766 - DNA, 25 bp, Mus musculus
tgcatgactctttggcaacatgtgt

SEQ ID NO: 24767 - DNA, 25 bp, Mus musculus
actctttggcaacatgtgttatctt

SEQ ID NO: 24768 - DNA, 25 bp, Mus musculus
ttatcttggagccacgtgtttttat

SEQ ID NO: 24769 - DNA, 25 bp, Mus musculus
tattccacggcaaacggagacattt

SEQ ID NO: 24770 - DNA, 25 bp, Mus musculus
ttaatccgctcgtggtcattgaata

SEQ ID NO: 24771 - DNA, 25 bp, Mus musculus
ttttgctaccaggatgtggatggca

SEQ ID NO: 24772 - DNA, 25 bp, Mus musculus
gagatcccagctaagacagttcctg

SEQ ID NO: 24773 - DNA, 25 bp, Mus musculus
ccagctaagacagttcctgggcaaa

SEQ ID NO: 24774 - DNA, 25 bp, Mus musculus
aagacagttcctgggcaaagatgag

SEQ ID NO: 24775 - DNA, 25 bp, Mus musculus
gtatctccagtctatgtggcactgg

SEQ ID NO: 24776 - DNA, 25 bp, Mus musculus
gggaaccccaaagatctgagccctg

SEQ ID NO: 24777 - DNA, 25 bp, Mus musculus
gtggacagctccagacctgtgagac

SEQ ID NO: 24778 - DNA, 25 bp, Mus musculus
agctccagacctgtgagacatcttt

SEQ ID NO: 24779 - DNA, 25 bp, Mus musculus
ctcgacaaaccaaagaaactctctg

SEQ ID NO: 24780 - DNA, 25 bp, Mus musculus
ccaaagaaactctctgcagagtgcg

SEQ ID NO: 24781 - DNA, 25 bp, Mus musculus
agtatccgtccacgttcttgccagg

SEQ ID NO: 24782 - DNA, 25 bp, Mus musculus
cgtccacgttcttgccagggaaatg

SEQ ID NO: 24783 - DNA, 25 bp, Mus musculus
ccacgttcttgccagggaaatggat

SEQ ID NO: 24784 - DNA, 25 bp, Mus musculus
cgttcttgccagggaaatggattct

SEQ ID NO: 24785 - DNA, 25 bp, Mus musculus
aatggattcttgtcctgtggttgga

SEQ ID NO: 24786 - DNA, 25 bp, Mus musculus
tggattcttgtcctgtggttggaga

SEQ ID NO: 24787 - DNA, 25 bp, Mus musculus
ggattcttgtcctgtggttggagag

SEQ ID NO: 24788 - DNA, 25 bp, Mus musculus
gattcttgtcctgtggttggagagt

SEQ ID NO: 24789 - DNA, 25 bp, Mus musculus
attcttgtcctgtggttggagagtt

SEQ ID NO: 24790 - DNA, 25 bp, Mus musculus
tgatataaacctttccgaagcgcca

SEQ ID NO: 24791 - DNA, 25 bp, Mus musculus
aaactctctgcagagtgcgcgaagt

SEQ ID NO: 24792 - DNA, 25 bp, Mus musculus
ctctctgcagagtgcgcgaagtact

SEQ ID NO: 24793 - DNA, 25 bp, Mus musculus
gatcatctcccagcagtacaattat

SEQ ID NO: 24794 - DNA, 25 bp, Mus musculus
tttaaagacactcagcaaggacgat

SEQ ID NO: 24795 - DNA, 25 bp, Mus musculus
gacactcagcaaggacgatatcatc

SEQ ID NO: 24796 - DNA, 25 bp, Mus musculus
cgatatcatcaaattctacaaggaa

SEQ ID NO: 24797 - DNA, 25 bp, Mus musculus
tatcatcaaattctacaaggaaatg

SEQ ID NO: 24798 - DNA, 25 bp, Mus musculus
aatgttggctgtggacgcaccaagg

SEQ ID NO: 24799 - DNA, 25 bp, Mus musculus
gcttgagtttctccagcacctggag

SEQ ID NO: 24800 - DNA, 25 bp, Mus musculus
agccactggtctgatgggaagctgt

SEQ ID NO: 24801 - DNA, 25 bp, Mus musculus
acacatcccagcggccaggttgctt

SEQ ID NO: 24802 - DNA, 25 bp, Mus musculus
catcccagcggccaggttgcttcag

SEQ ID NO: 24803 - DNA, 25 bp, Mus musculus
tggctgtctgtcactatggctgccc

SEQ ID NO: 24804 - DNA, 25 bp, Mus musculus
agttggccagagtcatgtgttctat

SEQ ID NO: 24805 - DNA, 25 bp, Mus musculus
tgtgttctatggtggcagcaaggag

SEQ ID NO: 24806 - DNA, 25 bp, Mus musculus
ctggcttttctatcgctaggggttg

SEQ ID NO: 24807 - DNA, 25 bp, Mus musculus
gcttttctatcgctaggggttgcta

SEQ ID NO: 24808 - DNA, 25 bp, Mus musculus
tttctatcgctaggggttgctaggg

SEQ ID NO: 24809 - DNA, 25 bp, Mus musculus
tagggatctacaccctgcctgtggt

SEQ ID NO: 24810 - DNA, 25 bp, Mus musculus
gctgaaaagttcccactgtacctgt

SEQ ID NO: 24811 - DNA, 25 bp, Mus musculus
tccttatcttcagtcaagtgttccc

SEQ ID NO: 24812 - DNA, 25 bp, Mus musculus
ttatcttcagtcaagtgttccctag

SEQ ID NO: 24813 - DNA, 25 bp, Mus musculus
tccctagggacacacagtggtgagg

SEQ ID NO: 24814 - DNA, 25 bp, Mus musculus
gtccctgcaagagtccctttagcct

SEQ ID NO: 24815 - DNA, 25 bp, Mus musculus
cctgcaagagtccctttagcctggc

SEQ ID NO: 24816 - DNA, 25 bp, Mus musculus
gcaagagtccctttagcctggcaga

SEQ ID NO: 24817 - DNA, 25 bp, Mus musculus
ttagcctggcagatttagggtctgg

SEQ ID NO: 24818 - DNA, 25 bp, Mus musculus
gtgatcacacatcccagcggccagg

SEQ ID NO: 24819 - DNA, 25 bp, Mus musculus
tcctgagaccatgtccactgtgcac

SEQ ID NO: 24820 - DNA, 25 bp, Mus musculus
catgtccactgtgcacgtgtgtcct

SEQ ID NO: 24821 - DNA, 25 bp, Mus musculus
ctcctcaagccaatcgtctgttctc

SEQ ID NO: 24822 - DNA, 25 bp, Mus musculus
ctcaagccaatcgtctgttctctgc

SEQ ID NO: 24823 - DNA, 25 bp, Mus musculus
ccaatcgtctgttctctgctttgaa

SEQ ID NO: 24824 - DNA, 25 bp, Mus musculus
atcgtctgttctctgctttgaagct

SEQ ID NO: 24825 - DNA, 25 bp, Mus musculus
gtctgttctctgctttgaagctgtg

SEQ ID NO: 24826 - DNA, 25 bp, Mus musculus
tctctgctttgaagctgtgttatga

SEQ ID NO: 24827 - DNA, 25 bp, Mus musculus
ttcttgcaccttaaagatgccattg

SEQ ID NO: 24828 - DNA, 25 bp, Mus musculus
ttgcaccttaaagatgccattgaca

SEQ ID NO: 24829 - DNA, 25 bp, Mus musculus
caccttaaagatgccattgacaacc

SEQ ID NO: 24830 - DNA, 25 bp, Mus musculus
agaccagatggccagaggcagcgtt

SEQ ID NO: 24831 - DNA, 25 bp, Mus musculus
gtccactgtgcacgtgtgtcctgtg

SEQ ID NO: 24832 - DNA, 25 bp, Mus musculus
tgtgcacgtgtgtcctgtgctgtaa

SEQ ID NO: 24833 - DNA, 25 bp, Mus musculus
gcacgtgtgtcctgtgctgtaattt

SEQ ID NO: 24834 - DNA, 25 bp, Mus musculus
taaagtcattctaggctaagaagaa

SEQ ID NO: 24835 - DNA, 25 bp, Mus musculus
agaatcttctgccaactcctcaagc

SEQ ID NO: 24836 - DNA, 25 bp, Mus musculus
atcttctgccaactcctcaagccaa

SEQ ID NO: 24837 - DNA, 25 bp, Mus musculus
ttctgccaactcctcaagccaatcg

SEQ ID NO: 24838 - DNA, 25 bp, Mus musculus
caactcctcaagccaatcgtctgtt

SEQ ID NO: 24839 - DNA, 25 bp, Mus musculus
catctcaggcccgattttctgttca

SEQ ID NO: 24840 - DNA, 25 bp, Mus musculus
aggcccgattttctgttcagatgtt

SEQ ID NO: 24841 - DNA, 25 bp, Mus musculus
ctttgatcttcatggttcaatgatg

SEQ ID NO: 24842 - DNA, 25 bp, Mus musculus
tcttcatggttcaatgatggaaagc

SEQ ID NO: 24843 - DNA, 25 bp, Mus musculus
acaagttggcatctttcagtgctgt

SEQ ID NO: 24844 - DNA, 25 bp, Mus musculus
tggcatctttcagtgctgttcttcc

SEQ ID NO: 24845 - DNA, 25 bp, Mus musculus
ctttcagtgctgttcttccttcaaa

SEQ ID NO: 24846 - DNA, 25 bp, Mus musculus
gtgctgttcttccttcaaatgtgat

SEQ ID NO: 24847 - DNA, 25 bp, Mus musculus
ttcttccttcaaatgtgatatgtat

SEQ ID NO: 24848 - DNA, 25 bp, Mus musculus
tatgtatgaagcccctgtctcctga

SEQ ID NO: 24849 - DNA, 25 bp, Mus musculus
tgaagcccctgtctcctgaaggaat

SEQ ID NO: 24850 - DNA, 25 bp, Mus musculus
ccctgtctcctgaaggaatgtggca

SEQ ID NO: 24851 - DNA, 25 bp, Mus musculus
tgggtcccataacacgacaacgaca

SEQ ID NO: 24852 - DNA, 25 bp, Mus musculus
ccataacacgacaacgacaaggtgt

SEQ ID NO: 24853 - DNA, 25 bp, Mus musculus
tccaggcctcagtgtccgcttccag

SEQ ID NO: 24854 - DNA, 25 bp, Mus musculus
cctcagtgtccgcttccagcaactt

SEQ ID NO: 24855 - DNA, 25 bp, Mus musculus
tgtccgcttccagcaacttgaggct

SEQ ID NO: 24856 - DNA, 25 bp, Mus musculus
cttccagcaacttgaggctcctgag

SEQ ID NO: 24857 - DNA, 25 bp, Mus musculus
ttctctcagccactttgatcttcat

SEQ ID NO: 24858 - DNA, 25 bp, Mus musculus
cagccactttgatcttcatggttca

SEQ ID NO: 24859 - DNA, 25 bp, Mus musculus
tgcataggtcctgactggccaccac

SEQ ID NO: 24860 - DNA, 25 bp, Mus musculus
ggtcctgactggccaccactgtgca

SEQ ID NO: 24861 - DNA, 25 bp, Mus musculus
atgaccacatctgggacattgtagg

SEQ ID NO: 24862 - DNA, 25 bp, Mus musculus
aggtgactctccattgtggctctca

SEQ ID NO: 24863 - DNA, 25 bp, Mus musculus
tgactctccattgtggctctcatgg

SEQ ID NO: 24864 - DNA, 25 bp, Mus musculus
tccattgtggctctcatggcattct

SEQ ID NO: 24865 - DNA, 25 bp, Mus musculus
attgtggctctcatggcattcttga

SEQ ID NO: 24866 - DNA, 25 bp, Mus musculus
gtggctctcatggcattcttgagca

SEQ ID NO: 24867 - DNA, 25 bp, Mus musculus
ctcatggcattcttgagcagctcag

SEQ ID NO: 24868 - DNA, 25 bp, Mus musculus
atggcattcttgagcagctcaggca

SEQ ID NO: 24869 - DNA, 25 bp, Mus musculus
gcattcttgagcagctcaggcagga

SEQ ID NO: 24870 - DNA, 25 bp, Mus musculus
ttgagcagctcaggcaggatatagt

SEQ ID NO: 24871 - DNA, 25 bp, Mus musculus
ccactgtgcatatccaggtggccga

SEQ ID NO: 24872 - DNA, 25 bp, Mus musculus
ctgtgcatatccaggtggccgaaga

SEQ ID NO: 24873 - DNA, 25 bp, Mus musculus
gcctcagctgtggtgaagtggtagt

SEQ ID NO: 24874 - DNA, 25 bp, Mus musculus
tccatgacccgatccaggtccttat

SEQ ID NO: 24875 - DNA, 25 bp, Mus musculus
atgacccgatccaggtccttatgag

SEQ ID NO: 24876 - DNA, 25 bp, Mus musculus
tcattattggcgatggtgatgacca

SEQ ID NO: 24877 - DNA, 25 bp, Mus musculus
atggtgatgaccacatctgggacat

SEQ ID NO: 24878 - DNA, 25 bp, Mus musculus
gtgatgaccacatctgggacattgt

SEQ ID NO: 24879 - DNA, 25 bp, Mus musculus
tcagatgcccatcaccacaggaaca

SEQ ID NO: 24880 - DNA, 25 bp, Mus musculus
caccacaggaacaggtgttgtgtat

SEQ ID NO: 24881 - DNA, 25 bp, Mus musculus
tgatcccaaatcagactatagcagc

SEQ ID NO: 24882 - DNA, 25 bp, Mus musculus
tgaggccccagagcctgtcagtgcc

SEQ ID NO: 24883 - DNA, 25 bp, Mus musculus
cccagagcctgtcagtgccaactga

SEQ ID NO: 24884 - DNA, 25 bp, Mus musculus
aattaaaacactctgacatttcgct

SEQ ID NO: 24885 - DNA, 25 bp, Mus musculus
aacactctgacatttcgctcccttt

SEQ ID NO: 24886 - DNA, 25 bp, Mus musculus
gagcccgcatgcatttgtggctcca

SEQ ID NO: 24887 - DNA, 25 bp, Mus musculus
gcatgcatttgtggctccacaatac

SEQ ID NO: 24888 - DNA, 25 bp, Mus musculus
atttgtggctccacaatacatcagc

SEQ ID NO: 24889 - DNA, 25 bp, Mus musculus
ggctccacaatacatcagcagaatg

SEQ ID NO: 24890 - DNA, 25 bp, Mus musculus
aattgcttcgtaacgtgtgagacag

SEQ ID NO: 24891 - DNA, 25 bp, Mus musculus
tgtgtatcctggtgctattactatg

SEQ ID NO: 24892 - DNA, 25 bp, Mus musculus
tgctattactatggcaacgaccaca

SEQ ID NO: 24893 - DNA, 25 bp, Mus musculus
tactatggcaacgaccacaccatca

SEQ ID NO: 24894 - DNA, 25 bp, Mus musculus
gatgacatctgactgctctagcacc

SEQ ID NO: 24895 - DNA, 25 bp, Mus musculus
atctgactgctctagcacctctgcc

SEQ ID NO: 24896 - DNA, 25 bp, Mus musculus
catccagagcacgtatggtatgaag

SEQ ID NO: 24897 - DNA, 25 bp, Mus musculus
aagcctggctgggaacgacatgatt

SEQ ID NO: 24898 - DNA, 25 bp, Mus musculus
cgaagatgatcccaaatcagactat

SEQ ID NO: 24899 - DNA, 25 bp, Mus musculus
ctggccctgccttgaggattaaaga

SEQ ID NO: 24900 - DNA, 25 bp, Mus musculus
ggccctgccttgaggattaaagagt

SEQ ID NO: 24901 - DNA, 25 bp, Mus musculus
ctggtcacgtagcctcaagcctgca

SEQ ID NO: 24902 - DNA, 25 bp, Mus musculus
tcacgtagcctcaagcctgcagact

SEQ ID NO: 24903 - DNA, 25 bp, Mus musculus
acgtagcctcaagcctgcagacttg

SEQ ID NO: 24904 - DNA, 25 bp, Mus musculus
gtagcctcaagcctgcagacttggg

SEQ ID NO: 24905 - DNA, 25 bp, Mus musculus
tcaagcctgcagacttgggtcctct

SEQ ID NO: 24906 - DNA, 25 bp, Mus musculus
aagcctgcagacttgggtcctctga

SEQ ID NO: 24907 - DNA, 25 bp, Mus musculus
gcctgcagacttgggtcctctgaaa

SEQ ID NO: 24908 - DNA, 25 bp, Mus musculus
ctgcagacttgggtcctctgaaacc

SEQ ID NO: 24909 - DNA, 25 bp, Mus musculus
ttgggtcctctgaaaccggatggcg

SEQ ID NO: 24910 - DNA, 25 bp, Mus musculus
tggcgtttggcgaggactagtgtta

SEQ ID NO: 24911 - DNA, 25 bp, Mus musculus
ccctgccttgaggattaaagagtag

SEQ ID NO: 24912 - DNA, 25 bp, Mus musculus
tagaggtgcctggggacagctagcc

SEQ ID NO: 24913 - DNA, 25 bp, Mus musculus
gacagctagccactgactggtcacg

SEQ ID NO: 24914 - DNA, 25 bp, Mus musculus
cagctagccactgactggtcacgta

SEQ ID NO: 24915 - DNA, 25 bp, Mus musculus
tagccactgactggtcacgtagcct

SEQ ID NO: 24916 - DNA, 25 bp, Mus musculus
cactgactggtcacgtagcctcaag

SEQ ID NO: 24917 - DNA, 25 bp, Mus musculus
ctgactggtcacgtagcctcaagcc

SEQ ID NO: 24918 - DNA, 25 bp, Mus musculus
gactggtcacgtagcctcaagcctg

SEQ ID NO: 24919 - DNA, 25 bp, Mus musculus
gcatctacgtgggcaaccttccgtc

SEQ ID NO: 24920 - DNA, 25 bp, Mus musculus
gacttgttctacaagtacggccgca

SEQ ID NO: 24921 - DNA, 25 bp, Mus musculus
ccgttcgccttcgtgcgcttcgagg

SEQ ID NO: 24922 - DNA, 25 bp, Mus musculus
gccttcgtgcgcttcgaggacccgc

SEQ ID NO: 24923 - DNA, 25 bp, Mus musculus
tcgtgcgcttcgaggacccgcgaga

SEQ ID NO: 24924 - DNA, 25 bp, Mus musculus
cccgcgagatgctgaggatgcgatc

SEQ ID NO: 24925 - DNA, 25 bp, Mus musculus
tacgattatggccagtgtcgactcc

SEQ ID NO: 24926 - DNA, 25 bp, Mus musculus
cgattatggccagtgtcgactccgt

SEQ ID NO: 24927 - DNA, 25 bp, Mus musculus
attatggccagtgtcgactccgtgt

SEQ ID NO: 24928 - DNA, 25 bp, Mus musculus
tatggccagtgtcgactccgtgtgg

SEQ ID NO: 24929 - DNA, 25 bp, Mus musculus
gtcgactccgtgtggagttccccag

SEQ ID NO: 24930 - DNA, 25 bp, Mus musculus
gcctcctacaagacggtcagatttc

SEQ ID NO: 24931 - DNA, 25 bp, Mus musculus
cttgttctacaagtacggccgcatc

SEQ ID NO: 24932 - DNA, 25 bp, Mus musculus
ctcctacaagacggtcagatttccg

SEQ ID NO: 24933 - DNA, 25 bp, Mus musculus
tgttctacaagtacggccgcatccg

SEQ ID NO: 24934 - DNA, 25 bp, Mus musculus
ccgcatccgcgagatcgagctcaag

SEQ ID NO: 24935 - DNA, 25 bp, Mus musculus
gcatccgcgagatcgagctcaagaa

SEQ ID NO: 24936 - DNA, 25 bp, Mus musculus
tcgagctcaagaaccggcacgcctc

SEQ ID NO: 24937 - DNA, 25 bp, Mus musculus
gctcaagaaccggcacgcctcgtgc

SEQ ID NO: 24938 - DNA, 25 bp, Mus musculus
acgcctcgtgccgttcgccttcgtg

SEQ ID NO: 24939 - DNA, 25 bp, Mus musculus
gcctcgtgccgttcgccttcgtgcg

SEQ ID NO: 24940 - DNA, 25 bp, Mus musculus
accctcggagacaccgcttctcaga

SEQ ID NO: 24941 - DNA, 25 bp, Mus musculus
ggagacaccgcttctcagaggagga

SEQ ID NO: 24942 - DNA, 25 bp, Mus musculus
cccagcatgggacactgtgaggcac

SEQ ID NO: 24943 - DNA, 25 bp, Mus musculus
cagacttacacctgacttcctcctt

SEQ ID NO: 24944 - DNA, 25 bp, Mus musculus
cctccttgtcccatggccagtggtc

SEQ ID NO: 24945 - DNA, 25 bp, Mus musculus
atggccagtggtctggccagctagg

SEQ ID NO: 24946 - DNA, 25 bp, Mus musculus
agtggtctggccagctaggtgcccg

SEQ ID NO: 24947 - DNA, 25 bp, Mus musculus
ctggccagctaggtgcccgaagaac

SEQ ID NO: 24948 - DNA, 25 bp, Mus musculus
agctaggtgcccgaagaacgtcatg

SEQ ID NO: 24949 - DNA, 25 bp, Mus musculus
gtgtgtgctcttagcatgttgggga

SEQ ID NO: 24950 - DNA, 25 bp, Mus musculus
gctcttagcatgttggggaacccat

SEQ ID NO: 24951 - DNA, 25 bp, Mus musculus
tcaacacaatcctgaataaatcttg

SEQ ID NO: 24952 - DNA, 25 bp, Mus musculus
aactgaagcctcaaccaatcatgaa

SEQ ID NO: 24953 - DNA, 25 bp, Mus musculus
agcctcaaccaatcatgaagaaggc

SEQ ID NO: 24954 - DNA, 25 bp, Mus musculus
aagtccaggtgcctgaggaacagaa

SEQ ID NO: 24955 - DNA, 25 bp, Mus musculus
aggagctgtcccactaccgtgctgt

SEQ ID NO: 24956 - DNA, 25 bp, Mus musculus
actaccgtgctgtgctttcacgcta

SEQ ID NO: 24957 - DNA, 25 bp, Mus musculus
gtgctgtgctttcacgctaccaggc

SEQ ID NO: 24958 - DNA, 25 bp, Mus musculus
tgctttcacgctaccaggcccagca

SEQ ID NO: 24959 - DNA, 25 bp, Mus musculus
cacgctaccaggcccagcatgggac

SEQ ID NO: 24960 - DNA, 25 bp, Mus musculus
tcatcaagcgtccagacctcaagta

SEQ ID NO: 24961 - DNA, 25 bp, Mus musculus
cagacctcaagtaccagctgggttt

SEQ ID NO: 24962 - DNA, 25 bp, Mus musculus
ccatgcctgcagccatgtttaggct

SEQ ID NO: 24963 - DNA, 25 bp, Mus musculus
tgtttaggctcctcacgggccagga

SEQ ID NO: 24964 - DNA, 25 bp, Mus musculus
gccaggagaccccgctgtacatcta

SEQ ID NO: 24965 - DNA, 25 bp, Mus musculus
aggagaccccgctgtacatctaggt

SEQ ID NO: 24966 - DNA, 25 bp, Mus musculus
agaccccgctgtacatctaggtaca

SEQ ID NO: 24967 - DNA, 25 bp, Mus musculus
tgtacatctaggtacacccaacctc

SEQ ID NO: 24968 - DNA, 25 bp, Mus musculus
cctcaccgtggagccgggataccag

SEQ ID NO: 24969 - DNA, 25 bp, Mus musculus
gggataccaggcagacccacctggg

SEQ ID NO: 24970 - DNA, 25 bp, Mus musculus
cggacgagccagaagccaggacaaa

SEQ ID NO: 24971 - DNA, 25 bp, Mus musculus
ccaggacctctggctccctcaaagg

SEQ ID NO: 24972 - DNA, 25 bp, Mus musculus
acctcaagtaccagctgggtttcag

SEQ ID NO: 24973 - DNA, 25 bp, Mus musculus
tcaagtaccagctgggtttcagcgt

SEQ ID NO: 24974 - DNA, 25 bp, Mus musculus
tgggtttcagcgtcagatggatcat

SEQ ID NO: 24975 - DNA, 25 bp, Mus musculus
tcggccaccgtatcatcgagatcaa

SEQ ID NO: 24976 - DNA, 25 bp, Mus musculus
accgtatcatcgagatcaacggaca

SEQ ID NO: 24977 - DNA, 25 bp, Mus musculus
tggtagccacagcccatgagaagat

SEQ ID NO: 24978 - DNA, 25 bp, Mus musculus
tagtccaggctctgtctaactcggt

SEQ ID NO: 24979 - DNA, 25 bp, Mus musculus
acatgaagaccatgcctgcagccat

SEQ ID NO: 24980 - DNA, 25 bp, Mus musculus
tgaagacattgctcacaagcaaatt

SEQ ID NO: 24981 - DNA, 25 bp, Mus musculus
cattgctcacaagcaaatttcccca

SEQ ID NO: 24982 - DNA, 25 bp, Mus musculus
cagccggacactgtcgtcagggccc

SEQ ID NO: 24983 - DNA, 25 bp, Mus musculus
gccactgagcagctcagccactatg

SEQ ID NO: 24984 - DNA, 25 bp, Mus musculus
gagcagctcagccactatgccctca

SEQ ID NO: 24985 - DNA, 25 bp, Mus musculus
ctcagccactatgccctcaattcag

SEQ ID NO: 24986 - DNA, 25 bp, Mus musculus
cactatgccctcaattcagtgcaaa

SEQ ID NO: 24987 - DNA, 25 bp, Mus musculus
gtgcaaacacaggtcgcccaatggg

SEQ ID NO: 24988 - DNA, 25 bp, Mus musculus
acacaggtcgcccaatgggggactg

SEQ ID NO: 24989 - DNA, 25 bp, Mus musculus
cgtccttccagaggctctggacacc

SEQ ID NO: 24990 - DNA, 25 bp, Mus musculus
tccagaggctctggacacctctcat

SEQ ID NO: 24991 - DNA, 25 bp, Mus musculus
ggctctggacacctctcatggcacc

SEQ ID NO: 24992 - DNA, 25 bp, Mus musculus
tcacaagcaaatttccccagcgtcc

SEQ ID NO: 24993 - DNA, 25 bp, Mus musculus
agcgtccattgagctttctgcccta

SEQ ID NO: 24994 - DNA, 25 bp, Mus musculus
tccaagccaagctttggagcccacg

SEQ ID NO: 24995 - DNA, 25 bp, Mus musculus
tttggagcccacgagggagtaccag

SEQ ID NO: 24996 - DNA, 25 bp, Mus musculus
gtaccagaacacccagctctcagtc

SEQ ID NO: 24997 - DNA, 25 bp, Mus musculus
ctcagtcagcacctttctgccggag

(The sequence listing continues in the following parts.)

What is claimed is:

1. An array comprising a plurality of nucleic acid probes, wherein said plurality of nucleic acid probes comprises each of the sequences listed in SEQ ID NOS. 1–127,811, or the perfect match or antisense match thereof.

* * * * *